United States Patent 9,254,311 (MODIFIED POLYNUCLEOTIDES FOR THE PRODUCTION OF PROTEINS) - sequence listing, part 23

SEQ ID NO: 49005 - DNA, 4005 bp, Artificial Sequence
  Description of Artificial Sequence: Synthetic coding sequence
atgagcgaggccatggaccagcccgccggcggccccggcaaccccagacctggtgaaggcgacgacggcagcatggagcccgggacctgccaggagctgctccataggcttagagaactggaggctgaaaattcagccctggctcaagccaacgaaaaccagcgggagacatacgagcggtgtctcgacgaggtagccaatcatgtcgtgcaggctctcttgaaccaaaaggatcttcgggaagagtgcatcaagttaaagaagagggtctttgacttggagcggcaaaatcagatgctctccgccctgttccagcagaagcttcagctgaccacggggtcactaccacagatccccctgactccactgcagcccccctctgaacctccagcatccccgagtctttcatccaccgagggtcctgctgcacccctccccctggggcattgcgctggccagagggaggtctgttgggaacagcagctgcgacccggaggccctggccccccagcagcaccccctcctgccctcgacgcgctctcaccgttcctccggaagaaagcccagatactcgaggtgctgcgcgccttggaggaaaccgatcccctcctgctctgctctcccgccactccatggcggccgccgggccaaggcccaggaagtcccgagcccattaacggagagctgtgtggccccccacagcctgaaccctctccctgggccccttgcctgctattgggtcccgggaatctcggcgggctgctccactgggagcgcctgctcggaggtctgggaggcgaggaggatacaggacgcccttgggggccatctcgcgggccacctcaagcccaggggacttcctccgggcccaattgcgctcctggctcgagtagcagttcatcgagcgacgaagcaggcgatccaaacgaagcaccatcccctgacacactgctaggggccctggcaagacgtcagcttaacctcggacagttgctggaggacacagagtcttacctgcaagcctttttagctggtgcagccgggcccctcaacggcgatcacccaggccctggccaaagcagctcaccggatcaggccccccctcaactgtcaaaaagtaagggactgcccaagtcagcctggggtggaggtactcctgaagcgcataggcctgggttcggggccactagtgaaggtcagggtcccctcccttttctgagcatgtttatgggagccggggacgcacccctcggcagtaggcccggacatcctcattcatcttcccaggtaaagtcaaagcttcagataggccccccctcacccggcgaggcacagggccccctgttgccatctcccgcgcggggcctgaaattccttaaactcccacccacatcagaaaaaagtcccagtcctgggggtcctcagctcagcccccagctgccccgcaactctagaattccttgcagaaacagcggctccgacggatcgccatcacctctgctcgccaggcgggggctcggaggaggagagctcagtcccgagggtgctcaagggttgcctacaagtccttccccttgttatactacacccgatagtacccaactgagacccccccagagcgctctgtccaccactctctcgccgggccctgtggtgtctccctgttatgaaaacatcctcgatctgtcacgcagcacctttcggggccctagcccagagcctcccccatctcctcttcaggtgccgacgtatcctcaactcacacttgaagtgcctcaggcccctgaagtgctgcgctcacctggtgtcccccccagcccatgtctgccagagtcatacccatacggctcaccacaggagaaaagcctcgataaagccggttccgagtctccacaccccgggcgaagaactcctggcaactcaagcaagaagccctcgcagggatctggcagacgccccggagacccgggttcaaccccactcagagatcgtctggccgcactaggtaaacttaaaacaggccccgaaggcgcccttggttccgagaagaacggggtccccgctcggccgggaacagaaaaaaccaggggaccaggcaaaagcggcgagagcgctggtgatatggttccatctatccatagaccacttgaacagctggaggctaaaggaggaatccgcggcgccgttgcacttggcactaattcgctgaaacaacaggagcctgggctgatgggagaccctggcgcaagagtatacagtagtcactcaatgggggcccgggtcgatctcgaacctgtctccccacgcagctgcttgacaaaggtggaactcgccaaaagccgcttggcaggggcgttatgcccacaagtgcccaggactcccgccaaagttccaacctccgccccatccctggggaagcctaataagagccctcattcatctcccacaaagctgccaagcaaaagcccgacaaaggtagtgccccggccgggagccccactagtgacaaaggagtcaccaaaaccagataagggaaaagggcccccgtgggccgactgtgggtccacaaccgcacagtccaccccgttggtgcccggtcccaccgatcccagccagggacctgaggggctcgcgccacattccgcgatcgaggagaaggttatgaaggggattgaggagaatgtcctcaggctgcagggacaagaaagggcacctggggccgaggtcaaacaccgtaatacttcgtcaatcgcatcttggttcggccttaaaaagtctaaactccccgccctgaatcgccggaccgaggcgacgaaaaataaggagggagcgggcggtggaagccccctgaggcgggaagtcaaaatggaggctagaaaactggaggcagaatccctgaatattagcaaactcatggcaaaggccgaggatctacggagagccctggaagaggagaaggcctaccttagttccagggcgcgcccaagacccggggggccagccccggggcccaatacaggcctgggccaggttcaggggcaactggccggcatgtatcagggcgccgacacttttatgcaacagctgctcaaccgagtggatggcaaagagttaccaagcaagtcgtggcgggagcccaagcccgaatacggggatttccagcccgtatccagtgatcctaaaagcccgtggcccgcgtgtggccctcggaatggccttgtgggtccacttcagggttgtgggaagcctcctggaaagccaagcagcgagccgggacgccgcgaagagatgcctagcgaggatagcctggctgagcccgtgccaaccagccacttcacagcatgcgggtcactgacccgcaccctagattctggaataggaacctttcctccgccggaccatggctcttccggaactccaagcaagaaccttcccaagactaaacccccaagactggatccacctcctggcgtgcctcccgccaggcctccaccgctgacaaaagtgccgcgccgggcgcacacattggagcgcgaggttcccgggatcgaggagcttctggtgtcaggaaggcaccctagcatgccagccttcccagccttgctgcctgctgcacctggccataggggccacgaaacctgtccggatgacccatgtgaagatcccgggcccactccacctgtccagctggcaaaaaattggaccttccctaacaccagagccgctgggtccagctcagatcccctgatgtgcccaccacggcagctcgaaggactgccccgcaccccgatggctcttcctgtcgatagaaagcgcagtcaggagccctcccgcccaagccccacaccacagggaccaccctttggcggtagtaggactccctctactagcgatatggcagaggaggggcgggtcgcgagtggcggcccacctggcctggagactagcgagagtctatccgatagtctgtacgacagtctctcatcatgcggatcacaaggatag

SEQ ID NO: 49006 - DNA, 3927 bp, Artificial Sequence
  Description of Artificial Sequence: Synthetic coding sequence
atggaccagcccgccggcggccccggcaacccccggcccggcgagggcgacgacgggagcatggagccaggcacctgccaggaactgctccatcggctgcgcgagttggaggccgaaaactcagccctcgcccaggcaaatgagaatcaaagagaaacctatgagcgttgccttgatgaagtggctaaccacgtggtccaagcattgctgaatcaaaaagacctcagagaggaatgtatcaagctgaaaaagagggttttcgatctggagcggcagaaccagatgttgagcgcactcttccaacagaagctccagttgacgacaggaagccttccacagattccactgactcctctgcaacctccatccgaacctcccgcctcacctagcttgtccagcacagaagggcccgcagctccactacctctgggccactgcgccggccagcgcgaggtgtgttgggaacagcagttgagacccggtgggcctggccctcctgccgctccaccgcctgccctggatgccctatctccctttctccggaagaaagcgcagatattggaagtgctcagagcactggaagaaacagaccccctgctgttatgcagtccggctacgccatggagacctcctgggcagggacccggcagcccagagcccataaacggcgagctgtgcggccccccccagcctgaaccatccccttgggctccctgtttactccttggcccaggcaatttgggagggctgctgcattgggagcgactactcggagggctgggaggcgaagaagacactggcaggccatggggcccaagcaggggccccccccaggcacaaggcacctcttcagggcctaattgcgccccaggctcgagctcatccagcagctctgatgaggccggagacccaaacgaggcaccgtctcccgatacactactcggcgctctcgctaggcgccaattgaatctgggtcagctgcttgaggacacggagtcttacctgcaggccttcctggccggagcagcgggtccactgaatggagaccatcctggccctggccagtcaagttcaccagaccaggctcccccccaattatctaagtccaaaggcctgccgaagtccgcttggggcggcggtacacccgaggctcatagacccgggttcggggccacctccgaaggtcagggccctctgcccttcctgagcatgtttatgggagctggagacgctccactcggatcccgaccaggccatccccatagctcatcacaggtgaagtccaagttacagatcgggcctccctccccaggcgaagcccagggaccactgctaccgtctcctgccagaggtctaaagtttcttaaactcccccctacatctgagaagtccccatctcccggcggtccacagctgtctcctcagctgcccagaaattcaagaatcccttgcaggaattccggctccgacgggagcccctcccccctcctcgctcgccgcgggttgggcggaggagagctgtcccccgagggagctcagggactgcccacttccccttcaccttgttataccacacccgattccacgcagctcaggcctccacaatcggccctatctaccaccctctcacctgggcccgttgtgagtccttgctacgaaaacatcctggatctctcaaggtccacattccgcgggcccagcccagagccccccccttccccactgcaggttccgacatacccgcaactgactctggaggtgccacaggcacccgaagtcctccggtctcctggggtcccgccgtctccatgtctacccgaatcctacccctatggatccccgcaagagaagtcactggacaaggccgggagcgaatctccacatcctggcagacgtacacccgggaattcaagcaaaaagccaagccagggcagcggtcgtagacccggggacccgggtagcacacctctccgtgatcgactggccgcactaggcaaattaaaaacgggccccgaaggggctctgggatcagagaaaaacggagtgcctgctaggccagggactgaaaaaactcgtggcccaggcaaatccggcgaaagcgctggggacatggttcccagtatccatcgacctctggaacaattggaagccaaggggggcattcggggggccgtggcgctgggcactaattcacttaaacaacaagaacctgggctgatgggtgacccgggagcacgggtatattcttcacattcaatgggggctcgtgttgacctggagcccgtgtctcctaggagctgcctgactaaagtcccgacctccgcacccagtcttggaaagccaaataaatccccccactcttcacctacaaaattgccctccaaatcaccgacgaaggtagtccctagacctggagcccccctcgtaacgaaagaaagccctaagccagataagggcaaggggccaccatgggcagattgcggctctaccacagcccagagcacccccctcgtaccgggaccaactgatccatcacaagggccggagggactggccccccatagcgcaatcgaggaaaaggtgatgaagggcatcgaagagaatgtgctcagactgcaaggccaggaaagggctcccggcgctgaggtcaagcaccggaataccagttccattgctagctggttcggcttgaagaaatcaaagcttcctgctctcaaccgacgcaccgaggccacaaaaaacaaggagggagccgggggcggtagcccactcaggagagaagtgaagatggaggccagaaagctggaggcagaaagcttgaacatcagcaagcttatggccaaggccgaagatctgagacgcgctttggaggaggagaaagcatatctcagcagccgggcccgcccacgaccaggaggaccagcgcccgggccgaacacaggtctcgggcaggtccaagggcagctggctggcatgtaccagggcgcagacacttttatgcagcaactgctgaaccgcgtggatggcaaagaactcccctctaagtcgtggcgagagccaaaacccgaatacggcgattttcaacctgtttcgagcgatcccaagtcaccatggcctgcttgtggccctagaaacggtctggtagggcccctgcaggggtgcgggaaacccccaggtaagccctctagcgaacccggacgacgtgaggaaatgccatcagaggactccctcgcggagccggtcccgacatctcactttacagcatgtggaagcctgactcgaaccctggactcaggtattggaacttttccacccccggaccacgggtcttccgggacaccttccaagaacctccctaaaacaaagccaccaagattggacccaccgcccggggttccccccgctagaccaccccccctgaccaaagtccccaggcgggcccacactctggagcgggaggtgcccggtattgaagagttactagtgtccggtagacatccaagcatgccggcttttcctgccctgcttcccgccgcccctgggcatagggggcatgagacctgtcctgatgacccttgtgaagacccaggccccaccccgcccgtgcagttggcaaagaattggacgtttccgaacacacgagccgcgggctccagtagcgacccactgatgtgccctcccagacaacttgaggggctccctcggactccaatggctcttccagtggatcgcaagcgtagccaagaaccttcccggccaagcccaaccccccaagggcctccatttggggggtcacgcaccccgtccacatccgatatggccgaggaaggtagagtggcctcaggcgggcctccggggctggagactagcgagagcctaagcgattcactgtatgattccctatcgtcatgcggcagtcaaggctag

SEQ ID NO: 49007 - DNA, 1116 bp, Artificial Sequence
  Description of Artificial Sequence: Synthetic coding sequence
atggccggcctgcaggagctgcggttccccgaggagaagcccctgctgaggggccaggatgctacagagctcgagagcagcgatgcgtttttgctcgctgcggataccgactggaaagagcatgacattgaaactccatatggcctgctgcacgttgttatccgaggctctccgaagggcaaccgccccgccatactaacataccatgacgtaggcctcaatcataagctctgttttaataccttcttcaatttcgaagacatgcaggaaatcactaagcactttgtggtttgccacgtagacgcacccggtcagcaggtcggtgcatcgcagttcccacaaggatatcaatttccctcaatggaacagttggccgccatgttgccttctgtggtacagcatttcggattcaagtatgtcataggaatcggagtgggcgctggggcctacgttctggcaaaatttgcccttatcttccctgacttggttgaaggtctcgtcttggttaacattgatccaaacggcaagggttggatcgattgggcggcgacgaaactgtcgggcttgacatccaccttgccagacaccgttttatcacacctcttcagtcaggaggaactggtcaacaacacagaattggtgcagtcctatcgccagcaaattggcaacgtggtgaaccaggccaacctccagctgttctggaacatgtacaactcccggcgggatcttgatatcaataggccaggtacggtgcctaacgcaaagaccctacgctgccctgtaatgctggtggtgggcgataacgcaccggctgaggatggggttgtggaatgtaatagtaaactggatcccactacaaccaccttcctgaagatggccgacagtggaggactgcctcaggtcacgcagcccggcaaactgacagaagcattcaaatatttcctgcagggtatgggctacatgccatcagccagcatgacgagactcgcacggtcgcggacggcttccttaacatcggcctcgtccgtagacggctcacggccccaggcttgcacccacagcgaaagctctgaaggacttggccaggtgaaccacaccatggaagtttcctgttag

SEQ ID NO: 49008 - DNA, 1110 bp, Artificial Sequence
  Description of Artificial Sequence: Synthetic coding sequence
atgcccgagtgctgggacggcgtgggcgagggcaacgccggcgccgttaaactggcaggtctcggcgatcctcgctggagtccaggacacctgctgtcccctggccatcaggagcatgacattgagacgccatatggtctgcttcatgtggtcatccggggaagccctaagggtaaccgccctgctattctgacatatcacgacgtgggtttgaatcacaagctgtgttttaatacttttttcaattttgaggacatgcaggagatcacaaagcactttgtggtctgccacgtggacgccccgggtcagcaggtcggggccagccaatttcctcagggctatcagtttcctagtatggaacagttagctgcaatgctgccttctgtggttcagcactttggctttaaatacgtcatagggatcggggttggtgcaggtgcttacgttcttgctaagtttgcacttatttttcctgacctagtggagggtctggtcctagtcaatatagaccctaatggaaaaggatggatagactgggctgcaactaaacttagtggcctgacctcaactttacccgatacagttctttcacatttattttctcaggaggagttggttaacaatactgaactcgtccagagttacagacagcagattggaaatgttgtgaaccaggcaaacctccagctcttctggaatatgtataattctaggcgcgatcttgacatcaaccgccccggaaccgtacctaacgccaaaactctgcggtgtcccgtaatgcttgtcgttggtgacaacgcacctgcggaggatggcgtcgtggagtgcaattccaagttggatcccaccacaacgacattcctgaagatggccgacagcggaggattgcctcaggtgactcaacctggaaagctgacagaggccttcaagtactttcttcagggaatgggatacatgccttcagcctcaatgacccggctggcgagaagccgtactgcttccctgacttctgcatcctctgttgacggttcaaggccccaggcctgtacacactccgaatcctcagaggggcttggacaagtcaaccatacaatggaagtcagctgttag

SEQ ID NO: 49009 - DNA, 1116 bp, Artificial Sequence
  Description of Artificial Sequence: Synthetic coding sequence
atggccggcctgcaggagctgcggttccccgaggagaagcccctgcttagagggcaagacgctacagagctggagtcgtccgatgcctttctcctcgccgctgatacagactggaaggagcacgatattgaaactccatatggactccttcacgtggttataaggggtagtcctaaaggaaatagacccgcaattctgacctaccatgacgttgggctgaaccataaactatgctttaacacttttttcaactttgaggatatgcaggagatcaccaaacactttgtcgtttgccatgttgatgcccctgggcagcaggttggcgccagtcagtttccgcagggctaccaatttccgtcaatggagcagctggctgcaatgttaccaagcgtcgttcaacactttggattcaagtatgtgattggcatcggtgtaggggccggggcgtacgttttagctaaattcgcactcattttccctgaccttgtagagggcctcgtgctcgttaacattgaccctaatgggaagggctggatcgactgggcggccacgaaactcagcgggttgacctctaccctgcccgacaccgtgctcagccacctctttagtcaggaggagctagttaacaacactgaactagttcagtcataccggcaacagatcgggaacgttgtgaaccaagccaaccttcagctgttttggaatatgtacaatagcagacgggacctggacattaaccgtcctgggactgttcccaacgctaaaacgctgcggtgtcccgttatgttagtcgttggtgacaatgccccagctgaggacggggttgttgagtgcaactccaagctcgatccaacaaccaccacatttctcaagatggcagactcgggtgggttgccgcaggtgacccagccaggcaagctaactgaggctttcaagtatttcctccagggcatgggatacatgccttctgccagtatgaccaggctggccagaagtagaactgccagtttgacaagcgccagttccgtggacggatccagaccgcaggcttgtacccattcagagagctctgagggactgggacaggtgaaccacaccatggaagtctcctgttag

SEQ ID NO: 49010 - DNA, 1176 bp, Artificial Sequence
  Description of Artificial Sequence: Synthetic coding sequence
atgaaggtgctgggccaccggctggagctgctgaccggcctgctgctgcatgatgtcaccatggccggtttacaagaactcaggtttccagaggaaaagccactgttaagaggccaggatgcaacggaactggagtcatccgacgcatttctgctcgccgccgataccgattggaaagaacacgacattgaaacgccatacggcttgcttcacgtggtgatcagagggtctccgaagggcaaccgccccgccatccttacctatcacgacgtcgggctgaatcacaagctgtgcttcaatactttctttaacttcgaggacatgcaggagataaccaagcacttcgtcgtctgtcacgtggatgcaccgggccaacaagtgggggcgagccagttcccccaggggtatcagttcccaagcatggaacagctggcagccatgcttccttccgtggtgcagcacttcggctttaaatatgtgatcggcatcggagttggggccggggcctatgtcctcgcaaagttcgccttaatcttccccgacctcgttgaaggcttagtcctggtgaatatagatccgaatggcaagggatggatagattgggctgcgacaaaactgtcaggccttacatcaacactcccagacaccgttctgagccatctgttcagccaggaagagctggtcaacaatactgagttggtccagagctatcgccagcaaatcggtaatgtagtgaatcaggcaaatctgcagctgttctggaatatgtataactcacgcagggacctcgacatcaataggccaggcacagttcccaacgccaagaccctgaggtgtccagtgatgctggtcgtcggggataatgcgcctgccgaagatggagtggtggagtgcaactcaaagctggatcccacaacaaccacttttttgaaaatggcagacagtggtggacttccgcaagtgacacagcccggcaagctcaccgaagcttttaagtatttccttcagggaatgggctacatgccctccgccagcatgacccgcttagcgcgaagtcggactgcctctctaacgtccgcaagttccgtggatggctcccgaccccaggcctgcacgcatagcgagagcagcgaggggctggggcaggtcaatcacaccatggaagtcagttgttag

SEQ ID NO: 49011 - DNA, 894 bp, Artificial Sequence
  Description of Artificial Sequence: Synthetic coding sequence
atgcaggagatcaccaagcacttcgtggtgtgccacgtggacgcccctgggcagcaggtgggagccagtcagttccctcagggttatcagtttcccagtatggagcaactggcggccatgctgccaagcgtcgtccagcactttggcttcaagtacgtgattggcattggcgtgggagccggagcatacgtactcgcgaagtttgctcttattttccccgacttagtggagggtcttgtgctggtcaatatagaccccaatggaaaaggttggatcgattgggccgcaaccaaattgtcaggtctgacctctacccttccagataccgtgttgtctcatctgttctcacaggaggagctggttaacaacacagagctcgtccagagctatcgccaacagatcggtaacgtcgtaaaccaagccaatctacagctcttctggaacatgtacaacagccgcagagatttggatattaacagacctggaactgtgcccaatgcaaagactttaaggtgccccgtgatgctggttgtgggagacaacgccccggccgaggacggcgttgtggagtgcaatagcaaattggaccctacgacgactacattcctgaaaatggccgactccggtgggctcccccaagtgactcagccaggcaaacttaccgaagcattcaagtacttcctccagggcatggggtacattgcctacctcaaggacagacgactcagtggtggcgccgtgcccagtgccagtatgactcgcctcgctaggtctcgtacggcatcactgacatcggcttcgtctgtcgacgggtcccgcccccaggcctgtactcattcggaatcatctgaggggctgggccaagtgaaccacaccatggaagtcagttgctag

SEQ ID NO: 49012 - DNA, 1020 bp, Artificial Sequence
  Description of Artificial Sequence: Synthetic coding sequence
atgcccgagtgctgggacggcgagcacgacatcgagaccccctacggattgctgcacgttgtgatccgcggttcacctaagggcaacaggccagccattttaacatatcacgatgtgggactcaatcacaaactgtgctttaatacgttctttaatttcgaggatatgcaggaaataacaaagcatttcgttgtgtgtcatgtagacgctcccggccagcaggtcggagcctcacagtttccccaggggtatcagtttccttctatggagcaactcgctgcgatgctcccttcagttgtgcagcatttcggattcaaatacgtgataggtatcggggtaggggcaggggcatacgtgctggcaaagtttgccctgatatttcccgatctagtggaggggttggttctggtgaacatcgacccaaacggcaagggctggattgactgggcggctacgaagctgtccggactgacttctactcttccagatactgtcctgagccacctgttttctcaagaggaactggttaacaacacggagctggtgcagtcatatcgacagcagattggcaatgtggtaaaccaagccaatctacagttgttttggaatatgtataactcaaggagagacctggacatcaatcgacctggaaccgtgccaaatgccaaaacgctccgttgccctgttatgctggtggtaggtgacaatgcaccggcggaagatggagtggtggaatgtaactctaaactggaccctactactaccacctttttgaaaatggccgattcaggaggccttcctcaggtgactcagccaggcaagcttacagaggccttcaaatatttccttcaggggatgggatatatgccaagcgctagcatgacccgcctggctcgcagccgcactgcatctttgacttctgcctcaagcgtagatggcagtcggccgcaagcctgcactcactcagagagctctgagggcctcgggcaggtcaatcatacaatggaagtgagttgttag

SEQ ID NO: 49013 - DNA, 1059 bp, Artificial Sequence
  Description of Artificial Sequence: Synthetic coding sequence
atgcccgagtgctgggacggcgagcacgacatcgagaccccctacgggctgctccacgtggtaattcggggcagtcccaaggggaatcgcccggctattttgacctaccacgacgtgggcctgaatcataaattgtgctttaacaccttctttaattttgaggacatgcaggagattactaaacactttgtggtttgtcacgttgacgcgccaggccagcaggtgggcgcttcacagttcccacagggctaccaatttccctccatggagcaactggccgctatgctgccaagtgttgtgcagcactttggcttcaagtacgtcataggtatcggcgttggggcaggcgcatatgtgcttgcgaagttcgctctgatctttcctgatctggtcgagggactcgttctggtcaacatagatccaaacggcaaaggctggattgactgggcggccacaaagttgtctggcctaacttcaaccctgcctgataccgtgctatcccacctcttcagccaggaggaactcgtgaacaacaccgaactggtccagagctaccgtcagcagatcgggaatgtggtgaaccaggctaatttgcagctgttctggaatatgtataatagtcggcgggacttggacattaatcgcccagggaccgtccccaacgccaagactctgcgatgccccgtcatgcttgtggtcggtgataatgctcccgccgaggacggggttgtcgagtgtaattccaagctggatccaacaacaaccaccttccttaagatggccgattcagggggcttgccacaggtaacacagcctggaaagcttactgaggccttcaagtacttcctgcagggcatgggctatattgcatatctgaaggatcgccgactctccggcggggctgttccctcagcctccatgacacggctcgcccgaagccgtaccgcttctctgacctcagccagttctgttgacggctctaggccccaggcctgcactcattccgagagttccgagggcctgggccaagtcaatcatacaatggaggtgtcttgttag

SEQ ID NO: 49014 - DNA, 345 bp, Artificial Sequence
  Description of Artificial Sequence: Synthetic coding sequence
atgatcgcccggcggaaccccgagcccctgcggttcctgcccgacgaggctcgatcgctacccccaccgaagctgaccgatcctcgcttgctgtacataggcttcttaggctactgctcaggcctcatcgataatctgatacgccgccgccccattgcaacggccggcctgcacagacaactgctctacatcactgccttcttcttcgctggctactacctggtgaaaagagaagactacctctacgccgtccgcgatcgtgagatgttcggttatatgaaactacaccccgaggacttccctgaagaagatgtgtattgctgcggcgcagagcggagagggtag

SEQ ID NO: 49015 - DNA, 732 bp, Artificial Sequence
  Description of Artificial Sequence: Synthetic coding sequence
atggaggacagcttcctgcagagcttcggccggctgagcctgcagccccagcaacaacaacagcgtcagcgacccccccgtcccccgccacgcgggacaccgccgaggcgtcattcgttcagaaagcacctgtacctgcttcgcggtctgcccggcagcggtaagacaacactggcaaggcagcttcagcacgatttcccgagagcactgatcttcagcactgacgacttcttcttcagggaggatggcgcctatgagtttaaccccgattttttagaagaagcacacgaatggaatcagaagagagcccgaaaagcaatgcggaacgggattagccctatcatcatcgacaacactaacctccatgcctgggaaatgaagccttatgctgttatggcactggagaataactacgaagtgatctttagagaacccgacacgcgttggaagtttaatgttcaggagctggctcgaagaaacattcatggcgtcagtcgcgagaaaatccatagaatgaaagagcgctatgaacacgacgtgacattccatagcgtcctgcacgcggaaaagcctagccggatgaataggaaccaggaccggaacaatgcattgccgtcgaacaatgccagatactggaactcatatactgagtttccaaaccggagagcccatggcggattcacaaatgaaagtagctaccatcgacgtggcggttgtcaccacgggtactag

SEQ ID NO: 49016 - DNA, 414 bp, Artificial Sequence
  Description of Artificial Sequence: Synthetic coding sequence
atgcggaacggcatcagccccatcatcatcgacaacaccaacctgcacgcatgggagatgaagccctacgcagttatggcactggagaataactatgaagtgatttttcgcgaacctgacacgaggtggaagtttaacgtgcaggagctggcccgacgaaacatacatggtgtgtctagagagaagatccaccggatgaaagagcgctacgagcacgacgtcacgttccacagtgttctccacgccgagaagccgagcagaatgaatcgcaaccaggaccgcaataacgccctcccatcaaacaacgccagatattggaactcctatacagagtttccaaataggagggcgcatggcgggtttaccaatgagtcttcctaccatagacgggggggttgccatcacggctattag

SEQ ID NO: 49017 - DNA, 522 bp, Artificial Sequence
  Description of Artificial Sequence: Synthetic coding sequence
atggaggacagcttcctgcagagcttcggccggctgagcctgcagccacaacagcaacagcaacggcagcggcccccgagaccaccaccccgcgggaccccgccccgtagacactcctttaggaaacacctgtacctgctcaggggcctgccgggcagtggcaagaccacgctggcaagacagctgcaacacgattttccaagagcacttattttctcgaccgacgatttcttttttagggaggatggcgcttatgagttcaacccagattttcttgaggaggcccatgagtggaatcaaaaacgagcccggaaagcgatgcgtaacggcatctctccgatcattattgataataccaatctgcatgcctgggaaatgaagccttacgcagtcatggtgttccagaccgagcagaagaatctcttcagactcgaaatggatatggtagtcttccggcctgagatgaagaagcatagctggtgcctaaaacgtaagaatccgccaaatgagcgaactgtttag

SEQ ID NO: 49018 - DNA, 1752 bp, Artificial Sequence
  Description of Artificial Sequence: Synthetic coding sequence
atgagctacggcgagatcgagggcaagttcctgggcccccgggaggaagtgacatcagagcctcgctgtaaaaagctgaaaagcactacagagagttacgtgttccacaaccattctaacgccgattttcataggatacaggaaaagactggtaacgattgggtgccagtgaccataatcgacgtacgtgggcatagctatctgcaggagaataagattaagacgacagatctccaccgccccctccacgatgaaatgcctgggaacaggcctgacgtgatagagagcatcgattcccaggtcctgcaggaggcccggcccccgctcgtctcagctgacgacgagatctattccacaagtaaagcctttattggcccaatatacaagccacctgagaagaaaaaacgtaatgaagggcgcaatgaggctcatgtactgaatggcatcaatgatcggggggggcagaaagagaaacaaaagttcaacagcgagaagagcgaaatcgataatgagctgttccaattttataaggaaatcgaagagctggaaaaggagaaggacggctttgagaatagctgtaaagagtcagaaccctctcaggagcagtttgttccattctatgagggtcacaacaatggccttctgaaacccgatgaagagaaaaaagacctatccaacaaagcaatgccatctcattgcgactatcagcaaaatctaggcaatgagccagataaatacccttgtaacggtcaggtcatcccgacattttgcgatacttcatttacctcctttcgacctgaatggcagtccgtgtacccctttatcgtaccatatgggccaccacttccaagtctgaactatcaccttaatatccaacgcttcagtggacctcctaatcctccaagtaatatcttccaggcccaggatgactcacagatccaaaatggctactatgtgaataactgccatgtaaactggaactgcatgaccttcgaccagaataatgagtataccgattgcagcgagaacagatctagcgtacatcctagtggaaacggctgcagcatgcaggatcggtacgtgtcaaacgggttctgcgaagtcagggaacggtgctggaaggaccattgtatggacaagcataatgggactgatcgcttcgttaatcaacagttccaggaggagaagctgaacaaactccagaagcttctgattctattgcgcggcctgccaggatctggcaagactacactgtcaagaatcttattgggacagaatcgggacggcatcgtcttctcaactgacgactacttccatcaccaggacggctacaggtacaatgtgaaccaactcggtgatgcccacgactggaatcagaacagggctaaacaagcaatcgatcaagggaggagccctgtgatcatcgataatacaaatattcaggcttgggagatgaagccgtatgtcgaggttgccatcggaaaggggtatcgtgtggaatttcacgagcccgagacttggtggaagtttgacccagaagagttagagaaacggaataaacatggcgtcagtagaaagaagattgcccagatgctggacagatatgagtatcagatgtctatttcgatcgtgatgaatagtgtggaacccagccacaaaagcactcaaaggcctccccccccccagggacggcagcgttggggagggagtttaggaagtcacaacagagtctgcgttacgaacaaccactag

SEQ ID NO: 49019 - DNA, 2214 bp, Artificial Sequence
  Description of Artificial Sequence: Synthetic coding sequence
atggccctgtgcagcgccctgatgaccatcttcaccatcaagatgggcacagccaagcaggcaatcgatcagggccgaagccccgttataatcgataatactaacattcaagcctgggagatgaagccatatgtggaggtcgcgattggaaagggatatagagtcgagtttcacgagcccgagacatggtggaaatttgacccggaagagcttgaaaagagaaacaagcatggcgtaagtagaaagaagatagcgcagatgctggatcgctatgagtaccagatgagtattagcatcgtgatgaacagcgtcgagccgtctcataagtccacccagcgccctccaccccctcagggtagacagcgggaaagagtgctgaagaagaccggtcaccgactgtccaagacaaaacagaaacggaatcgcaagcgtaataaaaaacaaaactcccagaatcggattatggaggagaactcgctggagttcttatccgatctgacccccggagaccaggatccctcccagtccgaggaggaggacatcgaaaagacacgtagggagagcgaatatccatttattgatggcctgcagaacgaagtgggcgactttgtcacaggctacaaggagaagcgctggaagaacaaagaccccaaggatagcttccagaatgtgatgtcaatagttgaattagacaatacacccaagaactatctgtcaaaggagggcgacaacctgtttgtcagtctgctgctccggcccaacgaaatctctgtgacttgtccaattctcacgcagaacctgagttgtgtcacgaccgacgactgttccgggatgaaggtggagaagcacatccgtaacagacacactattgcgctggacacacaggacctgtcagcagagacaagctgtcttttcatgaagaagcgtgagatcgtggacaaaaatctctctcacgagcctatcctgtgtcaccaacacggaatacggatgagtgacaaggttctgagggaggaacaggtctataccacaaagatcaaccattgggcatttttcaccacgaatttgtctgacgaggacctgcaactaggctctgacagacaaccttatttcggctcctggccagccggtccgcataagtttatttgcgagcaacgtccaaaaaaggatagggcgtgtaagttggcgggcccagacagtagagggcagtggatccagatgatctttaccagtgtagctgccagtgagcctggtaacaacccggagatcctcacagacaagttactcataggcaatgaggatttctcaccgccacctgagaccatggactcgttcatcgagaccaatctgtttaggtcttgcctgcctcagcccgatattcccaagaatgcactggagagtaccaagaacaagaaacggcgcaagaaaagaatctttaacctggtccctaatttcgacctgcttgggcagtcgcgcatcggagtgaaagagcgggaaaaatgcgaccttctgactaagaaccacggactgaaaatcaccctcggagaagaaaaagatcgaatctctgagagaaactctgaggaggagaataaacaaaaacttatgactttcgaccatcatcccctgtggttctatttagacatcatcaaggctacccccctcaacatcgacggccagcgctactctcattgcctctcgttcaataggctccgttgtagcgctagtttgtacaaaaattacataccatcctttgtgctgcataacctcagcagcatatggaagcccagttttactaataaaaaattattcttgacgtttgaaagtcagactagagtcggtaataagctcaatgatgccggattcatttcccctgaaatcttgcatagccacccagatacatcttgctcattgggcgtaacatcggattttcatttcctgaacgaacgatttgatcgaaagttgaaaagatgggaagaaccgaaggagctcccggcagaagactcccaggacctgacaagtactgattaccgttcgttggagctaccactgtcccagggatttgcattccagttggtgaagctgttcggttcccctggagtgcccatggagtccctgctgcccgatgactacgttgtgccattagactggaaaactctgaaaatgatctatctccagtggaagatgtctgtggaaaaacgccagaagaaaatcgggtag

SEQ ID NO: 49020 - DNA, 2259 bp, Artificial Sequence
  Description of Artificial Sequence: Synthetic coding sequence
atgagctacggcgagatcgaggagttctgcctggtgcggatcgtgatggcgctttgttccgcgctgatgaccatctttactatcaaaatgggcacagctaagcaggcaattgatcagggtagaagccctgtgatcattgacaacacaaacatccaggcgtgggagatgaaaccgtatgtcgaggtggcaatcggtaaaggataccgcgtggaattccacgaacccgagacgtggtggaagtttgacccagaagagctcgagaaaaggaacaaacacggcgtttctcgaaaaaaaatcgcccagatgttggataggtatgagtatcaaatgagtatttcaatcgtaatgaatagtgtggagccatcacacaagagcacccagcggccaccgccccctcagggaaggcagagggagagggtgctaaagaaaaccggccataggttgagcaagaccaaacaaaaaaggaatagaaagagaaataagaagcagaacagccagaatcgcattatggaggagaattccctggaattccttagcgacttgacccccggcgatcaggacccctctcagagcgaagaagaagatattgaaaaaacacgcagagagagcgaatacccattcatagacgggctccagaatgaagtgggggacttcgtgaccggctacaaggaaaaacggtggaagaataaagaccctaaagactccttccagaacgtgatgtctatcgtcgagctggacaacaccccaaaaaattacctttccaaagagggagataatctctttgtgtccctactgctgcggcctaacgagataagcgtcacttgtcccattctaacacagaatctgtcatgtgttactactgatgattgctccggcatgaaggtggaaaagcacattcgtaacaggcacacaattgctctggacacccaggacctgagtgctgaaactagttgtttatttatgaagaagcgggagattgtcgataagaatctaagtcatgagccgatcctgtgccaccagcacggcattcgcatgagcgataaagtcctcagggaggagcaggtttacaccaccaagatcaatcactgggcctttttcaccacaaatcttagcgacgaagacttacaactgggctccgatagacagccttactttggctcatggcctgcaggcccccacaagttcatttgcgagcagcgccctaagaaggatcgcgcttgcaaacttgctgggccagacagccggggtcagtggatacagatgatttttacatccgttgctgcttccgaaccaggcaacaacccagaaattcttaccgataaactgttgatcggcaacgaagatttcagccccccaccagaaacaatggattcatttatcgagaccaacctgttccgatcttgtcttccgcaacccgatatccctaagaatgccttggaatctaccaaaaacaagaagagaaggaagaaaagaattttcaacctggtccctaatttcgacctcctgggccagagtcggattggggtcaaagaaagagagaagtgtgacctgctgaccaaaaatcatgggctcaaaatcacattaggagaggagaaagatcggatctcagagagaaactctgaggaagagaacaagcagaagctcatgaccttcgaccatcacccactgtggttctatctggacataattaaagcaacccctctgaacattgatgggcagaggtactcccactgtctgagctttaacagacttcggtgcagtgcctccctctacaaaaattatatcccatctttcgtactgcataacctttctagcatctggaagccaagcttcaccaacaagaaactatttctgacgtttgagagccagactagggtcggcaataaattaaatgatgcagggttcatatcacctgaaatcctgcactcccaccccgacacatcttgcagcctgggagtcaccagcgatttccatttcctgaatgagagattcgatcgcaaactcaagcgatgggaggagcccaaggagctgccagctgaggattctcaggatttgacctcaactgattaccgcagtctggagctgccactgagccaggggttcgcattccagctcgttaagttattcggcagcccaggcgtgccgatggaaagtttgctacccgacgattacgtggtccccctggattggaagaccctgaaaatgatttacttgcagtggaagatgtctgtggaaaaaagacagaaaaaaatcggatag

SEQ ID NO: 49021 - DNA, 513 bp, Artificial Sequence
  Description of Artificial Sequence: Synthetic coding sequence
atgctgatcaaggtgaagaccctgaccggcaaggagatcgagatcgacatagagccaacagacaaagtggagcggatcaaggagagggtcgaggagaaggaggggatacctccccagcagcagcggctgatttacagtgggaaacagattgatggcaccgtcagggatcgccgcggacaagatgtcaggctttatccagaagtccctgaggtgctgaagcgtctccagagcctaggcgtgccaggcgccgcagcttcgagaacttcggaaatagaaggtgccaaccagctgctggaattatttgacctcttccggtattttgtgcacagagagatatatcccgggtctaagattacacactttgagcggctccagcagaaaacgggaataccattctctcagatgatattcttcgacgacgagagacgcaacatcgtggatgttagcaagctgggggtcacatgtattcacatccagaatggcatgaatctacagacactcagtcaggggtag

SEQ ID NO: 49022 - DNA, 339 bp, Artificial Sequence
  Description of Artificial Sequence: Synthetic coding sequence
atgtggaagggcggccggagccaccccttcctgccctgcagcagccggagggccggctcaggtggccagctcgacagtattctgccacaccagagtccagcttgggggccatggggatgcaaggacctcagcagcggcgttccaagctttctgacctcgtctatactgtggaaaagtgcagtgtttgcggaggataacgggcttaagatccacctttgttcctacaaacgcgatgatctggttctgttttatgactgcacgtcttttgtgctgacgttcgggccatccccgtggtttcttactcagggttttctgaacccgctcgagttttccgcttag

SEQ ID NO: 49023 - DNA, 2577 bp, Artificial Sequence
  Description of Artificial Sequence: Synthetic coding sequence
atgctgcagaccaaggacctgatctggaccctgttcttcctgggcactgctgtgtcgctgcaggttgatatcgtcccctctcagggcgagatttctgttggcgagagcaagttttttttgtgtcaggtggctggggacgccaaggataaggacatatcctggttctctcctaatggcgagaagttgaccccaaaccagcagagaatcagcgtagtctggaacgacgactccagtagcactttgacgatatacaacgccaatatcgatgacgcggggatctacaagtgtgtggtgacgggggaagacgggtctgagagcgaggctaccgtgaacgtcaaaatatttcaaaagctaatgttcaagaacgctcccacccctcaggagtttcgcgaaggcgaggacgccgttatcgtctgtgatgtcgtctcgtccctgccccctactattatctggaagcacaaaggcagagacgtcatcctcaaaaaagacgtgcggttcatcgttttgtcaaataattacttgcaaattcgggggataaagaagactgatgagggaacctatcggtgcgaaggccggatccttgcacggggagagatcaattttaaagacattcaagtgatagtcaacgtcccacctacaattcaggctagacagaacatcgtcaatgcgaccgcaaacctgggccagagtgtaacactggtctgcgatgccgaaggctttcctgagccgaccatgtcatggactaaagatggggaacagatagagcaggaggaggacgacgaaaaatatatcttctccgacgacagcagccagctaactataaagaaggtggacaagaacgatgaggctgagtatatttgcatcgcggagaacaaagcaggcgagcaggacgccaccattcacttaaaagtctttgcgaagccaaagataacctacgtggagaaccagaccgctatggaactcgaggagcaggtcacccttacatgtgaggcttcaggcgatcctattcccagcataacctggaggaccagcacgaggaacatctcttctgaggagaaggctagctggacaaggccagaaaaacaagagactctcgatggtcatatggtggtgcgcagtcacgcccgagtgagttcgcttacccttaaaagcattcaatataccgacgcaggggaatacatatgcaccgctagcaacaccatcggccaggatagtcagtctatgtatctagaggtgcaatatgcaccaaaattacagggcccagtagccgtgtacacttgggaaggaaatcaggtcaatatcacgtgcgaggtcttcgcctacccttctgctaccatctcatggttccgggacggccagcttctgcccagctcgaattattctaatatcaagatctataatactcccagtgcaagctacctggaagtgaccccagattccgagaacgattttggtaactataactgcactgccgtcaatcggatcggacaagaatcactggaatttatcctagtccaggccgataccccctccagcccgagcatagaccaggtggagccctacagcagcacggcacaggtgcagttcgatgagcctgaagccacagggggggttccgattttaaagtacaaggccgagtggcgcgcagttggagaggaggtatggcattcaaagtggtatgacgcaaaggaagcatccatggaaggcatcgtcaccatcgtcggacttaagccggagacaacttacgctgttaggctggccgctctaaacgggaagggactaggggagatctccgctgctagtgagttcaagacacagcccgtgcagggggaacccagcgcccccaaactggaaggccaaatgggcgaggatggaaatagtatcaaggtcaacctgattaagcaggacgacggcggttcacccatcaggcattacttggtgaggtaccgggcgctaagtagcgagtggaagcctgagattcgactgccaagcggcagcgaccacgtgatgctcaagagcctcgactggaatgccgagtatgaagtgtacgtggtggcagaaaatcaacagggcaagagtaaggcagcacacttcgtgttccggacctctgctcaaccaaccgctattcccgccaatggcagtccaaccagcggcctaagtactggggcgatcgtgggcatactgattgtgatatttgttttattactagtggtcgtcgacatcacatgttacttccttaataagtgcggcctgtttatgtgcatcgccgtgaacctttgcgggaaggcaggcccaggagcaaagggaaaagacatggaggagggcaaggccgccttttctaaggatgagtcaaaggagcctatcgtcgaagtccgcacagaagaagaacgcacacccaatcatgacggcgggaagcatacggaacctaatgaaacaacgcccttgactgagcccgagaagggaccagtggaagcaaagcctgaatgccaggagacggagacaaagcccgctccagctgaggtgaaaacagtgcctaatgatgccacacagacgaaagagaacgaaagcaaagcctag

SEQ ID NO: 49024 - DNA, 2181 bp, Artificial Sequence
  Description of Artificial Sequence: Synthetic coding sequence
atgctgcagaccaaggacctgatctggaccctgttcttcctgggcaccgccgtgagcctacaggtcgacatagtcccatcccagggcgaaatctccgtaggagaatctaaattcttcctatgccaggttgctggggatgctaaggacaaggacatctcttggttttcccccaacggggaaaaattaacccccaatcagcaacgcatatcggttgtgtggaacgatgattcctctagtaccctaactatttacaacgccaacattgacgacgctggtatctataagtgcgtggtaacgggcgaggatggtagcgagagtgaggcgacggtgaatgtaaagatcttccagaagctgatgttcaaaaatgcacctactcctcaggaattcagggaaggagaagacgctgtgattgtgtgcgatgttgtctctagtctgcctccgacaatcatttggaagcacaagggcagggacgtgatcctgaagaaggacgtgagattcattgttttgagcaacaattatctgcagatccggggcatcaaaaaaactgacgaaggaacatatcgctgcgagggacggattcttgcccggggagaaattaacttcaaggatattcaggttattgtgaacgtcccccctactattcaagcaaggcaaaacattgtgaatgcaacggccaaccttggtcaaagcgtgacccttgtgtgcgatgctgaaggcttcccagagccaacaatgtcttggactaaggatggcgaacagatcgagcaggaggaagacgatgagaagtacatttttagcgacgactcctcacagttgactatcaagaaggtcgacaaaaatgacgaagccgagtacatctgcattgccgaaaacaaagccggagaacaggatgcaaccatccatttgaaagtgttcgcaaaaccgaaaataacatacgtggaaaatcagacagccatggaactggaggaacaggttaccctgacgtgcgaagcttcaggagatcctatcccttctattacctggcgcacctctactcgaaacatcagttccgaagagaaaactcttgacggccatatggtggtcaggtcgcatgctagagtatcctcactgacccttaaatccatccagtatactgatgcaggcgagtacatctgcactgcaagcaacaccatcgggcaggatagccagagcatgtacctggaggtccaatacgcccccaaactgcagggccccgttgcagtgtacacgtgggagggaaaccaagtgaatattacttgcgaagtctttgcctacccatccgcaaccatttcatggtttcgagacggacaactcctgcccagctcaaattacagcaacatcaagatttataatacaccatctgcgtcatacctcgaagtaacccctgactcagaaaatgacttcggtaactacaattgtactgcagttaacagaatcggacaggagagtctggagtttatcttagtccaagccgataccccaagctctccttccatcgaccaggtcgagccctatagttccaccgcacaggttcaatttgacgagcctgaggccacagggggggtgccaattctcaaatacaaagcagaatggcgtgctgttggtgaggaggtctggcacagtaaatggtacgacgcaaaagaagcctctatggagggcatcgtgactatcgtcggcctgaagcctgagacgacgtacgctgtaagactggccgctctgaatgggaaggggctcggtgagatctccgctgcgtcagaattcaagacacagcccgttcagggtgaaccgtccgctcctaagctagaaggacagatgggcgaggacggaaattccattaaagtgaacttgattaagcaggatgacggtggttcaccaattaggcactaccttgtgcggtatcgggctctgtcatccgaatggaagcctgagatccggctgccttccggatctgatcatgtgatgttgaagagtctcgactggaacgcagagtacgaggtctacgttgttgcggaaaatcagcagggaaagtcaaaggctgcgcattttgtctttcgtacatctgcccagcctaccgccatcccggccactctcggaggtaatagcgcttcatatactttcgtttccttgttattcagcgctgtcacactgcttctgctgtgttag

SEQ ID NO: 49025 - DNA, 2286 bp, Artificial Sequence
  Description of Artificial Sequence: Synthetic coding sequence
atgctgcagaccaaggacctgatctggaccctgttcttcctgggcacagcagtgagccttcaggtggacattgtcccctcacagggcgagatttctgtgggcgagagcaagttttttctgtgtcaggtagccggtgacgccaaagataaagacatctcttggttcagccctaacggggaaaagcttaccccaaatcagcagcgtatatctgtcgtgtggaatgacgacagctcaagcactttgacgatctataatgctaatatagacgatgcaggcatctacaaatgcgtggtgaccggcgaagacgggagcgagtctgaggccaccgtcaatgtgaaaatttttcagaagttgatgtttaagaatgcccctacaccccaggaattcagggagggcgaagatgctgtgattgtctgcgacgtcgtctcctctctgcctccaaccattatctggaagcacaaaggacgggatgtgattctaaagaaggatgtgagattcatcgtgctctccaataactatctccaaatccgtgggattaaaaagaccgacgaagggacataccgatgcgaaggccgaattctggcccggggggagataaactttaaggacattcaggttatcgtaaacgttccccctacaatacaagccagacagaatattgtaaatgcaacggccaatctgggacagtctgtgacacttgtttgcgacgctgagggcttcccagagcccaccatgtcctggacaaaagatggcgaacagatcgagcaggaggaagacgacgaaaagtatatcttctctgatgacagcagccagctgacaattaaaaaggtcgataagaacgacgaggcagaatacatatgcatcgcagagaataaggctggggaacaggacgccaccattcatttaaaggtttttgccaaacctaagatcacctacgtggagaatcagacagccatggagctcgaggagcaggtgactctcacctgcgaggcaagcggagacccgatcccctctatcacatggaggacatctacacgaaatatctctagcgaggaaaaaactttggatggacatatggtggtgcgcagccacgccagggtgtccagtcttaccctaaaaagtatacagtacactgatgccggtgagtacatatgtaccgcctcaaataccattggccaggattcgcagagcatgtatctcgaagtgcagtacgcgccaaagttgcagggacccgtagcagtgtacacatgggagggaaaccaggtcaacatcacctgcgaggttttcgcctatccgagcgctactattagctggttcagagacggacaactcctgcctagttccaactattctaatatcaagatttacaacaccccctctgcctcatatctggaagtgacccctgattcagaaaatgacttcggcaattataattgcacagctgtcaacagaatcggacaggagagcctggaattcatcctggttcaggctgacaccccatcatccccatctatcgaccaggttgaaccctacagctcaaccgcccaggtccaattcgacgagcctgaagctaccggaggagtacccatactcaagtacaaagctgagtggcgggcagttggggaggaagtgtggcactcaaagtggtacgatgctaaggaagcttcaatggagggaattgtaacaatagtcggcctgaagcccgaaacgacctacgctgtcaggctggccgcacttaacgggaagggtcttggagaaatctcggccgcatctgagttcaagacccaaccggtccacagcccaccccccccggcgtctgcatcttccagtaccccagttcctttatccccacctgacactacttggccactccccgcccttgccaccacggaacccgccaagggagagccttctgccccaaagctggaggggcaaatgggggaagacggcaatagtatcaaggttaacctcatcaaacaggacgacggggggtctccaatcaggcactatctggtgagatacagggcactgagcagcgaatggaaacctgaaattcgcctgccatccgggtctgatcatgtcatgctcaagtccctggattggaatgccgaatatgaggtgtatgttgtcgcagaaaatcagcaaggcaaatcaaaggctgcccacttcgtctttaggacaagcgcccaacccactgctatcccagcaacactgggaggcaattctgcctcatacacattcgtcagtctgctgttttcagcagtgacattgctcctgctgtgttag

SEQ ID NO: 49026 - DNA, 1668 bp, Artificial Sequence
  Description of Artificial Sequence: Synthetic coding sequence
atgggcaacaccgtgcaccggaccctgcccgaccccagcccccccgccaggctgttagcaaccagaccatgttgtggccctggacccgagcggcgtccagtcctcggcgaagctccacgctttcacgctcaagccaagggtaaaaatgtgcgtctggacggacactcacgcagagctacgcgccgtaattctttctgtaatggagtgacgtttacccaaagacctattcgtctctacgaacaagtccgtttgcgcctggtcgccgtgcggcccggctggtctggggccttgcgcttcggattcacggcccatgatccgagcctcatgagtgcacaggatatccccaaatacgcatgcccagatctggttactagaccgggctactgggcaaaagcccttcccgagaatctggcccttagagacacagtcctagcctactgggccgatcgccacggtagggtgttctacagtgtaaacgatggtgaacctgtcctttttcattgcggcgtggccgtgggaggcccactgtgggctctgatcgacgtgtacggcatcaccgacgaagtacagttactcgaaagtgcattcgccgataccctgaccccagcgagactttcccaagcacggtttagtgcctgcctccccccatctagccacgatgctgctaactttgacaataacgaactcgaaaacaaccaggtggtcgcaaagctggggcaccttgccttgggtcgcgctcccggccctcccccggcagatgccgccgctgccgcgatcccctgtggaccacgggagaggcctaggccagcctcatcacctgccctgttggaagccgatctgagattccatgcaactaggggcccagatgtatcactgagcgccgaccgaaaagttgcctgcgcaccaagaccagatggcggacgaacactcgtattcagtgaaaggccgctgcggcctggggaatccctgttcgtggaagtgggtagacccgggctggcagccccgggtgcactggcctttggcattactagctgtgatccaggggtgttgcggccgaatgaactgccggccgacccggacgccctcctagatcgaaaagagtattgggtagttgcacgtgcggggcccgttcccagtggaggcgacgccctaagcttcaccctgaggcccggtggtgacgtcctgttgggaatcaatggccgtccacggggtcgactgctatgtgtggacaccactcaggccctttgggcattcttcgctgtgagggggggggtggccggacaactgagattattagggacgctgcagtcatcacccgcaaccaccacacctagcggctctttgtccgggagccaggacgactcagacagtgatatgacttttagtgtcaaccagtcctcatctgcttcggaatcaagcttagtgaccgccccctcgagtccattatccccccctgtgagcccagttttctctcccccagagcccgctggaatcaagaatggggagtgtactgtctgcttcgatggtgaggtggatactgttatctatacttgtggacatatgtgcttgtgtcactcttgtggtttaagactgaagcggcaggcacgtgcttgctgtcccatttgtagaaggccaattaaagatgtgatcaagatataccgaccctag

SEQ ID NO: 49027 - DNA, 4683 bp, Artificial Sequence
  Description of Artificial Sequence: Synthetic coding sequence
atggccgccggcagcggcggcagcggcggcagcggcggcggccccgggccaggcccagggggcgggggcggcccatcaggatccggcagcggtccggggagcaatggtggtctcggatcagggggagagctgcacccgcgcacaggacgcctcgttagtctctctgcctgcgggcgcactgcaagacgacaacaacccggccaggaatttaatcatggactggtgctgtcaagagagcctcttcgggacggacgcgtgttcactgttcgcatcgatagaaaagtgaacagctggagcgggagcatcgagatcggtgtgacggcattggatccttctgtgcttgacttcccatcctccgctaccggtctcaagggagggagctgggtggtaagcggttgtagtgtactccgtgacggtcggtccgtcctggaggagtatggtcaagatcttgaccagctgggggagggtgatagagtgggcgtggaacgaacagttgcaggtgaactgaggctgtgggtgaacggtagggactgtggcgtggcagctacagggttgcccccaagagtgtgggcggtggtggatctttatggcaagtgtacccaaatcactgttctgccccccgagccgggcttttctccccccacccccatccctaccccccccctcgaaccactcgcacctactgaggattctgccctcgctgaacaaggcactagtgccgatgaagctttcatggtgtctcccgcacaggccaggccagagacatttcccaatagccttgaatctcacaacgactttgccaacatggagctttcggaggtcgtgagcaatactatcctgagtgcctataatggtgggcttctgaacgtaaaccttagtagcccaccagcaggagagggactcggatctagcggagccgctacctcaccgattctgacctcaaatgacgcacttctattccatgaaaagtgtgggaccttgatcaaactctctaacaataacaagaccgcggagagacgtcgccctttagacgaattcaacaatggtgtggtgatgactaatcgaccactgcgcgacaatgaaatgtttgagattcgaatcgataaactagtcgataaatggtctgggagcatagagatcggagtcacgacacacaaccccaattcccttgaatatccggccaccatgactaatctacagagcggcacaattatgatgtcgggctgtggcatcctgacaaacggcaagggtactaggcgtgaatattgtgagttcagcctggatgagcttcaggagggggatcacataggactaacacggaaaagtaactccgccctgcactttttcatcaacggaatagaccagggggttgccactcctctgactccccccgtggtgtatggagttgtcgacttgtacgggatggccgtgaaggtaaccattgttcacaacaataaccactcggaccgtctgagaagaaataatgccatcttgcgtgccctgtccccagagggcgctctcaggcgcgctgcgccagccgcccaggccgaaccggagcgcctgctgtttcaccctaattgcggccagaaggctgctatcacacacgagggaaggacagccttgagacctcacgccaccgatgatttcaaccatggggtggtgctttcttcaagagccttaagggacggagaggtgttccaggtgcgaattgacaaaatggtcgacaaatgggcaggaagtattgagattggtgtaacgacgcacaaccctgcatacttgcaactgcccagtacaatgaccaatcttcgctctggcacatggatgatgaccggcaacggggtgatgcataacgggactactatcctggatgaatacggccataacctagaccgactcaaagccggggatacggtcggagttgttcggcgtgaggacggtacattacatttctttgtgaatggaatgacccagggacccgccgcctggaatgtcccccctggtgtctatgccgtggtggatctttatggccaagcagcgcaggccaccatagtcgatgacgtcgaagtggccccggtgcctgagccactccccgaggggaacaaccaggtgagcccctccagcccttctagtggcgcaggaggatccgacctgcgattccatcagttacatgggtccaacgctgtgattaccaacggaggccggaccgctctcaggcataactgccggtctgaattcaacgacgccattgtaatatccaaccgggcgctaagagatggagagctgttcgagatagtgatccagaagatggttgataggtggagcggctctatagaggcgggggtgaccgctattaggcctgaagacctggagttccccaatacgatgaccgacatagattacgatacttggatgttgtctgggacggccataatgcaggacggcaatactatgcggaataattacgggtgtgatttagatgccttaggtacaggcgcccgcataggcatgatgcgaaccgccaagggcgacctacattattttatcaatggccaggatcagggtgcagcctgctcaggactgcctccagaggtgtatgccgtggtggatctgtatggccagtgtgtgcaggtttccattacgaacgccactgggcccatggacaattcactagccacgagcaacacagcgaccgagaaaagttttcccttgcacagtcctgtcgcgggggtggcgcatcggtttcactctacctgcggcaagaatgtaacactggaagaggacggcacgcgcgcagtgagggctgccggctatgcccacggcttggtgttttctaccaaggagttacgcgcagaggaggtgtttgaggtgaaagtagaagaattagacgaaaaatgggctgggagcttacgcttgggcttaacaacgctagcacccggggagatgggtcccggggctggcggcggggggcccggcctccctccttctctgccagaactgaggacgaaaaccacttggatggtgtcaagctgcgaggttcgaagggacgggcagctgcagcggatgaattatgggagaaatttggagcggctgggcgtgggttccagggttggcgtgcggaggggggcagatgatactatgcacattctggtggatggagaggatatgggccctgctgctactggcatcgcgaagaacgtgtgggctgtgctcgacctgtatggcccagtcagaggcgtgagcattgtgtcctctacacgattagaagagtccgaagggacgcaaccaccttcaccaagctctgacacaggctcagaaggggaggaggatgacgaaggggaagaacacgggttgggcgggcagaacgaagttggcatcattcctactacgctggaatttctcgaaaatcacggtaagaatatcttactgagcaacggaaatcggaccgctacacgggtcgcaagctataatcaggggattgtggtgatcaaccaaccgctagtgccgcagcttctggtacaggttcgcatagattttttaaatagacaatggacaagtagtctggtcctaggtgtgattacctgcgcgcctgagaggctgaacttccccgcctccgcatgtgctcttaaacgcgcagcctggctgcttcgcggtcgcggggtatttcataatggattgaaaatttgtgaaaagttcggaccgaaccttgacacgtgtccagagggcaccatcctgggactgcgcctcgatagctcaggtggcctgcatctgcatgtgaatggggtggatcagggcgtcgcagtcccagacgtgccacaaccttgccatgctttggtggatctctatggccagtgtgagcaggtcacaatcgttaatccagaaccaggcgcggcctctggtaagagcgctggtacacaaggggacatggaaaaggctgatatggtggacgggatcaaagaatccgtgtgctggggcccaccccccgccgcctccccccttaagagttgcgagtatcacgccctttgctcccgatttcaagagctgctgctcctgcctgaagattattttatgcctccacccaagaggtctctttgctactgcgaaagctgcaggaaactccgaggcgatgaagcccaccgcagacgcggcgagcccccacgtgagtatgcactgcccttcggctggtgccggttcaatttgcgggtcaatcccaggctggaagccggcacactgaccaagaagtggcacatggcctaccacggctctaacgtggccgcggtgaggcgggtgcttgaccggggtgagcttggagctggcacagcaagtattctgagttgcagacccttgaagggagagccaggagtcggctttgaagagccaggagagaattgcgccccccctcgcgaggaacagccccctccagtcttgttaagtccgtccttgcagtacgctggggcagaaaccctggcctccaaggtacagttcagggatcctaagagccagagaacccaccaggcacaggtagcgtttcaagtatgtgtgcgccccgggtcttatacccctggcccccctagcgccgcgctaggcgagcctcctgacccccacttctccccagctgagctggagtgggtcacaaaggaaaaaggggcgacccttctgtgtgcactgctcgtcagggtggagtag

SEQ ID NO: 49028 - DNA, 4689 bp, Artificial Sequence
  Description of Artificial Sequence: Synthetic coding sequence
atggccgccggcagcggcggcagcggcggcagcggcggcggccccgggcccgggcccggcgggggcgggggcccatcaggcagcggttccgggcctggctccaatggcgggctcggctccggcggcgaacttcaccctcggacaggcagattggtttctctctcagcgtgcggaaggactgcacgaaggcagcagcctggtcaggaatttaatcacgggcttgtactttctcgggaaccactccgcgacggccgagtgttcaccgtgcgcatcgaccgaaaggtgaacagttggagcgggagtatagagattggggttaccgcgctagacccaagcgtgctcgacttccctagctctgctacggggttaaagggtggatcttgggttgtatcagggtgtagcgttctccgagatggcagaagcgtcctcgaagagtacggacaggacctcgaccagttgggggagggcgaccgcgtcggggtcgaaaggacagtcgcaggagaactgagactgtgggtgaatgggcgcgattgcggcgtcgctgcaacagggttaccccccagagtatgggctgtagttgatctgtacggcaagtgtacccagattacagtccttccaccggagcccggattcagcccacccacacctatccctacaccgcccttggagccattggcgcccaccgaggactctgctcttgcagagcagggtacatcggctgatgaggctttcatggtcagccccgcgcaggcgcgccccgaaacgttcccaaactcactggagtctcacaacgacttcgccaacatggagctgagtgaggttgtttctaatacgattctgtccgcgtataatggcggcctgctgaacgtgaatctctcttcccctcctgcgggggaaggtcttggctcttctggggcagccacttcccccatcctcacctcgaatgacgccctgttattccacgagaagtgtggcaccctgatcaagttatctaacaataataaaaccgccgaaagacgccgcccactggacgagttcaacaatggcgtggtgatgactaaccgccccttacgagataatgagatgtttgagatcagaatcgacaaactcgttgataagtggtccggttcaatcgaaatcggagtgactacacataatccaaacagcttggaataccctgctaccatgacaaacctccagtcagggacaattatgatgtctggctgtggaattttaaccaacgggaaagggacccgtcgagagtattgtgagtttagtctggatgagcttcaggaaggcgatcatatcgggctcacccgaaagtccaacagcgccctgcactttttcataaacggcattgaccagggggtggcaacccctcttacccctcccgtagtctacggtgtggtagatctgtatgggatggctgttaaagtcactattgtccataacaataatcactctgaccgcctgagacgaaataacgcaatactgagagcactctcccctgagggtgcactgcggcgggccgctcccgccgcacaggctgagcctgaacgccttctctttcatccaaattgcgggcaaaaggccgctatcacccatgaaggcagaacagctctccgtcctcatgccacagacgacttcaaccatggagtcgtcctgtcttccagggcccttcgagatggagaggtctttcaagtgagaattgataaaatggtggataagtgggccggcagcatagaaataggggtgacaactcacaaccccgcttacttgcagctccccagtacgatgaccaacttgaggagcggcacatggatgatgaccggcaatggtgttatgcacaacgggacaaccattctcgacgagtatgggcacaacttggaccgcctgaaagcaggagacacagtgggggtggtgcggagggaagatggcacactgcattttttcgttaatggcatgacacaagggcccgctgcgtggaatgtacctcccggcgtgtacgctgtggtcgacttgtatggtcaagctgcacaggccacaatcgtggacgacgtggaagttgctcccgttcctgaacctctgcccgaggggaacaaccaggtgtccccgtcttccccgtcttcaggcgcaggaggctccgatctccgatttcaccagcttcacggttctaatgccgtgattactaatggagggagaactgccttaagacacaactgtcggtcggaatttaatgacgctatcgtcatcagcaacagggctttgagggatggtgaactgtttgagatagtcattcagaaaatggttgataggtggagcggctctatcgaggccggagtgaccgctatcaggcccgaggacctggagtttcccaatactatgaccgatatcgactacgacacctggatgctgtccggtacagctatcatgcaagacgggaacaccatgaggaacaattacggatgcgaccttgatgctctcggaacaggcgccaggatcggcatgatgcgcaccgctaaaggcgatctgcattatttcatcaacgggcaggatcagggcgcagcttgttcaggactgccgccaggcaaggaagtgtatgccgtcgtggacttgtacggccagtgcgtgcaagtctcaatcaccaacgccactggccccatggacaactctcttgctacatctaatactgctacggagaagtccttcccactgcactcgcccgtagctggcgtggcccacaggttccactcgacatgcgggaagaacgtgaccttagaagaagacggcacacgcgcggtccgggctgccgggtatgcacacggactggtcttcagcaccaaggaactcagggccgaagaagtgtttgaagtgaaggtggaggaactggatgagaagtgggccggctctttgcgtctgggtctaacaactctcgcccctggcgaaatggggcccggtgccggtggtgggggcccgggcctccctccatccctacctgaactgcgtacaaagacgacttggatggtgagttcatgcgaggttcgccgtgacgggcagcttcagcggatgaactacggtcgcaacctggagcgcctcggcgtgggaagccgtgtgggcgtccgccgcggcgccgatgacacaatgcacattctcgtggatggcgaggacatggggcctgccgccaccggaatcgcaaagaacgtgtgggctgtgttggacctttatggcccagtccgcggcgtgtccatcgtgtcatctacacggttagaagagtccgagggcactcaaccgccctcgccctcaagtgacacaggttccgagggagaggaagatgacgaaggcgaagagcacggtctcggcggtcaaaacgaggtcggcatcatccctaccacgctagaatttttggaaaatcacgggaagaatatcttactctccaatggaaatcggacagccactagggtggcgtcatataatcagggaatcgtggtcattaaccaacctctggtccctcagctgctggtacaggtcaggatcgatttcctgaatcgacagtggacaagttcacttgtactgggggtgattacctgtgcccctgaacgccttaattttcccgcgtccgcatgtgccctgaaacgcgcagcttggctgctacggggcagaggggtttttcataacggactgaaaatatgcgagaaattcggccctaacctagatacttgcccagaaggcaccattctgggcctcagattggacagctccgggggcctgcatttacacgtgaatggggtggatcagggcgtggccgtacccgatgtcccccagccttgtcacgcgcttgtagatctctacggacagtgcgagcaggttaccattgttaatcctgagccaggggcggcaagcggtaagagcgcaggaactcagggggatatggagaaggcagacatggtcgacgggataaaagagtccgtttgttgggggcccccaccagccgcgagtccactgaaatcatgcgagtaccatgccttatgctctcggtttcaggaacttctgttgcttccggaagactacttcatgccaccgccaaagcgaagtctttgctactgtgaaagttgtcggaagttaagaggggacgaggcccatcggcgccgtggggaacctccacgcgagtacgcactcccgttcggctggtgcagattcaacctccgtgttaatcctcgtcttgaggcaggcacactgaccaaaaagtggcatatggcatatcacgggtccaacgtggctgctgtacgccgggtgctggataggggcgagctgggcgcgggaactgcatcgatcctttcttgccggcctctgaagggggagcccggggtgggatttgaggagccgggggaaaactgtgccccccctcgcgaagagcagccaccacccgttctgttgtctccaagcttgcagtacgctggtgcagagaccctagctagcaaggtgcagttcagggaccccaagtcccagcgcacacatcaagcacaggttgcgttccaagtgtgcgtgaggccgggttcttatactcccggtccaccatctgccgctcttggcgagccccccgatcctcactttagccctgccgagttggaatgggtgactaaggagaagggcgctacgctgttatgcgcactgctagtaagggtggaatag

SEQ ID NO: 49029 - DNA, 2760 bp, Artificial Sequence
  Description of Artificial Sequence: Synthetic coding sequence
atggtgaagcagaacaacatcatccccggcgagacccagatcctgttgcggttcactggatgggagtctaaggtcaacgctaagaagcagcttcctgtggggataaagtgtgagccaatggaccaagtccccgattccacatctagcgccaccaacgtaagtatggtagtgtccgccggcccctggagctccgaaaaggcagaaatgaacatattggaaataaacgaaaaactccgtccacagctcgccgaaaacaagcagcagtttcgaaacttaaaagagcgatgttttctaacccagttggccggatttcttgccaacagacagaagaagtataaatacgaggagtgcaaggacctcattaagttcatgctgcgcaacgagagacagtttaaggaagaaaagctggccgagcaattgaagcaagccgaagaattgcggcagtacaaagttcttgtgcactcccaggagcgtgaactcacccagctgcgagaaaagttaagggaggggagggacgcatcccgcagcctgaatgagcacctccaggccctcctgaccccggatgagcctgataaaagtcagggtcaggacttacaggaacagcttgccgaagggtgccgtctggcccagcatctcgttcaaaagctgtctcctgaaaacgacgaggacgaggacgaggacgtacaggtggaagaagacgagaaggtccttgaaagttcagcgcctcgcgaggttcagaaagccgaggagtcaaaagtgccggaggacagccttgaggaatgcgctatcacctgctccaacagccatggaccctgtgacagcatccagccccacaaaaatattaagatcacgttcgaggaagacaaggtcaattcgtcactcgtcgttgaccgcgagagtagccacgatggatgccaggatgctctgaacattctgcccgtgcccggcccaacctcctccgccaccaacgtgtccatggtcgtatccgccggcccgctgtcctccgagaaggctgagatgaatatacttgaaattaacgagaaattatgcccgcagttagccgagaagaagcaacagttccggtctcttaaagaaaagtgctttgtgactcaagtggcatgctttctggctaaacagcaaaacaagtacaaatacgaggaatgtaaggacttgataaagtcaatgttacgaaatgaacggcagttcaaagaggaaaaactggcagagcagctgaaacaggctgaggagttgcggcagtacaaagttctcgtgcactcccaagaaagggaactgacccagctgcgagaaaaactgcgagaaggccgcgacgcgtccaggtcccttaatgagcacctgcaggcactcctcacacccgacgaacctgacaagtcccaaggacaggacttgcaggagcaactggcagagggctgtagattggcccagcacctagtccagaagctttctcccgaaaatgacaacgacgatgatgaggatgtgcaggtggaggtggccgaaaaagttcagaagtccagctccccacgagaaatgcagaaggccgaggagaaggaagtacccgaggattctttggaggaatgtgctatcacatgctcaaactcccacggtccttacgactcgaaccagccgcaccgtaagactaaaatcacttttgaagaggacaaggtcgactccacactgataggctctagctcacatgtggagtgggaagatgccgtccatattatccccgaaaacgaatccgacgatgaggaagaggaagagaagggcccggttagtccacgcaatctgcaggaatccgaagaagaagaagtgccccaggagtcttgggatgagggctactccaccctcagcatcccccccgaacgcttagcatcttaccagtcctactcttcaacgttccatagcctggaggaacaacaggtatgcatggccgtcgacattggccgacatcgttgggatcaggtcaagaaggaggaccaggaagcgacaggccctaggttatcacgagaattgctggatgaaaaagaaccagaggtgctgcaagactcactggatcggtgctacagcacgcccagcgtctatttaggacttactgacagctgccagccctaccgctccgctttctatgttcttgagcagcagcgtattgggctagcagtggatatggatgaaatcgagaaataccaggaagtagaggaggaccaagatccctcatgtccgcggctctccagggagcttctggcagagaaggaaccggaagttctccaagactcactggaccgttgctactcaactccttccggctacttagaactaccggacctggggcagccataccggagtgccgtgtactcgttagaagagcaatacttaggcttggctctagacgtagataggatcaaaaaggaccaggaagaagaggaggaccagggcccaccctgtcctcgtctgtcacgagagcttctcgaagtcgtggaacctgaggtgttgcaagacagcctagatgtcattcaactactgcctgtcgtgctgaattctctgactccggcctcacctacagaggtgcccttcatgcactggcgtaagaatatgctcgcctttcttctgacttgggagaagttgaagcgcaggggacggggccggaaagagggcgaggaggaccagagaagaaaagaagaaggtgaagagaagaagggcaagaaaattaaaacacaccatgcgccgggttctgccgcctgttag

SEQ ID NO: 49030 - DNA, 2373 bp, Artificial Sequence
  Description of Artificial Sequence: Synthetic coding sequence
atgttcagcaacagcaccggccggctgcccggccagcccacccaggagatccagcaatataaagtcttagtgcacagccaagaaagggagcttacacagttaagggagaagcttcgcgaagggagagatgccagtagaagtcttaacgagcacttacaggccctgttgactcccgacgaaccagacaaatctcagggtcaggatctccaggagcagctagccgaagggtgtcgtcttgcgcagcacctggtgcagaagcttagccccgaaaatgacgaggacgaggatgaagatgtgcaggtggaagaggacgagaaagtgttggagagctctgctccgcgagaagtccaaaaggcagaggagtctaaggtgccggaggacagcttggaagagtgcgctatcacatgttccaactcacacggcccgtgcgattcaattcagccccacaagaacatcaaaatcaccttcgaagaggacaaagtcaactcctcacttgttgtggatagggagtcttcccacgacggctgccaggacgccttgaatatcctgccagttccagggcctaccagctctgctaccaatgtgtccatggtcgtgagtgcaggtcctttatcaagcgagaaagccgagatgaacattttggagataaacgaaaagctgtgcccacagctcgctgaaaagaagcagcagtttagatccttgaaagagaagtgctttgtcacccaggtcgcctgtttcttggctaaacaacagaataagtataaatacgaagaatgcaaggatctaattaaatctatgctgaggaatgaacgccagttcaaagaagaaaagctcgctgaacagcttaaacaggctgaagaactccggcaatacaaggtgttagtccacagccaggagcgcgagctgacacagctacgggagaaactcagggagggaagagacgcaagccggtctctcaatgaacatctgcaagctctcttaacacctgacgaaccagataagtcacagggacaagatctgcaggagcagctggccgagggctgtagactggctcaacacctcgtgcagaagctgtccccagagaacgacaatgacgatgatgaagacgtacaggtggaagttgctgagaaggtccaaaaatcctcatccccacgggagatgcaaaaagccgaggagaaggaagtccctgaggacagtctggaggaatgtgcaatcacttgctcaaactcccacggaccatacgattcaaaccagccccacagaaagaccaaaatcacattcgaagaagacaaggtggatagcaccttaattgggagctcctctcacgtggagtgggaagatgccgtgcatattatccccgaaaatgagtctgatgacgaagaggaggaggagaaaggccccgtcagtcctcgtaacctccaggagtccgaagaagaggaagttccccaggagagctgggatgagggctatagcacattatcgattccaccagagaggctggccagttaccagagttacagttctacattccatagcttagaagagcagcaggtttgtatggccgtggatatcggacggcacagatgggaccaagttaagaaagaggatcaggaagcgaccggcccaaggttatctagggagcttctggacgaaaaggaacccgaagtcctccaagatagtctcgaccgctgttactccacaccttcggtgtacttgggactgactgactcctgccagccttataggtccgccttttacgtgctggaacagcagcgaatcggacttgccgtcgacatggatgagattgaaaaataccaggaggtagaagaagatcaggatccaagctgccctcgcctgtccagggagctgctcgcagagaaagagcccgaggtcctccaggattcgttggatcgatgttattcaactcccagcggttatctcgaactgccagatctgggccagccatacaggtccgctgtatattcccttgaagagcagtatctcgggcttgcattggatgtggacagaatcaaaaaggatcaggaggaggaggaggaccaagggcccccctgccctaggctgagcagagagctcctggaggtggttgagccggaggtgttgcaggactctctcgacgtgatccagctgcttcccgtggtgctgaatagcctgacacctgcttcgcccaccgaggtcccatttatgcattggagaaagaatatgctggcatttctgctgacttgggagaagctgaagaggcgcggtcggggacgcaaagagggtgaggaggaccaaaggcggaaggaggaaggtgaggagaaaaaaggcaagaaaattaagacccaccatgcacctgggtctgctgcgtgctag

SEQ ID NO: 49031 - DNA, 1101 bp, Artificial Sequence
  Description of Artificial Sequence: Synthetic coding sequence
ctggccagctaccagagctacagcagcaccttccacagcctggaggagcagcaggtgtgcatggccgtggacatcggtaggcacaggtgggaccaggttaaaaaagaggatcaagaagcaactggtccacgcttgtcccgagagttactcgatgagaaagagccagaagtcttacaggactctctggacagatgttattcgactccgtccgtctacctcggcctgaccgattcctgccaaccataccgaagtgcattttacgtgctggagcagcagcgcattggactcgctgtggatatggacgagattgaaaagtatcaggaggtggaggaagatcaggacccttcatgtccaagactgagtagggagctcctcgctgaaaaggagcccgaggtgctccaagactcactggataggtgctattcaacaccatccggatacctggagctgccagacctggggcaaccctaccgctccgccgtgtacagtttggaagaacaatacctcggactggcgttggacgttgacagaattaagaaggaccaagaagaagaagaagaccaaggcccgccgtgtccccgtctctccagggagttactggaagtcgttgaacccgaagtgctgcaggacagcctatgttacagtaccccttcatcttgcctcgaacaaccggattcatgccaaccatatggatcctctttttatgctttggaggaaaaacacgtggggtttagcctagatgtgggagaaatcgagaagaaggggaagggcaagaagcgccggggccggagaagcaagaagaagcgccgccgcggtcgtaaggaaggagaggaagaccagaatcccccttgcccgagactaagcagcgtgctgatggaagtcgaggtgcctgaggtgcttcaggatagcctggatagatactattcaaccccttctatgtattttgaactgccggactcatttcaacactacaggtccgtgttctacagttttgaggaacagcacatttcattcgcactggatatggacaacaggttttttacactgactgtaaggtcattacacctcgtgttccaaatgggggtcatcttccctcaatag

SEQ ID NO: 49032 - DNA, 2517 bp, Artificial Sequence
  Description of Artificial Sequence: Synthetic coding sequence
atggtggtgagcgccggcccctggagcagcgagaaggccgagatgaatatcctcgaaattaatgagaagctgagaccccagctggccgagaataagcagcagtttcggaacctcaaggagagatgttttcttacacaactggcaggatttctcgcgaatagacataaaaagtataagtatgaggagtgtaaggatctaattaaatttatgctccgcaatgagcggcagtttaaggaggagaagctggcggagcaactgaaacaggccgaagaactaaggcagtataaagtactggtgcattcccaggagcgggagctgactcagttgagagaaaagcttcgagaggggcgtgatgcttcccgcagcttaaatgaacatctgcaagccctgctgactcccgatgaacccgacaagagtcaaggtcaggatctacaggagcagctggccgagggctgccggctcgcgcagcaccttgtgcagaagctgagtccagagaatgatgaagacgaggacgaagacgttcaggtggaagaagacgaaaaggtcctggagtcctccgcgccacgggaggtgcagaaagcggaggaaagtaaagttccagaagattctctagaagagtgtgctattacatgctctaatagccacggtccctgcgactccattcagccccacaagaacatcaaaatcactttcgaagaggacaaggtcaatagttctctcgtggttgatcgtgagtctagccacgacggttgccaggacgcccttaacattctgcctgtgcccgggcctacctcctccgccacgaatgtcagcatggtggtcagcgccggccctctaagcagtgaaaaagccgaaatgaatatactggaaatcaacgagaaactgtgccctcaacttgcagagaagaaacaacagtttcgatctttaaaggaaaagtgttttgtgacccaggtggcctgttttctggcgaagcagcaaaacaagtataagtatgaagaatgtaaagatctgatcaagtcgatgctgagaaacgagaggcaattcaaggaagagaagttggctgagcagctgaaacaggcagaagagctcaggcagtataaagttctcgttcattcacaggagcgggagctcacccaactgagggagaagttgcgggagggccgagatgcttcccgttctctgaatgagcacttgcaggctctcctgacaccagacgaaccagataagtctcagggccaggatttacaggaacagctcgcagaaggttgcaggctagcccagcaccttgtgcagaagttatcgcctgaaaatgataacgacgacgatgaggatgtgcaggtggaggtagcagagaaggtgcagaaatcatctagtccaagagaaatgcagaaggcagaagaaaaggaagtccctgaagatagcttggaggaatgcgcaattacatgcagcaactcgcacggcccctatgactccaatcaaccacaccggaaacctaagagtcatctccggaagaccaaaagtactcagctgtctttagctcaccctttaatgctcaacggccgcatgctctacactctgtcccaaaaaatgaaagtgatgatgcgtaaacgcaaaaagaagggccaatgcctcccaggaatctgccggtccctgaaacggagaaagtccccacgctctccaggaatgaaggtcatacgcctttcacagtttttgttaaagggccaccgatgggatcaggtaaagaaagaggatcaggaagccaccggccctagactgtcccgggagctgctcgacgaaaaggaaccagaagtactgcaggactcactcgatcgctgctacagtaccccttccgtgtacttagggctgaccgattcatgccagccttacagatccgcattctatgtgttggaacagcaacggattgggctcgccgtggacatggacgaaattgagaagtatcaggaagtggaagaagaccaagacccatcctgtcccaggctgtcgcgggagctcctggcagagaaagaaccagaggtattacaggactctcttgacagatgctactctaccccgtcagggtatctggagttgcctgaccttggccagccctacaggtcagcagtgtattcccttgaagagcagtacctaggcctcgctctagatgttgaccggatcaaaaaagatcaagaggaagaggaggatcagggccccccttgtccgagattgtcccgagaactcctggaggtggtggagccagaagtgctgcaagacagtctggatgtcatccagcttttacccgtcgttctgaattcgctgacaccagctagccccacagaggtgccattcatgcattggcgaaagaatatgctcgcgtttctcctgacctgggagaaactgaaaaggagggggcgcgggaggaaggaaggagaggaagatcagcggaggaaggaagagggagaagaaaagaaggggaaaaagatcaaaactcaccatgcccccgggtccgccgcttgctag

SEQ ID NO: 49033 - DNA, 258 bp, Artificial Sequence
  Description of Artificial Sequence: Synthetic coding sequence
gagatgcagaaggccgaggagaaggaggtgcccgaggacagcctggaggaatgtgctataacgtgtagtaattctcatggcccatatgacagcaaccagccacacagaaagacaaagataacattcgaagaagataaagtggattcaaccctcattgggagctcgtcccacgtcgagtgggaggacgctgtgcatatcatccctgaaaatgagagcgacgacgaagaggaagaggagaagggacccgtgagcccatag

SEQ ID NO: 49034 - DNA, 3570 bp, Artificial Sequence
  Description of Artificial Sequence: Synthetic coding sequence
atggcccggcagcccccccccccctgggtgcacgccgccttcctgctgtgcctcttatctcttggaggagccatcgagatccccatggacttgactcaaccccctaccatcacaaagcagagtgcaaaagaccacatcgtcgatccccgtgataacatcctgatcgagtgcgaggccaaaggcaaccctgcgcctagcttccactggaccaggaacagtaggttctttaacatcgcgaaagacccccgggtctcaatgcggcgacggtctggaaccctcgtgatagactttcgcagcgggggcagaccagaagagtatgaaggtgagtaccagtgttttgctcggaataagtttggtacagccctcagtaatcgcattaggttgcaagtctcaaaatctcccctctggcccaaggaaaacttggaccccgtggtcgtccaggaaggtgcccctctaacactgcagtgcaacccccccccaggactgccttcgccagtcatcttttggatgtctagcagcatggaacccattactcaggacaagcgtgttagccagggccacaacggggacctttacttttctaacgtaatgttacaggatatgcagacagattatagttgtaacgctcggttccatttcacccatacaattcagcagaaaaatcctttcaccctgaaggtccttactaaccacccttacaatgactcctccctcagaaatcaccctgacatgtacagcgcgcgaggggtggctgaaaggacccccagcttcatgtacccacagggtaccgcctcttcacaaatggtgctgcgggggatggatctgctactggaatgtatcgcctccggagttccaactcctgacatcgcgtggtataagaagggcggggatctgccttcagacaaggcaaagttcgaaaattttaataaagccttgcgcatcactaacgtgtctgaagaggactccggggaatacttttgtttagcctctaataaaatgggatcaatcaggcacaccatcagtgtacgggtcaaagctgccccgtactggctggacgagccgaaaaatctaatcctggcccccggggaagatggccggctcgtttgtagggccaatggaaatcccaagcccacagtgcagtggatggttaacggggaacccttgcaaagtgcaccacccaaccccaacagggaggtcgcaggcgacaccattatatttcgagatacgcaaatctcttcacgagctgtatatcagtgtaacacatcaaacgagcatggctaccttctagctaacgcgtttgtcagcgttttggacgtcccaccacgtatgttgtctcccaggaatcagctcatccgagtcatcctgtacaaccgtacaaggctggactgtcccttctttggttccccgattccaactttgagatggtttaaaaatggtcagggtagcaaccttgacggggggaattatcatgtttatgaaaatggatcactggagattaaaatgatccgcaaggaagatcagggaatttatacttgtgtggccactaacattcttgggaaggccgagaaccaagtgcgtctcgaggtaaaggaccctacacgcatctaccggatgcccgaagaccaagtggcccgccgcggaaccacggtccagctggagtgtcgcgtgaagcacgaccccagcctgaaactcactgtctcatggttgaaggacgacgagcccctctacatcgggaacaggatgaaaaaggaggatgattccctgactatctttggcgtggccgagcgggatcagggttcctatacatgtgtggcctccactgagctggatcaggacttggctaaggcttatttgacagtactggctgaccaggcaaccccaacgaatcggttggcagctctgccaaaagggagacctgatcgcccccgcgatctggaactaactgacttagccgagcgcagcgttagattgacctggatccccggcgatgcgaataattcgcccattaccgactacgtggtccaatttgaggaagatcagtttcagccaggcgtctggcatgatcacagtaaatacccagggtctgtcaactctgccgttctgcggctttcaccgtacgttaattatcagttccgcgtgatcgcaatcaacgaagtaggcagcagtcacccctccttgccttccgagagataccgaacctccggcgccccacctgagagcaatcccggtgatgtcaagggtgaaggcacacggaagaacaacatggaaattacctggacacccatgaatgccactagcgcattcgggcctaaccttcgatacatcgttaaatggagacggagagaaaccagagaagcctggaataacgtcacagtgtggggctccagatacgtagtcggacagaccccagtgtacgtcccctatgagatccgcgtccaggctgagaacgattttggcaaaggcccagagccagagagcgtgattggatatagcggggaagattaccccagggctgcccctactgaggtgaaagtgagagtcatgaactctaccgccatcagcctgcagtggaatcgcgtgtactccgatacagtgcaggggcaactgagggaatacagagcctattactggcgggagtcttctttgctcaagaacctgtgggtcagccagaaaagacagcaggcctcctttcccggcgataggctgcgcggagtcgtgtctaggctttttccctattcaaactataagctggagatggttgtagtcaacggcaggggagacggcccgcgctctgaaacaaaggaatttactacaccagaaggcgtcccatccgccccccggcggttcagggtgagacagcccaacttagagaccataaatttggaatgggaccaccccgagcatcctaacggcatcatgatcggatacacactgaagtatgtggcattcaatggaaccaaagtgggcaaacaaatcgtggaaaatttttcacccaatcagactaaattcactgtgcagcgaaccgatcccgtaagtcggtaccggttcaccctgagcgctagaacccaggtgggatccggcgaagcagtcacagaggaaagcccagctccccccaatgagggttccccattagcagcatatactaacaatcaggcagacatcgccacacaaggatggtttattgggcttatgtgtgcaatagctctgctggtcctcatcttgctaattgtctgtttcatcaaacgctcccgaggtggaaagtaccctgttcgcgagaaaaaagatgttcccctcggccccgaagaccctaaggaggaagacggctcctttgattacagcgacgaggataataagcccctccagggcagccagacttcgttggacgggaccatcaaacagcaggaaagcgacgactccctggtggattatggagaggggggggaaggccagtttaacgaggacggctcctttattgggcagtacacagtgaagaaggataaggaagagactgagggaaacgagtctagtgaagcaaccagccctgtaaacgccatatattccttagcttag

SEQ ID NO: 49035 - DNA, 3774 bp, Artificial Sequence
  Description of Artificial Sequence: Synthetic coding sequence
atggcccggcagcccccccccccctgggtgcacgccgccttcctgctctgccttctgagcctgggaggggcgatcgagatacctatggatccaaatccacagcaccggctgacgcagccaccgactattaccaaacagtcagccaaggaccatatcgtggatccccgtgataatatccttatcgagtgcgaggcaaaagggaatcccgcccccagcttccactggactaggaactccagatttttcaatatcgctaaagacccacgggtgagcatgaggcgacgctccggcactctggtgatagacttccgatcaggaggcagacctgaggaatacgagggagaatatcagtgcttcgctaggaacaagtttggcacagctctgagtaacagaattcgcctgcaggtgtccaaaagccccctttggcctaaagaaaaccttgatccggtcgttgtccaggaaggagcaccactcaccttacagtgcaatcccccaccaggactgccctccccagtgattttttggatgagcagcagcatggaacctatcacacaagacaagagagtatcgcaggggcataatggtgacttatatttctcaaacgtgatgctgcaggatatgcagacagactattcctgcaacgcacgcttccacttcacacacaccatccaacagaaaaaccccttcacacttaaggtgcttacgacgcgaggcgtggctgagcggacaccatccttcatgtaccctcaggggactgctagtagccagatggtattgagaggcatggatctgctgctggaatgcatcgcatcaggggtccccacgccagatatcgcctggtacaagaaaggcggcgaccttccctctgacaaagcaaaattcgaaaacttcaataaagctttacgcatcacaaatgtctctgaagaagactcaggcgagtatttttgcttggcctcaaataaaatgggaagcattaggcataccatcagtgtgcgtgtaaaagccgccccctactggctcgacgagccgaaaaacttaattctggctcctggcgaggacggacgcctggtgtgccgagccaatggcaaccctaagccaaccgtccagtggatggtcaacggcgagcctctccaaagcgcaccccccaatccaaaccgggaagtagctggagacaccataatcttccgggatacacaaatctcaagtcgggctgtttatcaatgtaatacgtctaacgaacacggctacctgctggccaatgccttcgtttctgtgctagatgtccccccacggatgctgagcccgcgcaatcagctaatccgcgtcatcttatataataggacacgactggattgccctttcttcggttcccccattcctacactgagatggttcaagaacggacagggaagcaacctcgatgggggcaattaccatgtgtacgaaaacgggtctttggagataaagatgatcaggaaggaagatcagggcatctatacctgtgtagccacgaacattctaggtaaagcagagaaccaggtgcgtttggaggttaaggatccaacaaggatatacaggatgccagaggatcaggtagccaggcgaggtacaacagtccagctggagtgtagggtcaagcacgatccttccctgaaacttacagtgtcttggctcaaggatgacgagccgctatacattggcaaccggatgaagaaggaagacgattcattgaccattttcggagtggctgaaagggatcagggaagctacacctgcgtggcttcaaccgaactcgaccaggacctggccaaagcttatttaacagtgctggcagaccaggccaccccaaccaatcgtttagcggccctcccaaagggaaggcccgacaggcctagagacttagagttgacggacctggcggagcggtcagtccgccttacctggatccccggagacgctaacaattcacctatcaccgactacgtggtgcaatttgaagaagaccagttccagccaggtgtgtggcatgaccatagcaagtaccccggaagtgtcaattcagcagtactcaggctttcaccttatgtgaattatcagtttagggtgatcgccattaatgaagtcggctccagccaccccagtctaccttccgagagatacaggacaagtggagccccccctgagtccaatcctggagatgtgaagggcgaaggaacccggaagaataatatggagatcacctggacccccatgaatgccacctcggccttcggtcccaaccttcgatacatcgtgaaatggcgaaggagagaaacccgggaggcgtggaacaacgtgactgtgtggggctccagatatgttgtggggcaaacccccgtctatgtcccatacgagatacgggttcaggctgagaacgattttggcaaaggcccggaaccagaaagtgtgatcggatactcaggcgaggactaccccagagccgcccctaccgaggtcaaggttcgcgtgatgaactccaccgctatcagccttcagtggaacagagtttattccgacacggtgcagggacagctcagggagtatagggcttattattggagagagagtagcctgcttaaaaacttatgggtctctcagaaacgccagcaggctagtttccccggtgatcgtcttaggggtgtcgtatctaggctcttcccatattctaattacaaacttgaaatggtcgtagtcaatggcaggggtgatgggccacggtctgagacgaaagaatttacaactcctgaaggtgtgccatctgcacctagacgtttcagggtcaggcagcccaacctggaaacgattaatctggaatgggatcaccctgagcaccccaatggtatcatgatcggctacacattgaaatatgtcgccttcaacgggactaaagtgggaaagcagattgtggaaaactttagtcccaatcaaacaaaatttacggtgcagcgcaccgatcctgtctcccgatatcgcttcacactgtccgcaagaactcaagttggcagcggcgaggcagtcactgaagagtctccagccccgcctaatgaggggagtccagtgatgagccctccaacgttgccgcccactacagttggtgcgacaggcgccgtgagcagcaccgacgccaccgctattgccgcgaccacggaagccactactgtaccaataattcctactgttgctccgactaccatcgccacaaccaccaccgtggctacaaccactaccaccaccgcagctgccaccactacaaccgagtcgccaccaacaacgacctcgggcactaaaattcacgaaagcgcttacacaaacaatcaagctgacatcgccacgcaggggtggttcatcggactcatgtgcgcgattgctttgcttgtcctgatcttgcttatagtttgcttcatcaagagatcaaggggcggcaagtacccggttcgggagaagaaggatgtgcccctgggtccggaagatcccaaggaggaagacggatcgtttgactacagcgatgaagataataagcctctgcagggttctcagaccagtctggacggaacaattaaacagcaagagtctgacgactccctggtggactatggtgaggggggcgagggacagttcaacgaggacggtagctttattggacagtacactgtgaagaaggacaaagaagaaacggaaggcaacgaatcttccgaggctacatcccccgtaaatgctatctacagcctggcttag

SEQ ID NO: 49036 - DNA, 3675 bp, Artificial Sequence
  Description of Artificial Sequence: Synthetic coding sequence
atggcccggcagcccccccccccctgggtgcacgccgccttcctgctgtgcctgctgagtttagggggggcgattgagatccctatggaccctaacccacagcacaggctgactcagccacctaccattactaaacagtctgccaaagaccatatcgttgaccctcgcgataatatacttattgagtgtgaggctaagggcaatccagcaccgtcctttcattggacccgaaactcccgcttctttaatattgccaaagatcctcgcgtctccatgcgccggaggagcggcacactggttatcgattttcggtctggtgggcggcccgaagagtacgaaggtgaataccaatgctttgccaggaataagtttggcaccgctctgagcaacagaattagactccaggtgtctaaaagccctctgtggccaaaagaaaatttagacccagtggtggtgcaggaaggcgcacccctcacactacaatgcaacccaccccctgggctgccgagcccagtcatcttctggatgtcttcatctatggaaccaatcacacaagataagagggtgtctcagggccataatggggatctctattttagcaacgtgatgctgcaagacatgcagaccgactattcttgcaacgccagattccattttacccatactatacagcagaagaatccattcacgctcaaggtgctgactacccgaggtgttgcagagagaacgcccagcttcatgtacccccagggcaccgcatcttctcagatggttctccggggtatggatcttttgttggagtgtattgcctccggcgttccaacccccgatatcgcctggtacaagaaaggaggcgatttaccatcggacaaggcaaaattcgagaacttcaataaggcgctccgcataaccaacgtgagtgaggaggactcgggagagtacttctgcctggctagcaataaaatgggctccatcaggcatacaataagtgtgcgggtcaaagccgccccttactggcttgatgagcccaaaaatttaatcctcgcgccgggggaggatgggagactggtctgccgagcaaacggaaacccaaagcccactgtgcagtggatggtcaatggggaaccactccagagtgctccacccaatccaaatagggaggtggctggagatacaattatcttccgcgatactcagatctcctcccgagctgtgtatcagtgtaataccagtaatgagcatgggtacctgctcgccaacgcctttgtgtccgtgctcgatgtcccaccaaggatgctgagtccacgcaaccagttgatccgcgttatactgtataatcggacccgcctggactgcccattctttggctctccgatacctacacttaggtggtttaagaatggacagggcagtaatcttgatggagggaattaccacgtctacgaaaacggtagccttgaaattaaaatgatacggaaagaggaccaagggatatacacatgcgtggccacgaatatccttggcaaagccgagaatcaagtgcgactggaggtcaaagacccaacccgcatttataggatgccggaggaccaggtcgctagacgggggacaactgtccagctcgagtgccgggttaaacacgatccttccctgaagctcaccgtcagttggttaaaagatgatgaaccactgtacataggcaataggatgaaaaaggaggacgattcgctcacaatcttcggggtcgcggagagagatcagggaagctacacatgtgtggcatctaccgagcttgaccaagacttagctaaagcctatctgacagtgttagccgatcaggcaacccccaccaatcgcttagcagctctgccaaaagggcgcccagacaggcctcgagacctggaactgacagatctggctgagaggagcgtccgtctgacttggatcccaggggacgcaaataattcacccatcaccgattatgttgtacagtttgaggaggaccagttccaaccaggtgtttggcatgatcactccaagtatcccggatcagtcaacagtgccgtcctgagactgagcccatacgttaattaccagtttcgtgtcattgcgattaatgaggtaggatcctcacacccctcgcttcctagtgagcgctatcggacgtcaggcgccccacccgaatcaaaccctggagacgtcaaaggcgaaggaacacgaaagaataacatggagattacttggacaccaatgaatgcgactagtgctttcggtcctaaccttcgctatattgtcaagtggcggcggcgagaaacgcgcgaggcctggaacaatgtgacagtgtggggcagccggtatgtagtgggacaaacacctgtgtatgtgccttatgagatccgggtccaagccgagaacgacttcgggaaaggacctgagccagaatctgtgatcggctattctggtgaagactatccacgggccgccccgactgaggttaaagttagggtgatgaactcaactgctatcagcttgcaatggaatagggtgtacagcgacacagtgcaaggccaactgagagagtatcgggcatattattggagggaatccagtctgttgaagaacttgtgggtgtctcaaaagaggcagcaggccagctttccaggcgataggctcagaggagtggttagccggctctttccctacagtaactacaaacttgaaatggtggtcgtgaatggtcgcggagatggaccccgatccgagacgaaggagtttaccaccccagagggcgttccctcagcaccccgaaggtttcgtgttcgtcagccaaacctagagacaatcaatctggaatgggaccaccctgaacacccaaacgggattatgattggatatacactaaagtatgtggcttttaacggcactaaagttggcaagcagattgtggaaaatttttctcccaatcagactaaatttacggtgcaaagaacagatcccgtatccaggtataggttcaccctgagcgctcgcacccaagtagggagtggcgaagccgttactgaagaatccccagcacctcctaatgagggtaatcacacgaagaagaccgtccccgtgaaagcacaggcccaaccaatccagttgactgacctgtatcctggtatgacgtatactttacgcgtctatagtcgagataatgaaggcatctcctctacagtcataacatttatgacctccaccgcgtataccaataatcaggccgatatcgccacacagggatggttcataggactgatgtgtgccattgccctgcttgtcctgattctgctcattgtctgcttcattaagagaagtcgtggcggaaagtacccagtccgggagaaaaaagacgttcccctgggcccggaggacccaaaggaggaggacgggagttttgattactccgacgaagacaataaaccgctccaggggtcacagacgagtcttgacggcacaattaaacaacaagagtctgacgacagtctcgtagactacggcgagggtggggaaggccagtttaatgaagacgggtcattcatcggtcaatacacagttaagaaagacaaggaagaaactgagggcaacgagtcctcggaggccacaagccccgtaaacgctatttattctctggcatag

SEQ ID NO: 49037 - DNA, 3723 bp, Artificial Sequence
  Description of Artificial Sequence: Synthetic coding sequence
atggcccggcagcccccccccccctgggtgcacgccgccttcctgctctgcctgctgtccctgggcggagccatagagattcctatggacccgtcgattcagaacgaattgactcagcctcctaccatcactaagcagtccgctaaggatcacatagtcgatccaagagacaatattctgattgagtgtgaggctaagggaaatcctgcaccatcctttcactggacacgcaacagccgctttttcaatatcgcaaaggatccaagggtgtcaatgcggagaagatccggaaccttggtgatagattttcgctccggagggagaccagaggaatatgaaggcgaataccagtgtttcgcgaggaacaagtttggcacagccctctctaatagaattcgccttcaggtgtccaaaagcccgctctggcccaaggaaaacctggaccctgttgtggtccaggagggcgcgcccctgactctgcagtgcaaccctcccccaggtctgcccagtcccgtgattttctggatgtcctcaagcatggagcccatcacccaggacaaacgtgtgtctcagggccacaacggcgacctatatttttctaacgtcatgctgcaggatatgcagactgactattcctgcaacgcgcggttccactttactcacactattcaacaaaagaacccttttactctcaaagtgcttactacacggggtgtagctgagcgcaccccctcattcatgtatccgcagggcactgcctcctctcagatggtcctgagagggatggacttgctactggagtgcattgcttccggcgtccctaccccagacatcgcctggtacaaaaagggtggtgatctcccgagcgacaaggccaaatttgaaaacttcaacaaggccctccgcatcacaaatgttagcgaggaggatagcggcgagtatttttgtttggccagtaacaagatggggtccatcagacataccatcagcgttagagtcaaagctgccccttactggctggacgagcccaagaacctgattttggctcccggggaagatgggcgacttgtctgtcgcgcaaacggcaatcccaaaccgacagtacagtggatggtgaacggagaaccgctacagagtgctcctcctaatccaaatcgtgaagtcgctggggacaccattatctttcgagacacccagataagtagtagggcagtgtatcagtgcaatactagtaatgaacacggatatctccttgcgaatgcctttgtgtccgtgctggacgtgcctccccgtatgctcagtccgagaaaccagctgattcgggtaatactgtataataggacgcgcttagactgtccattctttggctccccaattccaacccttaggtggttcaagaacggtcagggttctaacctggacggaggaaattaccatgtctacgaaaatggaagccttgagataaagatgatccgcaaggaagaccaagggatctatacctgcgttgctacaaatattctgggcaaagctgagaatcaggtcagattagaagtgaaagatccgaccaggatctatcgcatgcccgaagaccaggtcgctcgaagagggaccaccgtgcagttggaatgccgggtcaagcatgacccaagccttaagcttactgtgtcttggttgaaggacgacgagcccctgtatatcggtaatcgtatgaaaaaggaggacgacagcctgactatttttggagtcgcagagagagaccagggctcttatacttgtgtagcgagcacggagctggatcaagatcttgccaaggcttacctgaccgtgctggccgaccaggccacacccactaatcggctagccgccctacccaagggacgccccgatcgtccccgcgatttggaactgacagatctagcagaacggagcgtgagactgacatggatcccaggggatgccaacaactcacctatcacagactacgtcgtccagttcgaagaggaccagtttcaacctggcgtttggcatgaccattccaagtacccgggctccgtgaatagcgccgttctgagactgtctccgtacgtcaactatcagttcagagtgatcgcaattaatgaggtggggtcatcacatcccagcctgccaagtgagcgataccggacaagtggggccccacctgagagcaatcccggagatgtgaaaggtgaaggaacgaggaaaaacaacatggagattacctggacccctatgaatgccacaagcgcttttggtcccaacctccggtacattgttaagtggcggagacgcgaaacccgagaggcctggaataacgtcacagtgtggggcagcagatacgtcgtagggcaaactccggtatacgtcccctacgagataagagtacaggctgagaacgacttcgggaaaggcccagagccagagtccgttattggctacagtggggaagatctacctagtgcgccacgtaggttcagagtgcggcagcccaacctggagaccataaacctcgagtgggaccacccagagcatccaaacggtattatgatcggttatacgttgaagtacgtcgccttcaatggtactaaagtcggcaaacagatcgtggaaaacttctctcctaatcagactaaatttacggttcagcgcaccgatcctgtgtcgcgatatcgatttactctcagcgcacggacacaggtaggatccggggaagctgtaactgaagaatcaccagccccgcctaatgaggccactccaactgcagcccctcccacattacccccaaccaccgtgggtgctactggggcagtttcatccaccgatgccactgccatcgccgccaccacagaggctaccaccgtcccaatcatccccaccgtggccccgaccacgattgctacaacgaccactgtcgcgacaaccacaacgacaactgcggcggctaccaccaccactgagtcccctcccaccaccacttcaggaacaaagatccacgaaagtgcaccagatgagcaatccatctggaacgttaccgtcctgccaaatagtaagtgggcaaacattacgtggaaacacaattttggacccggtacggacttcgttgtggaatatattgacagtaaccataccaaaaagactgtaccagtcaaggcccaggctcagcccatccagctgacggatctctaccccggtatgacttatactctccgtgtatactctcgggataatgaaggtatttctagcacagtgatcactttcatgacaagcacagcttacaccaacaatcaggctgatatcgccactcagggatggttcatcggcctcatgtgcgcaatcgccctgttagtactgattttgttaattgtgtgctttatcaagcgcagccgtgggggaaaatatcctgtgcgcgaaaagaaggacgtaccactcgggcctgaggaccccaaagaggaggacggaagctttgactactcggacgaggacaacaagccactgcaaggttctcagaccagccttgatggaaccatcaaacagcaggaaagcgatgacagtctggtggattatggcgaaggcggcgaagggcaattcaatgaggacgggtcattcatcgggcagtacacggtcaagaaagataaggaggaaaccgaaggcaatgagagtagcgaggccaccagcccagtgaacgcgatttactccctggcttag

SEQ ID NO: 49038 - DNA, 3510 bp, Artificial Sequence
  Description of Artificial Sequence: Synthetic coding sequence
atggcccggcagcccccccccccctgggtgcacgccgccttcctgctgtgtctgctctccctgggcggggcaatcgagattcctatggacctgactcagccacccacaattacgaaacagtccgccaaagaccatatcgtcgatcctagagataatatcctcatcgaatgcgaagctaaaggaaacccagccccctcttttcactggacccggaacagccgcttttttaatattgccaaagaccctcgtgtgtcaatgaggcggcggtccggcactctggtgatcgactttcgttccggcggacggccagaggaatacgaaggcgagtaccaatgcttcgctagaaacaaattcgggactgcactgagcaacagaattcgcctgcaagtaagcaagtcccctctttggcccaaagagaacctggaccccgtagtggttcaggaaggtgctcccttgacactccagtgcaaccctcctcccggactgcccagtcccgttatcttttggatgtcttccagcatggagcctatcacacaggataaacgcgtgtctcaggggcataacggggacctgtacttctccaatgtcatgttacaggatatgcagaccgattattcttgcaatgctcggttccatttcactcatacgattcaacagaaaaatccttttacactcaaggtccttactaatcacccgtacaacgacagttcactcagaaaccacccagacatgtacagcgcgcgtggagtggctgaacgtacgccgagcttcatgtacccccaggggaccgctagtagccagatggtgcttagaggcatggatctattattggaatgtatcgccagcggagtgcctacgccagatatcgcctggtacaaaaaaggaggtgacttaccttcagacaaggccaaattcgagaacttcaacaaggccctcagaataaccaacgtctcagaggaagacagcggagaatacttctgcctggcttcaaataaaatgggaagtattcgtcatacaatcagtgtgagggtgaaggccgccccctactggctcgatgaaccgaagaatctgatcctggcacccggagaagacggtcgactcgtgtgccgtgcgaacggtaatcctaaacccaccgtgcagtggatggttaacggtgagccactacagtccgcacctcccaatcctaaccgcgaggttgcgggggatacaataatctttcgagacacacagattagtagtcgggcggtgtatcaatgcaacacatccaacgagcatggctacctccttgcaaacgccttcgtctcagttcttgacgtgccccccagaatgttaagccccaggaaccagcttatcagagtgattctgtataacagaactcggctggattgcccctttttcggttcacccatccctaccctgaggtggttcaagaatgggcagggctcaaatttagacggagggaattaccacgtttacgaaaatggatccctcgagattaaaatgatccggaaagaggaccagggcatttacacatgtgtggccaccaatatactcggcaaagcggagaaccaggttcggctcgaagtcaaggacccgactcgtatctatcgcatgcctgaggatcaggtcgcccgaaggggaacaactgttcagcttgagtgccgggtgaaacatgatcccagcctgaaactcacagtgagctggctcaaggacgatgagcctttgtatattggtaacaggatgaagaaggaggacgattcactcaccatcttcggtgtagccgagagagatcaaggctcctatacctgcgtcgccagcaccgagttggatcaggatctggctaaggcctacctcactgtgcttggaaggcccgacaggccacgagatctggagctgaccgatctggctgagaggtcagtgagactcacgtggattcccggggatgcgaataactcccccattacagactatgtggtgcagttcgaggaggaccagtttcagcccggcgtgtggcatgaccactccaaatatcccgggagtgtgaatagcgccgtcctcaggctaagcccctatgtgaactatcaatttagggttattgctattaatgaagtcggctcttcacacccaagcctgccaagcgaaaggtatcgtacttctggtgcaccccccgagtccaatcctggcgatgtgaaaggggaagggaccagaaaaaacaatatggagataacttggacccccatgaatgctacttccgcctttgggcctaatctgaggtatattgttaaatggcggcggcgagagacaagagaggcgtggaacaacgttaccgtgtggggatctaggtacgtggtggggcagacccctgtgtatgtgccatacgagatccgcgtccaggcagagaatgattttggaaaaggccccgagcctgaatccgtgatcgggtacagtggcgaagactaccccagggctgccccgaccgaggttaaggtgcgcgtgatgaacagtaccgctatttctctgcagtggaaccgtgtgtactccgacacagttcagggacagctcagggaatatagagcgtattattggcgcgaatcttcactcctcaagaacctttgggtaagccagaagagacaacaggcttcttttcccggagatcggcttcgcggggtcgttagccgcttgttcccgtactcaaactataaactagagatggtggtggtgaacggacgcggggacggcccaagatccgagacaaaggaattcactacccctgagggcgtgccgtctgccccccggcgttttcgtgtgaggcagccgaaccttgagaccattaatcttgaatgggaccatcctgaacatccaaacggaattatgatcgggtacacgctgaagtacgttgccttcaatggcaccaaggtcggtaagcaaattgtagagaatttctctcctaaccaaaccaagttcaccgtgcaacgtaccgatccagtgtcaagatatcgtttcacacttagtgccagaactcaagtggggtctggtgaggccgtaacggaagagagccccgccccgccgaacgaagcatatacaaacaatcaggccgatatcgcaacccaaggctggttcatcggactcatgtgcgccatagctctgctggttctaatcttgctaatcgtgtgtttcataaagcgatctcgaggaggcaaataccccgttagagaaaaaaaggacgtaccacttggccctgaagatcctaaggaagaggacggttcattcgactattcggatgaagacaacaagcctctccaagggtcacagacttctctcgacgggactatcaagcagcaagagtcagacgacagtcttgtcgactacggggaaggaggagaaggtcagtttaacgaagacggatccttcataggccagtacacagtgaaaaaggacaaagaggagactgagggcaatgaaagctcagaggctacttcacccgtcaatgctatttactcccttgcctag

SEQ ID NO: 49039 - DNA, 3216 bp, Artificial Sequence
  Description of Artificial Sequence: Synthetic coding sequence
atggcccggcagcccccccccccctgggtgcacgccgccttcctgttatgcctgttgtccttaggaggcgccatagagattccgatggatcccaatccgcagcatcgactcacacagcctccaacgatcaccaagcagagtgccaaggaccatatcgtggacccgcgcgacaatatattgatcgaatgtgaggcaaagggaaaccccgccccttcctttcattggacgcgcaattccaggtttttcaacattgctaaggacccgcgggtgagcatgcggcgaagaagcggaaccctggtaatagatttccgaagtggaggacggccggaagagtacgaaggtgagtatcagtgtttcgccaggaataaatttggtaccgccttatcaaatcgcatacggctgcaggtgagcaaatcccccctgtggccaaaggagaaccttgaccctgtggttgtccaggagggggccccgctgacactgcagtgtaaccctccccccggtctaccaagccccgtgattttctggatgagtagctcaatggaaccaatcacccaggataagagggtgtctcagggacataacggagacctgtacttttccaacgtgatgttacaggatatgcaaactgactactcttgtaacgcccgctttcacttcacgcataccatccagcaaaaaaaccctttcacgttgaaggtgcttacaacacggggtgtggctgagcgaacaccgtcattcatgtacccgcaggggactgcatcttctcagatggtcttgcgaggcatggacctgctgctcgaatgtattgcgtccggagtaccaacacctgacattgcctggtataagaaagggggagacctccccagcgataaagctaaattcgaaaatttcaataaggcactacggatcaccaatgtctctgaggaggatagtggagaatacttttgtctggcaagtaataaaatgggatctatcaggcatacgatctcagttagggtgaaggctgctccatattggctggacgagccgaaaaatttaattttggcccccggagaagatggacgactggtatgccgcgctaatggtaaccctaagccgactgtgcagtggatggtgaatggcgaacctcttcagagcgcccccccgaaccctaaccgggaggtggctggagataccattatattcagagatacccagatctcaagccgcgccgtgtaccaatgcaatactagcaacgagcacggatacctgctggctaatgccttcgtttccgtgctcgatgtgcccccccgcatgttgagccctagaaaccagctgatccgggtgattctgtacaaccggaccaggctcgactgtccgtttttcgggtcccctataccaaccttgaggtggttcaaaaatggacagggctccaacttagacgggggcaattatcacgtgtacgaaaacggtagtttggaaatcaagatgatccgcaaagaagaccagggaatctacacctgtgtcgcaactaatatccttggaaaagccgagaatcaggtgcggctggaagtgaaggatcccactcgcatctatagaatgccagaagatcaggtggcaaggcgagggacgaccgtgcagctggaatgtagggttaaacatgatccatccttgaagcttaccgtgagctggctgaaggatgatgaaccgctgtacatcggcaacaggatgaagaaagaagacgactcacttacaatattcggagtcgccgaacgcgaccagggctcatatacctgtgttgcctccaccgagcttgatcaagacctagccaaggcttacctaactgttctcgctgatcaggctactcctacaaatcgcttagctgcactcccaaaaggtcgccctgaccggccacgcgatcttgagcttacagatttggccgaacggtccgtgaggctaacatggatccccggcgacgctaataacagccctattacagactatgtcgtgcagtttgaagaagatcagttccagcctggggtttggcacgatcattccaaataccctggtagcgtcaacagtgccgtccttaggttatctccttacgtgaactatcaatttcgcgtcatcgctattaacgaagtgggctcttcccacccttccttaccatccgagcgatatagaacttccggagcacctccagagagcaatcccggagatgttaagggcgaaggaaccaggaaaaataacatggagatcacctggacccccatgaacgctacctctgccttcgggccgaacctgaggtacatagttaagtggcggcgcagggaaacacgcgaggcctggaataacgtgacagtgtggggatctagatacgtcgtgggccagacccccgtgtacgttccatacgagattagagttcaggcagagaacgatttcggcaaggggcctgagccagagtctgtgattgggtactctggcgaggacctcccctcagcacctagacgtttcagagtgcggcagcccaacctggagaccatcaatctggaatgggaccaccctgaacatccaaacggtatcatgattggctacaccctcaagtatgtggcattcaatggaaccaaggtgggcaagcagattgtggaaaatttcagtcctaaccagactaagtttacagtccaacgcaccgatccagtgagccgctaccgcttcacgttatctgcacggactcaggttggttcaggggaagctgtgacagaggagagccctgccccaccgaacgaggggtcccccgtgatgtcctacaccaacaatcaggccgacattgctacccaggggtggttcattggactgatgtgcgccatcgcattgctggtccttattctgcttattgtgtgctttattaaaagaagcagagggggcaagtacccagtgcgggaaaaaaaggatgtccctttaggccccgaggacccaaaagaggaggacgggagctttgattactccgatgaagacaataagccattacagggaagtcaaacatccctagatgggacgatcaaacaacaggagtcggacgactccctggtggattacggcgaagggggagaagggcagtttaacgaagatggctcgtttatcggccaatacacggttaaaaaagacaaagaggagactgaaggcaatgaaagttctgaggccacaagccctgtgaacgcgatctacagcctggcctag

SEQ ID NO: 49040 - DNA, 3807 bp, Artificial Sequence
  Description of Artificial Sequence: Synthetic coding sequence
atggcccggcagcccccccccccctgggtgcacgccgccttcctgctgtgcttactatctctgggtggcgccattgagatcccgatggaccccaacccacagcatagactgacacagcctcctaccatcaccaagcagagtgccaaggaccacatcgtagaccccagagacaacattctgattgagtgcgaagccaagggtaatccagctcctagcttccactggacaagaaatagtcgtttcttcaacatcgcgaaagatcccagggtgtccatgcggcggcggtccggcacgctcgtgattgactttaggtccggtggacgcccagaagagtatgagggggagtatcaatgctttgctaggaacaagtttgggaccgcactcagcaatagaataaggctccaggttagcaagagccccctctggcctaaagagaatctggaccccgtggtggtacaggagggggcccctctgacactccaatgtaatcctccacctgggcttccatcgccagtgatcttttggatgagctcctctatggaacctattacacaagacaaacgagtttcccagggccacaatggagatctctatttttcgaacgttatgctgcaggatatgcagactgactactcctgtaacgcaagatttcattttacacatacgatccaacagaagaatccctttactctgaaagtcttgacaacacgtggggttgccgagcgtacaccctcattcatgtatccacaagggacagcgtcaagccagatggtgcttcgtgggatggatttgttgctggagtgcattgcctctggcgtgccaacaccagatatagcgtggtacaagaaagggggagatcttcccagtgacaaggcaaaatttgagaattttaacaaggcacttagaattacaaacgtgagcgaagaggactctggagagtacttttgcctagcgtcaaataagatgggtagcattcgccatacaataagcgtgcgcgtcaaggcagccccctactggctggatgagcccaagaatctgatcctggcccctggagaggatggaagactcgtgtgcagggccaatggtaaccctaagccaaccgtgcaatggatggtgaatggagaacccctgcaatctgcgccaccaaacccaaatagagaggtagccggggacacaatcattttccgggacacccagattagcagtagagccgtgtatcagtgtaacacatctaacgagcacggctacctactggctaatgctttcgtgagcgttttagacgtgcctcctcgaatgttgtctcctcgaaaccagttgatccgggtgatcctgtataaccgcaccaggctcgattgcccattttttggaagcccaatcccaaccctccgatggttcaagaatggtcaagggagcaaccttgatgggggtaattaccacgtgtatgagaatggcagcctggagatcaagatgatcaggaaggaagatcaggggatctacacttgtgtggccacaaacatactcggaaaagcagaaaaccaggttaggctggaggtcaaggatcccacccggatctacaggatgccagaagaccaggtggcgcgcagaggtacaaccgtgcagctggagtgtagggtgaagcatgatccatcattaaagctcaccgtgtcttggctcaaagacgacgagccgctgtacatcggcaatcgcatgaaaaaagaggacgactcactcactatttttggcgtggcagaaagggatcaaggcagctatacctgtgtggcatctaccgaactggaccaggatctggctaaagcgtacctcaccgttctggctgaccaggccactcccaccaatagactcgccgctctgcctaaagggcggccggaccggccaagggacctggagcttacagatctggcggagcgatctgtgagactgacttggatccctggcgatgccaacaatagtcccataacggattatgtggttcagttcgaggaagaccagttccagcccggcgtttggcacgaccactccaagtaccctgggagcgtcaattcagccgtcttacgactgtcgccatacgtgaactatcaattccgggtcatagcaattaacgaagtgggaagctctcatcctagtctgcccagcgagcgttacagaactagcggtgcacccccagagtccaacccaggtgacgtgaaaggagaggggactcgtaaaaataacatggagattacatggactccaatgaatgcgacttcagcttttggacccaacttgcgttatatcgttaaatggaggaggcgggagacaagagaggcttggaacaacgtgacggtgtgggggtcaagatatgtcgttggtcagacccccgtgtacgtgccgtacgagattagagtgcaggcagaaaacgatttcggtaagggccctgagcctgaaagcgtaataggttactccggcgaggattatccacgagctgcccccacggaggttaaggtgagagtgatgaattccaccgccattagcctgcaatggaaccgggtttattccgatactgtccagggacagctgagagagtatcgggcctactactggagagaatctagcctactgaaaaacttatgggtatcacagaagcgtcagcaggcttccttcccgggtgaccgactaagaggtgtggtgagccgcctgtttccatactcgaattacaaactcgagatggtggttgttaatggtcgtggagatggcccacgatctgaaacaaaggaattcacgaccccagagggcgtgcctagtgctcctaggcggttcagagtgaggcagcccaacctagaaacgatcaatctcgaatgggatcatcctgaacatcccaatgggattatgatcgggtacacactcaagtatgtagcttttaacgggaccaaggtaggaaaacaaatcgtcgaaaacttttcccctaaccagactaagttcactgtgcagagaactgacccggtgagcaggtataggtttacacttagtgccagaacgcaggtgggcagtggtgaagctgtcacagaagaaagccccgcacctcctaatgaggggagtccagtgatgagcccggatgaacaatcaatttggaacgttaccgtattgcctaactctaagtgggcaaatattacttggaaacataacttcggccccgggacagattttgttgtcgaatacattgactccaaccatactaaaaagacagtcccagtgaaggcgcaagcccaacccatccagctgactgacctgtaccctggtatgacatacaccctaagagtatacagccgggataacgaagggatctcatctaccgtgataacatttatgacttctactgcttatactaataaccaggctgacatcgcaacacaaggatggttcattgggctaatgtgtgccatagcgttgctggtgctgatccttctcattgtttgctttattaagcgatctcgaggcgggaagtacccggttagggaaaaaaaagacgtacctctggggcccgaggatccaaaggaagaagacggttctttcgactattctgatgaagataataaaccacttcagggatcccagacgtcgctggacgggacaatcaagcaacaggaaagcgacgactctttggttgattatggagaaggaggggagggtcaatttaacgaggacggaagttttattggacagtataccgtgaaaaaagataaggaggagaccgaagggaacgaaagctctgaggccacatctccggtcaatgccatctacagcctagcatag

SEQ ID NO: 49041 - DNA, 3999 bp, Artificial Sequence
  Description of Artificial Sequence: Synthetic coding sequence
atggcccggcagcccccccccccctgggtgcacgccgccttcctgttgtgtttgctgagccttggcggcgcaatagagatccctatggacctgtctattgaaacaactgtaacacagccaccaactatcaccaagcaaagtgccaaggaccacatcgttgatcctcgggataacattcttatcgaatgcgaggccaaaggaaatcctgccccgagctttcattggaccagaaacagccgattcttcaacattgccaaagatccacgggtaagtatgcgcaggagatcaggaacactcgtgatcgactttcggtctggggggcgacctgaagagtatgagggtgagtaccagtgcttcgcgcgcaacaagttcgggacagcattgtcaaacaggattcggctccaggtaagcaagtcacctctctggcctaaggaaaatctggaccctgtggtcgtgcaggaaggcgcaccattgacgttacagtgtaacccacctcccggacttccttccccagtcattttttggatgagttcctccatggaaccaattactcaggacaagcgagtgtcacagggacataatggtgacctctacttctctaatgtgatgctgcaagacatgcagaccgactactcttgtaatgccaggtttcacttcacccataccatccagcagaaaaatccttttactctgaaggtgttaactacaaggggcgtggcggagcggaccccctctttcatgtacccacaaggtaccgcttccagccagatggtgcttcggggcatggacctactcctcgagtgcattgctagtggggttcccacacccgatattgcatggtacaagaagggaggtgacctgccatccgacaaagcgaagtttgaaaattttaataaagcccttagaatcaccaatgtgtccgaagaagactctggtgaatatttttgcctcgcgagtaacaaaatgggctccatcaggcatactatcagtgtgcgagttaaagccgccccctattggctagatgagcctaagaatttgatattggcacccggagaggatggccgactggtgtgccgggctaacggcaaccccaagccaactgtgcagtggatggtcaacggggagccactgcaaagtgcgccgccaaaccctaaccgcgaagtcgcaggggacactattatctttagagatacccagatttcatctagggcagtgtaccagtgtaatacttccaacgaacatggatacttgcttgcgaacgccttcgtcagcgttctggacgtgccaccaagaatgctatcgccacgcaaccagctgatcagggtgatcctttacaatcgcacccggcttgattgtccctttttcgggagtcctatccctaccttgcgttggtttaagaatggccagggctcaaacttagatggcggcaattaccatgtgtacgagaatgggtctcttgaaataaagatgatccgcaaggaagatcaagggatctatacctgcgtggccactaatatcttaggcaaggccgagaaccaggtgagactggaggtgaaagatccaaccagaatttacaggatgcccgaagatcaagttgctcgccgtggcacaactgtgcaactcgagtgtcgcgtgaaacacgacccttccctgaagctgaccgtatcctggttgaaggatgacgagccactgtatatcgggaaccgaatgaagaaagaggacgattcactgaccattttcggcgtggctgagagggatcagggaagttacacctgcgtggctagcacagagttggatcaggatctggccaaggcttatctgaccgtgctcggtaggcccgaccggcctagagacttggagctcaccgatctcgctgagagatcagtcaggttgacgtggatccctggagatgcaaataattctccgattaccgattatgttgtgcagtttgaagaggatcaatttcagcctggggtatggcatgaccacagcaaatacccagggtccgtcaattctgctgtgctacgcctctccccatacgtcaattaccagtttcgagttattgccattaatgaagtcggctccagccaccctagcctgcctagcgaacgatataggactagcggcgctccacccgagagtaatccgggcgacgtgaaaggcgaaggaactagaaagaacaatatggaaatcacttggaccccaatgaacgccacctccgcatttgggccgaatctgcggtatatcgtcaaatggaggcgaagagagactcgtgaagcctggaacaacgtgaccgtctgggggtctcggtacgtcgtgggacagaccccagtttacgtgccgtacgagatccgagttcaagctgaaaatgatttcggcaaaggccccgagccagagagtgtcatcgggtattctggcgaagattaccctcgggctgctcccaccgaagttaaggtccgcgtgatgaatagcactgccatttccttacaatggaatagggtatactctgacactgtccaagggcagctgcgtgaatatagagcatattactggagagaaagctccctgctgaagaacctctgggtctcccaaaaaaggcagcaggcctcttttccaggagaccgcctcagaggcgtcgtgtctagattgttcccgtactccaactataagctcgaaatggtggtagtcaacgggcgcggcgatggtcccaggtccgaaaccaaagaattcaccacacccgaaggggtcccatctgccccacgtcgctttcgagtgcgccagccaaatctcgagacaatcaatctggaatgggatcatccagagcatcctaatggcatcatgataggttacactctgaagtatgtggcattcaatgggacaaaggtaggtaagcaaatcgtggagaatttctcccctaaccaaactaagtttactgttcaaagaacggacccagtgtcgcgctaccggtttaccttaagcgcccgtacacaggtgggcagcggcgaggcagtgaccgaagagtccccggcacctcccaatgagggtagatgcatggctgctgcccctggcgtcaagggccctagcgttggcgctactggtgctgtatcctcaaccgacgctaccgccatagcagcaaccaccgaggctacaacagtgccaatcattccgacagttgcccccactaccattgcaacgactacaacagtcgccacgaccacaactacaaccgccgccgcaaccacaacaactgaaagccccccaacgacaacttccggcaccaaaattcatgagagtgctccggatgaacagtcgatttggaatgtgacagtgttgccgaatagtaaatgggcgaacattacttggaagcacaacttcgggcctggcacagatttcgtcgtggagtacattgacagcaatcacacaaagaagacggtacccgtcaaagctcaggctcagcccatccagctaactgatctttatcctggaatgacctatactctgagggtgtactctcgcgataacgagggaataagcagtaccgtgatcaccttcatgactagcacggcctacacaaacaaccaggctgatattgcaacccaggggtggttcattggcctcatgtgtgcgattgcactactggttcttatcctgcttatcgtgtgttttattaagcggagccgtgggggcaagtatcccgttagggagaagaaggacgtacctctgggacccgaggatcccaaagaagaggacggctccttcgactacagtgacgaggataacaaaccactacagggatctcaaacctcactggatgggacaataaagcagcaagaatccgatgactccctagttgactatggcgaagggggtgaggggcaattcaacgaagacgggagttttattggtcagtacaccgtaaaaaaagacaaggaggaaactgaaggaaacgagagctcagaggccaccagtcctgtaaatgccatctactctcttgcctag

SEQ ID NO: 49042 - DNA, 4044 bp, Artificial Sequence
  Description of Artificial Sequence: Synthetic coding sequence
atggcccggcagcccccccccccctgggtgcacgccgccttcctgctctgtttgctttctctggggggcgccattgaaataccaatggatcctaaccctcagcaccgcctgactcagccaccgacaataaccaagcaaagtgcaaaagaccatattgtcgatcctagagataacatcttgatcgaatgcgaggctaaaggtaaccctgcaccctctttccactggacccggaactcccggttttttaacattgcaaaagatccacgcgtatctatgagaaggcgcagcggaacactggttatcgactttaggagcggaggccgtccagaagagtacgagggtgagtatcaatgtttcgcccgcaacaagttcgggacagcactttctaatagaatcaggttacaggtctcaaaaagcccactctggcccaaggaaaatctggaccccgtggtagtccaggagggagcccctttgaccctacagtgtaacccccctccaggcctcccctcccctgtgatcttttggatgtcttcaagcatggaacccataactcaggacaagagggtttcccagggtcacaacggggatctttacttcagcaacgtgatgctgcaagatatgcagacagactattcatgcaatgccaggttccactttacccataccatccaacagaaaaacccctttacactgaaggtgctgacaactcgcggggtggctgagaggaccccatccttcatgtacccacagggtacagcttcgagtcagatggtcttaaggggcatggatttgctgctcgaatgcatcgccagcggcgtccccacaccagatatcgcctggtacaagaagggaggggacctcccatctgataaggcaaagttcgaaaatttcaataaagcccttagaataacaaacgtatcggaagaggactcgggagagtacttctgcctagcctctaataaaatgggctcaataagacacacgatctccgttcgggtgaaagctgctccatactggctggacgagccgaaaaatttaattctcgctcctggcgaagatggacggctggtgtgtcgtgcgaatgggaatcctaaacccaccgtccagtggatggttaacggagaaccccttcagtcagctcccccaaatcccaaccgcgaagtggctggggacaccatcatctttagagatacacagatttccagtagggcagtataccagtgcaatacaagtaacgaacatggatacctgctcgccaacgcttttgtgtcagtcttggatgttccccccagaatgctcagcccgcgaaaccagcttattcgtgtgatcttatacaaccgtacccgcttggactgcccattttttggctcacctattcctaccctgaggtggtttaagaatggccagggttcaaatctggacggcggaaattaccacgtgtatgagaatggaagcctggaaattaaaatgataaggaaagaagaccagggtatctacacatgcgtggccacgaatattttgggtaaagcggagaaccaagtgagattggaggttaaagatccaacacggatttatcggatgcccgaggaccaagttgctcgaaggggtacaaccgtccaacttgagtgccgcgttaaacacgatccttctctgaagctaaccgtatcctggctgaaagacgatgaacctttatatatcggcaatagaatgaagaaggaggacgattcgttaacaatttttggcgtggcagagcgcgatcaggggagctacacttgtgtcgccagcactgagctggaccaagatctagcaaaggcctacctgaccgtactcgctgaccaggctactccaactaaccgcctggcagctctgcctaagggacggccagaccgtcctcgggacctggagcttacggacctggccgagagatctgtcagactaacttggattccaggagatgctaataactctcctatcacagactacgtggtccagtttgaagaagaccaattccaaccaggggtgtggcacgaccatagtaagtacccaggctctgtgaactccgccgttctgcggcttagcccatacgtgaattaccagttccgcgtgatcgcgataaatgaggtaggttcatctcacccttcgcttcctagtgagcgataccgaacatcaggagctcctccggaatccaaccctggggacgtaaaaggtgagggcacaaggaagaacaacatggaaattacctggactcctatgaatgctacctccgcatttggacctaacctgagatacattgtgaagtggaggaggagggaaacacgcgaagcttggaataacgtcaccgtgtggggcagccgttacgttgtgggtcagactcccgtgtatgtgccttacgagatacgcgtgcaggcagagaacgattttggcaaaggcccagaaccagaatctgtgatagggtattctggcgaggactacccacgagcagcccccacagaagtcaaggtgagagtgatgaacagcaccgctatttcacttcagtggaatcgcgtttactccgatactgtccaggggcagttaagagagtaccgagcctattactggagagagagcagtctgctgaaaaatctgtgggtttcacagaaacgacagcaagcctcattccccggggaccggctacggggcgtggtctcaagactgttcccctattcaaactacaagttggaaatggtggtggtaaatgggagaggggacggtcctagatcggaaaccaaggaatttaccacaccggagggggtcccaagcgccccccgccggttcagagtgcgccaaccgaacctagagaccataaatctcgagtgggatcacccagaacatccaaatggtataatgatcggatatactctcaagtacgtagcatttaacgggacaaaggttgggaagcagatcgtagaaaatttctccccaaaccagacaaagttcactgtgcagagaaccgaccccgtgtctcgatatagatttacgctctctgctcgcacccaagtgggatcaggcgaggcggtgacagaggaaagccctgcacccccaaatgaggggagcccagtgatgagccctcctacattgccacccactaccgtgggggccaccggggcagtgagttcaacggacgccactgccatagccgctaccaccgaggcaacaacagtccccataattcctaccgtcgctcctactaccatcgctaccaccaccaccgtcgctactactaccacgactactgctgccgccacgactacaactgagtcaccccctaccaccacttctgggacaaagatacacgaaagtgcacctgacgaacagagtatttggaacgtgactgtgcttcctaacagtaaatgggccaacatcacgtggaagcacaactttggacccggcacagactttgtggtcgagtatatagactctaaccataccaaaaaaactgttcctgtcaaagcccaagcacagccaatccagcttactgacctgtatcccggtatgacctacaccctgagagtctattcacgagacaacgaaggcatatcctccaccgtgattacattcatgacctctaccgcctatactaataatcaagctgacattgccacacagggctggtttatcggacttatgtgtgccattgctctactcgttttaatccttctgatcgtgtgcttcatcaaaaggtcccgtggcggtaagtatccagtgagagaaaagaaggatgtgcctctcggacctgaggatcccaaggaggaagacggctccttcgattacagtgacgaggacaataagcccctgcaagggagtcaaacatcacttgacgggacaatcaagcagcaagagagcgatgattccctggtggactacggggaaggaggcgagggacagtttaacgaagacggcagcttcataggacaatacaccgtgaaaaaagataaggaagagacggaagggaacgagagcagtgaggctaccagtcccgtgaacgccatttacagtctggcttag

SEQ ID NO: 49043 - DNA, 3723 bp, Artificial Sequence
  Description of Artificial Sequence: Synthetic coding sequence
atggcccggcagcccccccccccctgggtgcacgccgccttcctgctatgcctcctgtcactcgggggtgccatcgaaattcccatggaccctagcattcagaacgagctgactcagcctcccaccattactaaacagagcgccaaggaccacatcgtggacccccgtgacaatattctgattgaatgtgaggccaaaggtaaccctgcaccctctttccattggacccgcaactcacggttctttaatattgctaaagatcctcgggtatcaatgagaagaaggagcggtacgctcgtgatcgatttccgctctggtggccggccagaagaatacgagggtgagtatcagtgcttcgccaggaataagttcggcaccgcattgtctaacagaattcgtctccaagtctcaaaatccccactttggcccaaggaaaatcttgaccccgtagtggttcaggagggagcaccgctaacactgcagtgtaacccaccccctggtctgcccagccccgtcatattttggatgtcttccagcatggaacctattacccaggataaacgggtcagccaggggcacaacggcgacctttactttagtaatgtaatgctgcaggatatgcagacggactattcttgcaacgccagatttcacttcacccacaccattcaacagaaaaaccctttcaccctgaaagtgctgacaacccgaggcgttgcagagcggaccccgtcttttatgtatcctcaggggaccgcatcctcccaaatggtgctcagaggcatggacctgctcctggaatgcatagcatctggagtgccaactccagatatcgcgtggtataagaaaggaggcgacttgccaagcgataaggctaagttcgaaaacttcaacaaagcactgagaattactaatgtgtctgaagaggattccggggaatatttctgtctggccagtaataaaatgggatctatcagacataccattagtgtgcgggtcaaagctgccccctactggctggacgagcccaaaaacctcatattggctcctggcgaggacggcaggctggtctgcagggccaatggaaatcctaagccaacagttcagtggatggtgaacggcgagcctctgcagagcgccccacctaatcccaacagagaggtggccggcgatactattattttccgggatacacagatttcatcacgcgctgtgtatcagtgcaacacatccaacgagcacggttacctgctggcaaatgcttttgtgagcgtgctcgacgtgcctccccgcatgctgtcccctagaaaccagttaattcgggtgattttgtataaccgaacaagactggactgcccattctttggatctccaattccgaccctgcggtggtttaagaacggtcagggatcaaacctggacggcggaaattaccatgtgtatgaaaacggctctctggagataaagatgatcaggaaggaagatcaggggatctacacatgcgtggccactaacatcctggggaaagccgagaaccaagtgagattagaagtcaaagacccgactcgcatttatcgaatgcctgaagatcaggtggctaggagggggacgaccgtgcagctggaatgtcgcgtcaagcacgatcctagtctgaaactgacagtgtcttggctgaaggatgatgagcctctgtatattggaaaccgcatgaaaaaagaggacgacagccttacgatttttggtgtcgcggagcgagatcaaggaagctatacttgcgtggcctccaccgagttggaccaagacctcgctaaggcatacctgaccgtcttggcggaccaggctacacccacaaatcgacttgcagccctgcccaagggtcggcctgaccgtcccagggatctggagctaacagacctggcggagcgctcagtccgtttaacctggatccccggagacgctaacaactcacctatcactgattatgtagtccagttcgaggaggatcagtttcagcccggggtgtggcatgaccactccaaatatccaggctctgtcaattccgctgtcttacgcctgagtccatacgtcaactatcagttcagagtgatcgccatcaatgaagtcgggtccagccacccatctctaccatccgaacggtaccgcaccagtggagcgccaccggaaagcaatccaggagacgtaaagggcgaaggaactcgtaagaacaacatggaaatcacttggaccccaatgaatgccacctcagcctttggacctaatttgcggtatattgttaagtggaggcgaagagaaaccagggaagcctggaataatgtgactgtgtgggggtcccgctatgtagtgggtcagactcccgtgtacgtgccttacgaaattcgcgtgcaggccgaaaatgatttcggaaaaggtcctgagcccgaatcggtcattggctactccggagaagacctacctagcgccccgcgcagattccgagtgcgtcagcctaatttggaaacaatcaacctcgagtgggaccatcctgaacaccctaacggcattatgatcggatatacactcaaatacgtggcctttaatggcaccaaggtcggtaaacagatagtagaaaattttagccccaaccagaccaaatttaccgtgcaacgcactgacccggtcagccgataccggttcacgctgtcagcccggacacaggtagggtccggggaggcagtgacagaagagtcccccgctcccccaaacgaagctaccccaacggccgccccgcctaccctcccacctacaacagtgggtgcaaccggagctgtgagctcaactgatgccactgccattgccgccacaaccgaggcgacgaccgtgcccatcatcccgacagtagcaccaactaccatcgcaaccactaccacagtagcgaccactacaaccactactgcggccgcgacaaccaccactgaatctcctcccactaccacttccgggacaaaaattcatgaatccgccccagatgagcagagcatctggaacgtcacagtactgcctaactctaaatgggctaatataacctggaaacacaacttcggccccggcacagatttcgtggtagaatacatagacagtaatcatacgaaaaagactgtccccgtaaaggcccaggcccagcctatccaactaactgatttatatcccgggatgacctacaccctgagggtctacagccgcgataacgagggaatctcgtccacagtgataaccttcatgacttcaacggcatacaccaacaaccaggcagatatcgcaactcaaggctggtttattggattgatgtgtgccatagccctgttggtgctcatactgctgatagtgtgttttattaaaagatcacgcggggggaaatatcctgtccgcgagaaaaaagatgtcccacttggtcctgaggacccgaaggaagaagacggatccttcgactattctgacgaggataacaagcccctacaagggtctcagacatctctggacggcacaatcaagcagcaggagtctgatgattctctggtggattatggggaggggggagaggggcagttcaatgaagacgggagctttatcggccagtatactgtgaagaaggacaaagaggagacggagggtaatgagagctctgaagccaccagccccgtgaatgccatctactcactcgcttag

SEQ ID NO: 49044 - DNA, 1860 bp, Artificial Sequence
  Description of Artificial Sequence: Synthetic coding sequence
atggcccggcagcccccccccccctgggtgcacgccgccttcctgctctgtttgcttagtctcggtggcgcaatcgaaattccaatggacccatccatccagaatgaactgacacagccccccaccatcaccaaacagagcgctaaggatcatattgtggacccaagagacaacatattgatagagtgtgaagcaaagggcaatccggccccttccttccattggactcgaaactctagattctttaatatcgcaaaggaccccagagttagcatgcgcaggagaagcggtaccctggtcatagatttccgctcgggaggcagacccgaagaatatgagggggagtaccagtgttttgcccgaaacaaattcgggactgcattgtccaaccgcatccgactacaggtctctaaatcacccctgtggccaaaagagaaccttgaccccgtggtggttcaagaaggggctcctttgacccttcagtgcaatcccccacccggtctgccttctcctgtgattttctggatgagttctagcatggaacccatcacccaggacaaacgggtgagccaggggcacaacggagacctatatttttctaacgtgatgctgcaggatatgcagaccgattactcctgcaacgccaggtttcatttcacgcatacgatccaacagaagaacccttttaccttgaaggtcctgactactcgaggtgtggccgagcgcaccccttccttcatgtatccacagggaactgctagttcccagatggtgctcagagggatggatctcctgctggagtgtatcgcgtcaggcgtccctacccctgacatcgcttggtataagaaaggaggcgatctcccaagcgataaggctaaatttgagaacttcaacaaggccctccggatcaccaacgtaagcgaggaggatagcggtgaatatttctgtttggcctctaataagatgggcagcattcgccacaccatctcggttcgagtgaaggccgcgccatactggcttgatgaacccaagaacctgattctagcgcccggcgaggacggtaggctcgtctgcagggccaatggtaatccaaagcctaccgttcagtggatggtcaacggggaacctctgcagagcgccccccctaacccaaacagggaagtagctggggacacgatcatatttagggacacacaaatcagttctagggctgtttatcagtgtaataccagtaatgaacatggttacctcctggctaatgctttcgtgtcagtgttggatgtaccccctagaatgctctcaccccgcaaccagcttatccgcgttatcctatacaatagaactagactggattgccctttcttcggctctcccatcccaacattgaggtggtttaagaacggccagggttctaatctggacgggggcaactaccatgtatacgaaaatgggagcctggagatcaaaatgattaggaaggaagaccaagggatttatacttgcgtcgctaccaacatcctcgggaaagctgagaaccaggtgcgcctggaggtgaaagacccaacacgcatttatcggatgcctgaggatcaagtggcaaggcggggcaccactgtccagttagagtgcagagttaagcatgatccaagcctgaaactgacagtgagctggttaaaagacgacgagcccctgtatatagggaatcggatgaagaaagaagacgatagcctgacgatcttcggagtggccgaacgggaccagggaagctatacgtgcgtggctagtaccgagttggatcaggacctcgccaaggcctatctgacggtcctgggcaattgtccctgttcaccctggcattag

SEQ ID NO: 49045 - DNA, 3525 bp, Artificial Sequence
  Description of Artificial Sequence: Synthetic coding sequence
atggcccggcagcccccccccccctgggtgcacgccgccttcctgctatgcttgctttccttgggaggcgccatcgaaatacctatggatctcacgcagccccctacgatcactaaacagagcgccaaggaccacattgtcgaccctagggataacatcctcatcgaatgcgaagctaagggcaatcccgctcctagcttccactggaccaggaattccagattttttaatattgcgaaagatccacgagtgagtatgagaaggcgttctggcacacttgtgatagatttcaggagtggggggaggccggaggagtacgagggcgaatatcagtgctttgcacggaacaaatttggtaccgcactgtctaatcgtatccgcctacaagtctcaaagagtcccctgtggccgaaagagaatctggatccagtggtggtgcaagagggcgcacctttaacgctgcaatgtaacccacctcccggcctgcccagcccggtgattttctggatgtcgagttccatggaaccaattactcaggacaagcgggtcagccagggacacaatggggacctctacttcagcaacgttatgctgcaggacatgcagaccgactactcctgtaacgcccggttccacttcactcacactattcaacagaagaacccgtttacccttaaagttctgacaaaccacccatataatgatagcagccttcggaatcatcccgacatgtacagtgctcgtggcgtggccgaacgaacgccttccttcatgtatccacagggcactgctagttctcagatggttctgcgcggcatggatcttctgctagagtgcatcgcctctggagtcccgacacccgatatagcatggtacaaaaagggcggagaccttccatccgataaggccaagtttgaaaactttaataaggccctcagaattaccaatgttagtgaagaggacagcggcgagtacttctgtctcgcaagtaacaagatgggtagcattaggcataccataagtgttagagtcaaggcagcaccgtattggttggatgaaccaaaaaacttaatcctggcccctggcgaggatggtaggctggtgtgcagagccaacggcaacccgaaaccaacagtgcagtggatggtgaacggggagccactccagagtgcccctccaaatcccaaccgtgaggttgcaggggacacaatcatcttcagagatacgcagatttctagcagagccgtatatcagtgcaacacttctaacgagcacggttacttactggcaaatgcattcgtgtcagtcctggacgttccgccacggatgttatctcctcgcaatcaactgatcagagtcattctgtacaaccgtaccaggctagactgtccattctttggctcgccgattcctaccctccggtggtttaaaaacggacagggtagcaatcttgatggaggaaattaccacgtgtacgagaatggcagcctagagattaagatgatacgcaaggaggatcaaggaatttacacttgcgtggcaactaatatcttaggcaaagccgagaatcaggtaagactggaggtcaaggatcctacacgaatatatcgtatgccagaggaccaggtggcacgccgtggaactactgtacagctggaatgtcgcgtgaagcacgacccgagcctgaaactgactgtgtcttggctgaaggatgacgaacccctttatataggcaatagaatgaaaaaggaggatgactcactaactatatttggcgtcgccgaacgcgatcagggaagctatacctgcgtggcatcaacggaactggaccaggacctcgccaaagcatatctgactgtgctcgggcgcccggataggccaagagatcttgaattgacagatctcgccgagcggagcgtcagattgacatggatccctggagacgctaacaattctcctattactgattacgtggtccagttcgaggaggaccagttccagcccggtgtgtggcatgatcacagcaagtaccccggtagcgtgaactcagccgtgctcaggttatccccctatgtgaattaccagttcagggtcatagcaattaacgaggttggatcatcccatccgtcacttccttcggaacgctaccggactagcggcgcccccccagaatcaaatcctggtgacgtaaaaggcgaaggtactaggaaaaacaacatggagataacttggacccccatgaacgcaacttctgcctttggcccgaatctgagatatattgtgaagtggcggcggagagaaaccagagaggcatggaataatgtaactgtgtggggcagcagatacgtggttgggcagacccccgtgtatgtaccctatgaaatccgggtacaagctgaaaacgatttcggcaaaggccccgagccagagtctgtgatcggctatagcggtgaggactatcccagagctgcaccaaccgaggtcaaggtgagagtcatgaattccacagccatatctctgcagtggaatcgtgtatattccgatacggtccagggacagctgagggagtatcgcgcctattattggagagagagtagcctgttgaaaaatctttgggtgagccagaagagacagcaggcatcatttcccggtgaccggctaagaggtgttgtctctcgcctgttcccctactcaaactataagcttgagatggtcgtcgtgaatggccggggtgacgggccaagaagcgaaaccaaggagttcaccacgcctgaaggtgtcccatcagccccaagacgatttcgagttcggcagcctaacctggagactattaatctggagtgggaccaccccgagcacccaaacgggatcatgattggctacaccctcaaatatgtagccttcaacggaaccaaggtaggaaagcagatcgtggaaaacttttctcctaaccagacaaaattcactgtgcaaaggaccgaccctgtgagccgatatcgctttaccctatccgctagaactcaggttgggtcgggagaagccgttacagaagagtccccagcaccgcccaatgaagcaacccctaccgcagcatataccaataaccaggctgacatcgctacacaggggtggtttattggcctcatgtgcgccatcgcgctgcttgtgctcatccttctcatcgtgtgtttcatcaaaagatcgaggggcgggaagtatcctgtgcgagaaaaaaaagatgtgcccctgggacccgaggacccaaaagaagaggatgggtctttcgactatagtgatgaagataataagccactgcaaggtagtcagacaagcctggacggtacgattaagcagcaagagtctgatgatagtctagttgattacggagaagggggcgaaggacaatttaacgaggacgggagcttcatcggacaatacactgtgaaaaaggataaggaggaaacagaaggaaacgagtctagtgaggccacttcccccgtcaacgcaatttactcactcgcttag

SEQ ID NO: 49046 - DNA, 3498 bp, Artificial Sequence
  Description of Artificial Sequence: Synthetic coding sequence
atcgagatccccatggacctgacccagccccccaccatcaccaagcaatccgctaaggatcacatcgtcgatcccagagataatattctgatagaatgtgaggcaaaagggaaccccgccccttcttttcattggacacggaactcaagattctttaacatagcgaaagacccccgggtttccatgcgcagacggagcgggacgctggttatagactttaggtcagggggccgcccagaagaatacgagggcgaatatcaatgcttcgccagaaacaaatttgggacagctctgagcaaccgaattagactccaagtgtccaagagtcctctctggccaaaagagaatctggatcccgtggtggtgcaggagggagctccgctgactctgcagtgtaacccaccccccgggttgccatcccctgtgattttttggatgtctagtagcatggagccgatcacacaggataaacgggtgagtcagggccataacggagatctatatttttctaacgtcatgctacaggacatgcagaccgattacagttgcaacgctcgctttcacttcacgcacaccatccagcaaaaaaacccctttacattgaaggtgttaactaatcacccctacaatgactcctccctgagaaatcatccagatatgtactctgcccgaggcgtggccgagcggacaccctcttttatgtaccctcaggggaccgcatcaagtcagatggtcctgagagggatggacctgttacttgagtgcatagcatccggcgtgcccacacccgacatcgcatggtacaaaaagggtggagatctgccctccgataaagctaagttcgaaaacttcaataaagccctcaggataaccaatgtgagcgaggaggattccggcgaatatttttgtttggcctccaataaaatgggcagcatcagacacacaatttcggtacgcgtgaaggcggccccgtattggctggatgagccaaagaatcttatcctggccccaggggaggatggtcgcttagtgtgtcgcgccaatgggaatcccaagccaactgtgcagtggatggtaaacggcgagccccttcagtcagcgcctcccaatccaaaccgggaggtggctggcgatactataatcttcagggatacccagatcagtagtagagcggtctaccagtgtaacacatccaatgagcacgggtacttacttgctaatgcgtttgtgtccgttctggatgtaccccctagaatgctgtcaccgcggaaccaactaatcagagtgatcttgtacaacagaacccgtttggactgtccctttttcggatccccgatacccacactccgttggtttaaaaatggccaggggtccaatttggatggaggaaattatcacgtgtacgagaacgggtccctggaaatcaaaatgatccgcaaggaggaccaggggatctacacatgcgtggctaccaacatacttgggaaagccgagaatcaagtgaggctggaagttaaagacccaaccagaatctaccggatgccagaggatcaggtcgcgcgcagagggacaaccgtccagctggaatgcagagtgaaacacgacccatctctcaagctcaccgtgagctggctcaaggacgacgaacccctgtatatagggaatcgcatgaagaaggaggacgattctctgactattttcggtgtcgctgagagagatcagggtagttatacctgcgtggcatcgacagagctcgaccaggacctggcaaaggcctatcttacggttcttgccgatcaagctacccctacgaatagactagccgccctgcccaaaggccgacccgatcgaccacgggatcttgagctcacagaccttgcggaacgctcagtgagactaacatggatcccaggcgacgccaacaactcccccatcactgactatgtagtgcagtttgaagaggatcaatttcagcccggggtatggcacgaccatagcaagtatccaggaagtgtgaactctgccgtgctccgactatctccatatgtcaactaccaattccgggtcattgccattaatgaggtcgggagtagtcatcccagcctgccgagcgagcggtacaggacatcaggggccccaccagagtcaaaccccggggatgtgaaaggcgagggaacccggaagaacaatatggaaataacctggacccccatgaacgcaaccagcgcctttgggccaaacctccggtacatcgtgaagtggcgccgaagggagaccagggaagcctggaacaacgtgaccgtgtggggaagccgatacgtggtgggtcaaacccctgtttacgtcccatatgaaatccgcgtgcaggccgagaatgacttcgggaagggaccagagcccgaatcagtgatcggatatagcggcgaggactatccccgcgcagcacctacagaggtaaaggtgcgtgtcatgaattccaccgctatttccctgcagtggaatagagtgtattcagatacagtacaggggcagttgagagagtacagggcgtactattggcgcgagtctagccttctgaagaatctgtgggtgtcccaaaaaagacagcaggcctcatttcccggggatagactgcgtggcgtcgtatcgagactgttcccatattctaattacaaactggagatggttgtggtcaatggaagaggtgatggtccacgaagcgaaacaaaagaatttacaactcccgaaggcgttccgagcgcccccaggagattcagagtgcgacagccaaatctcgaaacaatcaacttagagtgggaccacccagagcatcccaatggtatcatgataggctatacactgaagtacgtcgcctttaatggcacgaaagttggcaaacagattgtagaaaatttttctcctaatcagaccaaatttaccgtacaaagaaccgaccccgtgtctcggtataggttcacactttcagctcggacccaggtgggctcaggtgaagccgtaacagaagagtcacccgctccaccaaatgaggcaactccaaccgcggcctacaccaataatcaagcagacatagctactcagggctggttcattggcctgatgtgcgctatagcactgctcgtcctcattttgctgatcgtctgctttatcaaaaggtccagggggggcaaatatccagtgagagaaaaaaaggacgttccactgggaccagaagacccaaaggaagaggatgggtcatttgattactccgacgaagacaacaaacctttacaaggctctcagacaagcttggacggcactatcaagcaacaggaatctgacgactccctcgtcgattacggtgagggtggagaaggacagtttaacgaggacggttccttcattggacaatacactgtgaagaaggacaaggaggaaacggagggcaatgagtccagcgaggctacttctcctgtaaacgcaatatactcactggcttag

SEQ ID NO: 49047 - DNA, 909 bp, Artificial Sequence
  Description of Artificial Sequence: Synthetic coding sequence
atggcccggcagcccccccccccctgggtgcacgccgccttcctgttatgtttgctctcactcgggggagccatcgagattccaatggacccctctattcaaaatgagttgactcaacctccaaccataaccaaacagtcagctaaggaccacatcgtagacccacgggacaacattctaatcgaatgcgaagctaagggaaaccctgctccgtcatttcactggactagaaactccaggtttttcaatattgccaaggatccacgggtctctatgaggcggagaagcggcacattagtgattgattttaggagcggcggtcggccagaggaatatgagggcgagtaccagtgtttcgccagaaataaattcggcaccgcactaagcaatagaatacggctgcaggtgagtaaaagcccgctgtggccaaaggagaatctcgatccggtggtcgtacaggagggggcccctttgaccctgcagtgcaatccgccaccaggactgccctcacccgtgatcttctggatgtctagctctatggagccaattacccaagataaacgggtgagccaaggacacaacggagatctatacttcagtaacgtgatgttgcaggacatgcagaccgactacagttgtaatgccaggtttcacttcacgcacaccattcagcagaaaaatcctttcactttgaaagtgttaacaactcggggagtggcggagcggacaccaagttttatgtatccacaaggcacagccagttctcagatggtcctgagagggatggacctgctccttgagtgcatcgcatccggcgtacctactcccgatattgcctggtacaaaaagggcggtgacctgccatcagataaagccaaattcgagaactttaataaggccttaagatag

SEQ ID NO: 49048 - DNA, 390 bp, Artificial Sequence
  Description of Artificial Sequence: Synthetic coding sequence
atggcccggcagcccccccccccctgggtgcacgccgccttcctgctctgtctgttgagtcttggtggcgctattgagatacccatggacccttctattcagaatgaacttactcagccaccaaccatcactaaacaatccgccaaggaccatatcgtcgaccctcgggacaacatcctgattgaatgtgaggcaaagggcaatcccgccccttccttccactggaccaggaactcccgattttttaacatcgcaaaggacccacgcgtgagcatgcgacggcgctccgggactctggtgatcgactttcgcagcggaggaaggccggaggagtatgagggcgagtaccaatgctttgccagaaataagttcgggacagccctgagctag

SEQ ID NO: 49049 - DNA, 3510 bp, Artificial Sequence
  Description of Artificial Sequence: Synthetic coding sequence
atggcccggcagcccccccccccctgggtgcacgccgccttcctgctgtgcctgctgtcccttgggggggccatagagatccccatggacctgacccagcctcctaccattaccaagcaatctgccaaagaccatatagtcgacccacgggacaacatcttaattgaatgcgaggccaagggcaatccagctccctctttccattggacgcgtaactcccggttcttcaacattgccaaggatcctcgtgtatccatgaggcgacgctccggtacattggtgatcgatttcaggtctggcgggagacccgaggagtatgagggcgagtaccaatgcttcgcccgtaacaagttcggcacggccctaagcaaccgcatcaggttgcaggtgtcaaagtccccactttggcccaaggagaatctggaccccgtcgtggtgcaggaaggtgcccccctcaccctccagtgtaaccccccccccggtctgcctagccccgtaattttttggatgagtagtagcatggaacccatcactcaggataagcgtgtctcacagggccataacggcgacttatactttagtaatgtcatgctgcaggacatgcagacggactacagctgtaacgcccgatttcactttacccacacaatccagcagaaaaacccctttactcttaaggtattgacaaaccacccatacaatgatagctctctccggaaccatcccgacatgtactcggctaggggcgtggccgagcgcactccctctttcatgtatccccagggaacagcctccagccagatggttcttagagggatggatctgttactagagtgcatagccagtggggtgcctacccccgatatcgcgtggtataaaaagggtggggacctcccatcagataaagcaaagtttgaaaacttcaataaagcacttcggatcacaaatgtttctgaggaggacagtggagaatatttttgtctagcctccaataaaatgggaagcatacgacatactatcagtgtgcgggtcaaggcagccccttactggctggacgagcccaaaaatctgatcttggctcccggggaagatggtaggcttgtgtgtagggccaacgggaatcccaaaccaactgttcaatggatggttaatggtgaacccttgcaatcggcaccccctaacccaaatcgggaggttgcgggagatacgattatatttcgggatacccagatttccagtcgggccgtgtaccagtgcaatacaagcaatgagcatgggtaccttttagcaaacgcgtttgtgtcagtcctggacgtgcccccccgtatgttgagccctaggaaccaacttatcagagtgatcttgtataatagaacgcggctggactgcccatttttcggaagtccaatccccacccttcggtggttcaagaacggccagggaagcaatctcgacggcggcaattaccacgtatacgagaacggctccctggaaatcaaaatgatcaggaaagaagatcagggtatctatacttgcgtggcaaccaacatcctggggaaagcagaaaaccaagtgcggttagaggtgaaggacccaactaggatctatcggatgcccgaagaccaagtcgccaggaggggtaccactgtccaactggaatgcagagtgaaacacgacccatccctcaagctgacggtctcttggttgaaggacgatgaacccctttacattggcaatcgaatgaaaaaagaggacgatagccttaccatttttggcgtcgcagaacgggatcagggatcgtatacgtgtgttgcttctaccgaactagaccaggaccttgccaaggcctacctgacagtcctgggcagaccagataggccacgagacctagaactgacagatcttgctgaaagatctgtgcgactgacctggattcccggggacgctaataatagccccattacagactatgtggtgcagttcgaggaggaccagttccagcctggagtttggcatgatcactccaaatatccgggttcagtcaatagcgcagtgcttcgattatccccgtatgttaactaccagtttcgcgtgattgcaataaatgaggtgggaagctctcacccttccctgccaagcgagcggtatcggaccagtggagccccccctgagtccaaccccggagacgttaagggagagggcaccaggaaaaacaacatggagattacgtggacaccaatgaacgccacttcggcctttgggcccaatcttcgctatatcgtgaaatggcgaaggcgggagacccgcgaagcttggaacaatgtgacagtgtggggcagcagatacgtggtgggccagactcccgtctacgtgccctatgaaattcgggtccaggccgaaaatgacttcgggaaaggaccagagccagagagcgtgatcggttactccggcgaggactacccacgcgcagccccaaccgaagtcaaggtccgggttatgaacagcacagctatcagcttgcagtggaatagggtctatagcgacactgttcaagggcaacttcgggaatacagggcctactattggcgggagagctctcttctgaaaaacctgtgggttagtcaaaagaggcaacaagctagctttcctggagatagattgcggggagtggtgagcaggcttttcccttacagtaactataagctggaaatggtggtagtcaatggtagaggggatggcccgaggtccgagacaaaggaattcacaacccccgaaggggtccctagcgccccaaggcgctttcgcgtgcgccaaccaaacctggagaccatcaatctggaatgggaccaccccgagcatccaaatgggattatgattggatacacactgaagtatgtggcttttaatggcactaaggtggggaagcagattgtggagaattttagtcctaatcagactaaattcactgttcagcgcaccgaccccgttagccgctatagattcactctcagcgcccgaacccaggtgggaagcggcgaggcggtaaccgaagaatcacctgccccgcctaacgaagcctacaccaataaccaagctgacatagcgacgcagggctggttcatcgggctgatgtgtgccatagctctgttagtacttattctcctaattgtgtgttttatcaagagatcgaggggaggcaaatatccagttagggagaagaaagacgtgccgctgggaccagaagatccaaaggaagaggatggctcattcgattattccgacgaagacaacaagcccctgcaagggtctcaaacttccctggacggtactatcaaacagcaggagagcgatgactcgctggtagattacggagagggcggagagggccagttcaatgaggatgggtcattcattggccagtatacagtgaaaaaggacaaggaggaaacagaaggcaacgagagttcagaggccactagccctgtgaacgccatctacagcttggcttag

SEQ ID NO: 49050 - DNA, 3525 bp, Artificial Sequence
  Description of Artificial Sequence: Synthetic coding sequence
atggcccggcagcccccccccccctgggtgcacgccgccttcctgctgtgccttctctccctgggcggggcaatagaaatcccaatggatctgactcagccacccacaatcacaaaacagagcgccaaggatcatatagtggaccccagagataatatactcatcgagtgcgaggcaaaaggcaatccagcccccagctttcattggacccgaaactccaggttctttaatatcgcgaaagaccccagggtctctatgcggagaaggtctggtacgcttgtgattgacttccgttctggagggaggcccgaggagtacgagggtgagtatcagtgtttcgcccggaataaatttggcacagcactctctaacagaattagactgcaagtcagtaaaagtcccctgtggcccaaagagaacctggaccccgtggtagttcaggagggcgcaccattaacactgcagtgcaatccaccgcctggcctccccagccctgttattttctggatgtcaagttctatggagcctataacacaggataaaagggtctcacaaggacacaatggagacctctacttctccaacgtaatgttacaagacatgcaaactgactattcatgtaacgcacggttccattttacacacacaattcagcagaagaaccccttcactctcaaggtattgacaaatcacccatacaacgattccagcctcagaaaccaccccgacatgtatagcgcacgcggtgtcgcagagcgtacaccatcatttatgtatccccagggaacagctagttcacagatggtactgcgaggcatggatctgctcctcgagtgtatcgcctctggggtgcctaccccagacattgcctggtacaaaaaaggaggagatcttcccagcgacaaggccaaattcgaaaatttcaacaaggctttacgcataacaaatgtttccgaggaggactctggggaatacttctgcctcgcaagcaataaaatgggctccattcgacacacgatcagtgtccgcgtgaaggccgccccctattggctcgatgagcccaagaacctgatccttgctccgggcgaggacggccggctggtgtgtagagctaacgggaatccaaaaccgacagtacagtggatggtaaatggggaaccccttcaatctgctccccccaatcctaacagagaggtagcgggggacaccattatttttcgggatacccagatatcctccagagctgtctatcaatgtaacacaagcaacgagcatgggtatctgctggccaacgcttttgtcagcgtgctggatgtcccacctcgcatgctgtcaccgcggaatcagcttatccgtgtgattctctacaatcggactagactcgactgccccttctttgggtctcctatcccaactcttcgctggtttaagaatggtcagggcagcaacctggatggcggtaactatcacgtgtacgagaacggcagcctggagataaaaatgatacgcaaggaggatcagggaatttatacttgcgtggctacgaacatcctaggcaaggcagaaaaccaggtacgactcgaggtgaaggatcctacccgcatttaccgcatgcctgaggatcaggtcgcccgaaggggtaccacagtccaactagagtgtagagtgaagcatgacccctcattaaagctcaccgtctcttggctcaaagacgatgagccactgtatataggaaacagaatgaagaaggaagacgactctctgactattttcggagtggccgagcgggatcagggttcatacacatgtgtggccagtaccgaactcgatcaggatttggcaaaggcctatctgaccgtgttaggtaggcccgatcgcccacgagacctggagctgacggatctggcagaaaggagtgttcggctgacatggatacctggagacgctaataactctcccataaccgattatgttgtgcagtttgaggaggaccagtttcagcctggggtatggcatgaccacagcaaataccccggaagcgtgaattcggctgtgctgcggctgtcaccctatgtcaattaccagttccgggttatagccataaacgaggtggggagctcccatccctcattaccctctgagcgctacagaaccagcggggctccacctgaatctaatcccggcgacgtaaagggcgagggcacaagaaagaacaatatggagataacatggactcctatgaatgcaaccagcgcgttcgggcctaatttgagatacatcgtcaagtggagaagacgagagacccgcgaggcctggaataatgtgaccgtgtggggaagccgctatgtggtcggtcaaactccagtttatgtcccttacgagatccgcgtccaggcggagaacgatttcggtaaagggcctgagcctgagtctgtgatcgggtactccggtgaggactatcccagagccgcacccacagaagtgaaggttcgcgtaatgaactctaccgcgatcagccttcagtggaaccgtgtctatagcgataccgtccaaggccagctgagggagtacagggcctattattggagagagagctccctcctcaaaaatctctgggtctcgcaaaaaaggcagcaggcctctttccctggcgataggttacggggggtggtgagccggctgtttccatacagcaattacaagctggaaatggtagtggttaatggcaggggggatggaccccggagcgagaccaaagagttcacaaccccagaaggtgtcccctctgcgcctcgaaggttcagagtgaggcagccaaacttagagaccatcaatctggagtgggatcatcctgagcaccctaacggaattatgattggatacacactgaagtatgtcgccttcaacggcactaaagtgggcaaacagatcgtggaaaatttctccccaaaccagacgaaattcaccgtccagagaacggaccccgtgtcccgttaccggttcactctgagcgctagaacccaagttggttccggtgaggccgtgacagaggaatcccctgccccccccaatgaggccactcctactgctgcatacaccaacaaccaggccgatatcgccacccaaggatggttcattgggcttatgtgcgccattgcccttctggtgttaattcttctgatcgtgtgttttatcaaaaggtcgagaggaggcaagtatcccgtgcgcgaaaaaaaagatgttccgctcgggcctgaggatcctaaagaggaggacggtagctttgattactccgacgaggataacaaacctctacagggatctcagaccagtctcgacgggacgatcaagcaacaggagagcgatgattccctcgttgactacggtgagggtggagagggacaattcaatgaggatggttcctttatcggtcagtatacagtgaagaaagacaaggaggaaacagaaggtaacgaaagtagcgaagcgacatctcctgtgaatgcaatttactcattagcatag

SEQ ID NO: 49051 - DNA, 1503 bp, Artificial Sequence
  Description of Artificial Sequence: Synthetic coding sequence
ctgaagttcctggccgtgctgctggccgccggcatgctggccttcctcggcgccgtcatatgcattattgcttccgtgccccttgccgctagccccgcacgagctctgccaggcggcgccgacaacgccagcgtagcctcaggtgccgcagcaagccccggcccacagaggagtctcagtgccctccacggggccggcggatccgcggggcctccagcccttccaggagcgccagctgcatctgcacatccactcccaccagggcccttattttccagattcctctgcaccccattggccgctgcctgcccttcaggggctcagcagggtgacgccgccggcgctgcccctggagagcgagaggagctgcttctgctgcaatcaacagctgaacagcttaggcagacagccctgcaacaggaagcgaggatccgggcggatcaggatacaattcgggagcttacaggcaaactgggtcgatgtgagagtggcctgcctcgcggactgcaaggagccggtccacggcgcgatacaatggccgacggcccctgggattcaccagccctgatccttgagctggaagacgcagttagggccctccgggacagaatcgacaggctagagcaggagctacccgcacgcgttaatcttagcgccgctcctgcgcccgttagcgccgtcccgactggacttcactctaagatggatcagctcgaaggacagctattggcacaggtgctggccttagagaaagagcgagtagcactgtcacactcttctcgtcggcagaggcaggaggttgagaaggaattggacgtgctgcagggccgagtggctgagctcgagcacggcagctccgcatatagtccacccgacgcatttaagatctcgatccctattcgcaataactacatgtatgctagagtgagaaaggccctgcctgagctttacgcgtttactgcctgcatgtggctccggagtcgaagttcagggaccggccagggcacaccattcagctatagcgtgcctggacaggcgaacgaaatcgtccttcttgaagcgggacatgaacccatggagctgctaattaacgataaagtggcgcagttgcccctgtctctgaaagacaatggctggcaccatatctgtattgcgtggaccaccagggatggattgtggtctgcataccaggacggcgagttgcagggctccggcgagaacttggcagcctggcatccgataaagccacacggcatcctgattctgggccaagaacaagacaccctcggaggtagattcgatgccacacaggcctttgtgggtgatattgcccagttcaacctttgggatcatgcactgaccccggctcaggttctcggcatagcaaactgtaccgccccactcctcggcaatgtgctaccctgggaagataagctggttgaagcatttgggggagctaccaaagccgcattcgatgtgtgcaaaggccgcgcgaaggcttag

SEQ ID NO: 49052 - DNA, 2526 bp, Artificial Sequence
  Description of Artificial Sequence: Synthetic coding sequence
atgaacctgctgtaccggaagaccaagctggagtggcggcagcacaaggaagaggaggcaaagaggtcatccagcaaggaagtggccccagccggctcggccggccccgcagcagggcagggccctggagtaagggtgcgggacatcgccagcctcaggaggtcccttcgaatgggcttcatgacgatgccagcatcacaggaacacaccccgcacccgtgtcgatcagccatggctcctcgatcattgtcatgccatagtgtcggatccatggacagcgtgggaggtggtccagggggtgcctctggcggtctgaccgaggacagctccacacgtcgcccccctgccaagcccagaaggcatccatccaccaagctgtctatggtgggtccgggatcaggagccgaaaccccacccagtaagaaggccggcagccagaaacctacacccgagggacgggagtcatccaggaaggtacctcctcagaaaccccggcggtcccccaatacccagctgagtgtgagtttcgacgagtcctgcccccctggaccttctccacgtggtggtaacttgcctctgcagagattgacacgtggcagtagagtggcaggcgaccccgacgtaggtgcccaggaagagcctgtttacatcgaaatggtcggtgatgttttccggggaggagggcggagtggcggcggtcttgcaggaccccctctcgggggaggggggcctactccaccggcgggagctgacagcgactccgaggaaagtgaagctatatatgaagaaatgaaatatccactgccagaggaggcgggggagggaagagcaaacggccccccccctctgacggctacttcccctccccagcagccccacgctctgcctcctcatgcccaccgccgcccggcctctgctctgccatctcgccgtgatggaacccccacaaagaccaccccctgcgagataccacccccatttcctaatcttcttcagcaccgcccaccactccttgcattccctcaggcgaagtccgcatcgcggacccccggagacggcgtgagccggctgccggttctctgtcatagcaaagaacccgccggaagcaccccagccccccaggtgccggcccgtgagagagaaactccacctccccctcccccaccacccgccgctaacttgctgcttctgggtccatcaggtcgggcccggagccacagcacgccactgcctccacagggtagtggtcagcccaggggagaacgagaactgccaaactctcactccatgatctgccctaaagcagctggagctccggctgctcctcccgcgccggcagcccttttgcccggcccgcccaaggacaaggcagtgagctatacgatggtatactccgctgtgaaggtcactacccatagcgtgttgcctgcagggcccccactcggagcgggggagccgaaaacagaaaaagagataagtgtcctgcacggtatgctgtgcacatcctcccgcccgcctgtgccaggcaaaaccagccctcacggaggtgcgatgggggccgccgccggagtgctgcatcatcgaggctgtcttgcttctccccacagcctacctgatcctactgttgggccgctgacgccgctctggacataccccgccacagccgcaggcctcaagagaccacctgcatatgaaagtctgaaagccgggggcgttttaaacaaaggttgcggtgtcggggcccccagccccatggtgaaaattcagctgcaggagcaaggtacagacggcggggcattcgccagtatcagctgcgctcacgtgatcgcttccgccgggacaccagaggaggaagaagaagaagtgggcgccgcaacgtttggagccggatgggccctgcagcggaaagttctatatggcggcaggaaggctaaagagttggacaaggtcgaggatggagcaagagcctggaatggctctgctgaaggcccaggtaaggtcgagcgcgaggatcggggccctggtaccagcggcattccagtgagaagtcagggggccgaagggctgctagcccgcatccatcacggggaccggggaggctcaagaacggcgttgccaattccctgtcagacatttcctgcttgccatcgaaatggagattttactggcggatacagattgggccggagtgcttccactagtggcgtgcgccaggtggtattacacacacccaggccctgtagccagcctagagatgcccttagtcaaccacacccagctcttcccctgcctctccccctccctccgcagcccgctagggagagggatggaaagctgctcgaagtgatcgaacggaaaagatgcgtttgcaaggaaatcaaagcaaggcacaggccagacaggggcctatgtaagcaggaatcaatgcccatcctaccttcttggcggcgcggacccgagccccgaaagtctggcacccctccatgcagacggcagcataccgtgctgtgggataccgcaatctag

SEQ ID NO: 49053 - DNA, 2529 bp, Artificial Sequence
  Description of Artificial Sequence: Synthetic coding sequence
atgaacctgctgtaccggaagaccaagctggagtggcggcagcacaaggaagaggaggcaaaaaggtcaagctctaaagaggtagccccagctgggtcagcaggaccagctgccggccaaggtcctggcgtgcgggtcagggatatcgctagtctgagacgctccctccgcatgggtttcatgacaatgccagcatcccaggagcatacgccccacccctgtagaagcgccatggcacctaggtcgctcagctgccacagcgttggcagcatggactctgttggcggtggccccggcggcgcctccggcgggctgacagaggattccagcacacggcgccccccagctaaacctcggcgccaccccagcacaaagctcagtatggttgggcctggatccggagccgagacccctccctccaagaaagcggggtcccagaaacctacgcctgaggggcgtgagagctcacggaaggtgcccccacaaaagccccgccggtcacctaacacccagctttctgtgagcttcgatgaatcctgcccacctggaccaagtcctaggggcggaaacctacccttgcaacggcttactcgcggaagtagagttgctggggacccagatgttggagctcaagaggaaccagtgtatatcgagatggtcggcgacgtgtttcgggggggaggccgcagcgggggaggactggctggaccaccactgggaggcggtggacccactcctcccgccggggcagacagtgactcagaggagagcgaagccatatatgaagaaatgaagtatcccctgccagaggaagctggcgagggccgcgccaatggcccgcctcccctgacagcgactagccccccccagcaacctcatgcactgccaccgcacgcacacagaaggcctgctagcgctctcccctcacggagggacggtactccaacgaagacgactccctgtgaaatccccccccctttccctaacctgctccagcaccgccccccgctgctcgcttttccacaggccaagagcgcatcacggacacctggagacggagtctcgcggctccctgttctttgccattccaaggaacctgctggcagcacacctgcaccgcaggtgccagcacgtgagagagaaaccccccctccacccccacccccccctgcagccaacctacttctgctgggcccctcaggccgcgcgagatcccacagtacaccgcttccaccccagggctcaggacagcctcgtggcgaacgggagctgccaaattcccattccatgatctgccctaaagcagctggagctcctgcagcaccacctgcccccgccgcactactgccaggtccaccaaaagacaaggccgtctcatacacgatggtgtatagtgcagtgaaagtcactacccactccgtgttgcctgctggtccaccattgggggcaggcgagcctaagactgagaaggagatctccgtgcttcacgggatgctgtgcacctcttcacgcccacccgtgcccggcaagacctccccccacggtggcgcaatgggcgcagcagccggtgtactccaccaccgcggctgcctggcctctccccactcactcccggaccccacggtggggccattgacccctctgtggacctatcccgctactgcggctgggctaaagcgaccgccagcctacgaaagcttgaaggcgggcggcgtcttgaacaaggggtgtggagtgggggcccccagtccaatggtgaaaatccagctgcaggagcaaggcaccgatgggggagcgttcgcttctatatcctgcgcccacgtgatagccagcgctggcacgcccgaagaggaagaggaagaagtgggtgctgccacgttcggggcggggtgggcactgcaacgtaaggtgctttatggcgggaggaaggcaaaagagctggacaccgaggttgaagacggggcccgcgcctggaacggatctgccgaaggccctggaaaagtagaacgagaagatagaggacctggaacaagcggcatcccagtgcgctcccagggagccgaggggctactggctagaattcatcacggcgatagaggagggtctagaactgccttacccattccctgccagacattccctgcttgccataggaacggagacttcaccggcggctataggctgggacgcagtgcttccacaagcggtgttagacaggtcgttctgcacactccgcgcccctgctcacagcccagagatgcactgtcccagccccatccagccctgcccctccctttgccactacctccacagcccgccagagaaagagacgggaaactgctggaggtgattgaacgaaagaggtgcgtatgcaaagaaattaaggctcgacacaggcccgaccgcggtctctgcaaacaagagtctatgcctatcctccccagctggaggaggggacctgaacctagaaagtccggcactcccccatgccgcaggcagcatacagtattatgggataccgcaatctag

SEQ ID NO: 49054 - DNA, 2358 bp, Artificial Sequence
  Description of Artificial Sequence: Synthetic coding sequence
atgggcttcatgaccatgcccgccagccaggagcacaccccccacccttgccgctccgccatggccccaaggtccctttcttgccatagcgtgggtagcatggatagcgtgggcggcggccccggcggagcctctggtgggttgactgaagattcaagtactaggcggccgccagccaaaccgcgccgtcacccatctacgaagttatcaatggtggggcctggatccggcgccgaaacccccccctctaagaaggctggcagtcagaaaccaaccccagagggacgcgaaagctcgaggaaagtgcccccccagaagcccaggagaagccccaatacgcagttgtcagtctccttcgacgaatcttgcccccccggaccttccccaagaggaggtaatttaccacttcaaaggctgaccagggggtctcgagttgccggagatccagatgtcggagcccaagaggaacccgtatacatcgaaatggttggtgacgtatttagagggggcggaaggagtgggggaggactcgctggaccgccactcggtggaggcggcccgacccctccagccggagctgacagcgacagcgaagaatccgaggcgatttacgaggaaatgaaataccccctgcctgaagaagccggagagggccgggccaacggtccccctccgctgaccgccacctcacctccgcagcagcctcacgcccttcccccacacgcacacagaagacctgcctctgcccttccttcccggcgcgatggtacgccaacaaagaccactccgtgcgagatccctcctccctttccaaatcttctccagcaccggccacccctgctggcttttccacaggctaaatccgcctcccgaaccccaggagacggagtttcgaggctgccggttttatgtcactctaaggaacctgcgggatcaacacctgccccacaagtgccagccagggagagggagacgccgccccccccaccacctcccccagcagctaatctgcttctcctgggccctagcggaagggctagaagccactcgacccctctacccccccagggaagcggacagccaaggggagagagagagctccctaattcccattcaatgatttgtcctaaagccgcaggggcccctgccgctccacctgcaccagccgccctcctgcctggccctccaaaggataaggctgtgtcctacacgatggtctacagcgccgtcaaagtcactacccatagcgttcttccagctggtccacctctgggcgccggagaacccaagaccgaaaaggagatctccgtgctgcacggaatgctctgtactagttctaggccccctgtgcctggaaaaacctccccccatggtggggcgatgggagcggccgccggggtgctccatcatcgagggtgtctggccagcccccactctctgcccgacccgacagtgggaccgctgacgcccctgtggacttatccagccacagctgctggcctgaagaggccccccgcgtacgagagtctaaaagcgggcggagtgctgaataagggttgcggagtgggcgctccctcaccaatggtgaaaatacagctgcaggagcaggggacagacggcggcgcctttgcctcaatttcgtgcgcccacgtaatcgcctccgccgggacacctgaggaggaggaagaggaggtgggagccgccacatttggggctggatgggcactgcagcggaaggttctgtacgggggcaggaaggctaaggaactcgacactgaggtcgaagatggagcccgggcttggaacggctccgcggaagggccggggaaagtcgaacgcgaggatcggggacctggaacttccgggattcccgtccgtagccaaggtgcagagggattactggctcgcattcaccatggtgaccgtggtggctctcggacggcactgcccatcccttgccagacgtttcctgcatgccaccgcaacggcgacttcacaggcgggtatcggttggggcgctctgcctcgaccagtggagtcaggcaagtggtgctgcatacccctagaccgtgctcccagccacgtgacgcactgtcacaaccccaccctgccttgccgctgccattgcctctcccccctcagcccgcccgagaacgggatggcaaactgctggaagtcatcgaacgcaagcggtgtgtgtgcaaagagattaaggcccggcataggcctgatcgcggcctttgtaagcaggaatcaatgcccatactaccatcatggcgtcggggcccagagccccgaaagtcaggcacacctccttgccgacgccaacatactgtcctgtgggataccgccatttag

SEQ ID NO: 49055 - DNA, 1962 bp, Artificial Sequence
  Description of Artificial Sequence: Synthetic coding sequence
atgatcagcagcaagatgatgagcagcaaccccgaggaggaccccctcgacaccttcttacagtacatcgaggatatgggcatgaaagcctatgacgggctcgtgatccaaaacgcctccgatatcgcgcgcgaaaacgaccgcctccgtaatgagacaaatctcgcctaccttaaggaaaaaaatgagaaacgtcgtcgccaagaggaggctattaagagaataggcggtgaggtgggaaggggtcatgaaggttcctatgtgggtaaacacttcaggatgggatttatgactatgccagctccccaggataggctgccccatccttgttcttccggcttttcagtgcgtagccaaagcttacatagtgtcggcggaactgacgatgactcctcttgcggtagtcggaggcagcctcctcccaagccgaagagagacccctccacgaaactatcgacttcctctgagactgtgtcgtccacagctgcttccaaatctggaaagacacctgagaggaccgaagctagtgctaagcccaggccacatagcgacgaatatagtaaaaaaatccctcccccgaagcccaagagaaaccccaacacccagttatcgacttctttcgatgagacctatatcaagaagcacggaccacgtcggaccagtctcccgagggacagcagcctgagtcagatgggcagccccgctggcgatcctgaagaggaggaacccgtctatattgagatggtcgggaacatcctccgagatttccggaaggaggacgatgatcagtcagaggctgtttacgaagaaatgaagtatccaatcttcgacgatctgggccaggacgcaaagtgcgactttgaccatcatagctgcagcagccaatgcgccactccaacagtccccgaccttgactttgctaaggcctcggttccatgtccccccaagggattgctctgcgatatccctccaccatttcctaacttactgtcccataggcctcctctcctagtgttccccccggcccccgttcactgctcgcccaattcagatgagtcacctctcacccccctggaggtgacgaaactgcctgtgctggagaatgtcagctatatgaagcagccagcgggagccagcccgtcaaccctgcccagccacgtgcccggccacgccaaactcgagaaagaacaggcagccgccctcgggcccgcctctgctacccctgctctttcttcttctcctcctcccccttcaacactgtacagaactcagtctcctcacgggtacccgaagtctcactcaacaagcccttctccagtatctatgggcaggtctctgacaccacttagcctgaagaggccgcctccctacgatgcggtacattccgggagcctatcccgaagctccccctcagtgccccactccactccccgcccagttagccaggatggcgctaaaatggtcaatgcggctgtcaacacctacggtgcagccccaggagggagcaggtctaggacaccaacctctccactcgaggagctgacatccctgttctccagtggacgctccctgctccggaagtctagctccggcaggcgcagtaaagagcctgcagagaaaagtactgaggaactgaaggtcaggagccatagcaccgagcccctgccaaaactcgataataaggagagggggcaccacggggcctcatcctctagagaacctgtgaaggctcaggaatgggatggtacccccggaacccctgtggtgacttcaaggctgggccgatgctccgttagcccaactctgcttgcaggaaatcacagttccgagcccaaagtgagttgcaagctcggccggagcgcttctacttccggagtgccaccaccttccgtcactcctctacgacagtcaagcgatcttcaacagagtcaggtgccctcatcgctagctaatagagattag

SEQ ID NO: 49056 - DNA, 435 bp, Artificial Sequence
  Description of Artificial Sequence: Synthetic coding sequence
atgatcagcagcaagatgatgagcagcaaccccgaggaggaccccctggacacattcctgcagtacattgaagatatgggaatgaaggcttacgacgggcttgtcatacaaaacgccagcgatattgcgcgggagaatgatcgtctgcggaatgagacgaacctcgcttatttgaaggagaagaatgaaaaacggcgcagacaagaagaggctataaagaggatcaatcgcggcaccgagtctcctaagcctcagcatggggcaatcaccaaggtgggccagcaaggcaaacggccgccctggggagtattcctgcagcgcgcctgtcagtctagtggaatgggttggaatacgagagatacctgtggacatcagagcacaagaaaaatgctgtgcgaaccacacttggtttcaggaaagccacagttccgttag

SEQ ID NO: 49057 - DNA, 498 bp, Artificial Sequence
  Description of Artificial Sequence: Synthetic coding sequence
ctggcctggcggcccggcgagcggggcgcccccgccagccggccccggctggccctactactactgctccttctgctccctctcccgtccggcgcttggtacaaacacgtagcgagtccgcgataccacactgtgggcagagccgcaggccttctgatggggctgcgccgatcaccttatttgtggcgccgtgctctaagggctgccgccggacctctggcccgggacaccctcagccctgaaccagcggcacgcgaggctccattgttactgccttcctgggtgcaggaactgtgggaaacacgccgacggtcaagccaggcgggcattcccgtgagggcgccccgatccccacgggccccagaaccagctctcgagcctgagagtctcgatttctccggcgccggccagaggctgaggagagacgtcagtcgccctgctgtcgatcccgcagcgaaccggctggggctgccatgtctagcccccggccctttttag

SEQ ID NO: 49058 - DNA, 1260 bp, Artificial Sequence
  Description of Artificial Sequence: Synthetic coding sequence
atgaaccggcacctgtggaagagccagctgtgcgagatggtgcagcctagtggaggtccggcagccgaccaggacgtgctgggggaggagtctcccctaggtaagcctgccatgcttcacctcccatctgagcagggagctccagagaccctgcagcgatgcctggaggagaatcaggagctgcgggatgctatcagacagagcaatcaaattctgagagagcgctgtgaagagttgttgcattttcaggcctcacaacgggaggaaaaagagttcctgatgtgcaagttccaggaggcaagaaagttggtggagcgcctcggacttgagaagctagatctgaagcggcagaaggagcaagctttaagggaagtggaacatctgaaaagatgtcagcagcagatggccgaggacaaagcctctgttaaggcccaagttacctcactgctgggagaactgcaggaaagtcaaagccggcttgaagcggcaactaaggagtgtcaggccttggagggacgcgccagagccgctagcgagcaggcccgacagttagagtcagagcgggaggctcttcagcaacagcattccgtccaggtggaccagctccgcatgcagggacagagtgtggaggctgctctccgcatggagcggcaggcagcaagcgaggagaaaaggaagcttgcccaactccaggtcgcgtatcatcagttgtttcaagagtacgacaaccacatcaaatcgtccgtcgttggctcagaacgcaaacgagggatgcagctggaggacctgaaacagcaactgcagcaggcggaggaggcgttggtggctaagcaggaggttattgacaagctcaaggaggaggcggaacagcataagatcgtcatggagacagtgcctgttctgaaggcccaagcagacatctataaagcggatttccaggctgaaaggcaggcccgggagaagctggcggagaagaaagagcttctgcaggagcagctcgagcagctccagcgcgagtatagcaagttgaaggcgtcttgtcaggaatcagcacgaatcgaagacatgcgtaaacgccacgtggaggtttctcaggcccctttacctccagcccctgcttacctcagctcacccctggcgctgccctcccaacggagatcaccccccgaagagccacccgatttttgttgccctaagtgccaatatcaggctcccgatatggacactcttcagatacatgtgatggagtgtattgagtag

SEQ ID NO: 49059 - DNA, 1209 bp, Artificial Sequence
  Description of Artificial Sequence: Synthetic coding sequence
atgccccccgtgagccggagcagctacagcgaggacatcgtgggctcaaggcgccggaggcgcagcagttccgggtccccaccctcaccccagagccgatgctcttcttgggatggctgttcacgctctcactctcgcggaagagaggggctcaggcccccgtggtctgaactggatgtgggagccttgtatcccttcagtcgcagtggcagtcgcggcaggctgcctcgtttccggaactatgcattcgccagcagttggtcgacaagctactcagggtaccgatatcatagacactgctacgcagaggagcgccagtctgctgaggattacgaaaaagaagagagccaccgccagcgcagattgaaagagagggagagaatcggcgagttgggagcacctgaagtttgggggccaagccctaaatttccacaactggactcagatgagcacactcccgtggaagatgaggaagaagttacccatcagaagtcaagctcaagcgattctaatagcgaagaacacagaaaaaaaaaaacttcccgctctcgtaacaagaaaaagagaaaaaacaagtcctctaagaggaaacacaggaaatatagcgactcagatagcaactctgagagcgatacaaattctgattccgacgatgacaagaagcgcgttaaggcgaaaaagaagaagaaaaagaagaaacacaaaaccaagaaaaagaagaacaagaaaactaagaaagaatctagtgattcctcctgcaaggacagcgaggaggatctctccgaagccacatggatggaacagcctaacgtggctgataccatggacctgataggacctgaagcaccaataatccacacctcccaggacgaaaaacctctgaaatacgggcacgccttgctgcctggtgagggagcggctatggccgaatatgtgaaagctggcaagcgcatccctcgcagaggcgaaattggactcacctccgaagaaatcggatcctttgagtgcagtggttacgtgatgtctggttcccggcaccgaagaatggaggccgtgcgtctaagaaaggaaaatcagatctactctgccgacgaaaaaagggctctggcctctttcaatcaggaggagagaagaaagagggagtccaagatactcgcttccttcagagagatggttcacaagaagacgaaggaaaaagacgataaatag

SEQ ID NO: 49060 - DNA, 576 bp, Artificial Sequence
  Description of Artificial Sequence: Synthetic coding sequence
atgggcaagagctgcaaggtggtggtgtgcggccaggccagcgtgggtaaaacctctatcctcgagcaactcttatatgggaaccacgtcgtgggctctgagatgatcgaaacccaggaggacatttatgtcggcagcatcgagaccgacaggggggttagagaacaggtgaggttctatgacacgcgaggactaagagacggggccgagctgcccaggcactgcttcagttgtactgatggatatgttcttgtctatagtactgacagtagggaatcttttcagcgggtggagttgttgaagaaagagatcgataaaagcaaagacaagaaggaggtcaccattgtcgtgctgggtaacaaatgtgatcttcaggaacagcggagggtggatccagacgtagctcagcactgggccaagtcggagaaggtcaaactctgggaagtgtcggtggcggacagaaggagcctgctcgaaccttttgtgtatcttgcgtctaagatgacacagccacagagcaaatctgctttccccctgagtcgaaaaaacaagggatcaggctcactggatggctag

SEQ ID NO: 49061 - DNA, 2181 bp, Artificial Sequence
  Description of Artificial Sequence: Synthetic coding sequence
atggccgcccccggcggccggggccggagcctgagcggcctgctgcctgctcagacatccctggagtacgccctgctggatgccgtaacccagcaagagaaggactctcttgtctaccagtaccttcagaaagtagacggctgggagcaggacctgtccgtacccgagtttcccgagggactggagtggctcaataccgaagaaccaatatccgtgtataaggacctgtgcggaaaaatcgtcgtgcttgacttttttacctactgctgtatcaactgcatccacctgctgccagacctccacgctctggaacatacttactcagacaaggatggactgcttatcattggagtccattcggcgaagttccccaacgagaaagtgctcgataacataaagtcagcggtgcttcgttataacatcactcatcctatggtgaatgacgccgatgcaagtctttggcaagagctggaggtgagttgctggcccacactggtgatcctcggcccgcgaggcaacatgctgtttagcttgatcggggaagggcataaagacaagctcttcctatatacatcaatcgccctgaagtactacaaggatcgtggccagattagggacaataagatcgggattaaactgtacaaggactccctgccaccctccccgctgctgtttcccggaaaggttaccgtagatcaggtgaccgataggctagtgatagcagatacgggacaccaccgcattctggtagtgtggaagaacggccaaattcagtatagcatcggaggcccaaatccggggcgtaaggacggtatcttttcggagtccaccttcaactccccccagggtgtggccattatgaacaatatcatctatgttgccgacaccgaaaatcacctgatacgcaaaatcgatctagaagcggagaaagtgagcaccgtggccggtatcgggatacagggaaccgacaaggagggcggagcaaaaggtgagcaacagccaatttcatccccgtgggacgtagtatttggaacttcaggatcagaagtgcagagaggagatatcctttggatcgcaatggctggcacccatcaaatttgggccttgctcctggactcaggcaaactgcccaagaaaaacgagttgaccaaaggcacctgcctgcgatttgctgggtcaggcaacgaagaaaaccgaaataacgcctatccacataaggccggcttcgcacaaccctcaggattatccctggctagcgaggatccttggtcgtgtctcttcgtggccgattccgaatccagcacagtccgcacagtgagcttgaaagacggggccgtgaaacacctggtggggggcgaacgtgaccccatgaacctgtttgccttcggagacgtggacggtgtggggatcaatgctaaactccagcaccccctaggggtgacttgggataagaagagaaatctgctgtacgtggccgattcgtacaaccacaaaattaaggtagttgatccgaagaccaagaattgcactaccttagccggtactggggacacgaataatgtgacctcgtcatctttcacagaaagcacgttcaatgaaccagggggattatgtattggggaaaacggtgaattgctttacgtggctgacacgaacaaccaccagatcaaagttatggacctcgaaaccaagatggttagcgtgctacctattttcaggtcagagaacgcggtggtggacggaccctttctggtggagaaacaaaagactcttccgaagcttccaaaatccgcgccttccattcgtctgtctccagtcaccgcttgcgcaggacagaccttacagttcaaactgcggctggatttaccatcaggatctaaactaaccgaaggtgtgagcagttgctggttcctgactgcagagggaaatgaatggctcttgcaggggcaaatcgcagccggtgacattgaaaacatatcatcccagccgacaatcagtctgcagattccagacgactgcctttccttggaagcaatagtcagtgtgtccgtgtttctgtactactgctccgccgattcctcggcatgtatgatgaaggccattctattctcgcaacccctccaaattacagacacacaacaagggtgtatcgcccctgttgagttgaggtacgtcttctag

SEQ ID NO: 49062 - DNA, 372 bp, Artificial Sequence
  Description of Artificial Sequence: Synthetic coding sequence
atgctgggcctggagggcccctgctgggtgggccccggccccgacggcggcttggccgtaagcgaagagttcggcgatgtacggctctttggatccgctcggcagcccctgggttctcttgggggatggacagggcacacatttgggtgccccgccggaatttgctccaacagcgagggcaacgtgattgtagcagacgaacagcggcggcaagtcacgcttttccctcgggccggcccgcctatatgtctcgtttcagaaggactcggacagccactcggagtggcttgtgctccacaggggcagttgctcgtagctgatgcaaaagacaactctattaaggtgtaccagggactcaaggaactcgcatag

SEQ ID NO: 49063 - DNA, 372 bp, Artificial Sequence
  Description of Artificial Sequence: Synthetic coding sequence
atgctgggcctggagggcccctgctgggtgggccccggccccgacggcggactcgcagtcagcgaggagtttggtgacgtgaggctgttcgggagcgcaaggcagccgctgggttccttgggaggatggacagggcacacttttggctgccctgccgggatttgctccaattctgaaggcaacgtgattgtagcggatgagcagcggcgtcaagtcaccctcttccctcgggctgggccacctatttgcctggtgtccgagggactgggccaacccctgggtgtcgcctgcgcgcctcagggccagctcctagtggccgatgccaaagacaactctattaaggtctaccaggggctgaaggagctggcatag

SEQ ID NO: 49064 - DNA, 4821 bp, Artificial Sequence
  Description of Artificial Sequence: Synthetic coding sequence
atggtggtgttcatcaacgccaagatcaagagcctgatcaagctgtttaaaaagaagacggttagcaacctagacgaggaaagcagatggacggtgcactatactgcaccatggcatcagcaggagaacgttttcctgcctactaccagacctccctgtgtggaggacctgcatcgtcaggcaaagttgaacctgaagtccgtcttgcgagagtgtgataaactccggcatgatggctacaggtcctcacagtactactctcagggccccacttttgcggccaacgcttcacccttctgcgatgactaccaggacgaagacgaagaaaccgaccagaaatgctctctgtcttcctctgaggaggaacgcttcatatctatccggagacctaagacccctgcttcttctgatttttcggatctcaacacccagactaactggactaagagcttgcctctgcctactcctgaggagaaaatgcgccagcaagcccagacagtccaagctgacgttgtacccattaatatcaccggcgaaaactttgatcggcaagcgtccctgagaagatccctcatatataccgatacactggtaaggcgacctaaaaaggtgaaaagacgcaaaaccatcacgggcgttccggacaacattcagaaggagttagcgagcgggactggccaggacgacgcggatggtcacagcgtctacacacctgaccactatagtactctcggaaggttcaattcatgccggtccgcggggcagagatccgaaacccgcgacagcagttgccaaacggaagatgtgaaagtcgttcccccaagtatgcgaaggatccgagcgcagaaaggacagggcatcgctgcccaaatgggccacttctcaggtagctctggtaacatgtccgtgctgtccgacagtgccggcatcgtattcccctcaaggctggactcggacgctggttttcattccctacctcggtctggcgcccgcgcgaatattcagtcactcgagcctaggctgggcgccttaggtccggccggtgacatgaatggcacatttttgtatcagagaggacacccacaggccgatgaaaaccttggccacttaggtggcgcaagtggaaccggcacccttctgagaccgaagagtcaagagcttcggcactttgagtccgaaaatatcatgtcccccgcatgtgtggtgtctccacacgccacttacagcacgtcaataatccccaatgcaaccctgagtagttcatctgaagtgatagccatccctacagcccagtccgcgggtcagcgggagagtaagagttccggcagcagccacgcccgcatcaaatcccgtgatcacctcatttctagacatgcagtcaagggggacccccaatcgcctgggagacactggaacgaagggcacgccaccatcctgagtcaggacctggatccacattcccctggggagcccgctctactttcactctgtgattccgctgtaccactcaacgcccccgcgaatcgagagaatggctcacaggcaatgccatataattgtagaaacaatcttgcctttcctgcccatcctcaggacgttgacggcaagtccgagtctagttattctggagggggcggccactcctctagcgaaccatgggagtataaaagcagcggcaacggccgggcatcaccattaaagcctcatttggccacaccgggctattccacaccgacctctaacatgtcctcatgctcactggatcagacatccaataaggaggacgcaggaagcctatatagtgaggaccacgatgggtattgcgctagcgtgcatacagacagcgggcatggatcaggaaatctttgtaacagtagtgacggcttcggcaatccacgccacagcgttatcaatgtattcgtgggaagggcacagaagaaccaaggagacaggtctaactatcaagacaagagcttgagtagaaacataagtcttaagaaggccaagaagcctccgctgccaccaagcaggacggactctcttagacggatcccaaagaaatccagccagtgcaatgggcaagttctgaacgagtccctcatcgctacacttcaacacagtctccagctgagccttcccggaaagtcgggaagctccccgtctcagagcccatgttctgacctcgaagagccttggctcccaaggagtcgttcccagagtactgtcagcgccggatcctcaatgactagcgccaccacacccaatgtatattccctttgtggtgccaccccctctcagtctgatacaagctctgtgaagtcagagtacaccgacccttgggggtactacattgactataccgggatgcaggaggaccctggtaatccagcaggcggttgttctacgagctctggagtccctaccggaaacgggcctgtgaggcacgttcaggaaggctcgagagccaccatgccccaggttcctggtggatccgttaagcccaaaatcatgtccccagaaaagtctcacagggttatctccccatccagcggatacagctctcagagcaatacacccactgcactaactcctgtaccggtcttccttaaaagtgtttccccagctaacggaaaagggaaacctaaaccgaaggtccccgagcgcaaatcatcgctcatctctagtgtaagtatcagctcttccagtacttcactgtcttcgtccacctcaactgagggttccggtacgatgaagaagctggatccggctgtgggaagccctccagccccacctccacctccagtgcctagccctccatttccttgccctgcggatcgctctccgtttctcccccctccacctcctgttactgactgttcccaaggcagccccctgccacactcccccgtcttccccccaccaccccctgaagccctgatcccgttctgtagtcctcccgactggtgtctgagccctccaagacctgctctgagccccatactccctgactcacctgtgtcccttcctctgccacctcctctgcttccttcctcagagcccccccctgcgccaccacttgacccgaagttcatgaaagataccagaccccctttcaccaattctggtcaacctgagtcctcgcgggggtcgctccgcccaccatcaacaaaagaagaaactagtcgaccgcctatgccgctgattactaccgaggccctccagatggtccagctgaggcctgtgcgaaagaatagcggggccgaagctgctcaactgtcggaaagaactgcccaggagcagcggactcctgtagccccccagtatcaccttaagccttcagcatttctgaagagccgcaatagtaccaacgaaatggaaagcgaatctcaacccgcatctgtaacctcatccctgcccacacccgccaaatcctcatcacagggagaccacggttcagccgcagagagaggcggccccgttagccgttccccaggagccccatctgcgggtgaggccgaagcccgcccatctcccagcactacccctctccctgacagctccccaagccgcaaacctccaccaatttcaaaaaaacctaagctctttctcgttgtacctccgcctcaaaaggatttcgccgttgaacctgcagaaaacgtgtctgaagcactccgagcggtgccgtctcccactactggagaggagggctcagtacacagcagggaggcgaaggagagttcagccgctcaggccgggagccacgcaactcatcctggaacaagtgtactggagggtggcgccgcggggagtatgagtccctctcgagttgaggctaacgtaccgatggttcagcctgacgtaagtcctgcgcctaagcaggaagaacctgccgagaacagtgccgatacaggaggcgacggagagtcctgtctcagccagcaggatggcgccgctggagtccccgaaaccaatgctgccggaagctccagcgaagcttgcgatttcctgaaggaagacggaaatgacgaggttatgaccccctcacgaccacgcactaccgaggacttgtttgcggccattcaccgaagtaaacgcaaggtgctggggcgccgggactcggacgacgaccactccagaaatcacagtcccagtccccctgttacaccaacaggcgccgcaccctccctggcaagccctaaacaggtcggctcgatacagagaagcatccgcaaaagttccactagctctgataattttaaggcgctgctcctgaagaaagggtcacggagcgatacttccgcacgaatgtcagccgccgaaatgttgaaaaacaccgatcccagatttcagagaagtcgatctgaaccctcccccgatgcaccggagtccccatctagctgctccccgtccaaaaaccgccgcgctcaagaagagtgggccaagaacgagggcctgatgccaagaagcttgagtttcagtggccctcgatatggccgcagccggacccctccgtctgcagcgagtagcaggtatagtatgcggaatagaatacagagctcacctatgaccgtcatctctgaaggcgaaggggaggccgttgaacctgtcgattccatcgcccggggcgcgttgggtgcagccgaaggctgttccctggatggcctggctagggaagagatggacgagggcggcctgctgtgcggagagggccctgcagcttcactacagcctcaggcacccggtcccgttgacggcactgcctcagcagaggggcgcgagccctcaccacagtgtggcggttccttgtccgaggaatcatag

SEQ ID NO: 49065 - DNA, 4833 bp, Artificial Sequence
  Description of Artificial Sequence: Synthetic coding sequence
atgaagaaggagggcagcagcggcagcttccggctgcagcccaacaccggctctctgtcacgcgccgtctcttggataaatttttcatccctgtcgcgccagacgaaaaggctctttcgcagcgacggcgagctgtcagtatgtgggcagcaagttgaggtggacgatgaaaactggatataccgggcccaaccccggaaagcagtgtcaaatttggacgaggaatcccgctggacagtgcactacactgcgccctggcatcaacaggaaaacgtgtttctccctactacccgcccgccctgcgtagaggacctgcatcgtcaagccaagcttaatctaaagagtgtgcttcgcgaatgcgacaagctacgccacgacgggtatcgaagttcccagtactattcacagggtccgacgtttgcggccaatgccagccctttttgcgatgactaccaggatgaggacgaggagacagatcagaaatgtagcttgagttcgtcggaggaggagcgctttatctccatccgccggcccaaaacacctgcgtcaagcgacttcagtgatctgaatactcagaccaactggacaaaaagcttacctcttccgactccggaagaaaaaatgcgtcaacaagcccagaccgtgcaggccgatgtcgtgccaatcaatatcaccgcctcaggtaccgggcaggacgatgccgacggccactccgtgtatactccagatcactatagtacattgggtaggtttaactcctgtaggtccgccggtcagcgctcagagactcgagattccagttgtcaaaccgaggacgttaaagtggtgccgccatctatgagaagaatacgcgcgcagaaagggcaggggatcgcggcccagatgggacattttagcgggagcagcgggaacatgtcagtactgagcgatagcgccggtatcgtctttccttctagattggactccgatgcaggttttcacagcctaccccggagcggagctcgggccaatatccagtctctggagccacggttgggcgctctcggcccagcaggagacatgaatgggacattcctgtaccagcgcggccacccccaagcagatgagaacctgggccacctcggcggagcctctgggaccggaacactgctgagaccgaagagtcaggagctgaggcatttcgagtccgagaatatcatgtccccagcttgtgtggtgtctccacacgccacatattcaacctctatcatccccaatgccaccctatcgtcaagctccgaggtcatcgcaattcctactgctcagtctgccggacagcgcgaatcaaagtcttcaggatcttcacatgcccggattaaatcaagggaccacctgatctccaggcatgccgtgaagggagaccctcagagcccgggacgtcactggaacgaaggacacgccacaatcttgtcccaagatctggatccgcactcccctggggagccagcattactctctttatgtgattctgccgttcctctcaacgcccctgccaatagagagaacggtagccaggcgatgccctacaattgtaggaataatcttgcctttcctgcgcacccccaggatgtggatgggaaatcagaatcttcctactccggggggggcggacactccagttcagagccctgggagtataagtccagtgggaatgggcgtgcgtctcctctcaagcctcatctggccaccccagggtatagcacaccgaccagtaatatgtcctcttgcagcctcgatcagacctccaacaaggaagatgccggcagtctgtactccgaggatcacgacggatattgtgcctcagttcacactgactccgggcatggaagcggaaacttatgtaattcttccgatggatttggaaacccgcgacattctgttattaatgtgtttgtaggccgggctcaaaaaaatcaaggtgatagaagtaactaccaggataagagccttagtcgcaatattagcctcaaaaaggctaagaagcccccactccccccatcacggacagatagtttgaggcggatacccaagaaaagttcccagtgcaatgggcaagtgttaaacgaaagcttaattgcaaccctccaacactccctgcagttgagcctgcccgggaaatccggctcatcaccttcgcagagcccatgctccgatctggaggaaccttggctccccagaagccgttcccaatccaccgtgagcgccggttccagtatgacttctgccactaccccgaatgtttacagcctgtgcggcgctacacctagtcagtccgatacaagctccgtgaaatccgagtataccgatccatgggggtactacattgactacacgggtatgcaggaggatccagggaatcccgccggggggtgttccacctcatcaggtgtgccgactggcaacggtccggtccgtcacgtgcaggaaggttctcgcgccacaatgccgcaggtgcccgggggcagcgtgaaacccaagatcatgtctcctgaaaagagccacagggtaatctcaccctccagtgggtacagttcccagtccaatacaccaactgctttgacaccagtcccggtgttccttaagagcgtaagccctgctaacggaaaaggcaagcctaagcctaaggtcccggagcgaaagagctctctcatctctagtgtgtctatatcgagttcgagcacatctctgtcaagctcaacctccaccgagggttctggcacaatgaagaaactggatccagcggttggcagcccccctgcgcctccccccccaccagttccaagccccccctttccctgccccgcagatcgttcacccttcttgcctccaccaccccctgttaccgactgcagtcaggggtccccactgccccactccccagtgttccctccccccccacccgaagcccttattcctttctgtagccctcctgattggtgtcttagcccacccagacccgccctgtccccgattttgcctgatagcccagtgagcctgccattacctcctccacttctgccctcctccgaaccaccacccgcgccccccttggaccccaaattcatgaaagacacaagaccaccgtttacaaactccggtcagcctgagtcttcgcgaggctctctgcgaccacccagcactaaggaggaaacatcaaggccaccaatgcctctgattaccaccgaggcccttcagatggtccaactaaggcctgtccgaaagaattctggggccgaggcggcccagctgtctgaaaggactgcccaggaacaacggactcctgtggctccacagtaccacctaaaaccgtccgctttcctgaagtccaggaacagcaccaacgaaatggaaagcgagtcccaaccagctagcgtgaccagcagtttgccaacccctgcaaagtcgagtagccaaggcgaccacggatctgcagcagagaggggcggtccagttagcagaagtccaggcgctccctctgcaggggaggctgaagcgcgaccatcgccatccacgactcccctgccagacagctccccctctcgcaagccccccccgattagcaagaaacccaagctgtttttggtagttccacctccccaaaaagattttgccgttgaacctgccgagaatgtgtcagaggctctccgggcagttccttctcccactacgggggaagaggggtccgtgcactcccgggaggcaaaggaatcaagtgccgcccaagcgggctctcacgcaacccatcctggtacaagtgtgttagaaggaggcgcagccggcagcatgagcccttcaagggtggaggccaacgttccaatggtgcagccagacgtgtctcccgcccccaagcaagaagagccagcggaaaatagcgccgacacgggaggcgacggggagtcatgtctgagccaacaggacggcgcagccggcgttcccgaaacaaatgctgcaggttcctcttctgaggcgtgcgacttcctcaaggaagatggcaacgatgaggtgatgacaccctcaagaccacggacgacagaagatctgtttgccgctatccacaggagcaaaagaaaggtcctgggacggcgcgattcagacgacgaccatagtagaaaccatagcccttccccccctgtgactccgactggagcagcccccagcctggcttcacccaagcaggttggcagtattcagaggagcatccggaagtcctctacttcatccgacaacttcaaagcattacttttgaagaaagggagccggtccgacacatctgcaaggatgtctgcggctgagatgctaaaaaatacagatccccgcttccagagatcaagatcagagccgtcaccggacgctcccgaaagtccaagctcgtgttccccatcaaagaacaggcgcgcccaggaggaatgggctaagaatgaaggactgatgcccagatcactgtctttttctggtccgaggtacgggagatccagaacacccccttcagcagcatcatcccgctacagtatgcgtaatcgcatacagtcttcaccaatgactgtgataagcgagggggaaggagaagccgtcgaacccgttgattccattgcccggggcgcgttgggggccgccgaagggtgtagcctggacggcttagctcgcgaagagatggacgagggaggactgttatgcggggaaggaccagcggccagcttgcagccacaggccccagggcctgttgacgggaccgcatctgccgaggggagagaaccttccccacagtgcggtggttctctgagcgaggaatcttag

SEQ ID NO: 49066 - DNA, 2130 bp, Artificial Sequence
  Description of Artificial Sequence: Synthetic coding sequence
atggagagcatgggcatggtgtacagcgtgcccagcagctgcaacgggcccaccgaaagtacgttctctacttcctggaagggggatgcttttacttacatgactccttccgctacaagccaatctaatcaggttaacgaaaatggcaaaaatccatcgtgtgggaattcttgggtttcattgaataaggtgcctcccctggtgccgaaagaagcagctacattactggtggctcgagataacccagccgggtgtagtggctccgctggttacccagagcgcctaattcagcagcggcatatgcccgaacgtccctcaaagatcggcctgttgacgtccgggaccagtaggttggagacaggtcccgggggcgcttctagattccgcgaaagaagcttatctgttccaaccgacagcggtacgactgacgtcgactatgacgaagaacagaaagctaacgaggcttgtgccctgcctttcgcatctacttcatccgagggttctaattctgccgataatatcgcttccctctcagcacagcaggaagctcaacaccgtcgtcagcgttcaaaatctatctcccttcgcaaggcaaagaagaaaccttctcctcctacccgttcggtgtcactggtcaaggatgagccagggctccttcccgaaggggggtccgcactgcctaaggatcagcggccgaagtcgttgtgtttgtcgttggagcaccagggccatcactctagtcacccagatgcccagggccaccccgcaattccaaaccacaaggacccagagtccactcaattctcccaccattggtatctgaccgactggaaaagcggtgacacataccagtcactgtcatcatctagtaccgctacaggcactaccgtgatagaatgcactcaggttcagggcagctctgaaagcttagcatcgcccagcacatctagggccactacccccagtcaactatctattgaagtcgaggcccgggagatatcctctcccgggcggccccccgggttaatgtccccctccagtgggtattctagccaatctgagactcctacccccaccgtgagtatgtcattaacactcggccacctgccacccccaagcagtagtgtgagggtccggcccgtggttcctgaaaggaagagctccctgccaccgacatccccgatggaaaagtttcccaaatcccggttaagttttgatctccctctgacatcctctcctaatctggaccttagcggaatgtcgatctctatccgttctaagacgaaggtttcccggcatcacagcgaaaccaattttggggtgaagttagcgcagaagactaaccccaaccagcctatcatgccaatggtcacccaatcagatctgcgttctgttagacttagaagtgtgtctaaaagcgagccagaggatgacattgagagccctgaatatgctgaggaaccaagagcagaggaggtttttacattacccgagagaaaaacgaagccacccgtggccgagaagccaccggtggcccggcggccccctagcttagtccacaagccaccttccgtgccggaggaatacgctctgacctcacccaccctggctatgcccccaagatcctctatccagcacgcccgccctttgccgcaggatagttacactgttgttaggaaaccaaagccctccagctttccagacggacgatcacccggggagtccactgctcccagttccttggtgttcacccctttcgcgtctagctctgatgcttttttcagtggcactcaacagccgccccagggatctgttgaagacgaagggcccaaggttcgtgtcctgcccgagcggatctctctgcagtcacaggaagaggctgagaagaagaagggaaaaattccacctcccgtccccaaaaagccaagcgtcctgtaccttccacttacatcaccaaccgcccaaatggaggcatacgtcgcggagccacggctccctctcagtccaattattacactggaggaggacaccaagtgcccagctaccggggacgatctgcagtcactggggcagcgagttacatcaaccccccaggccgattccgagagagaagcgtcccccctcggatag

SEQ ID NO: 49067 - DNA, 2130 bp, Artificial Sequence
  Description of Artificial Sequence: Synthetic coding sequence
atggagagcatgggcatggtgtacagcgtgcccagcagctgcaacggccccacagagtccaccttttcaacatcttggaaaggcgacgcatttacatatatgaccccctctgcgacatcccagtccaaccaggtcaacgaaaatggaaaaaatccatcttgtggaaacagctgggtgtcgctcaataaggttccccctctggtccccaaagaagctgcaacacttctcgtcgctagggacaatcccgctggttgctccggtagtgcaggatatcccgaaaggttaatccagcagcgccatatgccagagcgaccatccaaaattggcctcctgacgtcggggacttccaggctggagacaggccctgggggagccagccgcttccgagagcgcagcctgtccgtcccaactgactccggcacaaccgatgttgattacgatgaggagcaaaaagcgaatgaagcttgcgcattaccgtttgctagcaccagctctgaaggatccaatagcgcagataacatcgcatccctgtcagcccagcaggaagcacagcatagaagacagcggtccaagtccatttcgctgagaaaggccaaaaagaaaccgtctccgccaacacggtcagtatcactcgttaaggatgaacccgggcttctccccgagggaggctctgctctgccaaaagaccagcggcctaaaagcctatgcctatctctcgaacatcagggacatcactccagccatcccgatgcccaggggcatccagctattcctaaccacaaagaccccgagtccacacagttctcacaccattggtatttaactgactggaaaagcggggatacctaccagagcctttccagcagctctacagccactggtactacagtgatcgagtgcactcaggtacagggctcttccgagagccttgccagcccttctacctcaagagccaccacgccctcacagctatctatcgaggtcgaggccagagaaatttctagccctggccgaccacctggtttaatgagccccagcagcggctatagcagccagtctgaaacccctactcccacagtgagcatgtcattgaccttagggcacctaccacctcctagtagcagcgtgcgggtgaggcctgtcgtacccgagaggaaaagctccctgccccctacatctccgatggaaaagtttcctaaatcgcgactttcttttgatctcccgctcaccagctcccctaatctggacctgagcggcatgtccatttccatacgcagcaaaactaaagtctcaaggcaccattccgagaccaatttcggtgtaaagctcgcacagaagactaacccgaaccagccaataatgccgatggtgacacagtctgacttgcgcagtgtacggcttcggtccgttagcaaaagcgagcctgaagacgatatcgagtcaccagagtatgccgaggaacccagagcagaagaagtctttaccctgcccgaacgtaaaactaagccgccggtggccgagaagccaccagtcgcccggaggccaccaagcctggttcacaagccgccatctgtaccggaagaatacgcactcaccagtcctactctagcgatgccgccgagaagttctatccaacacgctcgaccgctcccacaggactcatacaccgtcgttcggaagcccaagcctagcagttttcccgacggacgttcacccggcgaatcaacagcccccagtagccttgtgtttacacccttcgcttctagtagcgacgcgttcttctccggcacacagcaacctcctcagggctccgtggaggacgagggacctaaagtcagggttctacctgaaagaattagcctgcagtcccaggaggaggcggagaaaaagaagggcaagattcccccacctgtccctaagaaacccagtgttctctatctgcctctcacgtcaccaacggcccagatggaggcctacgtggcagaaccacgcctgcctctctcccctatcatcacactggaggaagacactaagtgtccggccacgggggatgaccttcaaagcctgggccagcgcgtgacaagcacaccacaggctgattccgagcgcgaggcctctcccctcgggtag

SEQ ID NO: 49068 - DNA, 3678 bp, Artificial Sequence
  Description of Artificial Sequence: Synthetic coding sequence
atgcccttctaccggcggaccgtggtgccccagcggctgtgccccaggaatccaccccagcaactcgctgaacttcgcgacgtgagccacctcgccgcactgtctttgctcagacagctcgcagatctgtgcggccattcgctggcgctgttggaagacctagagggacatttattagcgttaggacggaggaccgattccctgtatagaagaaccgtccgcctgcggaggcggttgccatgcaggctgctaggacccgaagaagacgaagaagagttggccgccgccaactcaggacgtgaaaatgctactgccacggcccattcccgatcaagctggaggcaaccagttaatgtgttcctcagctcaggtcgtcctccttctgtcgaggaacttctgcgagaagcccagcttaacctgcagtctctgttacaggaggagtacgaggagcagtatagcgaggccagactggtcggtcaaacatttcgaagtagcgacgaggctaccaagcccacccccaacccgcggccacagagcgctagacggttggaatttatcttaatgccaaccaaacggcagctatctgaggacgagacaacaacccagggggtgcgggctcccgaagcttcattaagtctatcgaccactgccgacaagcagaccgcgtggaactctctgtttccacttccaattctggaagaaaagcggtggccccagctgtgcagcacccagtcggatatcgtgcccattaacataagtggacaacagtttgacaagcacgcttctcttcgacactccctgttcaacaccgaaactgcggtgaatcctaaatctacattgagaagaagaaggacaatcatcgggtttagcaacttctcacagagggaccagggccattcaaatagtcccgccggcagtgtcgctcacagcactacttccgatatccgcccctcacacagcgtaccagaaggagtgcacgggcgggtggccgtaggtcaggatgccagattcccctctcttacaagccccgtgctccgaactccgagcagtgagcctgatgaaccacatcaagcacgcagcggacctaatcctccgggtatggaaagcatgggaatggtctacagtgtcccttcgtcttgcaatgggcctacagagagcaccttttcgacttcatggaaaggggatgcatttacctacatgactccctccgcaacaagccagtctaaccaagtgaatgaaaacggcaaaaacccatcttgcggtaatagttgggtgtccctgaataaagtgcctcccctggtacccaaagaggccgctaccctgctggtggcccgcgacaatcctgccgggtgttccggctcagccgggtacccggagcggctcatccagcaaaggcacatgcctgagcggccctcaaaaataggacttctcacaagcggtactagcaggctggagacgggacctgggggcgctagccgctttagagaacggtcgctttcagtccccaccgacagcggcaccaccgatgttgattacgacgaagaacaaaaggccaatgaggcctgcgcactcccattcgcatctacatcatccgagggatccaactccgctgataacattgcaagcctctctgcacagcaggaggcccagcatagacgccagagatccaaatctatcagtcttcgcaaggcaaaaaagaagcccagcccccctacaagatcagtctcactggtaaaggacgaaccaggcctcctccccgaagggggtagtgccttaccaaaagaccagcgtcccaaatcactctgtttgagcctagagcatcagggccaccacagctctcacccggatgctcaaggccaccccgctattccaaatcacaaagatcccgagtctacccaattcagtcatcactggtatctgacggactggaagagcggcgacacttaccaaagcctgtcctcttcctccacagctactggaaccactgtgattgaatgtacccaggtgcagggttcttccgaatctctggcctctcctagcacctcacgggcaactacccccagccagctgtcaatagaagtggaggcccgcgagatttcatcccctgggcgcccccctgggttgatgagcccgagctcagggtatagcagtcaaagcgaaacccctacccccactgtttccatgtctctcactctcggacacctgccccctccttcatcaagcgtgagggtgaggccggttgttccagagcgaaaaagctcactaccgccaactagccctatggagaaatttcctaaatctcgcttgagcttcgacttgccactcacaagttcacccaacctcgatctttcaggtatgagtatatcaattcggagcaaaaccaaagtgtcccggcaccactccgagacaaacttcggggtgaagctggcacagaagaccaaccccaatcaacctattatgcctatggtcacacagtccgacttacggtccgtaagacttaggagcgtcagtaaaagtgaacctgaggatgacatagaaagtcctgaatacgctgaggagccccgcgccgaggaggtgtttacccttcctgaaagaaaaaccaagccgcccgtagctgaaaaacccccggtggctagaagaccgcctagcctagtccataaaccaccttctgttcctgaagaatatgccctgaccagtcctacccttgccatgcctccgagaagttctattcagcacgctcgacctctaccgcaggactcatacacagtcgtgaggaagcccaagccctcctccttccctgacggtagaagcccaggggagtcaaccgcaccttcctcactcgtcttcaccccttttgccagttcttcagacgccttcttttcgggcacccaacaacccccccagggttctgtagaggacgagggccccaaggtgagagttcttcccgaacggatctctctgcagtctcaggaagaggccgaaaagaaaaagggcaagataccgccaccagtgccaaaaaagccaagcgtcctctacttgcccctgaccagccctacagctcagatggaagcttatgtagcggagccgaggctgcccctatcccctatcatcactttagaagaagataccaagtgtcccgccaccggcgatgacctgcagtcgctcgggcagcgggtgactagtacacctcaggcagacagcgagcgcgaggccagcccactggggagctcggtggaacccggtacggaagaaaagtccctcatctcagacaagacagcagagtggattgccgaagatgatgatgatgtcttcgtggcctcccggaccactgaagacctgttcaccgtcatccatagatccaaaagaaagctgttaggatggaaggagcctggagaggcgtttgtcgggggccggacatctagccattcgcccataaaaaacacagcagagtcccctatttctgagagtacagcaaccgccggctcaggctcgagtgctaacttagacgccggcagaaacgacgattttaaagccctgctccagaaaaaggggtctaaagccacgccgcggtcgaggcccagcgccgccgagctactgaagactacgaatccgttagccagaaggatcatcgctcagttctccaaggattatgagacgactgacaatccaagcacttag

SEQ ID NO: 49069 - DNA, 2139 bp, Artificial Sequence
  Description of Artificial Sequence: Synthetic coding sequence
atgcccgaccaggacaagaaggtgaagaccaccgagaagagcaccgacaaacagcaggagattactataagggactactccgacttgaagcggctgcggtgtttgctcaatgtacagtccagcaagcaacagctccccgctattaacttcgatagcgcccaaaattctatgacaaaatcagaaccagctatcagggctggaggccatcgggcccgaggacaatggcacgagtcaaccgaggcggtggagctagagaatttctctattaactataagaatgagcggaacttctctaaacacccccaacgtaagttgttccaggaaatctttactgcactcgtgaagaaccggcttatctcacgggagtgggtcaacagagctccttcaatccactttctccgtgtgctgatttgtctgagattactgatgagggatccatgttaccaggaaatactgcactccctgggcgggatcgaaaaccttgctcaatacatggagattgtagctaatgaatatctggggtacggcgaggagcagcataccgtggacaaactggtcaacatgacctatattttccaaaaactcgccgccgttaaagaccaaagggagtgggtgactacatctggagctcacaagacactcgttaatcttttaggggcgcgggacacaaacgtgctgctgggtagtcttcttgcacttgccagtcttgcagagagccaggagtgcagagagaagatctcagagctcaacatcgtagagaatctactcatgatcctgcacgaatacgatctgctgtctaagcgcttaaccgcagaactcctgaggcttctctgcgctgagcctcaggtgaaagagcaagtgaagctttacgaagggatcccagtgctactgtctctcctgcattcagatcatctgaagctcctatggagcatcgtgtggattttggtgcaggtgtgtgaggacccagagaccagcgttgaaatcagaatctggggagggataaagcagctgctccacatcctccagggggaccggaactttgtcagtgaccattctagcattgggagtctgtcctctgctaatgccgccggccgcatacagcagctccacctatccgaagatctgtccccacgagagatacaggaaaataccttctccctccaggccgcgtgttgcgcagctctcacggagcttgtgctgaatgataccaacgctcaccaagtcgtacaggaaaatggcgtctatactattgccaaattgattctccctaataaacagaaaaacgcggctaagtctaatctccttcaatgttacgcatttcgcgcattacgattccttttcagcatggagaggaacagaccacttttcaaacgccttttcccgactgatctgtttgaaatcttcattgacattggacactacgtgcgcgacataagtgcatacgaagagctggtgagcaaattaaatctgttggtcgaggacgaactgaagcagatagccgaaaacatcgagtcaatcaaccagaacaaagcccccttgaagtacattgggaactatgcaatcctagatcacctggggagcggcgcatttggatgtgtatataaagtccgaaagcatagcggccagaacctgctggctatgaaagaggtgaacttgcataatcctgccttcggcaaagataagaaggatcgcgacagctctgtgaggaacattgtgtccgagttaaccatcatcaaagagcagctgtatcaccctaacatagtgagatactataagaccttcctcgagaacgatcgcttgtacatagtcatggagttgatagagggtgctcctcttggagagcactttagttcccttaaggagaagcatcaccacttcacggaagaacgcctgtggaagattttcatacagctttgtttagctctgcgctacttgcacaaagagaagcgcatagtccatagagatctgactcccaataatatcatgctgggcgacaaggacaaagttaccgtgacagattttgggctggcaaaacagaaacaggaaaattccaaactcacatccgttgtcgggaccattttgtatagctgtgtgcagcatctgtatctgagatctcctgcaccagcgctggcgacctag

SEQ ID NO: 49070 - DNA, 1215 bp, Artificial Sequence
  Description of Artificial Sequence: Synthetic coding sequence
atggagctgatcgagggcgcccccctgggcgagcacttcagcagcctcaaggagaagcatcaccacttcaccgaagagcgtctgtggaagatttttatacaactgtgcttggcactgcggtatctgcataaggaaaagcgaattgttcacagggatctcactcccaataacatcatgctaggtgataaggacaaggtgacagtaaccgattttggcctggcaaaacagaagcaagagaattctaagctcacctccgtggtcggcaccatattgtactcgtgcccagaagttctgaaatcagaaccctatggagagaaagcagacgtgtgggcagttggctgcatcctttaccagatggcaaccctctccccacctttctactccaccaatatgctcagcttggctaccaaaattgtggaagctgtgtatgaaccagttccagagggaatatactccgaaaaggtgacggacactatcagccgctgcctgaccccagatgccgaggcccggccagatatagtcgaggtgtccagtatgattagcgacgtcatgatgaaatacctagacaacctgtctacttctcaactgtcactggagaagaagctggaaagagagagacggaggacacaacggtacttcatggaggccaatcgtaatacagttacgtgccatcatgaactagccgtgctgtctcatgagaccttcgaaaaggcttccttgtcatccagttcctctggtgcggcgtctttgaaaagtgagctgagtgagtccgcagacctgccacctgaagggtttcaggcctcttatgggaaggatgaggaccgggcttgcgatgaaattctctccgatgacaactttaatctggagaatgctgagaaagacacttatagcgaagttgatgacgaactggatatctctgataactcatccagctcgtcttcttcccctttgaaagaaagtactttcaatatactgaagagatccttttcggccagtggaggggaacgacagtcgcagacccgagacttcactggaggtaccggcagcaggccacgacccgctttgctgccactagatttgctgttgaaagtgcccccacacatgctcagagcccacattaaagaaattgaggcggaactggtcaccggttggcagtctcactccctacccgcagtgattctccggaacctgaaggaccacggctctacctattag

SEQ ID NO: 49071 - DNA, 1284 bp, Artificial Sequence
  Description of Artificial Sequence: Synthetic coding sequence
atggtgcccgtgcagcccgccgagccccccgaggtgctgaagagcgaaccatacggagaaaaggccgatgtgtgggcggtgggttgcattctataccagatggcaactctgtcgccgcctttttattctacaaatatgctcagtctcgccaccaagattgtcgaggcagtctacgagcctgtgccagaggggatttattccgaaaaagtgactgacaccatctcgcggtgtttaacccctgacgccgaagcacgccccgacattgtggaagtttcatcgatgatcagtgacgttatgatgaaatatctggacaatctatcaacttcacagctgagcctggaaaaaaaacttgaacgtgagcgccggagaacgcagcgctattttatggaagccaacagaaataccgtgacttgtcaccacgagctggcggtactgagtcacgaaacatttgaaaaagcctcgttgagttcttcttcatcaggtgccgccagtcttaagagtgaactttccgagagcgcggaccttccacccgaggggttccaggcatcttatgggaaggacgaggatagggcttgcgacgaaatcttgtctgacgacaacttcaatctcgaaaacgcggagaaggatacttactccgaggtcgacgacgaactggatatttcagataactccagctcatccagtagttccccgctgaaggagagtacgttcaacatactgaaaaggagcttctccgcgtctggaggcgagaggcaatctcaaacgagagactttactggcggtacaggctccaggccccggccagctagcgccggcattgctgtctctcaacgtaaggtgaggcagatatctgatcctatccagcagatactcatacagctgcataaaattatctacattacccaactgccgccagccctgcaccacaacttgaagcggcgagtgattgagcgctttaaaaaaagtcttttcagtcaacaaagcaacccctgcaacctgaaaagtgagattaagaagctaagtcagggatccccagagcccattgaacctaacttctttactgcagattatcacctcctccacaggtcctctggaggtaattcactctcgcccaacgacccaaccggacttcccacttcaattgaactggaagaaggtattacatacgaacagatgcaaactgtgatcgaagaggtgctggaggaatcagggtattataacttcacctccaaccgctaccacagttatccctggggcaccaaaaatcatccaacaaagcgttag

SEQ ID NO: 49072 - DNA, 1425 bp, Artificial Sequence
  Description of Artificial Sequence: Synthetic coding sequence
atggtgcccgtgcagcccgccgagccccccgaggtgctgaagagcgagccatacggggaaaaggctgacgtatgggcagttgggtgtattctctaccagatggccacattgagtccccctttctactctacaaacatgctttcgctggccacgaaaatcgtggaggctgtatacgagcccgtgccagagggcatctacagcgagaaagtcaccgacacgatatccaggtgtctgacaccagacgctgaggcccgccccgatattgtggaggtgtcctccatgatatccgatgtgatgatgaagtatcttgacaacctgagcacttcccagctatcactggagaagaagctcgagagagagcggagacgaacacaacgctattttatggaggctaatcgaaacaccgtgacctgccatcacgaactagcggtcctctctcacgagactttcgagaaggcttctctctcctccagttcttcgggtgcagccagccttaaaagcgagctctcggagagcgcagacctccctccggaaggctttcaagctagttacggcaaagacgaggatagggcctgcgacgagatcctttccgacgataatttcaacctcgaaaatgcagaaaaagacacctacagtgaggtcgatgatgagttggacatatctgataactcatcgagctcaagctccagcccacttaaagaaagtacatttaacattctgaaaaggtctttctcagcatccggaggggagagacaaagccagactcgcgatttcacgggagggacggggagtcgccctcgacctgcactgctgcccctggacctactcttaaaagtgccaccacacatgctcagggcccatatcaaagagatcgaggccgagttggttacaggatggcaaagtcacagccttcctgctgtgattctcagaaacttaaaagaccatgccagtgcgggcatcgccgtgtcccagcggaaggttcgtcagatctctgatcccatccagcagatcctgatccagcttcacaaaatcatttacataacccagctgcccccagccctgcaccacaatcttaaacgacgggtgatagaacgctttaagaaatctctttttagtcaacagagcaacccctgcaaccttaaatccgaaattaagaagctgtctcaggggtctccagaacctatcgagcccaactttttcaccgcagattaccatcttctccacagatcaagcggcgggaactccctgtctccaaacgacccaactggacttccaacttccattgagcttgaggaaggaattacctacgaacagatgcagaccgttatcgaagaggtgctcgaggagagcggctactacaacttcacaagcaacaggtatcattcctatccctggggaacaaagaatcatcccacaaagcgctag

SEQ ID NO: 49073 - DNA, 2178 bp, Artificial Sequence
  Description of Artificial Sequence: Synthetic coding sequence
atgcccgaccaggacaagaaggtgaagaccaccgagaagagcaccgataagcagcaggagattaccatccgagactacagcgacttgaaaaggctgcggtgtctgctgaacgtgcagagctccaagcagcagttgcccgcaattaattttgattccgcgcagaattcaatgaccaagagtgagcccgcaatccgtgcagggggccacagggcccgggggcaatggcacgagagcactgaggccgtggagctcgagaacttcagtattaattataaaaatgagagaaatttttccaaacatccccaacgcaagctcttccaggaaatttttactgcacttgtgaaaaatcggctgatttcgcgagagtgggtgaaccgtgctccctcaatccatttccttcgggttctaatctgcctgcgcctcctgatgagggacccctgctaccaggagattcttcattcgctaggaggcatcgagaacctggcacaatatatggaaattgtagctaacgagtacctggggtatggcgaggaacaacatactgtagacaaactggtaaacatgacctacatattccaaaagctcgctgccgtgaaggatcaaagggaatgggtaaccacttcaggcgcccataaaaccttggtcaacctgctgggggcccgagatacgaatgtgctgttggggagtctcttggctttggcatccctcgctgaatctcaggaatgcagggaaaaaatttctgaactgaatattgtggaaaacctgctgatgatcttgcacgaatacgatttgctaagcaagcggttgacggccgaactgcttcgactgctgtgcgccgaacctcaggtgaaggaacaggtaaaactctacgaaggaattcccgtgttgctctccctgctgcattcagatcacctaaaactgctttggagtattgtttggatattggttcaggtgtgtgaggatcctgagaccagtgtggaaattaggatttggggtggaattaaacagcttttacacatcctgcagggagatcgcaatttcgtgtcagaccactcttccattggcagtctcagctcagcgaatgcagcaggaaggattcagcaactgcacttatccgaggacctcagtccccgtgaaatacaggaaaacacattctctctgcaggcagcctgctgtgcagccctcactgagctagtgctgaatgacaccaatgcgcatcaagtcgtgcaggagaacggagtctacacaatagcaaagctgattctccccaataaacaaaagaacgccgccaaatctaacctactccagtgttacgcctttagagcgctgaggttcctgttttccatggaaagaaatcgccctctgtttaagcgactgttcccaaccgatctgtttgagatattcatcgatatcggacattacgtgcgggacatcagcgcctacgaagagctggtctccaagctgaacctgctggtcgaagacgagttgaaacagatcgctgaaaacatcgagtctattaatcaaaataaggccccccttaaatacattggcaattacgctattttagatcacctggggagcggggcgttcggatgcgtgtataaggtccgtaagcacagcggccaaaacttgcttgccatgaaagaggtgaaccttcacaaccctgcgttcggtaaggacaagaaggacagggattctagtgtgcgaaatatagtttcagagctgaccatcatcaaggaacagctgtatcaccctaatatcgtgcggtattacaaaacttttctggaaaatgacagactgtacatcgtcatggagctgatcgagggagctccactcggtgagcatttttctagcctgaaggagaagcatcaccactttaccgaggagcgactgtggaagatcttcatacagttgtgtcttgctctgaggtacttgcacaaagagaagcggatcgtacacagagatttaacccctaacaacatcatgctaggcgataaggacaaagtgacagtgagctgtctaaaatgcgctgctcccctgccatctttgtcttgcagctgcagcggacatatcaagagagcagggtcctccttcgctttctgctaccattggaaactgccagacgcatcccaggaagctaacgcaataatggtcccggtgcaaccagctgagccatag

SEQ ID NO: 49074 - DNA, 291 bp, Artificial Sequence
  Description of Artificial Sequence: Synthetic coding sequence
atgcccgaccaggacaagaaggtgaagaccaccgagaagagcaccgacaagcagcaggaaattactattagagattattccgacctgaagcgtcttcggtgcctcctcaatgtgcagagcagtaaacagcaacttcctgcgatcaactttgactctgcccaaaactctatgacaaagagtgagcccgccattagggcagggggccacagggcccgcggccagtggcacgagagcactgaggcagttgaattggagaactttagtattaactacaagaacgaacggaactag

SEQ ID NO: 49075 - DNA, 402 bp, Artificial Sequence
  Description of Artificial Sequence: Synthetic coding sequence
atgcccgaccaggacaagaaggtgaagaccaccgagaagagcaccgacaagcagcaggagataactatccgcgattatagcgatttaaaacgcctgagatgcttgctgaatgtgcagtcttctaagcaacagctccccgcaataaacttcgacagcgcgcaaaactccatgacaaaatccgaaccagccataagagcaggaggacatagagcacgtggtcagtggcacgagtcaactgaggccgtagaactcgaaaatttttctataaactataagaatgagcgcaactttagcaagcacccacagagaaaactcttccaggagatctttacagcgctagttaagaaccgcttgataagccgagagtgggtcaatcgggctcctagtattcactttctctag

SEQ ID NO: 49076 - DNA, 2127 bp, Artificial Sequence
  Description of Artificial Sequence: Synthetic coding sequence
atggacaagtacgacgtgatcaaggccatcggccagggcgccttcggcaaggcatacttggccaagggaaagtcagattccaagcactgcgttatcaaagaaatcaattttgagaaaatgcctatccaggagaaggaagccagtaaaaaggaggtgatattactggagaaaatgaaacatccaaacattgtcgctttcttcaatagttttcaggagaatggcaggcttttcattgtgatggagtattgcgatggaggcgatctgatgaagcgcataaaccggcagcgcggtgtactgttttcggaagatcagattctcggctggtttgtccagatatcgttaggtctgaagcatatccacgatcgtaaaatcctccaccgcgatattaaggctcagaacatatttctaagtaaaaatggcatggtggctaaactgggcgacttcgggattgctcgtgtgttgaacaattcaatggaacttgctaggacttgcataggtactccatattacctgtcccctgagatttgtcagaacaagccatacaacaacaagaccgatatctggagccttggttgtgtcctgtacgagttgtgtactctgaaacacccctttgaagggaacaatcttcagcagttggtgctgaagatttgccaggcgcattttgccccgatctctcccggattctctagggagctccacagcttgattagccagctgttccaggtgagtccaagagataggcccagcattaatagcattttgaaaaggcctttcctggagaatctgatccccaaatacctgactcccgaagtgatccaagaggaatttagccatatgttgatttgcagggccggcgcacccgcttcccgccacgccggcaaggtggtgcaaaaatgcaagatccagaaggtccggttccagggaaaatgcccgccgcggtcccgcatttcagtgcctatcaagagaaacgcaatattgcacaggaatgaatggcgccccccagctggcgctcaaaaagcgagaagtattaagatgatcgagcgcccaaagatcgctgctgtgtgtggccattacgattattactacgctcagctagacatgctgcgcaggagagcgcataaaccgtcttatcaccccatcccacaagaaaacactggcgtcgaggactatggacaggagacgagacatggcccctctccatctcaatggcccgctgagtatctacagagaaaatttgaagcgcagcaatacaaactcaaagtcgagaaacagctggggctgcgcccttcctcagcagagcctaactacaaccagcggcaggaactgaggtctaatggcgaggagcccaggttccaagagctcccattccggaagaacgaaatgaaggaacaagagtactggaagcagctggaagagattagacagcaatatcataatgatatgaaggaaatccggaagaagatgggcagagagcctgaggagaattcaaaaatttcccacaagacctatctagtcaagaaatcaaatctgcccgttcaccaggacgcttccgaaggagaggcacctgtgcagatggagttcaggtcttgttgcccaggctggtctgctatggccaggtcttggctcaccgccacttctgcctcacaggacattgagaaagatctcaaacagatgaggctgcagaacacaaaggagtcgaagaacccagaacaaaaatataaggctaaaaaaggagtgaaatttgagataaatctggacaaatgcatttctgacgaaaacattctccaggaagaagaggccatggatattcctaatgaaaccctcacctttgaagacgggatgaagttcaaggagtatgagtgtgtcaaggagcacggtgactataccgacaaagcgtttgagaagcttcactgcccagaggcgggtttttccacacaaactgtcgcagccgtcggtaatagaagacagtgggacgggggtgcccctcagaccttgctccagatgatggccgtggctgacatcacgagcacgtgtccaaccggtcccgattccgagtctgtcctctccgtgtccaggcaggagggaaaaacgaaagatccctacagccccgtgcttatcttgatgtag

SEQ ID NO: 49077 - DNA, 429 bp, Artificial Sequence
  Description of Artificial Sequence: Synthetic coding sequence
atgaacatcaacccctgcctggtgctgtgcgagtgcagcctgagcattagcctggatgcagacccgctcgtgagtccgttcgccaccgggccttgtcccggtgcacctcgggaggttgtcgccatgcagtcagacgtgggccagggcttccccatgcagtctaattggagagccccagtgcacgcatgtacttctggtgccgtgcgaaaggggtggcccggttgcggccgccggcggcataagatgggaggcggacccgtcagttgggagcagcgccagaaggaggtagaggcggcccagggcagcgaagagcgcggccctggttcactcgcggtgtcacttttatccctcgctgtagggatccatcgcatatctccaatattaggctttcatatatgctgcatgcaggttctcatggtcctcaaatag

SEQ ID NO: 49078 - DNA, 744 bp, Artificial Sequence
  Description of Artificial Sequence: Synthetic coding sequence
atgctggtgctgcggagcggcctgaccaaggccctggccagccggaccctggccccacaagtctgctctagtttcgctaccggcccaaggcaatacgatggcaccttttatgaattccgcacttactacctaaaaccttccaacatgaacgccttcatggagaatctgaaaaaaaatatccacctgcggacctcttatagtgaattagttggtttttggtcggttgaatttgggggccggaccaataaggtcttccacatttggaagtatgataattttgcccaccgggcggaggtccgtaaggccctggcgaattgcaaagaatggcaggagcagtccataatcccaaacttagcccgtatcgacaagcaggagacagagatcacgtatttgatcccctggtcaaagctggaaaagccccccaaagagggcgtgtacgagcttgctgtctttcaaatgaaaccaggtggccctgctttgtggggagacgctttcgaaagagccatcaacgctcacgttaacctgggctataccaaggttgtgggagtatttcatactgagtacggtgaactcaaccgcgtgcacgtattatggtggaatgagtctgccgacagtagagcagccgggcgccacaagagccatgaagaccctcgagttgtggctgccgtgcgtgagagcgtcaattaccttgttagccagcagaatatgctgctgattcctgcaagcttttcgccattaaagtag

SEQ ID NO: 49079 - DNA, 1632 bp, Artificial Sequence
  Description of Artificial Sequence: Synthetic coding sequence
atgcgggacaacaccagccccatcagcgtgatcctggtgagcagcggatctcgagggaacaaactgttattccgctatccgtttcaaaggtcgcaggagcatccagcaagtcagacctcaaaacctcgcagccgctatgcagccagtaataccggcgatcacgcggacgaacaggacggcgatagccggttctctgacgtgattctggccaccattctggccacaaaatctgagatgtgtggccaaaagttcgagctcaagattgacaatgtgcggttcgtcggccatccaacattgctgcagcatgcgctaggccaagccaatgccgacccctccgtgatcaattgcctccataacctcagcagaagaatcgcaaccgtccttcagcatgaagaaagacgctgccaatacctcacgagggaagctaaactgatcctcgccctccaagacgaagtctccgctatggcagacggcaacgaggggcctcagtcacctttccaccatatcttgccaaaatgtaaactcgctcgtgatctcaaagaggcctatgacagcctttgcacctctggggtcgttcggctacatattaacagttggctcgaagtcagcttttgtcttcctcataagattcattacgccgcttcttctttgatacctccagaagctatcgaacggtccctgaaagccattaggccataccacgctctactgttactgagtgatgagaagagtttattaggtgagctcccaattgactgctcccccgctttggtgcgcgtcattaagactacatcagctgtcaagaaccttcagcagctggcacaagatgcagacctggcattgctccaagtttttcagctcgctgcccacctggtctattgggggaaggcaatcataatctatccactgtgcgagaataacgtctatatgctctccccaaacgcttccgtatgcctttactctcctctagcagagcagttcagtcaccaatttccatcacatgatctcccatcagtcctggccaagtttagtcttcccgtttctctcagtgagttcaggaatcccctcgccccagccgtgcaggagactcaactcatacagatggtagtctggatgttgcagaggcgactcttgatccagcttcatacatacgtctgtctgatggcaagcccctcagaagaggaaccacgccctcgcgaggacgacgtcccatttacagctcgtgtcggaggacgctcactgtccactccaaacgctctctcatttggaagccccacttcttctgatgacatgaccctcacgagcccgtccatggacaacagcagcgccgagcttctgccttctggcgactctccactgaatcagagaatgacagagaacctactggcttccagcgagcacgagcgcgcagccattttatcggtacccgccgcacagaatcccgaagatctgaggatgttcgcccggctcctccactatttcaggggcaggcaccacctggaggagattatgtataacgaaaataccaggcgctcccaacttctgatgctcttcgataaattcaggtctgttctggtggttacaacccatgaagaccctgttattgccgtgtttcaggcgttactaccttag

SEQ ID NO: 49080 - DNA, 1170 bp, Artificial Sequence
  Description of Artificial Sequence: Synthetic coding sequence
atggccgacggcaacgagggcccccagagccccttccaccacatcctgcccaaatgcaaactcgcgagagatctcaaggaggcatacgacagcctgtgtaccagtggagtggtgcggctgcacatcaatagttggttagaagttagtttttgtctgccccacaagattcattacgccgcctcatccttgatccctccggaagctatcgagagaagcctcaaggccatcaggccttaccacgcactactcctgctgtctgacgagaaatcactcctgggcgaactgccaatcgattgcagtcccgccttagtgcgcgtaattaagacaaccagcgctgtgaaaaatctccaacagctagctcaagacgctgacctggccctcctccaggtgttccagcttgctgcacacctggtctactgggggaaggctatcataatctatcctctgtgtgagaacaacgtctacatgctgtcaccaaacgctagcgtatgcctgtactccccacttgcagagcaattttctcatcaattcccatcccacgacctgccttctgtcctggccaaattcagtctccctgtgtccctctccgaattcagaaatccactggctcctgcagttcaggagacacaacttatccagatggtcgtgtggatgcttcagaggagacttctgatacaactgcacacatacgtttgcttgatggcgtccccttccgaggaagagccccgacctcgcgaagacgacgtcccgttcacggctcgcgttggtggacggtccctgagcactcctaatgccctgtcgtttggatcccccacatcttcagacgatatgaccttgacttctccaagcatggataattcatctgctgaacttcttccatctggtgattccccactcaatcagaggatgactgagaatctgggacagctgagcgagcatgaaagggctgccatcctctcggtcccagctgcccagaaccccgaggatcttaggatgtttgcacggctcttacactactttcgcggcaggcatcacttagaagagattatgtataatgaaaatacaaggcgcagccagctgctcatgctgttcgacaaattccgttcagtactcgtcgtgacaactcatgaagatcctgtgatagccgtgtttcaggccctgctgccctag

SEQ ID NO: 49081 - DNA, 1707 bp, Artificial Sequence
  Description of Artificial Sequence: Synthetic coding sequence
atgcgggacaacaccagccccatcagcgtgatcctggtgagcagcggtagtcgggggaacaagctgctgttccgctaccctttccagcgctcccaggagcatccagccagccagacctcgaaaccgcgtagcaggtacgcagcttccaatacaggagaccatgctgacgagcaggacggtgattcccgtttctccgacgtgatcctcgcaactatattggcaaccaagagcgagatgtgcggtcagaaattcgagcttaagattgacaacgtgcggtttgtcggacatcctacgctgctccaacatgccttgggccagatttccaagactgatccatcacctaaacgagaggcccccactatgattctgttcaacgttgtctttgctcttagggctaacgccgacccctccgtaatcaattgtctgcataacctgtctcgccggatagcgaccgttctgcagcacgaagagaggcggtgccaatatctgaccagagaggctaagctcatccttgccctacaggatgaagtatctgccatggccgatgggaatgagggcccacagagcccttttcatcacatcttgcccaaatgcaagctggcccgggatctcaaagaggcctatgattcactgtgtacatcaggggtggtccggctgcatatcaattcctggttagaggtaagtttctgccttccacacaaaatacactatgccgcatcctcgcttatcccacccgaagccatcgagaggagcttaaaggctattcggccttatcacgctttgctgctactctcggacgaaaaaagtctcttgggcgagcttccaatcgactgttccccggccctggtccgcgtcattaagaccaccagcgccgtgaagaatctccagcagctggctcaagatgctgatttggctctcttgcaagtgtttcaactggccgcccacttggtctactgggggaaggctattatcatttaccccctctgcgaaaataatgtgtatatgctctctcctaatgcatcagtttgcctgtactcgcctctggccgagcagtttagccatcagtttccttcccacgacctgccctctgtcttggcaaaattttcattaccagtgtccctttcagagttccgtaaccctctggctcccgcagtgcaggaaactcagctgatccagatggtggtatggatgctgcaacgacgactgctgatccaactgcacacttacgtgtgcctgatggcttcaccatctgaagaagagccaaggcctagggaagacgacgtgcccttcacagccagagtgggaggccgctctctgtccacgcctaatgcactgagtttcgggtctccgaccagcagcgacgacatgaccctgacgtcaccatccatggataactccagcgcagaattgctgcctagcggcgatagtccccttaaccaaagaatgaccgaaaatctcctggcctcgtcagagcacgaaagggctgccatcttatcggtgcccgcagctcaaaatccagaggacctcagaatgttcgcccgactgttgcattacttccgagggcgtcaccatctagaagagataatgtataatgagaacacgagaagatcgcagctgcttatgctcttcgacaaattccggagtgtgttggttgtcacaactcacgaggatccagtgatcgcggtttttcaggctctcctcccttag

SEQ ID NO: 49082 - DNA, 210 bp, Artificial Sequence
  Description of Artificial Sequence: Synthetic coding sequence
atgcgggacaacaccagccccatcagcgtgatcctggtgagcagcggcagtcgggggaacaagttgctctttagatacccctttcagcggtcacaagaacaccccgcctcgcagactagcaagcctagatcacggtatgccgcttccaacacgggggatcatgccgacgagcaggatggggacagtcgaccgacacagactagacagtag

SEQ ID NO: 49083 - DNA, 999 bp, Artificial Sequence
  Description of Artificial Sequence: Synthetic coding sequence
atgctggcctggcaggacggcggcgccaaggccgcccccagccaccacaagatctctttttctgtgttggacatcttggatccccaaaaattcactcgcgctgccttacctgcagtacgaccagctccgcgtgaggcccgcaagtctctagctgaggttgaggcagggaaagatgctagttccagggaccctgtgagacagttggagacacctggacaagggtttgctgccagcctgctgacgcggcaggctcacccacatcactcatctgatgcgcgtgacgcagcaggaccaggggcagggcaggctagcccactcgaagggtcggaagctgaggaggaagaggacgccgaggacccacgtcgccctagattgagggagcgagcggcacggttattgcctgggttggctagaagcccagatgcgcccgctggggcactggcatcaggagagccttgcgaagatggcggtggcgggccagtccgatctccccccgggtctccggggtccccgaggccaagacgaagacgactcgagccaaactgtgctaagccgaggcgggctcggaccgcgtttacgtacgagcaactcgtcgctctagaaaacaagttcagggcaacacggtacctctctgtgtgtgagaggctgaacttagctttgtcactgagcttgacagaaacacaggtgaagatctggttccaaaatcgcagaaccaaatggaagaaacagaacccaggcgcagacggtgctgcacaggtgggcggtggcgctccgcagcccggggcagcaggcggcggtggaggtggtggatctggcggctcacccgggcctccagggacgggtgcattacacttccaaactttcccgagttatagcgctgcgaatgtgctgtttcccagcgccgctagtttcccactgaccgcagctgcgcctggatctccctttgctcccttcttgggcccctcttacctgacaccattctacgctcctcgcttatag

SEQ ID NO: 49084 - DNA, 933 bp, Artificial Sequence
  Description of Artificial Sequence: Synthetic coding sequence
atgctggcctggcaggacggcggcgccaaggccgcccccagccaccataagatcagtttcagcgtcctcgacatcttagacccccagaagtttacgcgggccgccctgcctgcagtccgacctgccccccgggaggctaggaagagtcttgctgaagtggaggctggcaaggatgcatcttcacgcgaccctgttaggcagttggagacgccagacgcagcaggtccaggagctggacaggctagccctctcgaagggtccgaagcggaagaagaagaggatgccgaagaccctagaagacccagactgcgggagagagcggctcgattgttaccaggcctcgcacggagcccagacgcaccagccggtgcactggcctctggcgagccttgcgaagacggaggcggaggacctgttcgttcccccccaggaagccccggctctccgcgaccccgccggaggcgcctagagccaaattgcgccaagccccgaagagccagaaccgcatttacctacgaacagctggtggcattggaaaataaattccgggctacccggtacctaagtgtttgtgaaagactgaatctggcactaagcctgagcttgacggagactcaggtcaaaatttggttccagaacagaaggactaagtggaagaagcagaatcccggggctgatggggccgcccaagtgggtggcggggcgccacagcccggagctgcaggaggaggcggaggtggcggatccggcggttcacctgggccaccgggaaccggggcactacattttcagaccttccctagctattctgccgccaacgtcttatttcctagcgctgcaagctttcccctcacagctgccgccccaggatccccctttgcaccctttctgggcccttcctacctgacccccttttacgcccctaggctatag

SEQ ID NO: 49085 - DNA, 114 bp, Artificial Sequence
  Description of Artificial Sequence: Synthetic coding sequence
gaggagtggatcacctacagcaacagctgctactacatcggcaaggagcgcaggacgtgggaggaaagggtgtgctggcctgttctacgccgaactctgatttgcttcctgtag

SEQ ID NO: 49086 - DNA, 3123 bp, Artificial Sequence
  Description of Artificial Sequence: Synthetic coding sequence
atggtgagcagcgcccagatgggcttcaacctgcaggccctgctggagcagctaagtcaagacgagctctctaagtttaagtacctcattacaacattttcgctcgctcacgaattgcaaaaaattccgcacaaggaggtcgataaggctgatggtaagcagcttgttgagatacttacaactcactgcgattcttactgggtagagatggcatctttacaagtgtttgagaaaatgcaccggatggacttgagcgaaagggctaaagacgaggtccgggaggccgccctgaaaagcttcaataagcggaagccactctccctcggcatcacaaggaaggaacgtcctccactggacgttgatgagatgttagaacgttttaagaccgaagctcaggacaaagataatcggtgccgctatatcctgaagaccaagtttagagagatgtggaagtcgtggccgggagactcaaaagaggttcaagttatggctgaaagatataaaatgctgatccctttttcaaacccaagggtgctgcccggccctttcagttatacggtagtgttgtatgggccggcgggtctagggaaaaccactctggcccagaagctgatgcttgactgggcagaagataacctgattcacaaattcaaatacgcattctacctgtcatgccgggagctgagccgactggggccctgctcgttcgcagagttggtctttagggactggcctgagttgcaagacgacattccccacatccttgcccaggcccgcaaaattttgtttgtcatagatggatttgatgaactcggggcagctcctggcgctcttatcgaagatatctgcggggattgggagaagaaaaaacctgtgccagttctgctcggatccttgcttaatagagttatgctcccaaaagccgctctattggtcactacccgccctcgcgccctgcgagacctgaggatcctagccgaagaacctatatacatcagagttgagggattcttagaggaggaccgaagagcctacttcctgcggcactttggcgatgaagatcaggctatgagagcgttcgaactgatgcggagtaatgccgctctcttccagctcggctcagcccctgcggtctgttggatcgtgtgcacgacgttgaagctacaaatggagaagggggaggaccccgtgcctacatgtctcaccaggactggactgttcctacggttcctctgctccaggtttccacagggagctcagttacgaggtgcactgcggaccctgtcactactagcagctcagggactctgggctcagacctctgtcctccaccgcgaagacctagagcgtctcggtgtgcaagagtcggacctgcgcttattcctcgatggcgacatcctaagacaagatcgcgtctccaaaggctgctattccttcatccacctctctttccagcaatttctgaccgccctcttttacaccctggagaaagaagaggaagaggaccgcgatggccatacatgggatatcggcgatgttcagaagttgctatctggcgttgagagactcagaaatccggaccttatccaagcaggctattactctttcggcttggcaaatgaaaaaagggctaaagagctcgaagcaacctttggctgccggatgagccctgatattaagcaggagctgttacgatgtgatatttcctgcaagggtggccatagcaccgttacagacttgcaggagcttctcgggtgtctgtatgaatcccaggaagaggaactcgttaaggaggtgatggctcagttcaaggagattagcctgcatctgaacgcagtggacgtcgtgcccagtagtttttgtgtgaagcattgtcgcaatctccagaagatgtccctgcaagtgatcaaagagaatttgcccgaaaatgtgacggcctccgagagtgacgcagaagtggagaggagccaggatgaccagcatatgctcccattctggactgacttatgttccatcttcgggtccaataaggatctgatgggcctcgctatcaacgactcttttctgagcgcctccctggtccggattctgtgtgaacagatagcttccgatacctgccatcttcagcgcgtggtgttcaagaacatctcacctgctgatgcccatagaaacctatgccttgccctccgtgggcacaagaccgtgacgtacctgaccctccaaggcaatgaccaggatgatatgttccccgccctgtgtgaggtgctgaggcatcccgagtgcaacctcagatacctcggcctagtgtcatgtagcgcaacgacccagcagtgggcagatcttagccttgcccttgaggtgaaccaatcgctgacttgtgttaacctgagtgacaacgagctactggacgaaggagctaaacttttgtatactactctgcggcatccaaagtgcttcctgcagcggctttcactggaaaactgtcatctgacagaagctaactgtaaagacttggctgccgtgctcgttgtgtctcgcgagttgacccatctgtgcctggcaaaaaacccaatcggcaacacaggtgtgaaattcttatgtgagggactgcgttatccagaatgtaaactgcaaaccctggtcctctggaactgtgacattacaagtgacgggtgttgtgatctgaccaaacttctgcaggaaaagtcatcactactctgcctggacctggggctgaatcatatcggggtgaaaggcatgaagtttctgtgtgaggctctgaggaagccattatgcaatctgcgctgcttgtggctgtggggatgctccatcccaccgtttagctgtgaagacttgtgcagcgccctgtcttgcaatcagtccttagtgacactggatctcggccagaatccgctgggatcttccggtgtgaaaatgctgtttgagacactgacatgttcctccggcaccctgcgtacgttgcgcctgaagattgacgactttaatgatgagctaaataagctcctcgaagagattgaggagaagaacccccaactgattatcgatacagagaaacaccacccgtgggcagagcggccctctagtcacgacttcatgatatag

SEQ ID NO: 49087 - DNA, 3189 bp, Artificial Sequence
  Description of Artificial Sequence: Synthetic coding sequence
atggtgagcagcgcccagatgggcttcaacctgcaggccctgctggagcaactctcccaagatgaactttctaaatttaaatatcttattaccactttttcactggcacatgagctgcagaaaattccgcacaaggaggtggataaagctgatggtaaacagctggtggagattctgaccactcactgtgacagctactgggtggagatggcaagtctgcaggtctttgagaagatgcaccgcatggacttgagcgaacgcgccaaggatgaggtccgggaagcagccctcaaatcatttaacaaaagaaagccgctgtctctgggtatcacccgcaaagaacgcccccctctagatgtggatgagatgctggaacgatttaaaacggaggcccaggcctttactgagacgaaagggaacgtcatttgcttggggaaagaggtgttcaaagggaagaagccagataaggacaatcggtgcaggtatatattgaagacaaagttccgagagatgtggaagtcctggcccggagacagtaaagaagtgcaggtgatggccgagagatacaaaatgctcatacccttctctaatccgcgcgtgttgccggggcccttctcgtataccgtggttttatacggacccgctggactggggaagaccaccctggcacaaaagctaatgctggactgggcagaggataacctgatacataagtttaagtacgctttctacctgagctgcagagaactttccaggttgggcccctgctcttttgcggaactcgtctttcgtgattggcccgagttacaggatgatattcctcatatactggcccaggccaggaagattctgttcgtgattgatggtttcgatgaactgggcgctgcacccggcgcactgatcgaagacatttgcggagattgggaaaagaagaagcctgtgccagtcctgctcgggagcctccttaaccgcgtgatgcttcccaaggctgcgttgttggtgaccaccagaccccgcgcattaagagatcttcgcattctggccgaggaacctatctacatccgcgttgaaggctttctggaggaggaccgtcgtgcttactttctccgccattttggggacgaggatcaggctatgagggccttcgagctcatgcgtagtaatgccgccctgttccagctcggatctgccccggccgtgtgctggatcgtgtgcactacgctgaaactccagatggaaaagggcgaggaccccgtaccaacttgccttactcgcacgggactgttcctacgattcctgtgtagtagatttccccagggcgcccagctaagaggcgctttaaggacactcagcttgttggcagctcagggcttatgggcccaaacaagcgtgttacaccgggaagatttagagagattgggcgttcaggagagtgatctgagactttttctggatggggatatacttagacaggacagagtatccaaaggatgctattccttcatccatcttagctttcagcaattcctgacggctttgttttacaccctcgagaaggaggaggaagaagaccgtgacgggcacacatgggacatcggtgacgtgcaaaagctactttctggcgtggaaagactacgcaatcctgatctcattcaggctggctactattcctttggtctggcgaatgagaagcgcgccaaagaactggaggcaacattcggatgtcgtatgtctcccgacattaaacaggaactattaaggtgtgacatctcatgtaagggcggccattcgacggtcaccgatctccaggagctcctcggctgcctgtacgagagccaggaggaggagctggtgaaagaagtaatggcgcagttcaaggaaatctctctgcacctgaacgcagtggacgttgtgccctcttctttctgtgtcaagcactgcagaaacctgcaaaaaatgtccttgcaggtaatcaaagaaaatctaccagagaatgttacagcctccgagtccgacgcagaagttgagcgctctcaggacgaccagcacatgctgcccttctggaccgacttgtgctctatatttggaagtaataaggatctgatgggactggccataaatgactcctttttaagcgctagtctggtgcgtatcctgtgcgagcagatcgccagcgatacatgccatctgcaaagggtggtcttcaaaaacatttcgcctgctgacgcccacaggaatctttgtctggcccttcggggccataagaccgtgacctacttgacacttcagggcaatgaccaagacgacatgttccctgcactctgcgaggtcctgaggcaccctgagtgcaatctgcgctacctgggactggtgagctgctcggctacaactcaacaatgggcagatctgtccctcgcactagaggtgaatcagtctttaacatgcgtgaaccttagcgataacgagctcctagatgaaggggccaaattgctctatacaactctgaggcaccctaaatgcttcctgcaacggctctctctggaaaactgccatctaactgaggcgaactgcaaagatctggctgcagtgctggtggttagccgcgaactgacccatctttgcctcgctaaaaatcccatcggtaatacgggagtgaagtttctctgcgaagggctgaggtaccccgagtgcaagctccagacactggttctctggaattgcgatattacaagcgatgggtgttgtgaccttaccaaactgctacaagaaaagtcgtctctactgtgtctggacctgggcctgaatcatatcggagtcaaggggatgaagttcctttgtgaagcactgcggaaacctctttgtaacttacggtgcttgtggctgtgggggtgttctatccctccttttagctgtgaagacttgtgctctgcgttgtcctgtaatcagagtctggttacacttgacctggggcagaatcccctgggaagcagtggcgttaagatgctgttcgagactcttacctgctctagtggaacactgcggaccttaagactgaaaatcgatgatttcaatgacgagctgaacaaactgctcgaggaaattgaggaaaagaaccctcagctgatcatcgacaccgaaaagcatcatccatgggccgagcgcccgtcatcacacgatttcatgatttag

SEQ ID NO: 49088 - DNA, 3189 bp, Artificial Sequence
  Description of Artificial Sequence: Synthetic coding sequence
atggtgagcagcgcccagatgggcttcaacctgcaggccctgctggaacagctgtcacaggatgagcttagcaaattcaaatacttaatcaccaccttttcactcgcccacgagctccaaaaaattccacacaaggaagtggacaaggcagacggcaaacagctggtggagatcctcacaacacattgcgatagttactgggtcgagatggcttcgctgcaggttttcgagaaaatgcaccgcatggacctatctgagagggctaaagacgaagtccgcgaggccgctctaaaatcatttaataagagaaagccgttgtcactgggcattacccggaaggagcgtccccctctcgacgtcgatgagatgttagaaagatttaagacagaagcccaagcctttactgaaactaagggcaacgtgatctgcctagggaaagaggtgtttaaggggaagaaaccagataaggataaccgatgtagatacatactcaaaaccaaatttcgcgagatgtggaaatcctggccgggagattcaaaggaggtgcaagtaatggctgaacggtataagatgttgataccattttctaatcctcgcgtcctgcctgggccgttctcctacactgtggtgttatacgggcccgctggcctgggcaagacgaccttggcccagaagctgatgctcgactgggcggaagataacctaatccataagtttaagtacgcattctacctgagttgcagggagctgtctagattgggtccctgcagctttgcggaactggtgtttcgagactggcccgaactgcaggatgatatcccccatatcctggcacaggctcggaaaatcctcttcgtcatagacggattcgatgaattgggcgctgcacctggagccctgattgaggacatctgtggagattgggaaaagaaaaagccagtccctgtgcttctggggtctctgctgaatagggtgatgcttccaaaggccgccctactggtgactacccgccctcgagccttgagggatctgagaatacttgcagaggagccaatttacatcagagtggaagggttccttgaagaggaccgccgcgcttatttcttgcgccatttcggagatgaggaccaagctatgagagcttttgagctgatgaggtcaaatgccgccctgtttcagctggggagcgcccctgccgtctgttggattgtctgtaccacccttaaacttcagatggagaagggtgaggatcctgttccaacatgtcttactcgcactggtctatttcttcgatttttatgctccagattcccacaaggcgcacagctgaggggagccctccggacgttatctctgctggccgcccagggactttgggctcagacaagcgtgctccaccgagaggatctagagcgcctgggggtgcaggagtccgatctgcggttgttcttggatggggacatcctgcgacaggatagggtgagcaaggggtgttattcattcattcacttgtctttccagcagtttttaaccgctcttttctacacccttgaaaaagaagaggaagaggatcgagacggccacacctgggacatcggagatgtccagaagctcctgtccggagtcgagagacttcggaaccccgatctgattcaggcgggctattacagcttcggcctcgctaacgagaaaagggcgaaagaacttgaggctaccttcggatgtaggatgagccccgacatcaaacaggagctcctgagatgtgacatctcctgcaagggcggccactccactgtcacggacctgcaggaactgctcggttgtctgtacgaaagccaggaggaggagctcgtaaaggaagtgatggcccagtttaaggagatctccctgcacctgaacgccgtcgacgtggtcccctcttcattttgcgtgaaacattgtcggaatcttcagaagatgagcctgcaggttataaaggagaatttgcccgaaaatgtgaccgcctccgaatccgacgccgaagtcgagcgaagccaggacgatcagcacatgctgcccttttggacggatctgtgcagtatttttggttccaataaggacctgatgggccttgccattaacgatagcttcctgagcgcgtcgctggtgcgcatcctctgcgagcagatcgcatccgacacttgccacctccagagggtagtgttcaagaatatcagccctgccgacgcacatagaaacctgtgtctcgcgctccgcggacacaaaacagttacgtaccttacactgcagggtaatgatcaggatgacatgtttcccgcactgtgtgaggttctgagacaccccgagtgtaatctgcgttacttaggcctcgtctcttgcagcgcgacaacacagcagtgggctgacctttctctggctcttgaagtgaaccagagcctgacatgtgtgaacctgtccgataatgaacttttggacgagggggctaagctgctgtacactaccctgcgtcacccgaaatgtttccttcagcgtctgagcctggagaattgtcatctgacagaggctaactgcaaagaccttgccgccgttttggtggtgtccagggaattaacccacctttgtcttgccaaaaacccaatcggcaacactggtgtcaaattcctctgtgagggactgcggtacccagagtgcaagctgcagacacttgtactgtggaattgcgatataaccagcgacggatgctgcgacttaactaagctcctgcaggagaaatcctcgctactctgcctggacctcggactcaatcatattggggttaagggaatgaagttcctttgcgaggctctgcggaaacccctttgtaacctgcgctgcctgtggttgtggggctgctccatcccaccattttcttgcgaggatttgtgttctgccctgagctgtaatcaaagcttagttacattagacctggggcagaaccctctgggttcctcgggcgtgaaaatgctttttgaaaccctcacttgctccagcggaaccctcagaacactaagactaaagatcgatgactttaatgatgagctgaacaagcttctagaggagattgaggagaagaaccctcagctgatcattgacaccgagaaacatcacccatgggctgagcgaccaagctcccacgacttcatgatttag

SEQ ID NO: 49089 - DNA, 3189 bp, Artificial Sequence
  Description of Artificial Sequence: Synthetic coding sequence
atggtgagcagcgcccagatgggcttcaacctgcaggccctgctggagcagctctcacaggacgagctaagtaagttcaagtatctgattacgactttctctctggcccacgagctgcagaagattccacacaaagaagttgacaaggccgatggaaagcagctcgtggagatcctgactacccactgtgactcctactgggtggagatggcgagcctgcaggtcttcgaaaagatgcaccgcatggacctctcggagagagccaaggatgaagtgagggaagctgccctgaagagctttaataagagaaaaccgcttagtctggggattacaagaaaagaacgccccccattagacgtggatgagatgttggagaggttcaaaaccgaggcccaggccttcaccgaaaccaaggggaatgtgatctgtctgggcaaggaggtgttcaaaggaaagaaaccagataaggacaatcgctgcagatacattctgaaaacaaagttccgcgagatgtggaagtcatggcccggagatagcaaggaggtccaggtgatggcggaaaggtacaagatgctgattcctttcagcaacccccgggtcctgcctggcccattcagttatacagtggtactttacgggcctgctgggctagggaagacgactctggcacagaaactaatgctagattgggctgaggataatctgatccataagttcaagtatgctttctatttaagttgccgagaactttctcgtctcgggccttgttcattcgctgaactggtgttccgggactggccagagctgcaagatgacatcccacacatcttggcacaagctcggaagattctttttgtgatcgatggctttgacgaacttggtgctgctccgggtgcactgattgaagacatctgtggtgactgggaaaagaaaaagcccgttccagtgctcctgggatccctattgaaccgagtaatgctccctaaagctgctctcctggtgaccacgcggccaagggctctgagagatcttagaatcctggctgaggagccaatttacatacgggtcgaagggtttctcgaagaggacagaagggcctacttcctgcgacactttggcgacgaggatcaggccatgcgtgcattcgagctgatgagatccaacgcagccctctttcagttaggttcagccccagctgtatgctggatagtctgcaccactctgaaactccagatggaaaaaggcgaggaccccgtaccaacttgtctcactcgtacaggtctgtttcttcgatttctgtgcagccggttccctcagggagcgcagttacgcggcgctctcaggaccctgtccctgcttgccgcacaaggtttgtgggcgcagacctcggtgctgcacagggaggacctggaaagattaggtgttcaggagtcagacctacgcctcttccttgacggggacatcctgcgccaggatagagtgagtaagggatgttatagctttatacatttgtctttccagcagttcctgacagctcttttttacacccttgaaaaagaggaggaggaggatcgcgacggccatacgtgggacatcggcgatgtccagaagctgcttagcggcgtggagaggctgagaaaccctgatctaatccaggctgggtactatagctttggtcttgctaacgagaaaagagccaaagagctggaggccacttttggttgtcgcatgagcccagatattaaacaggaattgttgaggtgcgatatctcttgcaagggcggtcatagtactgtgactgatcttcaggaactgctgggctgcctctacgagtcgcaggaagaggagttggtaaaagaggtgatggcacaattcaaagaaatctcactgcatcttaacgccgtcgacgttgttccaagtagcttttgtgtaaaacactgcagaaacttgcagaaaatgtcgctgcaggtcatcaaagagaacctgccggagaacgttaccgcaagcgagagtgacgccgaagtggagcgctctcaagatgatcagcatatgttgccattttggaccgacttgtgttctatctttgggtcgaacaaggatctgatgggcctagccataaacgattccttcctatccgcaagtttggtcaggatcctgtgcgaacagatagctagcgacacttgtcacttgcagagagtggtttttaagaacattagtcctgccgatgcgcatagaaacctgtgcttggccctgcgaggtcataagactgttacctacctgacactccaggggaacgatcaggatgacatgtttccggccctgtgcgaggtcctacggcatcccgagtgcaacctgcggtacttgggcctcgtttcctgtagcgcgaccacccagcagtgggccgatctatccctggccttggaggtcaaccagtcactgacttgcgtcaatctgtcagataacgagctgctggacgagggagcaaaattactgtatacaacccttaggcaccccaagtgctttctgcagcgactgagcctggagaattgccacctcaccgaggccaattgtaaggacttggcggcggtgcttgtagtgtcccgggagttgactcacctttgcttggctaagaaccccatcgggaataccggggtcaagttcctgtgtgagggcttgcggtatccagaatgtaaactccagacccttgtgttatggaactgtgacatcacatccgacggttgttgtgatctcacaaaattgcttcaagagaagtcatctctcctgtgcttggatctcggtctgaaccacatcggggtgaaaggaatgaagttcctttgcgaggcgctccgaaaacctctgtgtaatttgagatgcctgtggctgtggggttgctccataccgccgttctcttgcgaagacctgtgctctgccctgagctgcaatcagagcctggttacactggacctgggccagaatcccttagggtcttccggggtaaagatgttatttgaaaccttaacctgttcctcaggaacattgaggacactcagactgaagatcgatgactttaatgacgaattgaataagctgctcgaggaaatcgaagagaagaatcctcagctgatcattgacactgagaaacaccacccatgggcagaacggcctagctcacacgactttatgatttag

SEQ ID NO: 49090 - DNA, 3189 bp, Artificial Sequence
  Description of Artificial Sequence: Synthetic coding sequence
atggtgagcagcgcccagatgggcttcaacctgcaggccctgctggagcagttatcacaagatgaattgagtaagttcaaataccttattactaccttctccctcgctcacgagctgcaaaagatcccacacaaggaagtggataaggcagatggcaagcagctggtagaaattctaacaacacattgtgactcttactgggtagagatggcctcccttcaagtattcgaaaagatgcataggatggacctcagcgagagggccaaagatgaggtccgcgaggccgctttgaaatcttttaacaaacgcaaaccgctcagcttaggcatcacacgaaaggagcgcccgccccttgatgtcgacgaaatgctggaacggttcaagactgaagcccaagcctttacagagaccaagggaaacgtgatttgtttagggaaagaagtgttcaaggggaagaaacctgacaaggataacaggtgtcgctacatccttaagacaaagtttcgggagatgtggaaatcctggccgggggacagtaaggaagtgcaggttatggctgaacggtataaaatgctgattccttttagtaatcccagagtactgcccggcccgttttcctacacagtggttctttacggacccgctgggctgggaaagacaaccctggcccagaaattgatgcttgactgggcagaagacaacctcatccacaagtttaagtacgccttctatttgagctgccgggaactgagcaggttaggcccctgcagttttgccgaattagttttccgtgattggcccgaactacaggatgacattccacatatcctcgcccaggcacggaagatcctgtttgtgatcgacggtttcgatgaacttggggcagccccaggggcgctgattgaagacatctgcggtgattgggagaaaaagaagcccgttccagttttgctgggctcgctcctcaaccgggtcatgcttccaaaggccgctctcttggttacaactcggccacgagcattgagagacttgcgtatcctggccgaggagcctatatatattcgcgtcgagggtttcttagaggaggacagaagagcttacttcctcaggcactttggcgatgaggatcaggccatgagggctttcgaactcatgaggtccaatgcggcgctatttcagctgggaagcgcccctgcggtatgttggatcgtttgcactaccctgaaactccagatggagaagggagaggacccggttcccacatgcttgaccaggaccggtctattcctcagatttctgtgttctagatttccgcagggtgcacagctgcgcggcgccctccggaccctcagcctgttagcagctcagggcctttgggcccagacatcggtgcttcaccgggaggatttagagagactgggggtgcaggagagtgacctccggttgttcttggatggtgacatcttgcggcaggacagagtcagtaaggggtgttactccttcattcatctgagtttccaacagtttctgaccgcattattttatactttggaaaaagaggaggaggaggatagagacggccatacttgggacattggcgacgtgcaaaagttattaagtggcgtagagcgactgcgcaatccggatctaatccaggccggttactacagctttggcctcgctaatgaaaagagagccaaagagttggaagccaccttcggttgcagaatgtccccagatatcaaacaggagctgctgagatgcgacatctcgtgcaaagggggccacagcacggtaaccgacctgcaggagcttctgggttgcctctatgagagccaggaggaagaactggtaaaggaggtaatggcacagtttaaagaaatatccctgcacttaaacgctgtagatgtcgtcccatctagtttttgcgtgaagcactgtcgcaatcttcaaaaaatgtcacttcaagtgatcaaggagaacctaccagaaaacgtaactgcatccgagtctgatgccgaggtggaacggtcacaggatgaccagcatatgctgcccttctggaccgatctgtgttctatttttggttcaaacaaggacttgatgggcctcgcgataaacgacagtttcttgtctgccagtctagttcgcatcttgtgcgagcaaattgcgagcgatacctgccacttacagcgagttgtcttcaaaaatatcagcccagctgacgcccaccggaatctctgtcttgccttaagagggcacaaaacagtgacatatctgacgctacaggggaatgatcaggacgatatgttccccgccctgtgtgaggttctccgccacccagagtgcaacctccggtacctgggtcttgtgtcatgttccgcaactactcaacaatgggcagacttgagcctggctctagaggtcaaccagagtctgacatgcgttaatctttcggataacgagcttctagatgaaggagcaaaactcctttacaccaccctgcggcatccaaaatgtttcttgcagcggctgagtctcgaaaattgccatctaaccgaggctaattgtaaggatcttgccgccgttctcgtggtctcccgtgagcttactcacctgtgtctcgctaagaatcccatagggaacacgggggtgaaattcctttgcgagggactgaggtatccggagtgcaagctacagacccttgttctgtggaactgcgatatcacatcagacgggtgctgcgacctcacaaaactgcttcaagagaaatctagtttactatgtctcgacctggggctaaaccacatcggcgtgaagggcatgaagttcctgtgcgaagctctccggaagcctctctgcaatcttcggtgtctgtggctgtggggctgctctataccaccgttcagctgcgaggacttgtgttctgcattatcatgtaatcaatctcttgtgactttggatctcggccagaatcccctgggtagctctggcgtcaagatgctgtttgagacgcttacctgttcatcaggaaccctgaggactctacgcctaaagatcgacgacttcaacgacgaattaaataaacttctggaggagatagaagaaaagaaccctcagctgattatcgacacagagaagcaccacccatgggcagagcgaccctcttctcacgattttatgatatag

SEQ ID NO: 49091 - DNA, 3189 bp, Artificial Sequence
  Description of Artificial Sequence: Synthetic coding sequence
atggtgagcagcgcccagatgggcttcaacctgcaggccctgctggaacagctgtcccaggatgagctttctaaatttaaatatttgatcaccactttttctctggcacacgagctgcagaaaatcccccacaaggaggtggacaaggccgacggcaaacagcttgtcgaaatactgactacacattgtgactcttactgggtagagatggcctccctgcaagtgttcgagaagatgcaccgcatggacctgagcgagagggccaaggacgaggtgagagaggctgccttgaagtctttcaacaagcgcaaaccactgtctctcgggattaccagaaaggagcgtccacctctcgacgtggacgaaatgctcgagcgctttaaaacggaggctcaggcatttactgaaactaaaggtaatgtcatttgtttaggtaaggaagtttttaaggggaagaagccagataaggacaatcgctgcaggtacatactgaaaacaaaattcagggagatgtggaagtcttggcccggagactcaaaagaagttcaggtaatggccgaacgctacaaaatgctgatacccttctcaaatcctcgtgtcttaccgggaccattcagttacactgtcgtgttgtacggccctgctggcctgggaaaaacaactctggcacagaagttgatgctggattgggccgaagacaatctcattcacaagttcaaatacgccttctacctgagctgcagagaattatctcgtctcggcccatgtagttttgcagagctggtgttccgggattggcccgagctgcaagacgatattccccacattttagcccaggccaggaagatcctattcgtcattgacgggttcgacgagctcggggcagctcccggagccctgatcgaggatatctgcggggactgggagaagaagaagcccgttcccgttttgctgggaagcttgctaaatagggtaatgttgcccaaggccgcgctgctcgtgacaacacgtccccgggccttgcgggatctgaggatactggctgaggaacccatctacatccgcgtggaaggattcctggaagaggatcgaagagcctacttcctccgccattttggcgatgaagatcaggctatgcgtgctttcgagctcatgcggagcaatgcggccctgtttcagctcggctccgcccccgctgtttgttggatcgtttgtaccactctcaaactgcagatggaaaagggtgaggacccagtgcctacatgtctgacccgcactggactgtttcttcgcttcttatgttctcggttcccccagggggctcagctccggggtgccttgaggactctgtccctgctggcggcccagggcctgtgggcgcagacaagtgtcctgcaccgggaggacctggagagactgggagtgcaggagtccgatctccgactgttcctcgatggcgatattctccggcaggaccgcgttagcaaagggtgttacagcttcatccatctgtcttttcagcagtttctaaccgccctgttttacacattggagaaggaagaagaggaagatagggatggccatacctgggatataggagacgtgcagaaactgctttcaggcgtcgaaagacttcggaacccagacctgatccaggcaggctattattccttcgggctggcaaacgaaaagcgggcaaaggagctcgaggcaacattcggatgccgaatgtctccagatatcaagcaggaattgctccggtgcgacattagttgcaaaggcgggcatagcaccgtcactgacttgcaggagctactgggatgcctttacgagtcgcaggaagaggaactggttaaggaagtgatggcgcagttcaaggaaatatccctccatctcaatgcagtcgacgttgtcccttcatccttctgtgtgaagcattgtcggaatcttcagaagatgagtttgcaagttattaaagagaacctgcccgagaatgtcaccgcatctgaatctgacgcggaggtggaacggtcccaggatgatcaacatatgctacccttctggacagatctgtgcagtatttttggcagtaataaagaccttatgggtctggctattaatgacagctttttgagtgccagcctcgttcgcatactgtgtgagcagattgcatcagatacctgtcacctgcagagggtagtatttaaaaatatatctcccgccgatgctcacaggaacttgtgcctggccctgagagggcacaaaacagtgacgtatcttacgcttcagggcaacgatcaggatgacatgtttcccgctttatgcgaggtcctccgccatccagaatgtaacctgaggtacctggggttggtgagttgtagcgcaacaacccaacaatgggccgatttgtccctggcactggaagtgaaccaatctctaacatgcgttaaccttagcgataatgagctgttggacgagggcgcgaagctgctgtataccactctgaggcaccccaaatgctttctccagcgattatcactggaaaattgtcatctgacagaggctaactgcaaagacctggcggccgtgttagtggtcagccgggaactgacgcacttatgcctggccaaaaaccctatcgggaacacaggagtgaagtttctttgtgaggggctcagatatccagaatgcaaactacaaaccctggttctctggaactgcgatatcacctcagacgggtgttgtgacctcactaaactgttgcaggagaagagctccctgctctgcctcgacctggggttgaatcacattggtgtgaaaggcatgaaattcctctgcgaggctctcagaaaaccactttgtaacctgcgctgcctctggttgtggggctgcagcattccccccttctcatgtgaggatctttgttctgccttgtcttgcaaccagagcctggtaacgctcgatctcggccaaaaccccctaggctcctcaggcgttaagatgctctttgagactctcacatgtagtagtggtacactgagaaccctgcgactgaagatagacgacttcaatgatgagctgaataagctgctggaggaaatcgaggagaaaaaccctcaactgataatcgacactgagaagcatcacccttgggcggaacgcccttcctcccacgacttcatgatctag

SEQ ID NO: 49092 - DNA, 3123 bp, Artificial Sequence
  Description of Artificial Sequence: Synthetic coding sequence
atggtgagcagcgcccagatgggcttcaacctgcaggccctgctggaacaactgagtcaggacgaactttcaaaatttaagtaccttatcacaaccttcagcctcgcccacgagctgcagaaaatcccacacaaggaggtcgataaggcagatgggaagcaattggtggaaatcctgacaacgcactgcgatagctattgggtcgaaatggcatctctacaggtgttcgaaaagatgcataggatggacctgtcagagagggccaaggacgaggtacgtgaagccgcgctcaagtccttcaacaagaggaaacctctctctcttggcattacacgaaaggaaagaccacccctagacgtggatgaaatgttagaaagattcaagacggaggcacaagacaaggataataggtgtagatacatcttaaaaactaaattcagagaaatgtggaagagttggcccggagacagtaaggaagtccaggtcatggcagaacggtacaaaatgctaatcccttttagcaatccaagggtgttgccaggacctttctcatataccgtcgttttatatggcccagctggcttgggcaaaactactctcgctcagaaacttatgcttgattgggcagaagacaacctcatccacaaatttaagtacgctttttatctgagctgccgcgagctctcacggttgggcccttgctcattcgcagaactggtttttagagactggcctgagctccaggatgacatcccccatatcttagctcaggctcgaaaaattttgtttgtcatcgatggatttgacgagctgggcgccgctcctggcgccctgatcgaagacatctgcggcgattgggagaaaaagaaacccgtacccgtgctgctgggtagtctactcaacagggttatgctgcccaaggcagctctcctggtaacaacgcgaccacgggcgctaagagatctgaggattttggctgaggagcccatttatattcgcgttgaaggctttttggaggaggacaggagagcctacttcctgagacactttggggacgaggaccaggctatgcgcgccttcgagctgatgcgcagcaatgccgccttatttcagcttggaagcgcccccgcagtttgctggatcgtgtgcactacactgaagctgcagatggaaaagggcgaggacccggtaccgacttgtttgacccggaccggcttgtttctgcggttcctttgttctcgctttccccagggagctcaattgcggggcgcgctcagaacgctatcgctcctggctgcccagggactctgggcccagacctctgtccttcaccgcgaagacctggaacgtcttggagtgcaggagagcgatctgcgcctatttttagatggtgacattctgcggcaggaccgcgtgagcaaggggtgttattctttcattcacctatccttccagcagttcctgacagcactgttctatacattggagaaagaggaagaggaagatcgagatggtcacacgtgggacatcggagacgtgcagaagctactgtccggggtggaaaggttgcgtaaccctgacctgattcaggccggatattactcctttggactggctaacgagaaaagggctaaagagttggaagctacgttcggatgccggatgtcgccagacattaaacaggaacttctgcgatgcgacatatcctgtaaaggggggcattccacggtgacagacctgcaggaactgctgggatgcctctatgagtcccaagaggaggagctagtgaaagaggtcatggcccaatttaaggaaatttccctgcacctcaacgccgtagatgtcgtgccgagctctttttgtgtgaaacactgtcgtaatcttcaaaagatgtccctgcaggttatcaaggagaaccttcccgaaaacgtgaccgcaagcgagagcgatgcggaagttgaaagaagccaggacgaccagcacatgctgcctttctggactgatctatgtagtatctttgggtccaacaaagatttgatgggcctcgccattaacgacagctttctctctgcctcactggtgcgcattttgtgcgagcagatcgcaagtgatacctgccacctccagcgggtcgtctttaagaatatatctccggccgatgctcataggaatttgtgtctcgcactcaggggccataagacagtgacatacctgacacttcagggtaacgatcaggacgatatgttccctgccctctgtgaagtgctgcgacacccagagtgtaatttacggtacctggggcttgtgtcctgcagtgccaccacacagcagtgggcagacctgtccttagccttagaagttaaccaatctctgacatgcgtgaatcttagcgacaacgaattgctggacgagggggccaagctgctttatacaaccctgagacaccccaagtgcttcctgcagcggctatctttggagaactgccatctcaccgaagccaattgcaaagatttggctgcggtgctcgttgtatcgcgggagctcacccacttgtgcctggccaaaaacccaatcggaaacacaggcgtgaagtttctgtgtgaggggctgagatatccagagtgtaagctccagacactcgtgctgtggaactgcgatatcacttctgatggttgttgcgatcttactaaactgctccaggaaaagagctccctcttgtgtctggatttgggactgaaccatatcggggtgaagggcatgaaattcctatgcgaagcactccggaagcccctgtgcaacttgcggtgtttgtggctctggggctgctccatcccacctttcagctgcgaggacctctgctcagctctatcctgtaaccagtcgttagtgacactggacttgggtcaaaaccccttgggaagttctggtgttaagatgcttttcgaaaccctcacttgcagcagcgggacattaaggaccttaagactgaaaatcgacgatttcaacgatgaacttaataagctattggaggagatcgaggagaaaaacccacagctcattatcgatactgagaagcaccacccctgggccgaacgcccctcaagtcatgatttcatgatctag

SEQ ID NO: 49093 - DNA, 3189 bp, Artificial Sequence
  Description of Artificial Sequence: Synthetic coding sequence
atggtgagcagcgcccagatgggcttcaacctgcaggccctgctggaacaactatctcaagacgagctcagcaaattcaagtaccttattacaactttctctctcgcccacgaattacagaagattccacacaaagaggtcgataaggcggacgggaaacagctggtcgagattctgaccactcactgcgattcctattgggtggagatggcctccctacaagtctttgaaaaaatgcatcgaatggatcttagcgagcgagcaaaggatgaggtccgggaggcagcactgaaatccttcaataagagaaagcctctctcactggggatcaccaggaaggaacggcctcctctggacgtggacgagatgcttgagcggtttaagacggaggcacaggcctttacggaaacgaaaggcaatgtcatttgccttggtaaggaagtgttcaaaggaaaaaagccagacaaggataatcgttgtaggtatatcctgaagactaagtttagggagatgtggaagtcttggcccggagacagcaaagaggtccaggtgatggcggagcggtacaaaatgcttatacccttttctaacccccgagtcttgcccggccccttcagttacactgtggtgctgtatggacctgccggactaggcaagacaacactggctcagaagctcatgctcgattgggccgaagataatctcatccataagttcaaatacgccttttatttgagctgtcgcgagctgagccgcctaggcccatgttcatttgctgaactggtctttcgagattggccagaactacaggacgatatcccccacatcctggctcaggcccgcaagatactgtttgtcattgacgggtttgacgaactgggcgccgctcctggagcgctgatcgaggacatttgcggggattgggaaaagaaaaaacccgtgccagtcttactcggaagcctgctgaaccgcgtgatgctgccaaaggccgcactgctggtgactactcggcccagagcactgagggaccttcgcattttagccgaggagcctatatatattagggtggagggatttctggaggaggatcggagggcctactttctccgtcactttggtgacgaggaccaggcaatgcgggctttcgagctgatgagatctaacgccgccttatttcaattgggaagcgcaccagctgtatgctggatcgtttgcaccaccctcaaactacagatggagaagggcgaagacccagtgccgacttgtctgaccaggactgggctgttcctgagattcttgtgctcccggtttcctcaaggtgcgcaactgagaggcgcactccgcaccctgagcctcctcgcggcacaaggtctttgggcacagacctccgttctgcacagggaggacctggaacgcctgggcgtgcaggaatccgacctccggctatttctggacggcgatatcctgcgccaggaccgagtatctaagggctgctacagctttatacatctgtccttccagcagttcttaacggccctcttctacacactggagaaggaggaggaggaagaccgagatggccacacatgggatatcggcgacgttcagaaacttttgtccggtgtggagaggctcaggaatccggaccttattcaggccggctattacagtttcggcctggccaacgagaagcgagccaaggaattggaggccacctttgggtgtcgtatgtcccccgacatcaagcaagagctgctgcggtgtgatattagctgcaagggcgggcacagtaccgtgaccgacctgcaggagcttctgggatgtttgtacgaaagccaggaggaggagctggtcaaagaggtgatggcgcaattcaaggagataagcctgcatttaaatgccgtggacgtagttccttcctccttctgtgtaaagcattgccgtaatctgcagaagatgagtttgcaagtgattaaagagaatttaccagagaacgttaccgcctccgagagtgatgcggaggtggagcgatcacaggacgatcaacatatgctccctttctggaccgacctgtgctccatctttggatccaacaaggacctgatggggctggcaatcaatgatagcttcctaagcgcctcgctagtcagaatcctgtgtgagcagatcgcttcagacacctgccacctgcagagggtggtattcaagaacatatcccccgccgatgcacatcgtaacctgtgcctagcccttcgcggccataagacagttacatatttgaccctgcaaggaaacgatcaggatgacatgtttccagcgctctgcgaggtactgaggcaccccgagtgtaaccttcgatatctggggctggtctcatgctctgcgactactcagcagtgggcggatctctcattggccctggaggtgaatcagtcactgacctgcgttaatttgtcagacaacgaactgctcgatgagggcgcaaagctgctgtacactacgctgaggcacccaaaatgctttcttcagcgactaagccttgaaaattgtcacttgactgaggctaattgtaaggatctcgccgctgtgttagtagtgtcaagagagctgacccacctgtgtttggcaaaaaaccctattggcaacacaggagtgaagtttctgtgcgaagggctgaggtatcccgagtgcaagctacagaccctggtgttatggaattgtgacatcaccagcgacgggtgctgcgaccttacaaaactcctgcaggagaagtccagcctgctttgtctcgatttgggactgaatcacatcggcgtgaaagggatgaaattcctctgcgaagcgctgcgcaaacccctgtgcaatctccgttgtctgtggttgtggggctgttctataccacctttctcttgcgaagacctatgctcggcactctcttgcaatcagtcattggttaccttggacctgggacagaatcctttaggcagctccggcgtcaagatgctgttcgaaacattaacctgttcttctggcacgttgagaacactcagactcaaaatcgacgactttaatgacgaactcaacaaattgttagaggagatcgaggagaagaacccacaactcattattgacaccgagaaacatcacccatgggccgagaggcccagcagtcacgattttatgatctag

SEQ ID NO: 49094 - DNA, 3189 bp, Artificial Sequence
  Description of Artificial Sequence: Synthetic coding sequence
atggtgagcagcgcccagatgggcttcaacctgcaggccctgctggagcagctgtcacaggatgaactgagcaaatttaaataccttatcacgacctttagcctggcccacgagctccagaaaatccctcacaaagaagtcgacaaggcagatgggaaacaattagtggagatactcacaacccactgcgattcctattgggtagagatggcgtcactgcaggtgttcgagaagatgcaccgcatggacttgagcgagcgagccaaagatgaggttagagaggctgcgctgaaatctttcaataaaaggaaaccattatcactgggaataacaagaaaagagcggccccccctggacgtggacgaaatgcttgaacggtttaaaaccgaagcccaggcattcaccgagactaagggcaacgttatctgcttagggaaagaggtgtttaagggcaagaagccagacaaggataataggtgcaggtacatcctcaaaaccaagttccgcgagatgtggaagtcttggcccggagactcgaaggaggtccaggttatggcagaaagatacaagatgttgattccattttccaacccccgcgtgctccctggcccattcagctatacagtcgtgttgtatggccctgccggtttggggaagacaaccttggcacagaagctcatgctcgattgggctgaagataaccttattcataaattcaaatatgccttctacctctcatgccgggagctgtcaagattagggccttgctctttcgcagagctggtctttcgtgactggcctgaacttcaagacgatattccccacattttagcccaagcccggaagatcctgttcgtgatcgacggtttcgatgaattaggagctgctcctggtgctctgattgaagacatctgcggggactgggagaaaaagaagcccgtccccgtgctactcgggtccttgctaaatcgggtaatgctgcccaaggcagctttactagttacaactagaccacgggcgctgcgggacctgcgcatccttgcggaagagcccatttacatccgggttgaggggtttcttgaggaggataggagggcctacttcttgaggcactttggcgatgaagatcaggccatgagggcattcgaactgatgcggtccaacgccgctttattccagctcggctcagcgccggccgtgtgctggatcgtgtgcacaacactcaagttacagatggagaagggcgaggatccagttcctacatgtctgacacgtactgggctattcttacggtttctgtgttccaggtttccacaaggggcccagctaaggggcgctcttcgtaccctgtcactgttggccgcccagggtctgtgggctcaaacttcagtattgcacagagaggacttggaacgcctgggcgtccaggaatcagatttgcgactattccttgacggggacatcctgagacaagaccgagtgtccaaagggtgttacagctttatacatctgtcatttcagcaattcctcaccgctctgttctacacattagagaaggaggaggaagaggaccgagacggtcatacgtgggatatcggagacgtgcagaagttgctatcaggagtagaacggctcaggaaccctgatctgattcaagccggctactactcattcggcttagctaatgaaaaaagagccaaggagctggaggccaccttcggttgtcggatgtctccagacatcaagcaagagttactacgatgcgacatctcctgcaagggcggtcatagcacagttacagatttgcaggagctgctgggatgcctttatgagtcacaggaggaagagctagtcaaagaagtgatggctcaattcaaggaaattagtctccacctcaatgctgtggatgtggtcccgtcaagtttttgcgtgaaacattgtcgtaatctgcaaaaaatgtcactgcaggtgattaaggaaaatctaccagagaatgttactgccagtgaatcagacgcagaagtcgagagatcccaggatgatcagcacatgctgcctttttggactgatctctgcagcatcttcggtagtaacaaagatctgatgggtttagcgatcaatgatagcttcctctctgcgagcttggtgaggattttgtgcgagcaaattgcctcggatacatgccacctgcagcgggtggtgtttaaaaacatcagtccagccgacgcccacaggaacctgtgccttgctctcaggggccataagactgtgacttatctgacccttcagggaaacgaccaggacgatatgttccctgctctgtgtgaagtgctccggcaccctgaatgcaacctgagatatctgggccttgtcagctgctccgcaactacacaacagtgggcagacttgtctttggcactggaggtgaatcagagtctgacgtgtgtgaatctcagcgacaacgagctcctcgatgaaggggccaaactgctgtataccaccctgaggcatcccaagtgcttcttacagcgtctgtctttggagaactgtcatctgactgaagcgaattgcaaggatttggcggccgtccttgtagtgagtcgggaattgacacacctgtgcctcgccaagaaccccattggaaacactggcgtgaaattcctgtgcgaaggcttgagatatccagaatgtaaactccagactctcgtattatggaactgcgatattacctccgacggctgttgcgatctcaccaaacttctccaggagaaatccagccttttgtgtctagacttaggattgaatcatatcggcgtgaagggcatgaagtttctctgcgaagctcttcggaagcctctgtgtaatctgcgctgcctctggctgtgggggtgtagcatcccgcccttttcctgcgaagacctatgttcggcgttgagctgtaatcaatctctggtcactctcgacctcggtcaaaacccactcgggagctctggcgttaaaatgctttttgagaccctgacgtgcagctccggcactctacgaactctgcgactgaagattgacgactttaatgatgaactgaacaagctcctcgaggaaatagaagagaagaacccccagttgattatcgacaccgagaagcatcacccttgggccgaacggccatctagtcacgatttcatgatctag

SEQ ID NO: 49095 - DNA, 3189 bp, Artificial Sequence
  Description of Artificial Sequence: Synthetic coding sequence
atggtgagcagcgcccagatgggcttcaacctgcaggccctgctggaacaactgagtcaggacgagctcagcaaattcaagtacttgatcacaaccttctcattggcccacgaactgcagaagattccgcacaaagaggtcgacaaagcagatggcaaacaactggtggagatactgaccacccactgcgattcatactgggtggaaatggctagtctgcaggtctttgaaaagatgcatcggatggacttatccgagagggcaaaagatgaggtgagggaggctgcactcaagtcatttaataagaggaaaccgctgtctttgggtatcactcgaaaagaaagacccccactggatgtggacgaaatgctagaacggttcaaaacggaagcccaagctttcacagaaactaaagggaacgtgatctgtctcggaaaagaagtatttaagggtaagaaacctgacaaagacaatcgctgcagatatatacttaagacgaagtttagggagatgtggaaatcctggcctggtgacagcaaagaggttcaggtgatggctgaacggtataaaatgctgatcccttttagcaaccctcgcgtgctacctgggcccttcagttataccgtggtactctatggtccggccgggcttggaaagaccaccctggcccagaagcttatgctcgattgggcggaggataacctgattcataaatttaagtacgcattctatctgtcttgtcgggagctgagtagattgggcccctgttcgttcgcagaacttgtattcagagattggcccgaactgcaggatgatatcccgcatattttagcacaggcgaggaagatattatttgttattgatggttttgatgagctcggggccgcacctggagcgttgattgaagacatatgtggagattgggagaaaaagaaacctgtcccagtacttctgggctctctgttgaatcgcgtgatgctccctaaagcagcgctgttggtgaccacacggccccgagcacttcgcgatctgcgaatcctggcagaagaacccatctacattagagtggaaggctttcttgaggaagatagaagagcatactttcttcgccactttggtgacgaggaccaggctatgagagcgtttgagctgatgcgcagtaatgctgctctgtttcagctaggctctgctcctgctgtatgttggatcgtgtgcactacactcaaacttcagatggagaagggtgaagaccctgtacctacttgcctgacgcgaacgggactattcttacgctttctgtgtagtcgtttcccccagggtgctcagcttcggggcgctctgaggaccctctccctcttggccgcacagggcctatgggcccagacgtcggtgctgcaccgagaggacctagagcggctcggagtgcaggagtccgatctgaggttgtttctggatggtgacatcctgaggcaagatcgtgtgtctaaggggtgctatagcttcatccacttgagctttcagcagttcctgaccgcccttttctataccctggagaaagaagaggaggaagacagggacggtcatacctgggatataggtgacgtacagaaacttctaagcggcgtggagcgcctgaggaaccctgacctgatacaggctggctattactctttcggacttgcaaacgagaaaagggccaaggagttggaggcaactttcgggtgccgcatgtcaccagacatcaagcaggaactgctgagatgcgatatcagttgcaaggggggacactcaactgttaccgacctgcaggaactcctgggatgtctctatgagagccaggaggaagagctggtgaaagaagtgatggcacagttcaaggaaatttccctacacctgaatgctgtggacgtggtgccatccagtttttgtgtgaagcattgccggaaccttcagaaaatgtccctgcaggtgattaaggagaacctgcccgaaaatgtaacggcctccgagagtgatgccgaagtggagcgatctcaggacgaccagcatatgctgcccttttggacagacttgtgtagtatcttcggatctaataaggatctgatgggtctggcaatcaatgactctttcctctccgctagcctggttcggatcttgtgtgagcagatcgcttctgatacctgccacctccagcgcgtcgtttttaagaatattagtcccgccgacgcccaccgcaacctctgcttggccctgcggggacataaaacggttacttacctgactttgcagggaaacgaccaggatgacatgttccccgcactgtgcgaggttcttcgccaccctgaatgtaatttaagatacctggggctcgtttcgtgcagtgctaccacacaacagtgggccgatctgtctctagccctggaggtcaaccagtcccttacgtgtgtcaatctgtcggataatgagctcttagacgagggggctaaactcctgtacactacactgcgccaccctaagtgttttctgcagagacttagcttggaaaactgccacttgacagaggccaactgcaaagatctcgcggccgtgctcgtggtgtctagagagttaactcatctgtgcttagctaagaaccccataggaaacactggggttaagtttctgtgcgaagggctgcggtaccctgagtgtaagttgcaaaccctggtgctgtggaattgcgatattacaagcgacgggtgttgcgacttgaccaagctgctccaggagaaaagctcattgttgtgcctagatctgggactgaatcatatcggcgtcaaaggcatgaaatttctctgcgaagctctcaggaaaccactttgtaatttgaggtgtctgtggctctggggttgctccatacctccattctcatgtgaggatttgtgctctgccctgagttgtaatcagagcttggtcactctcgacttggggcagaatccattgggtagctccggggtcaagatgctctttgagaccctgacctgcagttcaggaaccctgcgcactctcaggctgaaaattgacgacttcaatgacgaactgaataaactgcttgaggaaatcgaggagaagaacccgcagctgatcatcgataccgagaaacaccatccatgggccgaacggccctcgtcgcacgatttcatgatttag

SEQ ID NO: 49096 - DNA, 3189 bp, Artificial Sequence
  Description of Artificial Sequence: Synthetic coding sequence
atggtgagcagcgcccagatgggcttcaacctgcaggccctgctggaacaattgtctcaggatgagctttcgaaattcaaatatctgatcactacgttcagcctagctcacgagctgcaaaaaattccccataaggaggttgacaaggcagatggcaaacagctggtagagatcctgacaactcattgtgattcgtactgggtggaaatggcaagccttcaagtcttcgagaaaatgcatcgtatggatctgtccgagagggccaaggatgaggtccgagaggctgccctgaagtccttcaataaacggaagcctctgtcactgggaattaccaggaaggaaagaccgcccctggatgtcgatgagatgttagagaggttcaagaccgaggcgcaggcctttaccgaaactaaggggaatgtcatctgcttgggcaaagaggtgttcaaggggaaaaaaccagataaggataacaggtgccgttacatcttgaaaacaaagtttcgggaaatgtggaaaagctggccaggagactccaaagaagtgcaggtgatggccgaacgttataaaatgcttattcctttctcaaatcctagggtgcttcctggtccatttagctacacagtagtgctgtacgggcccgccgggctggggaaaaccaccctcgcacaaaagcttatgctggattgggcagaggacaatctgatccataaattcaagtacgcattctaccttagctgccgcgagctaagtcgcctagggccttgtagttttgcagagttagtgtttcgggattggcccgagttgcaggacgacatccctcatatcctcgcacaggcccgcaaaatcctgtttgtaattgatgggtttgacgaactcggtgctgctccgggagccctgattgaggatatttgcggggactgggagaagaagaagcccgtgcccgtcctactgggctcgctgctaaatagagtgatgttacccaaggccgcactgctggttaccacgcggcctcgagctctgcgcgatctccgtatcctggcagaagaacctatctacatccgggtcgaggggtttctggaggaagaccgacgagcatactttctgcgccactttggcgatgaggaccaggccatgagggccttcgagctgatgcggagcaacgccgccctttttcaattgggtagcgccccggcagtctgctggattgtgtgcacaaccctcaagctgcagatggagaagggagaggatcctgtgccaacttgtctcaccagaacaggtctattcttaaggttcctgtgctcccgattcccccagggggcccagctccgaggcgccctccggaccctgagcctgctggccgcccaaggtctgtgggcgcagaccagtgtcttgcaccgagaagacctggagcgactgggcgtgcaagagagtgacctgcgcttgtttctcgatggcgacattcttcgtcaagatagagtttccaaaggttgctactccttcattcacctgtctttccagcaatttttgactgcccttttctacacccttgagaaagaggaggaggaagatcgtgacggtcacacctgggatatcggcgacgtccagaaattgctctcgggtgtggaaaggctcagaaatccagacttaattcaagccgggtattacagctttggcctcgcgaatgaaaagagagcaaaagaactggaggcaacatttggttgtcgcatgtcccctgacatcaagcaggaactgcttcggtgtgacatcagctgcaagggaggacactcaacagtgactgacctgcaggagctccttggctgcctgtacgagagtcaagaggaggaactcgtgaaagaagtgatggcacagttcaaggaaatcagtcttcacctgaacgccgtcgacgtagtgccctcctccttttgtgtcaaacactgtagaaatctccagaagatgtccctgcaggtgatcaaagaaaaccttcccgagaatgtgacagcttctgagtctgacgccgaagtggagcgttcccaggacgatcagcatatgttacctttctggacggacctgtgctcaatcttcggaagtaacaaggatcttatgggtctggcaatcaatgactctttcctttcagcctctctggttagaatcttgtgcgagcagatagcgtctgacacctgtcacctccagagggtggtgtttaagaatatctctcctgcggatgcccatcgtaacctatgcctggccctgcggggacataagacagtgacatatctgaccttgcagggcaacgaccaggacgacatgtttccagccctttgcgaggtgctcaggcacccagaatgtaacttgcggtatcttggtctcgtgagttgctcggccacgacccagcagtgggccgacctttcactcgccctggaagttaatcaatccttgacatgcgtcaacctgtctgacaatgaactgctggatgaaggggccaagctgctctacacgaccttacggcaccctaagtgctttctccagcgactaagtttggaaaattgtcatctgaccgaagcgaattgtaaggacctggccgcagtgcttgtcgtgtcacgagagctcacacacctgtgcctcgccaagaaccccattggaaatacgggggttaaatttctgtgtgaaggcctcaggtacccggagtgtaagctgcagacactagtactgtggaattgcgatataacctcagacgggtgctgcgacctgaccaaactgctacaggaaaaaagctccctgctgtgcctcgatctcgggctgaaccatattggcgtgaaaggcatgaaattcctgtgcgaggcactgcgaaaaccactgtgcaacttgaggtgcctgtggctgtggggatgtagtatcccacctttcagctgcgaggacctctgttctgccttgagctgtaatcagagtcttgtgacacttgatttaggccagaatcccctgggctcttccggagttaaaatgctattcgagacactgacctgttcctccggcaccctccgcaccctgagattaaaaatagatgacttcaacgacgaactgaacaaattgctcgaagagattgaagaaaagaatcctcagctgattattgataccgagaaacaccacccctgggccgaaagaccaagctctcatgatttcatgatctag

SEQ ID NO: 49097 - DNA, 3123 bp, Artificial Sequence
  Description of Artificial Sequence: Synthetic coding sequence
atggtgagcagcgcccagatgggcttcaacctgcaggccctgctggagcaactgtctcaggacgaactgtccaagtttaagtacctgatcaccacattctctctggcacatgagttgcagaagatcccccacaaggaggtagataaggcggacggcaagcagctggttgagatactgacgacacattgcgacagttattgggtggaaatggcctcactgcaggtctttgaaaagatgcaccgcatggatctcagcgagcgagctaaggacgaagtgcgcgaggccgctttgaagagcttcaataagcgcaagccgttaagcctgggcatcaccagaaaagaacgcccacctcttgatgtggatgaaatgctggagcgcttcaaaacagaggcacaggacaaggataacaggtgccgatatatcctcaagaccaaatttcgagagatgtggaagtcttggcccggagacagcaaggaggttcaggtgatggccgaacgatataaaatgctgattccgttctccaatccacgggtgttacctggcccttttagctacaccgttgtgctgtatgggcccgcgggactcggcaagaccacattggctcagaagctgatgctggactgggcagaagataatcttattcataaatttaagtacgcattttatctttcatgcagagagctgagccgcctgggtccctgcagctttgccgagctggtctttcgggactggcccgaactgcaggacgatatcccccacatcctggcgcaggctcgaaaaatcctcttcgtgattgacggcttcgacgagctgggggcagcgcctggtgcactgatcgaagatatctgtggcgattgggagaagaagaaaccagtccctgtcctgctgggctcgttgctcaacagagtcatgttacctaaagcggcactgctagtgacgacccgccccagggcactgagagatttaaggattctagcagaagaacctatttatatacgggttgagggttttctggaagaggatagaagagcctactttttacggcatttcggcgacgaggaccaagccatgagagcttttgagctgatgcgctcaaatgccgccctgttccagctggggtctgccccagcggtatgttggatcgtttgtacaacgctgaaactccagatggaaaaaggagaggacccagttccaacatgtctgacacggacaggcctgttcttgagattcctatgctctcgcttcccacagggagcgcagttgcgtggtgcgctgcggacattatctttgctcgctgcccaggggctgtgggcccagacatccgtgctccaccgagaggacctcgagcgtctgggagtacaggaaagcgatctcagactatttctcgatggtgacattctccggcaggacagggtttccaaggggtgctatagtttcatccacctgtcttttcagcagtttttgacagccctgttttacacactcgaaaaggaggaggaagaggatagagacgggcatacttgggatataggcgacgttcagaaattgctgtccggagtggagcgactccgaaatcctgacctcattcaggccgggtactatagctttgggcttgcaaatgagaaacgtgcaaaggagctggaggcaacgtttggttgtagaatgtcacccgacatcaagcaggagctcttaaggtgcgatatcagctgcaagggcgggcactcgacggtgacagacctgcaggagctgttggggtgtctgtacgagagccaagaagaggagctggtcaaggaggtgatggcccagtttaaggagataagcctgcatctgaacgccgtggacgtggtaccctcttccttctgcgtcaagcactgccgcaatctgcagaagatgtccctacaggtcatcaaggagaacctacccgaaaatgtgaccgcatcggaaagtgacgctgaggtggagcggagtcaagacgatcagcacatgctgcccttctggacagatctgtgcagcatcttcggcagcaacaaggatctgatgggtctggccatcaatgactctttcctgagcgcttcactggttcgtattttatgcgaacagatcgcctcagatacatgccatcttcagagggtggtgtttaaaaatatatctcctgctgatgcacatcgcaacttgtgcctggcgctcaggggccataagactgtgacttaccttaccctgcaggggaacgatcaggacgatatgtttcccgctctctgtgaggttctgagacatcctgagtgtaatctacgctaccttggcctggtttcgtgctcagctactacccaacagtgggctgatctgagcctggctctggaagttaatcagagcctgacatgcgttaacttaagcgataacgaattgctggatgagggagccaagttgctctacactaccctacgtcaccctaaatgtttcctgcagcgactctcacttgagaactgccacctcacagaggctaattgcaaggatctcgcagcggtattagtggtgtccagggaattgactcacctttgtttggctaagaaccccattgggaacacgggggttaaattcctatgcgagggcctgcgctaccctgaatgcaagctccaaacactcgttctgtggaattgcgatatcaccagtgatggctgttgcgacctgaccaagctgctgcaagagaagagttccctactgtgcctcgacctgggcctaaatcatatcggtgtcaaaggcatgaagttcctgtgcgaagccctaagaaagccactttgtaacttgcggtgcctttggctttgggggtgctccatcccgccgttttcctgtgaggacctctgcagtgcactttcttgcaatcagtccctcgtaactctggatctgggacagaaccccctcgggtcctccggagtgaaaatgttgtttgaaacgctcacctgctcctcggggactctcagaacccttcggctcaagattgacgatttcaatgacgaattgaacaagctcctggaagaaatcgaggagaagaacccacaattgatcattgacaccgagaaacatcacccgtgggctgagcgcccctcatcacacgactttatgatttag

SEQ ID NO: 49098 - DNA, 3123 bp, Artificial Sequence
  Description of Artificial Sequence: Synthetic coding sequence
atggtgagcagcgcccagatgggcttcaacctgcaggccctgctggaacagctttcgcaagacgaactgtctaaatttaaatacttgataacaacattcagcctggcacatgagctacaaaaaatcccccataaggaggtcgataaagccgatgggaaacagctggtggagatcttgacaactcactgtgatagttattgggtagagatggccagcctgcaagtgtttgagaagatgcaccgcatggacttgtctgagcgggccaaggatgaggtccgcgaagccgccttgaagagcttcaacaagaggaaacccctatctttaggcatcactagaaaagagcggcctccacttgacgtggatgaaatgctcgaacggtttaagaccgaagcacaggataaagataaccgctgtcgctacattctgaaaacgaagtttcgcgagatgtggaagtcctggcctggtgacagcaaagaagttcaggttatggcggagagatataaaatgctgattccgttctcgaatcctagggttctcccaggtcccttctcttacacagtagttttatacggccccgctggactaggtaaaacaactctggcgcagaagctgatgttggattgggcagaggacaacctcattcataagttcaagtatgctttttatctgagctgccgcgagctgtctagactgggtccttgtagtttcgctgagcttgtatttcgggactggcctgaattgcaggatgacatcccccatattctcgcccaagctagaaaaatcttattcgttattgatggttttgatgagcttggcgccgcaccaggagcgcttatcgaggacatttgcggcgattgggagaaaaaaaaacctgttcctgtcctgttagggtctctgctcaaccgggtgatgctcccgaaagcagcactgttagtgacgacccgccccagagctctgcgtgatcttaggatcctggcggaggaaccaatctatatccgggtggaaggctttctggaggaggatagacgggcatatttcctgaggcactttggagatgaagaccaggccatgcgcgctttcgagctgatgcggagcaacgctgcgttatttcagctagggtcagctcctgcggtgtgttggatcgtgtgcacgactctgaaactgcaaatggagaaaggggaagatccagtgccaacctgtttaacgcgaacaggcctgttcctccgtttcctttgtagccggttcccccagggcgcccagctcaggggagccctgaggacactgtccttattggcggctcagggcctgtgggcgcaaacgagcgtgctacacagagaggatctggaaaggctgggcgtgcaagagtctgacctgcggctgtttttagatggcgacattcttagacaggatagagtgtcaaaaggttgttactctttcattcacctgtctttccagcagttcttaaccgcgctgttctatactctggaaaaagaagaggaagaggaccgtgatggacatacctgggacatcggggatgtgcagaaactcctgtcgggcgttgaacggctcaggaatcctgacctgattcaggcaggctattactccttcggcctagctaatgaaaagagggcaaaggaactcgaggctaccttcggttgccggatgagtcctgacattaagcaagagctcctccgctgtgacatttcctgtaagggtggacacagcactgtaaccgacctacaggaattgttgggttgcctttacgagtctcaagaggaggagttagtcaaggaggtcatggctcagtttaaggagatatcattgcacctcaacgccgtggatgttgtgccatccagtttttgcgtaaaacactgccgcaatctccagaagatgagcctccaagtaatcaaggaaaacctgccggagaatgtgacagcctccgaatccgacgccgaagtggagcgctcccaggatgaccagcacatgctgcccttttggaccgatttgtgttcaatatttggctcaaataaggatctaatgggcctggccattaatgactcattcctgagcgcgtctctggtgaggatcctgtgtgaacaaattgcctcggacacatgtcatctccagcgagtcgtgttcaaaaatatatcccccgccgacgcacaccgcaacctctgcctggccctgcggggccacaagacggtgacttacctgacccttcagggcaacgatcaagacgacatgttccctgcgctgtgcgaagtcctgagacaccccgaatgcaacctgcggtacctgggcctagtaagttgtagcgccacgacccagcagtgggcggacctctctctcgcactggaggtgaatcagagtctgacctgcgtaaacctaagcgacaatgagctgctggacgagggggctaaactcctgtacaccactctgaggcatccgaaatgcttccttcaacgactcagcctggagaattgccacctgaccgaagcgaattgcaaagaccttgcagccgtgttggtagtatctcgggagctgacacacctgtgcctcgctaaaaatcccatcggcaataccggggtgaaatttctgtgcgaagggctgcgatatccagagtgcaagctgcagacactggtcttgtggaactgcgatattacctccgatggatgttgtgatctgaccaaactcctgcaggaaaaaagctctctgctgtgcttagatttaggcctcaaccacattggcgttaaagggatgaagtttttatgcgaagctctcaggaaacctctttgcaacctccggtgcctttggctctggggatgcagcatcccacctttcagttgtgaggatctgtgcagtgctctgagttgtaatcagagcctggttaccctagacctcggacagaatccattaggctccagcggagtgaaaatgctattcgagaccctgacctgcagcagcggcacactcaggaccctaaggttgaagattgacgattttaacgatgaattgaacaagttgcttgaagagatcgaggagaaaaacccccagctcattatcgacaccgaaaagcaccacccatgggcagagaggccatccagccatgattttatgatctag

SEQ ID NO: 49099 - DNA, 3189 bp, Artificial Sequence
  Description of Artificial Sequence: Synthetic coding sequence
atggtgagcagcgcccagatgggcttcaacctgcaggccctgctggagcagctgagccaggatgagctcagtaaattcaagtatctgattacgacttttagtctggcccatgaacttcagaagattcctcacaaagaagttgacaaggctgacgggaagcaactggtggaaatcctcaccacgcactgtgactcttattgggtggagatggcatccctgcaggtattcgaaaagatgcaccgaatggacttgagcgagagggctaaagacgaggtgagggaggcggcgctgaagagcttcaacaaacggaagcccctgtcattgggtatcacacggaaagagagacctccactagacgttgatgagatgctggaacggtttaagacggaggcgcaagccttcacagaaaccaagggcaatgtcatatgcctggggaaggaggtgtttaaaggcaagaaacccgacaaagataatcggtgccggtatatcctgaagacgaaatttcgtgagatgtggaagtcatggcctggagattctaaagaagttcaagtgatggccgaacgatataaaatgttgatccctttttccaatccacgcgtgctaccaggacctttcagttatactgtagttttatatggccccgctggtctgggaaaaacaacattggctcagaagctgatgttggactgggccgaggataatctgattcataaattcaagtatgctttctatcttagctgtcgggaattaagccgcttaggcccctgcagcttcgccgagctggttttcagagactggcctgagctacaggacgatatcccgcatattcttgcgcaagctaggaaaattttgttcgtcatcgacggcttcgacgaattgggcgccgcacctggcgctctgatagaggatatatgtggtgattgggagaaaaaaaagcctgtgccagttctactcggcagcctcctcaatcgcgttatgctccccaaagcagccctcctcgtcaccacgaggcctagagcgttgcgtgatttaaggatccttgccgaagaacctatctacatacgcgtggaggggttccttgaggaagatcgtcgggcttacttccttagacattttggagacgaggaccaagccatgagagcgttcgaactcatgcgcagtaatgctgctctgttccaattgggaagcgctcctgctgtttgttggatagtgtgcactacattgaaacttcaaatggagaagggcgaggatcctgtgcccacttgcttaacgcggacgggcttatttctgaggttcctttgtagccggttcccacaaggagctcaattaaggggagcgctacggaccctgagtctacttgccgcgcagggcctctgggcgcagacgtcagtcttgcaccgagaggacctcgagcgtttaggcgtgcaggaaagtgatcttcgattgttcctagacggcgatattctgagacaggatcgcgtgtccaaaggatgttactctttcattcacctgagttttcaacagtttctgactgctttgttttacacactagagaaagaggaggaagaggatcgcgacggacacacttgggacatcggtgatgtgcaaaagctgctgagtggagtggagcgtctccgtaatcccgacttgattcaggctggctactacagcttcggtctggctaatgaaaaaagagccaaggaactggaggccacgtttggttgcagaatgtcaccagatattaagcaggaattgctcaggtgtgatatttcatgcaaaggtggacacagcacagtaacagacctacaggaactactcggttgtctttacgaaagccaggaagaagaactcgtgaaagaagtcatggcccagtttaaggaaatttcactccacttgaacgccgtggatgttgtcccaagctcattctgcgtaaagcattgtcgaaatctgcagaagatgagtctgcaggtaatcaaggagaaccttccagagaacgttactgcttctgagagtgatgccgaggtcgaaaggtcacaagacgaccagcacatgctcccattctggaccgatctgtgtagcatcttcggatcaaacaaggatctgatgggactggcaattaacgactccttcttatctgcttccttggtgcgcattctgtgcgagcagattgcctctgatacatgtcatcttcagcgggtagtgttcaagaacatcagccccgccgacgcacaccgaaatttgtgtcttgcattgcgaggccataaaaccgtgacctacctgacactgcagggaaatgatcaggacgatatgtttccggcactgtgcgaagttctgcggcaccccgagtgtaaccttcggtacctcggcctggtctcgtgctccgcaaccacacagcagtgggccgatttgagccttgcactggaggttaaccagtccctgacgtgcgtgaacctttctgataacgagcttctggacgaaggggctaagttactctacaccacactccgacaccctaaatgttttctgcagaggttatccctggagaattgccacctgaccgaggccaattgcaaagacctggccgcagtgctggttgtgtcacgggagctaactcacttgtgtctggctaagaatccaattggtaacaccggagtgaagttcctttgcgagggactccgatatcccgaatgcaaactgcagacactggtcctgtggaattgtgatattacgtcagacgggtgttgtgatctgactaagctgctgcaggaaaagagtagcctcctttgtttggatcttggactcaatcatataggagtaaagggaatgaagttcctttgcgaggctctgcgcaaaccattgtgtaatttgcgatgcctatggctttggggttgctcaattccgcctttttcctgcgaggatttgtgcagtgccctcagttgtaaccagtcactggtgaccctagatctgggtcagaatccactcggaagtagcggagtcaagatgctgtttgagacactgacctgttcaagcggtactttgcgaactctgaggctaaagattgatgactttaatgatgagctgaataaattactggaagagatcgaggaaaagaacccgcagttgattattgatacggagaaacatcatccctgggcagagcgtccttcctcccacgattttatgatttag

SEQ ID NO: 49100 - DNA, 3123 bp, Artificial Sequence
  Description of Artificial Sequence: Synthetic coding sequence
atggtgagcagcgcccagatgggcttcaacctgcaggccctgctggagcagctgtctcaagatgagctttcaaaattcaagtacttgatcactaccttttcactggctcatgagctacaaaagatacctcataaggaggtagacaaggctgatggcaagcagctggtggagatcctcacaactcattgcgattcctattgggtggagatggcatccttacaggtcttcgaaaaaatgcacaggatggacctcagcgagcgagcaaaagatgaggtgcgcgaagctgcgctcaaatccttcaacaaaagaaagcctctttccttagggataaccagaaaggagcgacctccgctcgacgtcgacgagatgctggaacgattcaaaactgaagcccaggataaggataatcgatgcaggtatatattgaagactaaattcagagagatgtggaaaagttggccaggtgatagtaaggaggttcaggtcatggctgagcgctacaaaatgctgatccctttctccaatcctcgtgtcctcccagggccattttcctacacggtagtcctctacggccccgccgggcttggcaagactactctcgcccagaaactcatgctagattgggccgaagataaccttatccataaattcaaatacgcattctatttgtcctgccgcgagctgagccggctgggcccctgcagttttgctgagctggtgtttagagactggcccgaactccaggatgacatcccacatattctcgcacaggcacgcaaaattctgttcgtgattgatggtttcgacgaattaggagctgctccgggcgcattgattgaagatatatgcggggactgggagaaaaaaaagccagttcctgttctcctcggctccctcctaaatagggttatgctgcccaaagcagcactcctcgtgaccacgagacccagagccctaagagacttgcgcatccttgccgaggaacctatctatatccgtgtggagggattcctcgaagaggatcggcgcgcctacttcctgaggcactttggggatgaggaccaggccatgagggctttcgaactgatgagatcaaatgcagccctgttccagctgggctcggcaccagccgtgtgctggattgtctgtacgaccttgaaactgcagatggaaaaaggcgaggatccagtccccacgtgtctgactaggactggcctgttcctgaggtttctctgctccaggttcccacagggggcccagcttaggggcgcgttgcggaccctgtccttgctggcagcacagggcctctgggctcagaccagtgtccttcatcgggaggatctcgagagattaggagttcaggagagcgatctgagactgttcctggatggggatattctccggcaagatcgcgtcagcaaaggctgctattcattcatacatttgagctttcagcaatttctcaccgccctgttttacacattggagaaggaggaggaggaggacagggacggacacacttgggacatcggagatgttcagaaacttctcagcggggtggagagactacgaaaccctgacctaatccaggcagggtactacagctttggcctggccaacgagaaaagagctaaggagcttgaggctaccttcggatgtcgcatgagccccgacataaagcaagaacttttgagatgtgacatttcatgcaaggggggacacagcactgtgaccgacctgcaagagctcctgggctgcctgtatgagtcacaggaagaggaactggttaaggaggtcatggctcagttcaaggaaatcagtctgcatctgaacgcagtagatgtggtcccttcttcattttgtgtgaagcattgcagaaacttacaaaaaatgagcttgcaggtcatcaaagagaacctcccagagaacgtgacagcctcagaatctgacgccgaggtggaaagaagccaggacgatcagcacatgctgcctttttggactgacctttgttctatctttgggagcaataaagacctgatgggattggcaattaatgactccttcctctctgcctctttagtccgaatcctttgtgagcagattgctagcgatacctgccatttacaacgcgtcgtgttcaagaatatcagcccggccgacgcacaccgtaacctctgcttagccctgcgtggccacaaaacagtcacctacctcactctccagggaaatgaccaggacgatatgttcccggcgctgtgtgaggtgcttagacacccagagtgcaatttgcgctatctgggcctggtgagctgttctgccaccacgcaacaatgggctgacctttccctggcactggaggtaaatcaatctctgacttgcgtcaacctgagtgacaacgagctgttggacgaaggagcaaagctcctgtacactaccctgcgccatccaaagtgctttctgcagcgcctgagtctggaaaactgccacttgacagaggcaaactgtaaggacctcgcggctgtgctggtggtgtcccgagaactgacgcacctgtgcctcgcaaagaaccctatcgggaacacaggtgtgaaattcctgtgtgagggattgaggtatccagaatgcaaacttcagacccttgtcttgtggaactgtgacattaccagcgatggatgctgtgacttaacaaaactgctgcaggagaagagtagtctgttgtgcttggatttgggacttaatcatattggagtcaagggaatgaagtttttgtgtgaagccctgcgcaagcctctatgtaatttacgttgcctctggctatggggatgtagcatcccaccattttcatgtgaggacttatgttctgccctgtcatgtaaccagtccctggtgaccctagatctgggccagaatcccctgggcagctccggtgtgaagatgctgtttgaaactctgacttgcagctcaggcaccctgcgcacactgcggctcaagattgatgacttcaatgacgagcttaacaagctgctcgaggaaatcgaggagaagaatcctcagctgattattgatacagaaaaacatcacccctgggcagagagaccctcttcacatgattttatgatctag

SEQ ID NO: 49101 - DNA, 3189 bp, Artificial Sequence
  Description of Artificial Sequence: Synthetic coding sequence
atggtgagcagcgcccagatgggcttcaacctgcaggccctgctggagcagttgagtcaggacgagctatctaagttcaaatacctcattactactttctcattagcacacgagttgcagaagatccctcataaagaagtggacaaagccgacggcaagcagttggtggaaatcctgacaacccattgcgactcctattgggtggagatggcttctttgcaagtgttcgagaagatgcacaggatggatttaagtgaaagagcgaaagacgaggtcagagaggctgctctgaaatctttcaataaaagaaagcctttatcacttgggattaccaggaaggagcgtccccctttagacgtagacgaaatgttggaaaggtttaagaccgaggctcaggccttcacggaaaccaaagggaatgtgatttgccttgggaaagaggtatttaaagggaagaaacccgataaagataatagatgccgatatatcctaaaaactaagtttcgggagatgtggaaatcctggccgggagatagcaaggaggtgcaggtcatggcagagaggtacaaaatgctgattcccttttctaaccctcgggtcctgccggggccattttcttacacagtcgtcctttacgggccagcagggttgggcaaaacaaccctggctcaaaagctcatgcttgactgggcagaagacaatttaattcataagttcaagtatgctttttacctgtcatgcagagagctgagcagacttggcccatgttcattcgctgagctggtgttccgggattggccggaactgcaagatgacattccgcatatcctggcccaagcccgcaagatacttttcgttatcgacggcttcgacgagttaggggccgcccctggcgcacttattgaggatatctgtggagattgggagaagaagaaacccgtgccagtactgttaggatcgctgctcaatcgggtgatgctacctaaagccgctctgctggtgactacccgcccccgagctctcagggacctcaggatcctcgcagaagagcccatttatatccgcgtggagggcttcttggaagaggatcgtagagcttacttcctgcggcactttggcgacgaagatcaggctatgagagcctttgagttgatgcggagcaatgctgctctcttccagctcggatctgcccctgccgtatgttggatcgtctgcactacccttaagctacagatggaaaagggtgaggacccagttccaacctgccttaccaggaccggtctgtttcttaggtttctatgttcgagatttcctcagggggcccagcttcgcggcgccctacggacactgagcctattggcggcgcagggcctgtgggcgcaaacttcagtgctccatcgagaagatttggaacgcctcggcgtgcaggaaagtgaccttaggttattcctggatggggatatactgcggcaagaccgtgtcagtaaaggatgctattcattcattcacctgtctttccagcagttcttgacagcgttgttctacaccttggagaaggaagaggaagaggaccgtgacgggcacacttgggatattggagacgtgcagaagcttctgtcgggtgtcgagaggcttcgaaatcccgatctcatacaagccggctactacagctttgggctggccaacgaaaaaagggccaaagaattggaagccacttttggctgccgtatgtcccctgacatcaaacaggagctcctgaggtgcgacatctcttgcaagggcggtcacagcacagtgacagatctgcaggagctattggggtgcctctatgaaagccaagaggaggagctggtgaaagaagtgatggcgcagttcaaagaaattagcctgcatctgaatgcggtggatgtggttcctagctcattctgcgtcaaacattgccgtaacctgcagaagatgagcctgcaagtgatcaaagagaatctgccagagaatgtcaccgcctccgagagcgatgctgaagtggagaggtctcaggacgaccagcacatgttgcccttctggaccgatctctgtagcatctttggctccaataaggacctgatggggttagctattaatgactcattcttgtctgccagcctcgtgcgcatcctctgtgaacaaatcgcatcagatacctgccaccttcagagagtggtgttcaagaatatttctcctgccgatgcccaccgcaacctgtgcctggcgctccgcgggcataagacagttacgtacttgactctgcaaggaaatgaccaggatgacatgttccctgccctatgtgaagtgcttcgacatccagaatgtaatctgcgctatctgggattagtatcttgttctgctacaacccagcagtgggccgacctgtctttagccctcgaggtgaaccagagcctgacctgtgtaaatctgtcagacaacgaactgcttgatgagggcgctaaacttttgtatacaaccctgagacatcccaaatgttttttgcaacgtttaagcctggagaattgccaccttacggaagctaactgcaaagatctcgccgcggtattagttgtctcacgggaactaactcacctgtgcttagccaagaacccaattgggaataccggcgtcaagtttttatgtgaagggttacggtatcccgagtgcaagctgcaaacccttgtattgtggaactgtgatattacaagcgatggttgctgcgacctgacgaagctgctgcaggaaaagagcagtctgctttgccttgacctcggactgaatcacatcggggtgaagggaatgaagttcttatgtgaggctcttaggaagcccctatgcaacttgcgctgcctctggttgtggggatgtagcataccaccctttagctgtgaggatttgtgctctgccctgtcttgcaaccagagcctcgtgaccctggacctgggccagaatcccctcgggagttccggagtgaagatgctcttcgaaacacttacttgttccagtggtacactccggactctgaggttaaagattgacgacttcaacgacgagcttaacaagctgctggaggagattgaggagaaaaatcctcagctcataatcgacactgaaaagcaccatccctgggcggagcgaccctccagtcatgattttatgatctag

SEQ ID NO: 49102 - DNA, 3189 bp, Artificial Sequence
  Description of Artificial Sequence: Synthetic coding sequence
atggtgagcagcgcccagatgggcttcaacctgcaggccctgctggagcaactctcccaggacgagctgtccaaattcaagtatcttatcacaaccttcagtcttgcccacgaacttcaaaagatccctcacaaggaggtggacaaggcagacgggaagcagctggtggaaattctcacaacgcactgcgattcgtattgggtagagatggcatccctccaggtgttcgagaaaatgcatcgcatggacttgagcgaaagagcgaaggacgaagtaagggaggccgccctgaaatccttcaataaaagaaagccactgtcactcggaattacccgaaaggagagacccccccttgacgtggatgaaatgttggaaagatttaaaaccgaggctcaagccttcaccgagactaagggcaatgttatatgtctgggcaaagaggtgttcaaaggaaaaaaacccgataaggataatcgctgccgatacatcctgaaaacaaaattccgtgagatgtggaagagctggccgggcgattctaaggaggtgcaagtgatggcagaacggtacaagatgctgattccatttagtaaccctagagtcctgcccggcccctttagttacactgtagtgctgtacggaccagccggcctgggcaaaactacactggcccaaaaacttatgcttgactgggcagaagacaatttgatccacaagtttaagtatgccttctaccttagctgtagagagctctccaggcttgggccatgcagcttcgcagaactggtgttccgcgattggcccgaattgcaagatgatattcctcacatcctagcccaggctcggaagatcctgttcgtgattgacggctttgatgagctgggggcagctcctggggcgctcatcgaagacatctgcggggattgggaaaagaagaagcccgttcccgttctgctcggaagcttactgaatagggttatgttacctaaagcagctctgctcgtaaccacccggcctagagcgcttcgggacttgaggatcctcgcggaggagccaatctacattcgcgttgaaggctttctggaggaagatagacgggcctacttcttacgacactttggggatgaagatcaggccatgagagcgttcgaattgatgcgctctaacgctgcattattccaacttggtagtgcccccgctgtgtgctggatcgtgtgtacaaccctcaaactgcagatggaaaagggcgaagatccagttcctacctgtctgacccgcaccggtctgttcctccgcttcctgtgcagccggttcccacagggcgcccagctaagaggcgctctgagaacactttcacttttggccgctcagggactgtgggcacagacaagtgtcctgcaccgtgaggacttggaacgcttgggagtacaggagtctgacctccggttgttcttggatggtgacatcctgagacaggatagagtatctaaaggctgttatagctttattcatctctcctttcagcaatttcttacggccctgttctatactctggaaaaggaggaggaggaagatcgggatggacacacgtgggacattggggatgtccaaaaactgttgagtggcgtggaacgactaagaaaccccgatctcattcaggcgggatattactccttcggccttgccaatgaaaagagagctaaagagcttgaggccactttcgggtgccggatgtctcctgacatcaagcaggagctcctgagatgtgacatttcctgcaaaggcgggcattccaccgttacggatcttcaagaactcctgggatgcctctacgagagtcaggaagaggaacttgtaaaggaggtgatggcccagtttaaggagatctctctgcacctgaatgccgtggatgtggttccaagttctttttgtgtgaaacactgtcggaacttacaaaaaatgtccctgcaagtgatcaaggagaatctgcctgagaacgtaaccgcctcagaatctgatgcggaggtggagcggagccaggacgaccaacatatgctgcccttttggaccgacctatgttccattttcgggtcgaataaagacttgatggggttggcaattaacgactctttcttgtcggcctcattggtccggatcttatgcgagcagattgctagtgacacgtgccacttgcagcgtgtggtatttaaaaacatctcaccagctgatgctcatcgaaatctgtgtttggcccttcgaggccacaagaccgtcacgtacctcacattgcaaggcaacgaccaagacgacatgttcccagcactctgcgaagtcctcagacaccctgaatgtaaccttaggtaccttggcctggtttcctgcagtgcgaccacgcagcaatgggccgacttatcactcgcactggaagtgaatcagtccctcacctgtgtcaatctgtcagataacgaattacttgacgagggtgccaaactactgtatactaccctgagacatcctaaatgtttcctccagcgcctgagcctcgagaactgtcatttgaccgaggccaattgtaaagacctggcagccgtgctagtggtcagtcgggaactgacccatctctgcttagccaaaaacccgatcggcaacaccggggtgaagttcctttgtgaaggcctgagatatcctgaatgcaagctgcagaccttggtgctctggaattgcgatatcacaagtgatggatgctgtgacctcactaaattgcttcaagagaaatccagtcttttgtgccttgacctgggactgaatcacataggggtgaaaggcatgaaatttttgtgcgaagcactcagaaagccactttgtaatttgcgctgtctctggctgtggggttgttccataccccctttctcctgtgaagatctatgcagcgccctcagctgtaatcagtctttggtgacccttgaccttggccagaaccccctgggatcatctggtgttaaaatgctgtttgagacgctcacctgttcttccggaacgttgcgaactctgagactgaagatcgacgactttaatgacgaactcaataagttacttgaggaaatcgaggaaaagaacccccagctgatcattgatactgaaaagcatcacccatgggccgaacggccttcttcccacgatttcatgatttag

SEQ ID NO: 49103 - DNA, 3189 bp, Artificial Sequence
  Description of Artificial Sequence: Synthetic coding sequence
atggtgagcagcgcccagatgggcttcaacctgcaggccctgctggaacaactctcccaggacgagctctctaagtttaaatacctgattaccacattcagcctggctcatgagttgcagaagattccacacaaggaggtggacaaggcagacggcaagcaattggtggagattttgaccacacattgcgattcttactgggtggaaatggcttccctgcaggtttttgaaaagatgcaccgaatggatctgtcggaaagggccaaggacgaagtgcgcgaggccgccctgaagagcttcaacaagcggaagcctctgtcactgggcattacccgcaaggagagaccccctctagacgtggacgagatgctcgagaggttcaagaccgaagcccaggcgttcacagaaaccaagggaaatgtcatttgcctaggcaaggaagtgttcaaaggcaaaaagccagacaaagacaatcgctgcaggtatattctgaagactaagttccgagaaatgtggaaatcctggccaggtgactctaaggaagttcaggtaatggcagagaggtacaagatgctgatcccatttagcaatcccagagtactgcctgggccattcagctatactgtggtcttatatgggcccgcaggcttgggaaaaaccaccttggctcaaaagctcatgttagactgggcagaggacaacctcatccacaagttcaagtacgccttttacctatcttgccgcgaactgtctcgccttggcccatgctcctttgcagagctggtgttccgtgattggccagagctgcaggacgacatcccacacatactggcacaagcgagaaaaattctcttcgtcatcgatggattcgatgaactcggcgctgcacctggcgccctaattgaagacatttgtggcgattgggaaaagaagaagcctgtgcctgtccttttgggatcccttctgaatagagtgatgctacctaaggctgccctgctggtaactactcgtcctcgcgccctcagggatctgcgcatccttgcagaggagcctatctacattagagtagaaggcttcctggaagaagataggcgggcctatttcctgcgtcatttcggagacgaagaccaggccatgagagcgtttgagttgatgaggtccaacgccgctctgtttcagctcggctcagccccagccgtttgttggatcgtttgcaccaccctcaaactgcagatggaaaagggcgaggaccccgtgccaacatgtctgacaagaacaggcctgttcctaagattcctctgctccaggtttccacagggagctcaactccggggcgcattgaggaccctttcactgctcgctgctcagggtctgtgggcgcaaacatccgtgctgcatcgagaggacctagagagattaggagtgcaggaaagcgacctgaggctgttcttagacggagacatcctgcggcaggaccgggtttctaaggggtgctatagctttattcatctctcctttcagcagtttctgaccgcccttttctacaccctcgaaaaggaggaagaggaggaccgtgacggtcatacctgggatatcggggacgtgcagaaactgctgtcgggcgtggagcgcctgcgcaatcccgatctaatacaggcggggtactactcattcggtctcgccaatgagaaaagggcaaaggagctggaggctaccttcggctgtcggatgtccccagacatcaagcaggagcttcttaggtgtgatattagttgtaaaggagggcactccacagtaacggatctccaggaactcttaggttgcttatacgagagtcaggaggaggagctggtcaaggaagttatggcccagttcaaagagatctctctccacctgaacgcggtcgatgtggtgccctcatccttttgtgtcaaacattgccggaatctccagaagatgagtctgcaggtcatcaaagagaaccttccggaaaatgtgacggccagcgagagtgatgcagaggtggaacggtcgcaggatgaccagcatatgctgcccttttggacagatttatgctcaatctttggttccaataaagacctcatgggtttagccataaatgattcgttcctgtcggccagtttagtcagaatcctgtgcgagcagatcgcatccgatacttgccatttgcagcgcgtggtctttaagaatatcagcccagctgacgcgcaccgtaacttgtgccttgcactccggggacacaaaactgtgacttacctgacactgcaaggcaatgatcaggatgacatgtttcccgccctgtgcgaagtgctgcggcacccagaatgcaatctgaggtatctcgggctggtatcttgtagcgccacaacgcagcagtgggcagatctatctctcgcactggaggtgaaccagtccctgacgtgcgtgaatctgtctgataatgaactcctcgatgagggcgctaagctcctctatacaacgctgaggcaccctaagtgttttctccagcgccttagccttgagaactgtcatctgacagaagccaactgcaaagatctggcggccgtactggttgtgagccgtgagctcacccacctctgccttgcgaagaatccaattggtaatactggcgttaaattcctgtgtgagggactgcggtaccccgagtgtaagttacaaaccctcgtgctgtggaactgtgatatcacaagcgacggctgttgcgatctaactaagcttttacaggaaaagagctctctgttgtgcttggaccttggcctcaatcacatcggagtcaaaggaatgaaatttctgtgcgaggcgctacggaagccgctctgcaatctgcgttgcctgtggctatgggggtgttccatccccccattttcatgcgaggacctgtgcagcgctttgtcctgcaaccaatccctcgttactttagacctgggacaaaacccactgggatcatccggggtcaagatgctgtttgagacactcacttgttctagtggaactctgagaactctgcggctgaagatcgatgactttaacgacgagcttaacaaactgcttgaggagattgaggagaaaaatccgcaacttatcattgataccgagaagcatcatccatgggccgagcggcccagtagtcatgattttatgatctag

SEQ ID NO: 49104 - DNA, 3123 bp, Artificial Sequence
  Description of Artificial Sequence: Synthetic coding sequence
atggtgagcagcgcccagatgggcttcaacctgcaggccctgctggagcagctgtcccaagatgaattaagcaagttcaagtaccttatcactactttttctctcgcccacgaactccagaagatcccacacaaggaagtggataaggcagacgggaagcagttggtggagatcctgacgacacattgtgatagctattgggtggagatggcatctctgcaagttttcgagaaaatgcaccggatggacctgtctgagcgcgccaaggacgaggttcgcgaagcggccctcaagtctttcaacaagcggaagcccctgtccctgggcatcacaaggaaggagcgccctcctctcgacgttgatgagatgttggaaaggtttaaaaccgaagctcaggataaggacaacaggtgtcgttacattctgaagaccaagttccgggaaatgtggaaatcctggcccggggattctaaagaggtccaggtcatggcagagaggtacaaaatgttaatcccattttctaatcccagagtactgccggggcccttctcctatacagtagtgctatacggtccggctgggctaggcaaaacaacattggcccagaagctgatgctggattgggccgaggataacctgatccacaagtttaaatatgcgttttatctctcttgtagggagcttagccgcctaggcccttgctcgttcgccgagctcgtgttccgtgactggcctgaacttcaagacgacatccctcacatcttggcgcaggcacgtaaaattcttttcgtcatagatggattcgatgagttgggtgctgcccctggcgcattgatcgaggatatttgcggggactgggaaaaaaaaaaaccagtcccggtactcctgggttccctgctcaaccgcgtgatgcttccgaaggccgcgttactggtgactactaggccgagggcactccgagacctcagaatcttggcagaggagccaatctatatccgggtcgaaggcttccttgaagaagacaggagggcctatttcctcagacacttcggggacgaggatcaggcaatgcgggctttcgagctgatgcggagtaatgctgcgctgttccaactcggaagcgctcccgcggtgtgttggatcgtctgtaccactttgaagttgcagatggaaaaaggggaagacccagtcccaacatgcctgaccagaacaggcctttttctgcgcttcctgtgtagtaggttcccacagggggcgcagttgaggggggctttacgtacactaagcctgctagcggcacaaggtttgtgggctcagacatcggtcctgcaccgggaggatctggagcgcctgggagtgcaggaatccgacctgcgcttatttctagatggtgacatactgcggcaggatagagtgagcaaggggtgttacagcttcatacacctgtcctttcagcaattcctgactgccctgttctataccttggagaaggaagaggaagaggatcgggacggacatacatgggacattggcgatgtgcagaaactgctgtccggcgtggaacgccttaggaatcctgatttaatccaagcgggctattattccttcggactggccaacgagaaaagagccaaagaattggaagcaacattcggttgtcggatgtccccggacatcaagcaggagctgctgcgatgtgacatttcctgcaaaggcggacacagcacagtgacggatctgcaggagcttctgggctgtctgtacgagagtcaggaagaagagctggtcaaggaagttatggcccagtttaaggagattagtcttcatctgaatgccgtggacgtggttccctccagcttctgcgttaagcattgccgtaacctgcagaaaatgtccttgcaggtgattaaagagaatctaccagagaatgtgactgcaagtgagtccgatgctgaggtcgaaagatctcaggatgatcagcacatgctaccgttctggactgacctgtgttctatctttgggagcaacaaagatctaatgggacttgcgatcaacgacagcttcctgtcagcctctctcgtaagaattttgtgtgagcaaattgcctccgacacttgccatcttcagcgggttgtgtttaaaaacatcagccccgctgacgcacaccgcaacctttgcttggcgctccggggtcataaaaccgtgacttatctgaccctacaggggaacgaccaagatgacatgttcccagcactgtgtgaagtcttaagacatccggagtgcaatctgcgctacctgggcctcgtgtcatgctctgccacaacccagcaatgggcggacctgagccttgcactggaggtcaaccagtctctgacctgtgtgaacctgagcgataatgagctgcttgatgaaggtgccaagttgttatatactacgctgcgccaccctaaatgcttcctgcagagactgagcttggagaactgtcaccttacagaggcgaactgcaaggaccttgccgctgtgctcgtcgtcagccgtgagttgacccacctgtgcttggcgaagaaccccatcgggaataccggcgtgaagttcctctgcgagggcctgcgctaccccgaatgcaaattgcagactctggtgctctggaactgcgacatcacgagcgacggatgctgcgacctgaccaaattgttgcaggagaagtcgagcctgctgtgtctggatcttgggctgaatcacatcggtgtgaaagggatgaaatttctgtgtgaagcattgcgcaagccgctctgtaatttacggtgtttgtggctgtggggctgttctatcccgcccttttcatgtgaggatctatgttctgcactgtcttgtaatcagtccctggttacactcgacttaggccaaaaccctctgggtagctccggagttaaaatgttgttcgaaacattaacatgctccagtgggactctaagaacattgaggctgaagattgatgatttcaatgatgaattgaacaagctgctggaagagatcgaggaaaagaacccacagttgattatcgacactgaaaagcatcatccgtgggcagaacgcccctcctctcacgacttcatgatatag

SEQ ID NO: 49105 - DNA, 3123 bp, Artificial Sequence
  Description of Artificial Sequence: Synthetic coding sequence
atggtgagcagcgcccagatgggcttcaacctgcaggccctgctggagcagctcagtcaggatgaattgtcgaagttcaagtacctgataaccacgtttagcctggctcacgaactacagaagatcccacacaaggaggtggacaaggccgatggcaagcaacttgtcgagatcctcaccactcattgtgattcctactgggtggagatggcctctctgcaggtatttgaaaaaatgcatcgaatggatctgtccgaaagagctaaagacgaggtcagagaggccgctctgaaaagcttcaacaaaaggaaacctttgtccctaggaattacgcgtaaggagcgcccacccctggacgtagatgagatgcttgaacgctttaagactgaagcgcaggacaaggataaccgatgccggtacattcttaagaccaagttcagagaaatgtggaaatcgtggccgggtgatagtaaggaggtgcaagtcatggccgaacgttataaaatgctgatccctttttcaaacccccgcgtgctgcctgggcctttttcctacaccgttgtgctctacggcccagccggtctgggaaagacgaccttggcccagaagcttatgctcgactgggcagaggacaacttaatacataagttcaagtatgctttttatctgtcttgcagagagctgagcagactgggcccttgctcttttgctgaattggtttttcgggactggcccgagctccaagatgatatcccccacattcttgcccaggctcggaaaatcctcttcgtgatcgacggattcgacgagctgggggccgcccctggagccctcatcgaagacatttgtggcgattgggaaaaaaaaaagcctgtgccggttctactgggctctctgctcaatcgagtcatgctccctaaagctgctttgctggtgaccacaagaccccgggctctgagggatcttcggatactcgctgaggagcccatctacatacgagtggagggatttctggaggaagaccggcgggcctacttccttaggcattttggcgacgaagaccaggctatgcgggcttttgaattgatgcggtcaaacgccgcgctgttccagcttggcagcgccccagccgtgtgctggatagtttgcactacgctgaagctgcagatggagaagggggaagatcccgtccccacatgcctgacccggactggactgtttctgcgcttcctttgctctcggttcccacagggtgctcagctgcggggggcattgcggaccctgagcctactggcagcacaaggcttgtgggcccagacctccgtgctccatcgcgaggatctcgaaagactgggcgtgcaggaatccgatctgcgactgtttctcgacggagatattctgcggcaggacagagtctccaaggggtgttatagttttattcacctgagcttccaacagttcctgacagctctgttttatactctggaaaaagaggaggaggaagatcgagatggccacacctgggatattggtgatgttcagaagttgttatcaggcgtggaacggctgcgaaaccccgacctgattcaggctggctattatagcttcggacttgcgaacgaaaagcgtgcaaaggagctagaggcaaccttcggatgtaggatgtccccagacattaagcaggagcttctgagatgtgacatttcatgcaagggtgggcactccaccgtaaccgatctgcaggaactgctgggatgtctctatgagtctcaggaagaggagctggtgaaggaggttatggctcagttcaaggagatctctcttcatctcaacgctgtcgacgtggttcctagctcattctgcgtcaagcattgtcgcaacttgcagaagatgagtctccaggttatcaaagaaaatcttcctgagaatgttactgcatccgagtccgatgcagaagtcgaaaggtcccaggatgaccagcatatgcttcccttttggacagacctgtgcagtatttttggcagtaacaaagacttgatgggcctggctatcaatgactcctttctttcagcgagcctcgtccgcattctttgtgagcagatcgcctccgatacctgccacctgcagcgagtcgtgtttaagaatattagtcccgccgacgcccatagaaacctctgcttagccctcaggggccataagactgttacatacctgaccttacagggcaacgatcaagacgatatgtttcccgccctatgtgaagtcctgcgccacccagaatgtaacctgcggtatctgggactggtcagctgttctgctacaacgcaacagtgggccgatctctccctggcccttgaggtgaaccaatcacttacatgtgtgaacctatctgataatgaactgcttgacgagggggcgaagctgctatatactacactgcgtcaccccaagtgttttctgcagcggctatcattggaaaactgtcacctgactgaggcaaattgcaaggacctcgccgctgtgttagtggtgtctagagagttaacccatctctgccttgccaagaacccgattgggaataccggcgttaagttcttatgcgaaggtctgcgctatcctgaatgcaagttgcagacacttgttctgtggaattgtgacattacatctgacggatgttgcgatctcacgaagcttttgcaggaaaagtccagcttgctctgccttgatcttggactgaatcacatcggtgtgaaggggatgaagtttctatgtgaggcccttcgaaaacctctgtgtaacctccgctgtctctggctgtggggctgttctattccacccttttcctgtgaggacctgtgttcagcactttcttgcaaccagtcattggtgactctggaccttgggcagaacccgctaggttccagcggagttaagatgctatttgagactctgacctgcagtagcggcacactgcgcacactgcgtctgaaaatcgacgatttcaacgatgagctcaataaattactcgaagaaatagaggagaaaaacccccagcttattatcgataccgagaaacaccatccttgggccgagagaccctcatcccacgactttatgatttag

SEQ ID NO: 49106 - DNA, 3189 bp, Artificial Sequence
  Description of Artificial Sequence: Synthetic coding sequence
atggtgagcagcgcccagatgggcttcaacctgcaggccctgctggagcagctgagccaggacgagctctccaaattcaagtacctcataacaactttttcactggcccacgagctgcaaaaaatcccgcataaagaagtagacaaggcagatggcaagcagctggtggaaattctgactacccactgcgattcttattgggtggagatggccagcttacaggtctttgagaagatgcatcgcatggatttgtctgaacgagccaaagatgaggtcagagaggccgctttgaaatcgttcaacaagcggaaacctctgagcttgggcattaccaggaaagagaggccacccctggatgtcgacgagatgctagagcgctttaaaacagaggcccaggcattcactgaaaccaagggcaatgtgatttgcctaggcaaagaggtcttcaaagggaagaagccggacaaagacaacagatgtcggtacatcctgaaaaccaagttccgagagatgtggaagtcctggcccggtgactccaaagaagttcaggttatggcagagagatataagatgctcatcccatttagcaatccaagggttctgcctggccccttttcatatacggtggtgttgtatggacctgctggtttgggaaagactacactggctcaaaagctgatgctggactgggctgaggacaacctgattcataagtttaaatacgcattctacctatcatgccgtgaattatcacgactgggcccttgctcattcgccgaactggtctttagggactggcctgagctgcaggacgatatcccccacattctggcccaagcccggaagatactcttcgtaatcgacggatttgacgagctgggagcggcacccggcgcgctgatcgaggatatctgtggcgactgggagaagaagaaacctgtcccagtgctgttggggagcttattaaaccgggtgatgctccccaaggcagccctgctggtgaccactagacctagggccctgcgggatctgcgcattctagctgaggagccaatttatatcagggtcgaaggctttttagaggaagaccgtcgagcatacttcctgagacattttggggatgaagaccaggctatgagggccttcgaactcatgcgcagcaacgccgccctctttcagctgggtagcgctccagcggtctgttggatcgtgtgtacaacacttaagctgcagatggaaaaaggcgaagatcccgtgccgacgtgtctcactagaactgggctatttctcaggtttctgtgttcccgattcccgcagggagcccagcttcggggagcgttgcgaaccctgtccctgctagcggcacagggtttatgggcacagacatccgtgctgcaccgcgaagacctggaacggctcggcgtacaggaatccgacctgaggttgtttttggacggcgatattctccgccaggaccgcgtaagtaagggatgttatagttttatccatttgtcgttccagcagtttttaaccgcactgttttacacactcgaaaaagaggaggaggaggatagagatggccatacctgggatatcggcgacgtgcagaagttacttagcggagtcgagagattacggaaccctgatctaatccaagccggctactactcctttggactggcgaatgagaagcgagcgaaggagctggaagcgacgtttggatgtcgcatgtctcccgatataaaacaggaattactgcgatgcgacatttcctgcaagggagggcactcaactgtgactgacttgcaggagctactgggctgtttgtacgaaagccaggaggaggaattggtgaaggaggtgatggcacagttcaaggagatctctctccacctcaacgccgtggacgtggtcccatctagtttctgtgttaagcactgtaggaacttacagaagatgagcttgcaggtcatcaaggaaaacttacccgagaacgtgaccgcatctgaaagtgatgccgaggttgaacgctcacaagacgatcagcacatgctccccttctggaccgacctgtgcagcattttcggatcaaacaaggatctgatgggactcgcaattaatgatagcttcttatcagcatctctcgtgcggatcctctgtgaacagatcgctagtgacacttgtcacctgcagcgggtcgtgtttaaaaacatctcacctgcagatgcacatagaaacctctgcttggctctgcggggccacaaaactgtcacttatctcacgttgcaagggaacgaccaggacgacatgtttccagccctgtgcgaggtgttgcggcatcctgagtgtaacctcagatatcttgggctggtctcctgtagcgctacaacacagcaatgggccgatctgtccctcgccttggaggtgaaccagtcactgacttgtgtgaatctgagcgacaatgagcttttggacgaaggtgctaagctgctttacacaactcttaggcaccctaagtgcttcctgcagcggctctctctggaaaattgccaccttacagaagcaaattgtaaagaccttgccgctgtattggtcgttagcagagaattgactcatctatgtttggccaaaaaccctatcggaaatacaggtgtgaagttcttgtgcgaagggttgcgataccctgagtgcaaactgcagactctggttctgtggaactgcgatatcacgtcagacggatgctgcgatctgacaaagcttctccaggagaaatcatccctcctgtgcttagacctagggctgaaccacatcggggtcaaaggaatgaagttcctctgtgaggccctgaggaagccgctgtgtaatctccggtgcctatggctgtgggggtgcagcatcccccccttctcttgcgaggacttatgctctgcactgtcctgcaaccagtccttagtgactctagacctcggacagaaccctctgggctcctcgggtgtgaaaatgttgttcgaaactttaacttgtagtagcgggaccctgaggactctgcgcctcaaaattgacgattttaacgacgaattgaacaagctgctggaagaaatcgaggaaaaaaaccctcagcttataatcgacaccgagaagcaccatccctgggctgagcgcccatccagtcacgattttatgatatag

SEQ ID NO: 49107 - DNA, 2943 bp, Artificial Sequence
  Description of Artificial Sequence: Synthetic coding sequence
atgaccagcccccagctggagtggaccctgcagaccctgctggagcaactgaatgaggacgagctgaaatcatttaagagcttgttgtgggcctttccactggaggacgttctgcaaaaaactccctggagcgaggtggaggaggctgatggcaaaaagctagcagagatcctcgtaaacacctcgtcggagaattggataagaaatgcaaccgtgaatatcctcgaagagatgaacctgacagagctatgcaagatggctaaggcagaaatgatggaagatgggcaggtccaggaaatagacaaccctgagcttggggatgctgaggaggactctgagctcgccaaacccggagagaaggagggctggagaaactcaatggagaaacagtcgttagtctggaagaacactttctggcaaggcgatatcgataatttccacgatgacgtgactctgcgcaatcagcgattcatcccatttctgaacccgcgcacccctaggaagctgaccccttacacggttgttctacacggtcctgccggagtgggcaagacgaccctcgccaagaaatgcatgctggattggaccgactgcaacctttctcccactctccgctatgccttttatctctcatgtaaagaactttcccggatgggaccctgctcctttgctgaactcatctctaaggattggcccgaactgcaggacgacatacccagcattctcgctcaggcacagcgcatcctgttcgtagtggacgggttagatgagcttaaagttccaccaggcgcactcatacaggacatctgtggcgattgggagaagaaaaaaccagtaccggtgcttttagggagcctgttgaaacggaagatgctgccccgcgccgcactgctggtcaccacacggccccgagcgctgcgggatctgcagctgctggcccagcagccaatctacgtgcgtgtagaaggattcctcgaggaagataggcgagcttacttcctgcggcatttcggagatgaagaccaagcgatgcgagcattcgagctcatgcgaagtaatgctgccttgttccagctagggagcgcacccgccgtgtgttggatcgtctgtactactctgaagttgcagatggagaagggggaggaccctgtacccacctgtctaacccgtacaggcttgttcctgaggttcctgtgcagccgctttcctcaaggtgctcaactacggggcgccctaagaacgctgtcactgctagccgctcaagggctgtgggcccagatgagcgtttttcaccgagaagacctggaaagacttggagtgcaggagagcgatctgcgccttttcctggacggcgacatccttcgtcaggatcgagtgtccaaaggctgctacagctttatccatctttccttccagcaattcctgacagccctcttctatgctctggaaaaggaggaaggagaggatcgtgatggccacgcatgggacatcggagacgtccaaaagttgctatccggcgaagaacgcctcaagaacccggacttaatccaggtcggtcacttcctgttcggtctggccaacgagaaacgcgccaaggagctagaggccaccttcggatgccgcatgtctcctgacataaagcaggaactgcttcagtgcaaagctcatttgcacgcaaataagcctctgtcggtcactgaccttaaagaagtcctcggctgcttgtacgaatcacaggaagaagagttagcaaaggtcgtggttgccccttttaaagagatatccattcatctaaccaacaccagcgaagtcatgcactgctccttcagcctgaagcattgccaagatcttcagaaactgagccttcaagtggctaagggggtgttcctggaaaactacatggacttcgagctggatatcgaatttgaacgatgtacatatttgacaatacccaattgggctcggcaggacctacgctctctgcgcctctggactgacttctgttcccttttttcgagcaactcgaatctaaagttcctcgaagtcaaacaatctttcctaagcgattcctccgtccgcatcctttgcgatcatgtcactcgtagtacttgtcacctccagaaggtggagattaaaaatgtcactcccgatactgcatatagagacttctgtttggcctttattggaaaaaaaactctcacccacttaaccctagccggacacatcgagtgggagagaaccatgatgctgatgctgtgtgatttgcttcgaaatcacaagtgtaacctgcagtacctccgtctgggagggcattgcgccacccccgaacagtgggcggagttcttttatgtgttgaaggccaaccagagtttgaaacaccttcggctgagcgcgaatgtgcttctggatgagggtgcaatgctcctttataagactatgacccgtcccaagcattttctccaaatgttgtctcttgaaaactgtcggttgaccgaggcaagttgtaaggatctggcggccgttctggttgtgtcgaaaaaactgactcacctgtgcctggcaaagaaccctataggagacaccggggtgaagttcttatgtgaaggtcttagctacccagactgtaaactccagacccttgtactgcaacaatgttccataactaaattaggttgtcgctacctgtcggaggccttgcaggaagcttgctcactcacaaacctggacctgagcattaatcagattgcccgcgggctctggatcctgtgccaggctctcgagaatccaaactgcaacctgaaacatctgaggctcaagacatacgagactaatttggaaatcaagaagctcctagaggaggttaaagaaaagaacccaaaactgacaattgactgtaacgcttcaggcgcaacggccccgccatgttgtgactttttctgctag

SEQ ID NO: 49108 - DNA, 3030 bp, Artificial Sequence
  Description of Artificial Sequence: Synthetic coding sequence
atgaccagcccccagctggagtggaccctgcagaccctgctggagcagctgaatgaagacgagttgaagagctttaaatcacttctgtgggcgtttccactcgaggatgtgcttcagaagaccccgtggtccgaagtcgaggaagcagatggtaaaaagctggcagaaatcctcgtgaatacctcatcagaaaattggatccggaatgccaccgtcaacatccttgaggagatgaaccttaccgagttgtgcaaaatggctaaggcggaaatgatggaagacggccaggtgcaggagattgacaaccccgagctgggggacgccgaggaggactccgaattagccaaaccgggcgagaaggagggttggaggaactcaatggaaaagcagagcctggtatggaaaaataccttctggcagggtgacattgataatttccacgatgacgtaaccctcaggaaccagaggttcataccctttcttaacccccgcactccaaggaaactgaccccctacacagtggtgctccacggccccgcgggggtggggaaaacaaccctcgccaaaaagtgcatgctggactggacagattgtaacctgtctccgacacttaggtacgccttctatctgtcttgcaaagagctttcgcggatggggccttgcagtttcgcggagctaatctcaaaagactggccggaactgcaggacgacatcccatcgatcctagcccaggcccagagaatcctgtttgtcgtggacggcctcgacgaactgaaggtcccacccggggcccttattcaggatatctgtggagactgggagaaaaagaagcccgtgccggttctgctgggtagcctcctcaagcgcaagatgctcccaagagccgccctcttggtgacaactaggcccagagctctgcgggatctgcagctgctggctcagcagcccatctatgtaagagtggaaggctttttggaggaagatagacgggcgtatttcttacggcacttcggtgatgaggaccaggctatgcgggcatttgaacttatgcggagtaatgccgccttgtttcagttgggaagcgcaccagccgtctgttggatcgtttgcactacactgaagctgcaaatggaaaaaggagaggaccctgtacccacttgtctgacacgtacgggcttattccttcgatttctgtgctcccggttcccacaaggcgcccagctcagaggagcactccgaactttgagtctgctcgcagcccagggactttgggcacagatgtccgtgtttcacagagaagacctggaaaggctcggagtacaggaatccgatcttcggctgtttttagacggggacattctccggcaggatcgggttagtaagggatgctattccttcattcacctctcttttcaacagttcttgaccgccctcttttacgctttggagaaggaagagggtgaggaccgagacgggcacgcttgggacattggcgacgttcagaagctgctctcgggcgaagagcgtctcaagaaccctgacctgatccaggtgggacacttcctgttcggccttgccaacgaaaagagagctaaggagcttgaggctaccttcggatgccgcatgagccctgatatcaaacaggagctcctgcagtgcaaggcccatttgcatgctaacaaacctttgagtgtgactgatctcaaggaagtcctcgggtgcctttacgagtctcaagaggaggagctagctaaagttgtcgtcgccccgttcaaagagatatctattcacctgacaaacacgtctgaggtgatgcactgttccttttcccttaaacactgccaggatttgcagaagttgtcactacaggtggccaaaggcgtcttcctagagaactacatggacttcgaactggatatcgaattcgaatccagtaacagcaacctgaaatttctggaggttaaacaaagtttcctcagcgattcatccgtaaggatcctttgcgaccacgtgacaagatcaacctgccacctgcagaaggtggagatcaagaacgtcacaccagacacagcataccgggacttctgcctcgccttcatcggtaagaagaccctcactcacctgactcttgcagggcacatcgaatgggagcgcaccatgatgctaatgctgtgcgatttgttgcgcaatcataaatgcaatctccagtacctgaggctcggggggcactgcgccactcccgagcagtgggctgagtttttctacgttctgaaagcgaatcagtctctcaaacatctgcggctgagtgctaatgtactcttggacgagggcgcaatgctcctctataaaaccatgacaagaccaaagcatttcctgcagatgttgtctctcgagaattgccgactgaccgaggcctcctgtaaggacttggcggccgttttggtggtgtctaaaaagcttacgcatctatgcctagccaaaaacccaatcggagatactggagtcaaattcctgtgcgagggactcagctatccagattgtaagctccagaccctggtgctccaacagtgctctattacaaaactcggctgtcgctatctgtccgaagccttacaggaagcatgcagtctgaccaacttagacctgagtatcaatcagatcgcgcgaggactgtggatcctgtgccaggccttggagaatcccaattgcaatctgaaacacctgcgcctctggtcttgttctttgatgccattctactgccagcatctgggttcggctctgctcagtaaccagaaattagaaaccctggatctgggccaaaatcacctatggaagtcaggtattattaaactttttggagtcctaaggcagcgcacagggagcctcaagattctcaggctcaaaacctacgagacaaacttagagatcaagaaattgctggaagaggtcaaagaaaagaaccccaaactgactattgactgtaatgcctccggcgcgactgcaccaccctgttgtgacttcttctgctag

SEQ ID NO: 49109 - DNA, 3198 bp, Artificial Sequence
  Description of Artificial Sequence: Synthetic coding sequence
atgagccggaagcaccggctggaggcccggcccgacctgcgggagttcttctccttgaacctgagatcacacaccagatctactatgaccagcccccagttggagtggactttgcagacccttctagaacagctgaatgaagacgagcttaaatctttcaagagcctcttatgggcatttccacttgaggatgtcctgcaaaaaaccccatggtccgaggtggaggaggctgatggcaaaaaattagccgagatcttggtgaatacctcttctgaaaactggatacgtaacgcgacggttaatattcttgaggaaatgaaccttaccgagttatgcaagatggcgaaggctgagatgatggaggacggccaggtacaagaaattgacaaccctgagttgggcgatgctgaagaagatagcgagctggcaaagccgggcgagaaggaggggtggagaaatagcatggaaaaacaaagcttggtctggaaaaacacattctggcaaggtgatatcgacaacttccatgatgacgtcaccttacggaaccagagattcattccctttctgaacccgaggacacccaggaagctgactccgtatacagtggttttacacggccctgcaggcgtcggtaagaccactttggctaagaagtgtatgcttgattggaccgactgtaatctgagtccgaccttaagatatgccttttatctgagctgtaaggaattgtcccggatgggaccttgtagctttgccgagctcattagtaaggactggccggagctgcaggatgatatcccatcaatcctcgctcaggcacagcgaattctctttgtagtcgacggactggacgagcttaaggtgccgcccggtgccctgatacaggatatatgcggcgattgggagaaaaagaagccagtgcccgttttattgggaagcctgctcaaacggaagatgctgccaagggcagctctgttagttactacgagaccacgggccctgcgagaccttcagctgctggctcaacagcctatttacgtgcgagttgagggttttctcgaagaagaccggcgcgcctattttttgcggcatttcggagatgaagatcaagccatgcgggctttcgagctgatgcgaagtaacgcagccttgtttcagttgggatcagctccagctgtgtgttggattgtctgcacaaccctgaagctacagatggagaagggcgaagaccccgtgcctacatgcttgacgcgtactggcctattcctgcgcttcctctgctcgagatttccccagggcgcccagctgcggggcgccttgcgaaccctgtcactccttgccgcccagggcctttgggcccagatgtcagtctttcaccgggaggacttggagcggctgggggtgcaggaatcagaccttcggctgtttctggacggcgatattcttcgccaggacagggtatccaaaggctgttatagctttatacatctgtcttttcagcagtttttgactgcactgttctacgccctggaaaaagaagagggcgaggatcgggacggtcatgcctgggatattggcgacgtccagaagctcctatctggggaggagcgccttaagaaccccgacctgattcaagtcggccactttttgtttggcctggcgaatgagaaaagggccaaagaactcgaagccacgtttggctgcaggatgtcccctgacattaagcaggaactcctccaatgtaaagcacatctgcatgccaacaaaccattgagcgtaactgaccttaaggaggtgctgggctgcctatacgaatcccaagaggaagagcttgccaaagtggtcgttgccccatttaaagagatctccatccatctcaccaatacatctgaagtgatgcactgttccttcagcctaaagcactgccaggatctgcagaaactgtccttgcaggtcgccaagggcgtgttcctcgaaaactatatggactttgagcttgatattgagtttgaacggtgtacttatctcaccattcccaattgggctagacaggatctgcgttccctgcggctttggacagacttttgttcgctctttagctccaacagtaatctcaagttccttgaagtgaagcaatcatttctgtcagactccagcgtgcggatcctgtgcgatcacgtaactaggagtacatgccaccttcaaaaagtagaaatcaaaaacgtgacccccgacacagcctacagggacttctgtctggccttcattggtaaaaagaccctcacacacctgactctggctggacacatcgagtgggaacgcacaatgatgctgatgctgtgtgaccttctccgtaaccataagtgcaatctgcaatacctcaggttgggtggccattgcgctacccccgagcagtgggctgaatttttctacgtgctaaaggcgaatcagtctctgaagcacctgagactgtctgcaaatgtgctcctggacgagggggctatgctgttgtataagacaatgacaagaccaaagcacttccttcagatgctatcactggagaactgccggctgactgaagctagttgcaaggacctggctgctgtattggtcgtaagcaagaaactgacccacctgtgcctcgcaaaaaaccctataggtgatactggcgtgaaatttctatgcgaaggactgagctaccctgactgcaagttacagaccctggtcctgcaacagtgttccattacgaagttgggttgtcgctaccttagcgaagcactccaggaggcttgtagcctcacaaacttggacttgagtattaatcaaattgcgaggggcttgtggatcctctgtcaggccctggagaatccaaattgcaatctcaaacatttgagattgtggtcgtgcagcctcatgccgttctactgtcagcacctcggcagtgctctgctgagcaatcaaaaactcgagaccctcgatctcgggcagaatcatctatggaagtcggggattataaagcttttcggcgtgctcaggcagaggaccggatctctgaaaatcttgaggctgaaaacttacgagaccaacctcgagatcaagaagttactggaagaggtaaaagagaaaaaccccaagctgacaatcgactgcaatgctagtggtgccacagctcccccatgctgcgattttttttgttag

SEQ ID NO: 49110 - DNA, 3030 bp, Artificial Sequence
  Description of Artificial Sequence: Synthetic coding sequence
atgaccagcccccagctggagtggaccctgcagaccctgctggagcagctgaatgaagacgagctgaaaagcttcaaaagtctcctgtgggcttttcccctggaagatgtgcttcaaaagaccccttggagtgaggtggaggaagccgacggtaagaagctggccgagatcctcgtgaacactagctccgagaattggattcggaacgccacagtgaatatcctggaggagatgaatttaaccgagttgtgtaagatggccaaggctgaaatgatggaggacggccaggtgcaggaaatcgacaatcccgagctcggggacgccgaagaagattcagagctcgccaagcccggtgagaaggaggggtggcgtaattccatggagaaacaatctctggtgtggaagaacacattttggcagggcgatatcgacaatttccacgatgatgtgaccctaaggaaccagaggtttataccctttttaaaccctagaacaccacggaagctcaccccctacactgtagtactacacggccccgccggtgtgggcaaaacaaccctcgccaagaagtgtatgttggactggaccgactgcaacctgtcgccgacactgcggtatgctttctacctgagctgcaaagagctgagccgaatgggaccttgttctttcgccgaattaatctccaaagattggcccgagctgcaggatgatatcccatcaattttggcccaggcccagcggatcctgttcgtggtagatgggctggatgagctgaaagtgccacctggagccctgattcaggacatctgtggggactgggaaaaaaagaagcccgttccagtcctgcttgggtcactgctgaaacgtaagatgttgccgcgcgcggctcttcttgttactacccgacctcgggcccttagggatcttcagctgctcgcccaacagcccatctatgttcgggtggaaggcttccttgaggaagatcgacgggcctactttctgaggcattttggagatgaagaccaggccatgcgtgccttcgaactgatgaggtccaacgcagccctgtttcagctcggaagcgccccagctgtgtgttggatagtgtgcaccacactgaaattgcagatggaaaaaggcgaagatcctgtcccgacatgtctgactcggacaggcctgttcctaagatttctgtgcagcaggtttccccagggcgcccagctccggggtgcccttcgcaccctatccctgttagcagcccagggcttgtgggctcagatgagtgtattccatcgcgaggatctggaacggctgggagtccaggagagtgaccttagactgtttctggatggcgacatccttcggcaggatagagtttctaaaggctgttactcgttcatccacctgtcttttcagcagttcctgactgctcttttttatgcccttgaaaaggaggagggggaggacagggatggacatgcctgggacatcggtgacgtgcagaagcttcttagcggtgaagagcggctaaaaaatccagacttgattcaggtgggccacttcctgtttggactcgcaaacgagaagagagcgaaagagttggaagcaacatttggctgtagaatgtcccccgatattaagcaggaactgctgcagtgcaaggcccacttgcatgcaaataagccactaagcgtgacagacctgaaggaggtgctggggtgtctctacgaatcccaggaagaagagcttgcgaaggtagtggttgcgccatttaaggaaattagcatccatttgaccaacacctccgaggtgatgcattgctccttctcactgaagcattgccaagatttgcaaaagttaagcttgcaagtcgcgaagggcgtttttctggagaactacatggatttcgaattagatattgaattcgagtcttctaactcgaacttgaagtttctcgaggtgaaacaatcattcttgtcagactctagcgtgcggatactctgtgatcacgtcacccgttcaacatgtcatctgcagaaggtggagatcaagaacgtcacaccggatactgcgtaccgtgatttttgcctggcttttataggcaagaagaccctgacacaccttacacttgcgggccatatcgaatgggagagaactatgatgctcatgctatgcgacctgcttcgaaatcataagtgcaacctccagtaccttcgtctcggagggcattgcgccactccagagcaatgggccgaatttttctacgtgctgaaggcgaatcagagcctaaagcacctccggctcagtgcgaatgtgctcctggacgaaggggccatgctgctctacaaaacgatgaccaggccaaaacacttccttcagatgctgtctctggagaattgtaggctgactgaggcgagttgcaaggacctggctgcggtcctagtggtgagcaagaagttgacgcacctttgcctggccaagaaccccattggtgacaccggagttaaatttctgtgtgaggggcttagctaccctgattgcaaactccaaaccctggtcttacagcagtgctctataactaagctgggctgcaggtacctgagtgaggcattgcaggaagcttgctccctgacaaacctggacctcagcattaatcagatcgcccggggcctctggatcctctgtcaggctctggagaaccccaactgtaacctcaagcatctgcgcttgtggtcctgtagcttgatgcccttctactgtcagcacctggggtccgcactgctctcaaaccaaaagcttgaaaccctggatctgggacagaaccacttatggaagtccggcatcattaagttgtttggtgtgcttagacagaggaccggttccctgaagatcctgcgtcttaaaacatatgagacaaacctcgagataaagaaactcctggaagaagtgaaagagaagaatcccaagctcaccattgattgcaacgcaagcggtgccaccgcaccaccatgttgcgattttttttgttag

SEQ ID NO: 49111 - DNA, 3198 bp, Artificial Sequence
  Description of Artificial Sequence: Synthetic coding sequence
atgagccggaagcaccggctggaggcccggcccgacctgcgggagttcttctcattaaacctgaggagtcacacccgctctacgatgacttcacctcagctagagtggacactgcagaccctgcttgaacaactcaacgaagacgaattgaaatctttcaaatctcttctttgggcattccccctggaggacgtgttgcagaagaccccctggtccgaagtggaggaagccgacggtaagaaactggccgagattctggtgaatacctcatctgagaattggattcggaatgctaccgtgaatatccttgaggaaatgaatctgacagagctctgcaaaatggctaaagcagaaatgatggaagacgggcaggtacaggagatagacaatcctgagttgggtgacgcagaagaggactcagaactggctaaacctggagagaaggaaggatggagaaactccatggaaaaacagtctctggtgtggaaaaacacattctggcagggcgatatcgacaactttcatgatgatgtgactcttcggaaccaacggtttatcccattcctgaacccacgcacccccaggaagctgacaccttacaccgttgtcctgcatggaccggccggggtcggcaagactacactggccaagaaatgtatgctggactggactgactgcaacttgtcacctactctcaggtacgcattttaccttagctgtaaggagctgagcagaatgggcccctgcagtttcgctgaactgatctctaaggactggccggagctgcaggatgacattccaagcattctggcccaggcccagaggattttgtttgtggttgatggactcgatgagctgaaggtacctcctggagctctgatccaggacatctgcggagattgggagaagaagaagcccgtgcctgtgttacttggttctctcctcaaaaggaagatgctccctagggcggccctgctggttactacaaggcctcgcgccttacgcgacttgcagctgctggcacagcaacccatctacgttagggtggaaggattcttagaagaagataggagagcctacttcctgaggcatttcggcgatgaagaccaggccatgcgggcatttgaactgatgcggtccaacgcagcactattccagttggggtccgcccccgcggtctgctggattgtgtgcaccactctgaagctgcaaatggagaagggggaggacccagtgcctacctgtctcacacggaccgggctcttcttaaggtttctgtgctcgagattccctcagggagcccagctgaggggagcactgagaaccctgagcctgctcgccgcccaagggctgtgggctcagatgtcagtcttccatagggaagaccttgaacgtttgggggtccaggagagcgatctaaggctgtttcttgatggcgacattttaaggcaggacagggtaagtaagggatgctactctttcatccatctttcttttcaacagttcctgaccgccctgttctacgccctcgagaaagaggagggagaggacagagacggacacgcttgggatatcggagacgtccagaagctgttatctggtgaggagagacttaaaaatccagacctcatccaggttggacattttctctttggcctagccaatgagaaacgggctaaggagctggaggctactttcggctgtaggatgtctccagacatcaagcaggagctgctgcaatgtaaggcacacctgcacgccaataaacccctgtcagtgactgatctgaaggaagtcttaggatgtttatacgaaagtcaggaggaggagttggctaaggtcgttgtcgcgccgtttaaagagatcagtatccacttgacgaatacgtctgaggttatgcattgctccttctcattgaaacactgtcaggacctccagaagttgtctctacaagtagccaaaggagtatttctggaaaactatatggacttcgaactggacattgagttcgagcgctgtacttatctcacaattcccaactgggctaggcaggaccttcgctccttgaggctgtggaccgatttctgcagcctcttttcgtctaactccaatttaaagtttttagaggtgaagcagagtttcttgagcgatagcagcgtaagaattctgtgtgatcatgttactaggagcacatgtcacttgcagaaggtggagatcaaaaacgttaccccggacacagcatacagagatttttgccttgccttcatcggaaagaaaactttgacccacctgacgttagcagggcacattgaatgggagaggacgatgatgctgatgttatgcgacctactgcggaaccataaatgtaacctgcagtatctgcgcctcgggggacattgtgctactcctgaacagtgggccgagtttttttatgtgctcaaggccaaccaatctttgaaacatctaaggcttagtgcaaacgtacttctggacgaaggagcaatgctgctgtataaaaccatgacacgccctaaacacttcctgcagatgttgagtttggaaaactgtcggctaaccgaagccagctgtaaagatctggccgcagtgcttgtagtcagcaagaagctgacacacctgtgcctagctaaaaatcctataggagacactggcgtcaagtttttgtgtgaggggctctcctatccagattgcaaactgcaaaccctggtgctgcagcagtgcagcataacaaaactgggttgtaggtacctgtcggaggccctgcaggaggcctgttcactgacaaaccttgacttatcaatcaaccagattgcccgtgggctgtggattctctgccaggcgctcgagaatcctaattgcaacctgaagcacctaagactctggagctgcagtttaatgcctttttattgccagcacttaggaagtgcgctactttccaaccaaaagctggagactctggatctaggacagaatcatctgtggaaatccggtatcatcaaattgtttggcgtgctgcgccagaggacgggcagcctgaagatcctgcgtctcaagacttacgagactaacttggagattaagaaattgctcgaagaagttaaagagaagaaccccaagttgaccatcgactgcaatgcctctggtgctacagcaccaccttgctgtgatttcttttgctag

SEQ ID NO: 49112 - DNA, 3030 bp, Artificial Sequence
  Description of Artificial Sequence: Synthetic coding sequence
atgaccagcccccagctggagtggaccctgcagaccctgctggagcagctcaacgaagacgaactgaagtctttcaaaagccttctgtgggcattccctctggaggacgtactgcaaaaaacaccttggtctgaggtggaagaggctgatggcaagaagctcgcagagattctagtcaacaccagttctgagaactggatccgtaacgcaacagtcaatatactcgaggaaatgaatctgaccgaactctgcaagatggccaaggcggaaatgatggaggatggacaggttcaggagattgataaccctgaactgggagatgccgaggaagactccgagctcgccaagcccggagaaaaggaagggtggaggaactcgatggagaaacaatcactcgtgtggaagaatacattctggcagggagacatagataatttccacgacgatgtaacactgcgaaatcaacggtttattcctttcctgaatcctaggactcctcgaaaactgacaccctacacagtagtgctgcacgggcccgctggagtgggaaaaactacccttgcaaaaaagtgcatgctggactggactgactgtaatctctctccaacactgagatacgctttctacttgagctgcaaagaactctctcgcatggggccatgcagcttcgctgagcttatcagtaaggactggcccgaactacaggatgacattccatccattctcgctcaagcgcaaaggattctgttcgtggtggatggtcttgacgaacttaaagtgccacccggcgcactcattcaggacatttgcggagattgggaaaaaaaaaagcctgtgcctgtgttgctgggaagcttgctgaaacggaaaatgttgccacgagccgcccttttagtcactactaggccccgcgccttacgggacctgcagttactcgctcagcagcctatatatgtgagagtggagggtttcctcgaggaagacaggagagcgtacttccttcgccactttggggatgaagaccaggctatgcgcgcgttcgagctgatgagatctaatgcagcgttgtttcagctcggcagcgcccccgctgtttgctggatagtttgtacaacactcaaactgcagatggagaagggtgaagatccggtgcccacatgcctgactcgaaccggcctgtttctgcgttttctttgtagcaggtttccccaaggcgcccaactgcgcggcgcacttcgtacactgagccttttggctgcgcagggactctgggcacaaatgtccgtgtttcaccgggaggatttggaaaggctgggcgtacaggagagcgacctcaggctgttcctggatggggacatattgcgacaggacagggtgagcaagggctgctactctttcattcatctctccttccagcaatttttaaccgcactcttttatgccttagaaaaagaagaaggcgaagatcgggacggtcacgcttgggatattggtgacgtgcagaagctgctaagcggggaggaaaggctcaaaaaccccgatcttatccaggtgggtcacttcctgttcggcctggccaacgagaagcgggctaaggagctagaggcaacctttggctgcagaatgtcgcctgacatcaaacaggagctcctgcagtgtaaggcccacttgcatgcaaacaaaccactgtctgtgacagacttgaaggaggtactaggctgtttatatgaatcccaagaggaagaactggcaaaggtggtggtggcaccatttaaagaaatatcaatccacctcacaaacacatcggaggttatgcattgtagcttctctctcaaacattgtcaggacctgcaaaagctatctctccaagtggcaaaaggcgtgttcctggagaactacatggattttgagcttgacatcgagttcgagagctcaaacagtaaccttaaatttctcgaggtgaaacagtctttcttaagcgacagtagcgttagaattctttgcgatcacgtgaccagaagcacatgccacctgcagaaggttgaaatcaagaatgtaacgccagacacagcttatagagatttctgcctagcctttattggcaagaagaccttaacccacctaaccctagcaggccatatcgagtgggaacgaaccatgatgctcatgctgtgtgatctgttacgcaatcataaatgtaatctccagtatttgaggcttgggggtcactgtgcaacgcccgagcagtgggctgaatttttctatgtcctaaaagctaaccagtccttaaaacatctcaggttgagcgccaacgtcctgttggatgagggcgcgatgttgctatataagacgatgacaagacccaaacattttcttcagatgctgtcacttgaaaattgccggctaactgaggcatcctgcaaggacctggccgctgtactggtcgtgtccaaaaagctaacccatttgtgtttggctaagaaccccataggcgatacaggggtgaagtttctgtgcgagggtctatcataccccgattgtaaactacaaactttggtgttgcaacagtgctccattactaaactggggtgtcgatacttgtcagaggctcttcaggaagcctgctctttaactaaccttgatctctcaatcaaccagattgcccggggtctgtggatattatgccaggcattggagaaccctaattgtaatctcaagcatctgcggctgtggtcttgtagtctgatgcccttttactgtcagcatctgggatctgcactcctgagtaatcagaagctggagaccctagacctcggccaaaaccatctgtggaaatcagggataattaaactgtttggggtgctgcggcagaggactgggtcgttgaaaattctcaggctcaaaacgtacgaaacgaacctcgagattaaaaagcttctggaggaggtgaaagagaaaaatccaaagctcaccatcgattgtaacgcgagcggggccacagcaccgccttgctgtgatttcttttgttag

SEQ ID NO: 49113 - DNA, 3198 bp, Artificial Sequence
  Description of Artificial Sequence: Synthetic coding sequence
atgagccggaagcaccggctggaggcccggcccgacctgcgggagttcttttctctgaatctgcgcagccacaccaggtcgaccatgacaagcccccagctggagtggactctgcagaccctgctcgagcagctgaatgaagacgagctcaaaagcttcaagtccctactgtgggcgttccctcttgaggacgtactgcagaagactccctggtctgaagtcgaagaagccgatgggaaaaagctggcagagattcttgttaacacctcctctgaaaattggatccgaaacgcaaccgttaatattttagaagagatgaatctcaccgaactatgtaaaatggcgaaagcagagatgatggaggacggccaggtccaggagatcgacaatcccgaacttggcgatgcagaggaggacagtgagctcgctaaaccaggtgagaaggaggggtggaggaattccatggaaaaacagtcactggtctggaaaaacacattctggcaaggggatattgataattttcatgacgatgtgacgctccgaaaccagaggtttattccttttctgaacccacgaactccccggaagctgacaccctacaccgtggtgttgcatggaccggcgggcgtcgggaagacaacgcttgccaagaagtgtatgctggactggacagactgcaatttatctcctactctccgatatgcattttacctctcgtgcaaggaactatccaggatggggccttgcagctttgcagagctgatttctaaagactggcctgaactgcaagatgacataccttcaatcctggcccaagcacaacggattctgtttgtggttgacggcctggatgagctgaaagttcccccaggcgccttgatacaggatatctgcggcgactgggagaagaagaaacccgtgcctgttctactaggatctctcctgaagagaaagatgttgccgcgagccgccctgctggtcacaactagaccgcgggctctgagggacttacagctcttggcccaacagccgatctacgttcgagtggaaggatttctcgaagaggaccgccgagcttattttctccgccatttcggagacgaagatcaagctatgagggcttttgagttgatgagatccaacgccgccctttttcagctgggatctgcacctgccgtttgctggattgtttgcactaccctgaagctgcagatggagaagggtgaggaccctgtgcccacatgtctgacccggacaggactcttcctgcggttcctctgctctcggttccctcagggtgcccagctgaggggcgcactccggaccctgagcctgctcgcagctcagggtctctgggcccagatgtctgtttttcatagggaggatctggaacgtctgggagttcaggaatccgacctgcgtctgtttctggacggggatattctgagacaagatcgggtgtcaaaggggtgttactctttcattcatctctcattccaacaatttctgacagcactcttctatgcactcgagaaggaggaaggcgaagatcgcgacggtcacgcatgggacattggggatgtacaaaagctcttgagcggagaagagaggctcaagaatcctgacttgattcaggttggacattttttgtttggactcgccaacgaaaaacgggcaaaagagctcgaagcaacgttcggatgtcgaatgagtcccgacatcaagcaggaattgctgcagtgcaaggctcacctacacgctaataagccactgtctgtgactgatctcaaagaagtcctgggctgtctctatgaatcacaggaagaagagctcgccaaagtggtagtagcccccttcaaagagatctccattcatctaacaaatactagcgaagtgatgcattgctctttttccctgaagcactgccaagatctccagaaactgtccctgcaggttgcaaaaggcgtgttcctcgaaaactatatggactttgagctggacatcgaattcgaaagatgtacatacttgactataccaaactgggcaaggcaggatttgcgctcactaaggctgtggaccgacttttgttcattattttcttctaatagcaaccttaagttcctggaagtcaagcagagcttcctgagcgactccagcgtccgaatactatgtgatcacgtgactaggagcacctgccatctccagaaggttgaaatcaagaacgtgaccccagataccgcatacagagatttttgtctggcctttataggcaagaaaactctgacccatctgaccctagcaggccatatcgaatgggagaggacaatgatgttgatgctctgtgatttattgagaaaccacaagtgtaacctgcagtacctgagactcgggggccactgcgccactcccgagcagtgggctgagttcttttatgtgctgaaggcgaaccaaagcctgaagcacctgaggctttctgccaatgtgctcttagatgagggcgcaatgctcctgtataagaccatgacaagaccaaagcacttcctgcagatgctcagtctggaaaactgtaggctcacagaagcatcctgtaaagacttggccgccgttctggttgtgtcaaaaaagctgactcacttgtgtctggctaagaaccctatcggagataccggtgtgaagttcttgtgcgaaggtcttagctatccagattgcaaattgcagaccttggttctacagcagtgttccattaccaagttgggctgccggtacctgtctgaagcattgcaggaggcctgctcactgacaaacctggaccttagcataaaccaaattgctagaggactgtggatcctgtgccaagccctggagaatcctaactgcaacctgaaacacctccggctctggagctgcagcttaatgcccttttattgtcagcatctcggctcggccctcctgagtaatcaaaagctggagacacttgacttgggccagaaccatctctggaagtccggcattatcaagcttttcggagtgctgcgccagagaaccggatcattaaagatactacggcttaaaacttacgagacaaatctggaaattaaaaaattgttagaggaagtgaaggaaaagaatccaaaattgactattgattgtaacgcatctggcgccacagcaccgccttgttgcgatttcttttgctag

SEQ ID NO: 49114 - DNA, 2943 bp, Artificial Sequence
  Description of Artificial Sequence: Synthetic coding sequence
atgaccagcccccagctggagtggaccctgcagaccctgctggagcagctcaatgaagacgaactcaagtctttcaagtctctattgtgggcgtttcccctggaggatgttctacagaagactccttggtctgaagtagaagaggcggatggcaagaaacttgctgaaatcctcgtcaacacatcgtcagagaattggattaggaatgccacggtgaacattctggaagaaatgaacctgacagagctgtgcaaaatggcaaaagccgaaatgatggaggatggtcaggtgcaggagatagacaatcctgaattaggagatgcagaggaggactcagagttggcaaaaccgggtgaaaaagaagggtggagaaacagcatggagaagcagagcttggtgtggaagaacaccttttggcaaggcgacattgacaatttccacgacgacgttacactgcgaaatcagagattcatcccatttctgaatccacgcacgccacgcaagctcaccccttataccgtcgtgctccacggacctgctggggttggcaaaacaactttagcaaaaaaatgcatgttggactggacagactgcaacttgtcacctaccctcaggtatgctttctacctgagttgcaaagagctctccaggatggggccttgtagttttgcagagctaatctccaaagactggcccgagttgcaagatgatatcccttccatcctcgctcaggcgcagaggatactcttcgtggttgacggactggacgaattaaaagtccctcctggcgctctgatccaggatatctgcggggactgggagaagaagaagccagtaccagtgctcctgggctccctgctcaagcgcaagatgttacctagagcggctctgctggtcacgacacgacccagggcactgcgggacctgcagctgctggctcagcaaccgatctatgtcagagttgagggctttctggaagaggataggagagcatatttcttgagacactttggagacgaagatcaggccatgagggcgttcgagctgatgcgtagtaatgccgctctgtttcagttggggtcagcaccggcagtatgttggatcgtctgcacaaccctgaaactccagatggaaaagggagaggatcctgtacccacctgcctgacgcgcacaggccttttcctgcgctttctctgttcccgctttccacagggggctcaactgcgcggagcgttaagaacattgagcctcctcgcagcccagggcctctgggcccaaatgtccgttttccaccgcgaggacctagaacggcttggggtccaggaaagcgatttgaggctgttcctggacggcgatattttacgacaggaccgagtgagtaaaggatgctactcattcatccatctgagctttcagcagttcctgaccgcacttttttatgcgttagaaaaggaggagggggaggatcgagacgggcacgcatgggacattggagatgtgcagaagctactgtcaggcgaggagagactgaagaaccctgacctcatccaagttggccacttcctattcggactcgccaatgaaaaacgagccaaggagctggaggccacttttggctgtcgaatgagtccagatatcaagcaggagctgctccagtgtaaggcacaccttcacgcaaataaacctctgtctgtcaccgaccttaaggaggtcctgggatgcttgtacgaatctcaagaagaggaactggccaaagtggtggtagcaccctttaaggaaataagtatacatctgacaaataccagtgaagtgatgcattgctcctttagcttaaaacactgtcaggacctgcagaaactgagtctgcaggtggctaagggagtgtttctggaaaattatatggattttgaactagacattgaatttgagcggtgtacttaccttacaattcctaactgggctcgacaggacttacgttccttgagactgtggaccgatttctgtagtctgttctcctccaactcgaatcttaaattccttgaggtgaagcagtcatttctgagcgacagctccgttagaattctctgcgatcatgtgaccagatcaacgtgccaccttcaaaaagttgaaatcaagaacgtaacacctgatacagcataccgtgacttctgcctggcctttatcgggaaaaaaaccttaactcatctgactctggctggccacattgagtgggagaggactatgatgctgatgctttgtgatctccttagaaaccataagtgcaacctgcagtacctgcgtctagggggacattgtgcaacacctgaacagtgggccgagtttttttatgtcctgaaagctaatcagtcgctgaaacacctgaggctgtcagcgaacgtcctgctcgacgaaggcgctatgctgctgtataagacaatgactcggcctaagcactttctgcagatgctgtcattggaaaattgtaggcttactgaggcaagctgcaaggacctcgccgctgttttggtggtctcaaaaaaactcacacatctgtgtctggctaagaaccctatcggcgatacaggggtgaagttcttgtgcgagggcttgagttacccagattgcaagctccagacattggtgctgcagcaatgctcgataactaaactcggctgccggtacctctccgaggcgctacaggaggcatgttcattgaccaatttagacctcagcattaaccagatcgctagggggttgtggattctgtgccaggcacttgaaaatcccaattgtaatctgaaacacctgagactgaagacttatgaaacgaatctcgaaatcaagaaactgctggaagaggtgaaagaaaaaaaccccaaattaactatcgattgcaatgcctcaggcgcaaccgcccccccatgttgtgatttcttctgttag

SEQ ID NO: 49115 - DNA, 3030 bp, Artificial Sequence
  Description of Artificial Sequence: Synthetic coding sequence
atgaccagcccccagctggagtggaccctgcagaccctgctggagcaactgaatgaggatgagctcaaaagcttcaaaagtctgctatgggccttccctttggaggatgtgctccaaaagaccccatggtctgaagttgaggaggccgacgggaaaaagctggctgagatcctggtgaacacttcgtcagaaaactggatccgcaatgcgacagttaacatcctggaagagatgaatctgactgagctatgtaagatggcaaaagcagagatgatggaagatggccaggtgcaggagatcgataacccggaactcggggatgctgaagaggactccgagctcgctaaaccaggggagaaggagggctggaggaacagtatggagaagcagtctcttgtgtggaagaatacattctggcagggagacattgacaacttccacgacgacgtgacactcaggaaccagcgtttcattccattcttaaatcctcggacacctagaaagctgactccttacaccgtggtcctgcacgggccagcaggagtcggcaaaaccacgctggcaaagaagtgtatgctcgattggacagactgcaatctcagccctacactgcggtacgcattttatttgtcatgcaaagaactttcgagaatggggccatgctcctttgccgagctgatcagcaaggattggcccgagctgcaagacgacatcccctccattctggcccaggctcagaggattctgttcgtcgtggatggtctcgatgaactgaaggttccccccggagccctgattcaagatatctgcggtgactgggagaaaaaaaaaccagtccctgtcctcctggggagccttctgaagaggaaaatgctgcctcgcgccgctcttctggtgactaccaggccgcgagctctgcgggatctgcagcttctggctcagcagccaatctacgtcagggtggagggcttcctcgaagaggaccgacgagcttatttcctgcgccatttcggcgatgaagatcaggccatgcgagctttcgagctcatgagatccaatgctgctctctttcagttgggttcagctcccgcggtctgctggatcgtgtgcactaccctgaagctccagatggagaagggagaggatccagtccccacctgtctgaccaggaccggcctttttttaaggtttttatgctctcggttcccacagggagcgcaactgcgaggcgcattgcgcaccctatcactgcttgcggcccagggcctctgggcccagatgtccgtctttcacagagaagatctggagcgtctaggagttcaggagtctgatctgcggctgtttctggacggagatatactgcgtcaggacagggtgtcgaagggctgttactcctttatccacttgagctttcagcagttcttgactgctcttttctacgccctggagaaagaggagggcgaggatagggatgggcatgcatgggatatcggcgacgtgcagaaattgctgagtggcgaggagagactcaagaacccagatctaatccaagtcggacacttcttgttcggcctggctaatgagaaaagggcaaaggaactggaagcgacattcgggtgtagaatgtcccctgatataaaacaggaacttctgcaatgcaaagcacaccttcatgcaaacaagcctctgtcagtaacagatctgaaggaggtgctcggatgcctgtatgaatcccaggaggaggagttagcgaaggtggtcgtggctccgtttaaggaaatctctattcatttgacaaatacatctgaggtcatgcattgttctttctcactcaagcactgccaagatctgcaaaaactgtccttacaggttgccaagggcgtgttcctagaaaactatatggactttgaactcgatatagaatttgaaagcagtaacagtaatctgaagtttttggaagtgaagcaatccttcctttcagattccagtgtgcgcatcctgtgtgaccacgtgactagaagcacttgtcacctccagaaagttgaaattaaaaatgtgacacccgacacagcctaccgggatttttgtctggccttcattggcaagaagacgctgactcatctgacactggcagggcacattgagtgggaaagaactatgatgcttatgctgtgcgatttactccggaatcacaagtgcaacctgcagtacctccggctgggcgggcattgtgccacgcctgaacaatgggccgagttcttttacgtgctgaaagccaaccagagtttgaaacacctgcggttgagcgccaatgtgttgctcgatgagggagccatgctgctgtacaagaccatgactcggccgaaacatttcttgcagatgcttagtctcgagaattgccgcctgacagaagcaagctgcaaagacttagcagccgttcttgtggtcagcaagaagcttacacacctttgtttagctaagaatcccatcggtgataccggagtgaagttcttgtgcgagggtctgtcctacccagattgcaagctgcagactctcgtgctccagcagtgttccatcaccaaactgggctgtcgatatctgtccgaagcgttgcaggaggcctgctcccttaccaacttagatctcagcatcaaccagatagccaggggactgtggatcttgtgtcaggccctggagaatcccaattgtaaccttaagcacctccggctttggagttgcagccttatgcccttctactgtcagcacctcggatctgcgttgctttccaatcagaagctggagacgcttgatcttggtcagaaccacctgtggaagagcggaattatcaagctgtttggcgtgctcaggcaacgaacaggcagcctgaagattctgcggctgaaaacatatgaaactaacctggaaatcaagaagctgttggaggaagtgaaagaaaagaacccaaaattgacaatcgactgcaacgcctctggtgccacggccccaccctgctgtgatttcttttgctag

SEQ ID NO: 49116 - DNA, 2943 bp, Artificial Sequence
  Description of Artificial Sequence: Synthetic coding sequence
atgaccagcccccagctggagtggaccctgcagaccctgctggagcagcttaatgaggacgaacttaaaagtttcaagagtctgctctgggctttccctttggaagacgtcctccagaaaactccctggagcgaagttgaggaagcagacggcaagaagttagccgaaatactggtgaatacaagcagtgagaactggatcagaaatgcaacagtgaacattttagaagaaatgaatctgacagagctgtgcaaaatggcgaaagctgagatgatggaagacggccaggtgcaggaaatcgacaaccctgagctaggagacgctgaggaggattctgagctggcaaaacctggtgaaaaggagggctggaggaacagcatggagaaacagtctctggtatggaagaacactttttggcagggcgatatcgacaacttccatgacgacgtaactctccgcaaccagcgattcattccctttttgaacccacgcacaccccggaagcttacaccctatacagtggttctgcacggccccgcaggcgtcggaaaaacaaccttggccaaaaagtgtatgctggattggacagattgtaacttgagccctacgctgagatacgccttctacctgtcatgtaaagaactttcaagaatgggtccctgcagcttcgcagagttgatatctaaagactggccagagcttcaggacgacattccgagtatcttggcacaagctcagagaatcctctttgtggtagacggcttagatgaattgaaggtgccacctggggccctgatacaagacatttgcggcgattgggagaagaaaaaaccagtgcctgtgctgctggggagcttactcaagagaaaaatgctcccgagagccgccctacttgtgacaacccgcccacgagcccttagagatttacagcttctggcccagcagcctatttacgtgcgggtcgagggttttctggaggaagatcgtagagcttactttctgagacacttcggagatgaagatcaggccatgagggcgtttgaactcatgcgttctaatgctgctctgttccagctaggcagtgcccctgcagtctgttggatagtgtgcaccacgctgaaacttcagatggaaaaaggggaggaccctgtgccaacatgcctgacccgtaccgggctgttccttaggttcctgtgttcgagatttcctcagggggctcagctccggggtgcattgagaaccctatctcttctcgcagctcagggtctctgggctcaaatgtccgtatttcaccgagaggacctagaaagactaggcgtgcaggaatcagatctcaggctgtttctggatggggacattctgcgccaggaccgagtaagcaaggggtgctactccttcatccatctcagcttccaacaatttctgacggcactgttctacgctctggaaaaggaggaaggagaggatagggatggccacgcatgggacatcggcgatgtccagaagttgttaagtggcgaggaaaggctcaagaatcctgatctcatccaggtggggcacttcctgtttgggctagccaatgagaagagagcaaaagagctagaagctacctttggctgcaggatgagcccagacatcaaacaggaactacttcaatgcaaggctcaccttcatgctaataagccactctctgtcaccgacctcaaagaagttttgggatgcctctatgaatctcaagaggaggagcttgctaaagtggttgtcgctcctttcaaggaaatctcaatccacctaacgaatacgtccgaagttatgcactgtagcttttccttaaaacactgccaggatctgcagaaactcagtcttcaggtggcaaagggcgttttcttggagaattacatggatttcgagctcgacatcgagtttgaaagatgcacatacctgaccatccctaattgggctcgacaggaccttcgatcgttacggctctggactgatttctgttcattgttctcgagcaactccaacctcaagtttctggaggtgaaacagagctttctcagtgacagcagtgtaagaatcctgtgcgaccatgttactagaagtacctgccacctgcagaaggtcgaaatcaagaatgtaaccccagatacagcgtaccgggatttttgcctagcatttataggaaaaaaaacactgacacacctcaccctcgcagggcatattgagtgggagagaaccatgatgctgatgctctgcgatctgctgcgcaatcacaagtgtaatttgcagtacctgcggctcggaggccattgtgcaacaccggaacagtgggccgagttcttttacgtcctcaaggcaaaccagagcctcaaacacctgaggctctctgctaacgtgctcctcgacgaaggcgccatgctgctgtacaagacaatgaccaggccgaaacactttctccagatgctttccttagagaactgccggctaactgaggcctcctgcaaagatcttgccgccgtgctagttgtgtcgaagaaactgacgcacttatgcctcgccaagaatccaatcggtgatactggggttaaattcctttgtgaaggcctgtcttacccagactgcaagttacaaactctggttctgcaacagtgcagtattaccaagctgggatgccggtatctgagtgaggcactgcaggaagcctgctctctgactaatctcgatctctctattaaccaaatcgcgcgcggcctgtggatcctttgccaagctttagagaaccctaactgtaacctgaagcatctacgcctgaaaacatacgaaaccaatttggagataaagaagcttttggaagaggtaaaggagaagaaccctaagctcacgattgactgtaatgcatctggcgccactgcccctccttgctgcgatttcttttgctag

SEQ ID NO: 49117 - DNA, 2943 bp, Artificial Sequence
  Description of Artificial Sequence: Synthetic coding sequence
atgaccagcccccagctggagtggaccctgcagaccctgctggagcaactcaacgaagatgaactgaagtcttttaagagcttactgtgggctttcccattggaggatgtgctccagaagacaccctggtcggaggtggaggaagcagatggtaagaaactggctgaaatactcgtaaatacaagcagcgagaactggatcaggaacgccaccgtgaatatactggaggagatgaatttgaccgaactgtgcaagatggcaaaagcagagatgatggaagatggccaggtgcaggagattgacaatcccgagcttggggatgccgaggaagattctgagctggccaaacctggagagaaggaggggtggagaaatagcatggaaaaacaaagcctagtttggaagaatacattttggcaaggtgacattgataatttccacgatgacgttacactacgaaaccagaggtttattcccttcttgaatcctcgaaccccacggaagctgacaccttacacggttgtgctccacggccctgcaggagtcggcaagacaaccctagccaaaaagtgcatgttggactggactgactgcaacctgtccccgacactgagatacgccttttacttgagctgcaaggagctgtctcgtatgggcccatgctccttcgccgagctgatttctaaggactggccagagctgcaagacgatatcccttcaatcctcgcacaggcccagcgtattctgttcgttgttgatggtctggacgaactgaaggtcccgcccggggctctgatacaggacatttgtggcgactgggagaagaaaaaaccggtcccggtgttgctgggatccctgctgaagcgtaagatgctgcctcgcgcagccttgctggtgaccacccgccccagggccctgcgcgatcttcagctgcttgcccagcaaccaatctatgtgcgggtcgaaggctttttggaagaagatagaagggcgtacttcctgcggcacttcggggatgaagaccaagcaatgagggcattcgaactaatgcgatccaatgcagctctcttccagctcggctctgcaccagctgtttgttggatcgtctgtacaactctgaagctccagatggaaaagggggaagaccccgtgcccacttgcctcacccggaccggactcttcttacgctttctgtgcagccgcttcccacagggcgcccagttgagaggtgccctgcgcacactgagtctgctcgctgctcaaggcctgtgggcacagatgtcagtattccacagggaggatctggagagactgggtgtgcaggaatctgatcttaggttatttctggatggagacatactacgccaagatcgagtgagtaagggctgttacagtttcattcacctctcctttcagcaattcttgaccgctctcttctatgcactggagaaagaggagggagaggatcgcgatggtcatgcttgggacataggcgacgtgcagaagttacttagtggtgaagagcgcctgaagaaccccgatctgattcaggtcggccactttctgttcggcctggccaatgagaaaagggcgaaggaactggaagcaacgttcgggtgtagaatgtcacctgacattaagcaagaactgctgcagtgcaaggctcaccttcatgccaataaacctctttccgtgacagatttgaaagaggtcctcggctgcctttatgagagtcaggaggaggaactggccaaggtggtagtcgcccctttcaaggagatatccattcacttgacaaacacttctgaggtgatgcactgttccttttcactcaaacactgtcaggacctccagaagttgagcttgcaggtggccaaaggcgtgttcctcgaaaattatatggactttgagctggatatcgaattcgaaaggtgcacctacctgactatacccaactgggctcggcaagaccttagatccctgagactctggacagatttttgcagtcttttctcatccaatagtaacttaaaatttttagaagtaaagcaatcctttctgtccgacagttcagtgcggattttatgcgatcacgtgacccggagcacctgccatttacagaaggtagaaattaagaacgtgaccccggacaccgcttatagagatttttgtctagctttcattgggaagaaaacactcacacaccttacacttgctggacacattgaatgggaacggactatgatgctgatgctgtgcgacctcctgcgtaatcataaatgtaatctgcagtacctcaggctaggagggcactgcgcaacacctgagcagtgggcagaattcttttatgtgctgaaggctaatcagtccctcaaacacctgaggctatccgccaacgttctgctcgatgaaggagctatgcttctctataagaccatgacccgtcctaagcatttcctccaaatgttatctctcgaaaattgtcggctgactgaggcatcttgtaaggacttggctgcagtactggtggtgagcaaaaaactcacccacctctgtcttgccaaaaaccctatcggggacacaggtgtgaagtttctgtgcgaaggtctttcctatcctgattgcaagctgcaaacactggtgctgcagcagtgctctatcacgaagctaggctgccggtatctcagtgaggccttacaggaagcttgctccctcacgaacctggacctttcaattaaccagatcgccagaggtctctggatcctctgtcaggcgttagagaaccccaattgcaacctgaagcatctgcggctgaagacctacgagacaaacctggaaatcaagaaactgctggaggaggttaaagagaagaatccaaaattaaccatcgactgcaatgcttcgggagcaacagcacctccttgttgtgactttttctgctag

SEQ ID NO: 49118 - DNA, 2943 bp, Artificial Sequence
  Description of Artificial Sequence: Synthetic coding sequence
atgaccagcccccagctggagtggaccctgcagaccctgctggagcaactcaacgaggatgaactgaagagcttcaaatccttattgtgggcgttccctctggaagacgtcctgcagaagacaccttggtcagaagtggaagaggccgacgggaagaaactagctgagatcctggtgaacaccagctcagagaactggatccggaatgcgactgtgaacatcctcgaggagatgaacctgacggagttgtgtaagatggcgaaagccgagatgatggaggacgggcaagtacaggagattgacaatccggaactaggagacgccgaagaagattccgagttggccaaacctggcgaaaaggagggatggcgcaactctatggagaaacagagtcttgtgtggaaaaataccttctggcagggggatatcgacaacttccacgacgacgtcactctacggaaccagcggtttattccttttctgaatccccggacgccccgaaaactgacaccgtataccgtggttttacacggacctgctggggtgggcaagaccaccttagcaaaaaaatgtatgcttgactggacggactgcaacctgtcgcctactttgaggtacgcgttctacctctcttgtaaagagctgtcgcggatgggtccatgctcattcgctgagttgatctccaaagactggccagagctgcaggacgacatccccagcattttggctcaggctcagcgcatactgtttgtcgtggatggactcgacgaactcaaggtcccaccaggtgcgctgatccaggatatctgcggggattgggaaaaaaaaaagccagtacccgttttgcttggcagccttctgaagcgaaagatgttgcccagggcagctctcttggtgacaacacgtccccgggctcttagggacctacaattgctggctcagcaacctatatacgtccgcgtggaagggtttctggaggaggaccgcagagcgtacttcttgagacactttggggatgaagatcaggcaatgagagcctttgaactgatgagatctaacgccgcactgtttcagctaggttccgcccctgctgtttgttggatcgtctgtacaaccctaaagctacaaatggagaagggtgaggacccagtgcccacttgtttgactcggacaggattgtttctgcgcttcctatgctctcgatttcctcaaggcgcccagttgcggggagcattgagaactctgtctctgcttgcggcccagggtctttgggctcagatgagtgtgtttcatcgggaagatcttgagcgcctgggcgtgcaggaatccgaccttcgcttattccttgatggagatatcttgcgccaggatcgggtttcaaagggttgctacagtttcatacaccttagcttccagcagttcctgaccgccttgttttacgccctcgagaaagaagaaggcgaggatagggacggccacgcttgggatattggagacgtgcagaagttactttccggcgaggagcggctcaaaaacccagatctcatccaggtgggacatttcttgttcggccttgctaacgagaaacgagcaaaggagcttgaggcaacttttggatgccgaatgtcacccgacattaagcaagagctgttgcagtgcaaagctcatcttcatgctaacaaaccgctctctgttaccgacttgaaggaagttcttggctgtctgtacgaatcgcaggaagaagaattagctaaagtggttgtggcacccttcaaagagataagcattcacctgactaacaccagcgaagtgatgcattgtagcttctcactgaaacactgtcaggacttacaaaagttatcgttgcaggttgctaagggtgtttttctcgagaactacatggacttcgaactcgatatcgagttcgagcgttgcacttacctcactattcctaattgggctaggcaggacctgcgttccctgcgcttatggacagatttttgctccctattctcttcaaattcaaacttaaagttccttgaggtcaaacagtctttcctgagtgatagttccgtgcgaatcctctgcgatcacgtgacccgcagtacctgtcatttgcaaaaggtggagatcaaaaacgttacaccagatactgcgtaccgggatttttgtttggcctttatcggcaagaagactctcacccacttgactctggcaggccacattgaatgggagaggaccatgatgcttatgctgtgtgacctgctacgtaaccataagtgcaacctgcagtacctgaggttggggggccactgtgccactccagagcagtgggccgaattcttttatgtgctaaaagccaaccaatccctaaaacatctgagactcagtgccaacgtgttgttggatgagggtgccatgctcctgtataaaactatgaccagacccaaacatttcctgcagatgctgtccctggagaactgtaggctaacggaggcatcctgcaaagacctggcagcagtccttgtagtttctaagaagctgacccacctgtgtttagctaaaaaccctatcggagataccggcgtgaaattcctctgcgagggccttagctatccagactgtaaactgcaaacacttgtgctgcagcagtgttccataacaaaacttggatgccgttacctcagcgaggcactccaagaagcttgttcactgacgaatctagatctgtcaataaaccaaattgcgcgggggctgtggatcctttgtcaggcgctggagaacccaaattgtaacctcaagcacctacgcttgaagacctacgagactaacctggagatcaaaaagctgctggaggaagtcaaggagaaaaatccaaagttgactatcgattgtaacgcaagcggagcgactgcacccccctgctgtgatttcttttgttag

SEQ ID NO: 49119 - DNA, 3198 bp, Artificial Sequence
  Description of Artificial Sequence: Synthetic coding sequence
atgagccggaagcaccggctggaggcccggcccgacctgcgggagtttttctccttgaacttgcgctcacatacgagatccaccatgacttctccacagctggagtggacactccaaaccctgctggagcagctgaatgaagatgaactcaagagcttcaaaagcttgctgtgggcttttccattggaggacgtgctccagaagacaccctggtcagaggttgaagaagcagatggcaaaaaactggccgagatcctggtgaacaccagctcagagaactggatacgaaacgccaccgttaacatcctggaagagatgaatctcacagagctttgcaagatggccaaggctgaaatgatggaagacggccaggtacaggaaatcgataaccctgaactgggtgatgccgaggaggactctgaattggccaaacctggagaaaaggagggctggcgaaactcgatggaaaagcaatcactggtctggaaaaatacattttggcaaggagatatcgacaattttcacgacgacgtgacactaagaaatcagaggtttattccctttttaaacccacggacaccccgtaagctgaccccctacacagtggtcctgcatggccctgcgggcgttggaaagactactctagctaagaagtgtatgctggattggacagactgtaaccttagtcctaccctcaggtacgccttttacctgtcctgtaaggagttgtcacgcatgggaccttgttcattcgccgaattaatttctaaagactggcctgagttacaggacgatattccttccattctcgctcaggctcaacggatcctgttcgtggtggatggcctggacgagctgaaggtcccaccgggggcgcttattcaagacatctgcggggactgggagaaaaaaaagcctgtacctgtgcttttgggcagtttgttaaagagaaaaatgttgccaagggcagctcttttggtgaccacacgccctagggccctgagggatttgcagctactggctcagcagccaatctacgtccgggtggaaggctttcttgaggaagatcgaagggcatattttctgagacactttggtgatgaggaccaggcaatgcgggcctttgaattaatgagatctaatgccgccctgtttcagctcggttcagcccctgcagtatgctggatcgtgtgtaccacgttgaaactgcagatggagaaaggcgaagaccccgttcctacatgtcttactagaacaggcctgttcctgcgtttcctatgctcgcgcttccctcagggcgctcaactccgaggggcactgagaactctcagtctgctggctgcacaaggtctgtgggcccagatgtcagtgttccatcgggaggatctcgagcgcctaggggtacaggagtccgacctgagattatttcttgacggggatattctcaggcaagacagggtgagcaaaggctgttactcatttatccacctgtccttccagcagtttctgactgcactgttctacgcgctggagaaggaagagggcgaggacagagacggccacgcctgggacattggtgacgtacagaaacttttgtccggtgaagagcgcctgaaaaacccagacctgatccaggtgggccattttttgttcgggctcgctaatgagaaacgggctaaagaactcgaagcgactttcggttgccgaatgagccctgacattaagcaagagttactgcagtgtaaggcacaccttcacgcgaataagccattgtcagttacagacctgaaggaagtgttaggatgcttgtatgagagtcaagaagaggagctcgctaaggtcgtcgtagcaccctttaaagagattagtatccatctcacaaacaccagcgaagtgatgcattgctccttttcccttaagcattgccaggacctgcagaaactcagccttcaggtcgccaagggggtgttcctggagaattacatggactttgagctggacattgaatttgaaagatgcacatacctaactattcctaattgggcaaggcaggacctcagatccctgaggctctggaccgatttttgttccttgttctcgtccaatagcaatctgaagtttctcgaagtcaagcagtcatttctgtcagactcctcggttcggatattatgtgaccatgtgactcgaagcacctgccacctgcaaaaggtggaaattaagaatgtcacgcctgacactgcttatagggacttctgtctcgcctttataggaaaaaagacgctgacgcatcttacactagctgggcatatcgaatgggagcgaactatgatgctcatgctatgcgatctgctgcgcaaccacaagtgtaacttacaatacttacgcctcggcgggcactgtgccacccccgaacaatgggccgaattcttctacgtgctgaaagcgaatcagagcctgaagcacttaaggctcagcgccaacgtgctactcgacgagggcgccatgctactgtacaagacaatgacaaggccaaaacactttctccagatgttgagtctagagaactgcaggctcaccgaagcatcttgtaaggatttggccgcggtgctcgtagtatccaagaaactcacccacctgtgtctggcgaaaaatcctatcggcgacaccggtgtcaaatttctctgcgaagggctgtcctacccggactgcaagctccagactttagtccttcaacagtgttctattactaaactggggtgtcgatacctgagcgaagcgctccaggaagcatgtagcttaaccaacctggatctttcaatcaaccaaattgcgcgcgggctgtggatactctgtcaggcactggaaaaccccaattgcaacctgaagcatctccgcctgtggtcctgcagcctgatgcctttctactgccagcacctcggatcagcactgctgagtaatcagaagttggagactttggatctcggacagaatcacttgtggaagtctgggatcatcaaactgttcggtgtgctccggcaaagaactggcagtctcaaaattttgaggcttaaaacatatgagactaatctggagatcaagaagctattggaagaggttaaggagaaaaatcccaaactaactatcgactgcaatgccagcggcgcgacagctccgccttgttgcgacttcttttgttag

SEQ ID NO: 49120 - DNA, 3198 bp, Artificial Sequence
  Description of Artificial Sequence: Synthetic coding sequence
atgagccggaagcaccggctggaggcccggcccgacctgcgggagtttttctcccttaacctaaggtcccacacacggtccaccatgactagcccccagttagaatggacgttacagactctcttggaacagttaaatgaggatgaactgaagagctttaagtcgttactgtgggctttccccctcgaggacgtgttgcaaaagacaccatggagcgaagtggaggaggcggacggtaagaaattggccgagatccttgttaatacatcaagcgaaaattggattcgtaatgccaccgtgaatatcctcgaagaaatgaatcttacggagctgtgcaagatggcaaaggctgagatgatggaagatggccaggtgcaggagatagacaacccggagcttggcgacgccgaagaggattccgagctggcaaaacccggtgagaaagagggctggcggaactctatggagaaacaatctctggtatggaaaaacactttctggcagggagacattgacaacttccacgacgacgtgaccctgcggaatcaaaggtttatcccctttctcaatccgaggaccccaagaaagctgacaccctacacggtagttcttcatggacccgcgggagtgggcaaaactactctcgcaaaaaaatgtatgctggattggacagactgcaatctgagtcccacacttagatacgcattctatctgtcctgcaaggagttgagccggatgggcccatgcagctttgccgaactgataagtaaagactggccagagttacaggacgacatcccctccattttggcccaggcccagaggatcctgtttgtggtggacgggctggatgagcttaaggtaccacctggagctctgatccaagatatctgcggcgattgggagaagaaaaaacctgtccccgtgctgttgggatcccttcttaaaaggaagatgctgcctcgcgctgccctattggttacaacaaggcctcgggccctgagagatcttcagctgctcgcacagcagccaatttatgtccgcgtggaaggttttttggaggaggatagacgcgcttacttcctgcgccatttcggcgatgaggatcaggcaatgagagccttcgagctgatgagatctaatgcagctctgtttcagttagggtccgccccagcagtctgctggatcgtgtgcactacgctgaagctgcagatggaaaagggagaagatccagtgcccacgtgccttacaaggacagggttattcctgagatttctttgctcgaggtttccacaaggggctcagctgaggggtgctctgcgaaccctctccttgctggcagcccaaggcttatgggcccagatgagcgtgttccaccgggaggatctcgaaagattgggcgtccaggagtcggatctcagactgttccttgacggggatatcttgagacaggaccgcgtgagtaagggctgctactctttcatccacctttctttccagcaatttctcacagccctattttatgccctggagaaggaagagggtgaagacagggatggacacgcgtgggatattggtgacgtgcagaagttactatctggagaagaacgactgaagaatccggatcttattcaagttggccactttttattcggcctggccaacgagaaacgagcaaaagagctggaagccacttttggctgcaggatgtcaccagatatcaaacaggagctgcttcagtgtaaagcacacctccacgccaacaaaccacttagcgtgactgacttaaaggaagtgcttggatgcctgtacgagagtcaggaggaggagttggccaaagtggtcgttgccccctttaaagaaataagcatccacctgactaatacaagtgaagtaatgcattgctccttcagtttgaagcactgtcaggacctgcaaaaactctctctccaggttgcgaaaggagtgttccttgagaactacatggactttgaactcgacattgagtttgaaagatgtacctacttgaccatacctaactgggccaggcaagacctgaggtcccttcgactgtggactgacttctgcagtttatttagttccaacagtaatttgaaatttcttgaggttaagcagagcttcttatcagatagcagcgttcgcatcctgtgtgatcacgtgactcgctcgacctgccacctccaaaaggtggagattaagaatgtaacccctgatacagcctaccgtgatttttgtcttgccttcatcggcaaaaagacacttacccatttaaccctggcgggtcatatcgagtgggagcgaactatgatgttgatgttgtgtgatcttttgagaaaccacaagtgcaacctacagtacctgagacttggtggacactgcgccactccagagcagtgggcggaattcttctatgtgctcaaagccaatcaatcactgaaacacctgagactgagcgccaacgtgctcttagacgagggcgctatgttgctgtacaagaccatgacccgcccaaagcactttctgcagatgctgtccctggagaactgccgcctgacagaagcttcttgtaaggacctggccgctgtgctcgtcgtttcaaaaaagcttacacacctgtgcttggccaaaaacccaatcggggacaccggagtcaagtttctgtgcgagggcctcagctatcccgattgcaaactccagactcttgttcttcagcaatgttctattaccaagttaggatgtcggtatctgtcagaagccctacaagaagcctgctccctgactaaccttgacctctctattaatcagatcgccaggggactgtggatcctttgtcaggccttggaaaacccaaattgtaacctgaaacacctgaggctctggtcttgttcactgatgcccttctactgtcaacatctgggctccgctttgctgtccaatcaaaaactggaaacactcgacctgggacagaaccacttgtggaagtcgggcattatcaaactcttcggcgtgctccggcaacgcacaggctccctcaagatcctgagactgaagacttatgaaacgaacttggagattaagaaattgctggaggaagtgaaggaaaagaaccccaaactgactattgattgcaacgccagtggcgctaccgcaccaccttgctgtgactttttttgctag

SEQ ID NO: 49121 - DNA, 2943 bp, Artificial Sequence
  Description of Artificial Sequence: Synthetic coding sequence
atgaccagcccccagctggagtggaccctgcagaccctgctggagcagcttaatgaggacgagctcaaatcttttaaatcattgctctgggctttccccctagaggatgtgttgcagaaaacgccatggagcgaggtcgaggaggccgacggcaagaagctcgccgaaatcctggtgaatacaagcagcgagaattggattcggaacgccaccgtcaacatactcgaagaaatgaatctgacagagctgtgtaagatggccaaagcagaaatgatggaggacggccaggtgcaggagatcgacaatccggaactgggcgatgcagaagaggattccgaacttgcaaaacccggagaaaaggaaggatggcggaattccatggagaaacagagtctcgtgtggaaaaatacgttctggcagggcgacatcgataactttcatgatgacgtgaccctaagaaatcagaggttcatcccctttctgaatccccgaaccccaaggaagttgaccccttatactgtggtgttgcacggccctgccggcgtagggaaaacaacactcgcaaaaaagtgtatgctcgattggaccgactgtaatttgtccccaaccctgagatacgcattttacttgtcctgtaaggagctgtcacgcatggggccatgtagttttgctgaacttattagcaaggactggccagaactgcaggatgacatcccctctatcctcgcccaggcccagcggatactgtttgtggtcgacggtctggatgaactgaaggtgcctcccggcgcactgatccaagacatctgcggggattgggagaagaagaagcctgtcccagtcctgctaggtagcctgttgaaaagaaaaatgctacctagagctgcattactcgtgacaacccggcctcgagcactacgcgacctgcagttactggcccaacagccaatctacgttagggtggaaggctttctagaagaggataggcgcgcatattttctgcggcactttggagatgaggaccaagctatgagagcttttgagctgatgcgtagcaatgccgccctttttcagctcggttcagctcccgctgtgtgttggattgtgtgtacaacactcaaactccagatggagaagggagaggacccagtgcccacttgtctgacccgaaccggtctgttcttgcggtttctatgctctcggttccctcaaggggctcaactgcgaggagccctccgaacacttagtctcctggccgcccaagggctgtgggctcagatgtcagtctttcatagagaggaccttgaacgactcggtgtgcaagaatcggacctgcgcctattcctcgatggtgatatcctgaggcaggatagagtgtcaaaagggtgctactcctttatccatctcagctttcaacaattcctgaccgcactgttctatgccctggagaaagaggagggcgaggaccgggatggccatgcatgggatattggcgacgttcagaaactcttgtcaggcgaagagcgcctcaaaaatcccgacctgattcaagtggggcacttcctgtttggcttagcaaatgaaaagcgtgccaaggaacttgaggcgacgttcggctgccgcatgagccctgacattaaacaagagctgttgcagtgcaaggctcatctccacgccaataaacccctgagtgtcaccgacttgaaggaagtgctgggctgtctatacgaatctcaggaggaagaactcgctaaggtggtggtggctccattcaaggagatcagtatacatctgacaaatacgagtgaggtcatgcactgtagcttctccttaaaacactgtcaagacttgcaaaaactgtcactgcaggtcgcaaagggcgtgtttcttgagaactatatggactttgaactggatattgagttcgagcggtgtacatatctgaccatccctaactgggcccgacaggacctgcgatcactgcggctgtggaccgatttctgcagcctgttctccagtaattccaacttgaagttcctggaggtgaagcaaagtttcctctccgattcttcggtgcgcattttgtgcgaccacgtgactaggtcaacttgccacctgcagaaggtggaaattaaaaacgttacgcccgatactgcttaccgggacttctgccttgcttttattggtaaaaagaccctcactcatctcacactggctggtcatattgaatgggagagaaccatgatgctcatgctatgcgacttgttgcgaaatcataagtgtaacttgcagtaccttcggctcggagggcattgtgccactcctgaacagtgggctgaatttttctacgttttgaaagcaaaccagtctttgaaacacttacgtctgagcgctaacgtcctcctggacgagggggcaatgctattgtacaagacaatgaccaggcctaagcatttcctgcagatgctgagcttggaaaactgtaggctgacagaagccagctgtaaggatctagccgccgtcctcgtcgtcagcaagaagttgacccatctttgcctggcaaaaaatcctattggcgacacaggtgtcaaattcctctgtgagggcctgagttaccctgattgcaagctgcaaaccctagtgctgcaacaatgttctattaccaaattggggtgcagatatctcagcgaggcactacaagaagcatgtagcctcactaatctggatctgagcataaatcaaattgccagaggactctggatcctgtgtcaggccttagagaatcctaactgcaatctcaaacatctccgactcaaaacatatgaaaccaatttggagattaagaaattgctcgaggaggtgaaagaaaagaatcccaagttgacaatcgattgtaatgcgtctggagcaaccgcaccaccttgttgtgactttttctgttag

SEQ ID NO: 49122 - DNA, 3030 bp, Artificial Sequence
  Description of Artificial Sequence: Synthetic coding sequence
atgaccagcccccagctggagtggaccctgcagaccctgctggagcaacttaacgaggacgagctgaagagcttcaagtccctcctgtgggcctttcccttggaagatgtgctgcagaagactccatggagcgaggtagaggaggccgacgggaaaaaattggctgagatattggtaaatacttcctctgagaattggatcaggaatgcaacggtgaacatccttgaagaaatgaatcttacagaactctgtaaaatggctaaagccgaaatgatggaggatggacaggttcaggaaattgataacccagaattaggggatgcggaagaggattccgagctagcgaaacccggagaaaaggaagggtggcggaatagtatggagaaacagtccctcgtatggaaaaataccttttggcagggagacatagataacttccacgatgatgtaactttaagaaaccaaagatttattccatttttaaatccaaggaccccgagaaaactgacaccgtacacagttgtcctgcatggccccgcaggcgtcggcaagacaaccctagccaagaagtgtatgctggactggacagactgcaacttgtcacccaccctgaggtatgcattctacctttcatgcaaggagctgagtcggatggggccatgttcattcgctgagctgatatccaaggactggcccgaactgcaggacgatataccatctattctggcccaggctcagcgcatcctgtttgtagttgatgggttggatgagctgaaagtaccgccaggcgccctgatccaggatatctgtggcgactgggagaaaaaaaagccagtcccggtgcttctggggagcttgctcaagcggaagatgctgccccgagccgcattacttgtcacgaccagacctcgcgcccttcgcgacctgcagctgctggctcagcagccaatttatgtaagagttgagggcttcttagaggaagaccgtagggcatacttcctgagacacttcggtgatgaggaccaagcgatgagagcctttgagttgatgaggagcaatgccgctctattccagcttggatctgccccagctgtgtgttggatagtttgtacaacacttaagctacagatggagaagggggaggatcctgtgcctacctgcctgacaagaaccggtcttttcctgcggtttctgtgttcacgctttccacagggagcccagcttcggggcgccctgcgcaccctttccctactagccgcccaaggattgtgggcgcaaatgtcagtgtttcacagagaagacttggaacgactgggagtacaggagtccgacctgcgattgttcttggacggcgatatcctccgacaagatagggtgagtaagggatgttacagttttatccacctctcgttccagcaattcctaaccgccctcttctacgcactggagaaggaagagggcgaggatagagatgggcatgcatgggacataggggatgtacaaaaactgctctcaggggaggaacggttaaaaaacccggacctgatccaggtgggacacttcctattcggtctagctaacgaaaagcgagcaaaggaactcgaagcgaccttcggctgtcgaatgtcaccagacattaagcaggaactcttacagtgcaaagctcacctgcacgccaataagccgctgtccgttacggatttgaaagaagtgttgggatgtctttatgagagccaagaagaagaactggctaaggttgtggtggccccctttaaagaaatcagcattcacttgacaaacactagcgaggtgatgcattgctcattttccttgaaacattgccaggacctgcagaaactgtcactgcaggtcgccaagggtgtctttctggagaactacatggattttgaactggacatcgagttcgaatcatcaaattcaaatctcaagttcctggaagttaagcagagtttcctgtcagactcttcagtccggattttatgcgaccacgtgactaggtctacatgtcacctgcagaaggttgagattaagaacgtgactcccgacactgcatatcgtgacttctgtctggcgttcatcggtaaaaagaccctcacgcacttaaccctggcaggacatattgaatgggagaggaccatgatgttgatgctgtgtgatctgttaaggaaccataaatgtaacctgcaatacctccggcttggtggccattgtgctacaccagaacagtgggcagagtttttttacgtactcaaagccaaccagagcctgaaacatctgcgactgagcgctaacgtactgctggatgagggggccatgctcctgtacaaaacaatgacacgtcctaagcactttctgcagatgctgtcactggaaaattgccgcctcacggaagccagttgcaaggaccttgcagccgtgctggtggtctcaaaaaaacttactcacctgtgtctggcaaagaatccaatcggtgatactggcgtgaagttcctctgcgaaggtctctcatacccggactgtaagctccagacattagtactgcaacagtgcagtattaccaaactcggatgtcgctacctctctgaggccctgcaggaggcctgctctttgaccaacctagatctctcaataaatcaaattgccagagggttatggatcctgtgccaggccctggagaatcctaactgcaacctcaagcacttgcgattgtggtcttgttcccttatgcctttctactgtcagcatttggggagtgctctactgagtaaccaaaagttggaaaccctggacctgggccaaaaccatctgtggaaatcaggtattattaagctgtttggagtgctgcgtcagagaactggttctctgaagattcttcgtctcaaaacatacgaaacaaatctggagataaagaagctgcttgaagaagtgaaggagaaaaaccctaagctaacaattgactgcaatgcgagtggcgcgactgcccctccatgctgtgacttcttctgctag

SEQ ID NO: 49123 - DNA, 3030 bp, Artificial Sequence
  Description of Artificial Sequence: Synthetic coding sequence
atgaccagcccccagctggagtggaccctgcagaccctgctggagcagttgaatgaagacgagcttaaaagctttaagtctctgctatgggcgtttccgttggaagatgtgcttcagaagacgccttggtccgaggtggaagaagcagatggcaagaagctggcagaaattttggttaatactagctccgagaattggatcagaaatgccaccgtaaatatcctcgaggaaatgaatctcacagaactgtgcaaaatggccaaggcggagatgatggaggatggccaagttcaggagattgataatcccgagctgggggatgctgaggaagacagtgagcttgcgaagccgggagagaaagaggggtggagaaattctatggagaagcagtcccttgtgtggaagaataccttctggcagggagatatcgacaacttccatgatgacgtaaccctgcgcaaccaacgattcatcccattcctgaaccctcgtacaccacgcaaactaaccccatacacggtggtccttcacggccctgccggggtcggaaaaactactctcgccaaaaaatgcatgctggattggacagactgcaatctctctcctacattgcgatatgccttttaccttagctgcaaagaactgagccggatggggccttgctcattcgcagagctgatttctaaggactggcccgaactgcaggacgacattccttctattttggcacaggcccagagaattttgtttgtggtcgatggtttggacgaactgaaagttccccctggcgctctgattcaggatatctgcggtgactgggaaaaaaagaaaccagttcctgtgctgctggggtccctgctgaagcgaaaaatgctcccacgggccgccctgttggtcactactaggccgcgtgccctcagggacctgcagctgctggcccagcagcctatttatgtgagggtcgaagggtttctcgaggaagatagaagagcatacttcctaagacatttcggggacgaggatcaggccatgcgcgcctttgagctaatgaggagcaatgctgctctgttccaactaggcagtgcccctgcagtgtgctggatcgtgtgtactaccctaaaactgcagatggagaagggcgaggaccccgtccctacctgtctgactagaacaggactgtttttgcggtttctgtgctccaggtttcctcagggagctcagttacggggggccctgcggacgctgagtctcctggcagctcaggggctttgggcccagatgagtgtattccatagggaagacctcgaacggctcggagtgcaggagtccgacctccgactgttcctggatggcgacatactgaggcaggaccgagtatcaaaaggctgctactctttcatccacctttccttccagcaatttcttaccgccctgttctacgccctggagaaggaagagggtgaagatcgggacggccacgcatgggatatcggcgatgtgcaaaagttgctgagcggagaagaaaggctcaagaacccagaccttatccaggtgggccattttctattcggcctcgccaacgagaagcgtgccaaagagctggaggccacgttcggttgccggatgtctccagacattaagcaagagctattgcagtgtaaggcccacttacacgcgaataagccactaagtgtgacagatctcaaagaggtactgggttgcctctacgaaagtcaggaagaagagctcgccaaagtcgtggttgccccatttaaagagatttcaatccatcttacaaacactagcgaagtcatgcattgctctttttcgctgaagcactgccaggatctgcagaaactgagccttcaggttgccaagggggtgttcctggagaactacatggatttcgaacttgatattgagttcgaatcgtccaacagcaacctgaagtttcttgaagtgaagcagagcttcctgtcagattctagtgtgcggatcctgtgcgaccacgtaaccaggagtacctgccaccttcaaaaagttgaaatcaaaaacgtcactcctgatactgcctatcgggatttctgtctggccttcattggcaaaaaaacattgactcatctgacactcgccgggcacattgagtgggagaggacaatgatgcttatgctgtgcgacctccttcgcaaccacaaatgtaaccttcagtacctaaggcttggaggccattgcgctacgccggagcaatgggcagaattcttctacgtgctgaaagccaaccagagtctcaaacacctgcggttgagcgccaatgtgcttctggatgagggggccatgttactgtataaaaccatgaccagacctaagcatttcttgcagatgctatcgcttgagaattgccggctgacagaggctagctgtaaagacttggccgccgtgctggtagtgagcaagaaacttacacatctgtgtctggccaaaaatcccattggcgacaccggcgttaagttcctctgtgaaggtctgtcatatcccgactgcaagttacagacccttgtcctgcagcagtgttccattacgaagttgggatgcaggtacctctctgaagccctgcaggaggcgtgctcgttgacgaacctggatctttcaatcaaccaaatcgctcggggcctgtggattctgtgtcaggctctggagaacccaaactgcaacttgaagcatcttaggttgtggtcctgctctctcatgcctttctactgtcaacatctcgggtccgcccttcttagcaatcagaagttagaaacattggatctgggtcagaaccatctatggaagtctggtataatcaaattgtttggggtgctgcgacagcggacgggctctctcaaaatactgcgactcaagacctatgaaaccaaccttgagattaagaaactcctggaggaggtcaaggaaaaaaaccctaaattaactattgactgtaacgcctcaggtgccacagctccgccatgttgtgattttttttgttag

SEQ ID NO: 49124 - DNA, 3198 bp, Artificial Sequence
  Description of Artificial Sequence: Synthetic coding sequence
atgagccggaagcaccggctggaggcccggcccgacctgcgggagttcttttctctgaacctaaggtcacatacccgaagtaccatgaccagtccccagttggagtggaccttacaaactttactggagcaactgaatgaggacgagctcaaatcctttaaatctcttctgtgggcttttcccctggaagatgtcctccagaaaaccccctggtccgaggtcgaggaggccgatggtaagaaacttgcagaaattttagtcaatacatcatcggaaaactggatcagaaatgcgacagtgaatatcttagaagagatgaatctgacagagctctgcaagatggcaaaagcagaaatgatggaggacggccaggtgcaggagattgataatccagaactgggagatgccgaggaagattctgagctggcaaagccgggagagaaagaagggtggcggaactccatggaaaagcagtctttggtgtggaaaaatactttctggcagggcgacattgacaattttcacgatgacgtgacactcaggaaccagaggttcattcctttcctgaacccaaggacccccagaaagcttacaccatatacagttgtccttcacggaccggcgggggttgggaagactacgttagccaagaaatgcatgttggactggaccgactgcaatctatcaccaactctgaggtacgctttctatttgtcttgtaaagagttgagccgcatggggccgtgctctttcgcggaactgatttcaaaagactggcctgagctccaggacgacatacccagtatcctggctcaagcgcaacggatactgttcgtcgtggatggattagatgaactaaaggttccacctggtgctctgatccaggatatctgcggcgactgggagaagaagaaacctgttccagttttgctgggatcgctgctgaaacggaagatgttgccacgggctgccttgctggtgactaccaggccacgggcactaagggacctgcaactgcttgcccagcagcctatctatgtgagagttgagggattcctggaggaggacagacgcgcttattttttgcgccattttggtgatgaggatcaggccatgcgcgcgtttgagctgatgcgatctaacgcagcacttttccagctcggtagcgcccccgccgtgtgctggattgtgtgcacgacactgaagctgcagatggaaaagggcgaggatccagtgcccacatgcttgacacggaccggattatttctgcggttcttatgttcccggtttccgcagggcgcacaactgcgcggcgcccttcgaaccctgagccttctcgccgcccaaggcctatgggctcagatgagtgtttttcatcgcgaggatctggaaaggctcggcgttcaggaatccgatctgaggctgttcctggatggagacattctgcggcaggaccgagtgagcaagggctgctatagttttattcatctctcatttcagcagttcctcaccgctctgttctatgccctggagaaggaagagggtgaagaccgagacggccacgcttgggatatcggagatgtgcagaaactgctgtctggcgaggagcgccttaaaaaccccgatctaattcaggtcggacactttctcttcggtcttgctaacgagaaacgcgctaaggagttagaagccacatttggatgtagaatgtctcccgacataaaacaagagctgctgcagtgcaaggcccacttgcacgctaataagcctctgagcgttactgatctgaaggaggtcctcggatgtctgtacgagtctcaggaagaagagcttgctaaggtagtcgttgcccccttcaaagaaatcagcatccaccttaccaacacctccgaggtcatgcattgttctttctcactgaaacattgtcaggacttgcagaagctgtccctgcaggtggcaaagggagtgttcctggagaattacatggactttgaactcgatatagagttcgagcggtgcacatacctcacaatccctaactgggcaaggcaggacctgcgatcattacgtctgtggaccgacttttgttccctgttttcctcaaactctaacctgaagttcctggaggtcaagcagtcttttctatctgattcctcagtccgtatcctgtgcgatcacgtgactcgatcgacctgccacctgcagaaggttgaaattaagaatgtgacccctgatacggcctacagggatttttgtctcgctttcattggcaagaagacactcacacatctaaccctagctggacatatcgaatgggaacgcactatgatgttgatgttgtgcgatcttcttcggaatcacaagtgtaaccttcagtatctgagactgggaggacattgcgcaactcctgaacagtgggcagagttcttctatgtccttaaggccaatcagtcattaaaacatttgaggttaagcgccaatgtacttctcgacgaaggagccatgctgttatataaaacaatgacacggccaaagcatttcttgcaaatgctttcccttgagaattgcaggctgaccgaggcttcgtgtaaggatttggcagctgtattggtcgttagcaagaaactcacacacctatgtcttgccaagaatccaataggcgacacaggtgttaaatttctgtgtgaaggccttagctacccagactgtaagctgcagacactggtgctgcagcagtgctccattactaagctgggctgtaggtacctctctgaagccttgcaggaggcatgtagtctaactaacctggatctgagtattaatcagattgcccggggtttatggatcttgtgccaggccttagagaacccaaactgcaatctgaagcatctgcgtctttggtcctgtagcctcatgccattctattgccagcaccttggctcagccctactgagcaaccaaaagctagaaacgctggatttagggcagaatcacctgtggaaaagcggtatcatcaaactgttcggggtgctgcgtcagcgcacgggaagtttgaagattctaaggctgaagacatacgagactaacctagaaatcaaaaaactgctcgaagaagtgaaagaaaagaaccccaagctcaccatcgattgcaatgctagcggcgctacggcccccccctgttgcgatttcttctgttag

SEQ ID NO: 49125 - DNA, 3114 bp, Artificial Sequence
  Description of Artificial Sequence: Synthetic coding sequence
atgaccagcccccagctggagtggaccctgcagaccctgctggagcagcttaacgaagacgaactgaagagcttcaagtctctactttgggccttccctttggaagatgtgctacagaagaccccttggagtgaagttgaagaggcagacggaaaaaagttggctgagatcctagtgaatacatcttccgaaaactggatcaggaacgctactgtcaatattctggaggaaatgaatctcacagaactgtgcaagatggccaaggccgagatgatggaagacggccaggtgcaagagatcgacaaccctgaactgggggatgcggaagaggatagcgagctggccaagccaggggagaaggagggatggcgcaacagcatggaaaaacagtcactcgtttggaagaataccttctggcaaggcgatatcgataatttccatgatgacgtcactcttcgaaaccagagatttatacccttcctgaaccccagaactccacgcaaactgacgccctatacagtggtcctgcatggcccagctggagtgggcaaaaccactctggccaaaaagtgcatgcttgattggactgattgcaacttgtccccaacattgaggtacgctttttacctctcttgtaaggagctgagtcgcatggggccttgctcctttgccgagctgatctctaaagactggcctgagttgcaggacgacataccgagcatactggcccaggcccaaagaattttattcgtggttgatgggctggacgaattgaaagtccccccgggggctctcatccaagatatttgcggcgactgggagaagaagaaacccgttccagtccttctcggaagcctgttgaaacgtaaaatgttaccaagagccgccctcctagtcacgacccgccctcgggccctgcgagaccttcagttgctcgctcagcaacctatctacgtgagggtggagggcttcctcgaagaagatagacgggcttactttctgcgacactttggggatgaagaccaagcaatgagagcttttgagctcatgaggagcaatgcagcgttgtttcaactgggaagcgccccggccgtgtgctggattgtttgcaccactctcaagctgcagatggagaagggggaagacccggtgccaacgtgcctcacaaggaccggcctgtttctgaggtttttgtgtagccggttcccacagggtgcccaactgaggggggcccttcgaaccctgtcactgctcgccgcccagggactctgggcacaaatgagtgtttttcacagagaagatctggaaaggctcggcgtccaagagtcagacctgcgcctcttcctcgacggagacattctgaggcaagatagagtgagcaaaggctgctacagtttcattcatttaagcttccaacagtttctcaccgccctattttatgccctcgaaaaggaggagggtgaggaccgggatggccatgcctgggacatcggagacgtccagaagctgttatctggagaagaacgtttgaagaatcccgatctcattcaagtaggacatttcctctttggactggcaaacgaaaaacgtgctaaggaactcgaggcaacgtttggctgcagaatgtcccctgatatcaaacaagagctgctgcagtgcaaggcacatcttcacgctaataagcccctctccgtgactgacttaaaggaggtgctcgggtgcctgtacgaaagtcaggaggaggagttggccaaagttgtagtggcgccttttaaagaaatcagcattcacctgactaacactagcgaagtgatgcactgctctttttccctaaagcactgtcaagaccttcagaagttgagcctccaggtggcgaagggcgttttcctagagaattacatggatttcgagctggatattgagttcgagagatgcacttaccttacaattcctaattgggctaggcaggatttaaggtcgcttcgtctgtggacagatttctgtagcctgtttagctctaactctaatctgaaatttttggaggtgaagcagtcctttctatccgacagtagtgtgagaatcctgtgtgatcacgtgacaaggtctacgtgtcacctacagaaagttgagatcaagaacgtgactccagacaccgcctatagggatttttgtcttgcttttatcggaaagaagacattgacacatctcactctcgcaggacacattgaatgggaacgaactatgatgttgatgttatgcgatcttctgcgaaatcacaaatgtaatctccaatacctcaggctggggggtcattgcgctacacccgaacaatgggctgagtttttctatgtgctcaaggccaaccagtccctgaagcacttgcgcctaagcgctaacgttctgttggatgaaggagccatgttattgtataagaccatgaccagaccgaagcacttcttgcagatgctgtctctcgaaaactgtaggttaacagaggcatcttgcaaggatttggccgccgttttggttgtgagtaaaaagcttacccacctctgtcttgcgaagaaccccattggcgataccggcgttaagttcctgtgcgagggcctgtcctaccctgattgtaagttgcagactcttgtcctccagcagtgcagcattaccaagctggggtgccggtacctcagcgaggccctgcaggaagcatgctcgctcaccaatctggatctgagcatcaaccagattgctcgcgggctctggatcctgtgtcaggccctcgaaaaccctaactgcaaccttaaacacctaagactgtggtcatgctctctgatgcccttttattgtcagcacctggggtctgccctgctgtctaaccagaaactcgaaaccttggacctgggacagaaccacttgtggaaatccggcatcatcaaactgtttggcgttcttagacagagaacaggatcactgaaaatcttgaggctaaagacttatgagaccaatttagaaatcaagaagttactggaggaagtcaaggaaaaaaacccaaagctgactatagattgcaatgcaagcggcgccactgccccaccgtgctgtgacttcttttgttag

SEQ ID NO: 49126 - DNA, 3114 bp, Artificial Sequence
  Description of Artificial Sequence: Synthetic coding sequence
atgaccagcccccagctggagtggaccctgcagaccctgctggagcagctgaatgaagacgagctaaagagcttcaagagcctcctgtgggcatttccgctggaggatgtgctgcaaaagaccccatggagcgaggtcgaagaggccgatggaaagaaactggccgagatcttagtgaatacatcatcggagaactggatcaggaacgcgacggttaatattttagaggagatgaacctcacagagttgtgtaaaatggctaaggctgaaatgatggaggacggtcaggtgcaggaaatcgataacccagaactcggcgatgctgaggaagatagcgaactggcgaaacctggagagaaggaaggttggcgcaactccatggaaaagcaatccttggtgtggaaaaacacgttctggcagggtgatatcgacaattttcacgacgatgtcaccttgcgaaatcagagatttatcccctttctcaaccccagaacccctcggaagttaacaccatatacagtcgttctacacggtccagcaggcgtcggcaagacaacactggctaagaaatgcatgttagactggacagactgcaatcttagccccacgctgagatacgccttctacctcagttgcaaggagctcagtcgaatggggccttgctcttttgccgagctcatcagcaaggattggcccgagttgcaggacgacataccatctattctcgcacaagcacagaggattttgtttgttgtggacggcctcgacgaactcaaggttcccccgggtgccctaattcaggacatctgcggcgactgggagaaaaagaaaccagtgccggtgctcttaggaagccttttaaagcgcaagatgcttcctagggccgccctgttggtgactacaagaccaagggcccttcgagatcttcaactactagcccagcagcctatctacgtgcgagtcgaaggttttttagaggaagaccggcgggcttactttctgagacacttcggggacgaggatcaggcgatgagggccttcgagctgatgagaagcaacgccgctttgtttcagttaggtagtgctcctgcagtgtgttggattgtgtgcaccaccttaaaactgcagatggaaaagggggaggatcccgtgccaacctgcttgactaggactgggctatttttgcgcttcctgtgtagccggttccctcagggggcacagctgagaggggccctgcgcactctctcattgcttgccgcccaagggctatgggcccagatgtcagtgttccaccgcgaggacctggaacggctcggcgtgcaggagtctgatctgaggctttttctagatggcgatatcttgcgacaggaccgggtgtccaagggatgttatagcttcatccacttatcttttcagcagttccttacggccctgttttatgctttagaaaaagaagagggggaggaccgcgatggccacgcgtgggacatcggcgacgtgcagaagctcctttcaggtgaagaacggttgaagaaccccgacctcattcaggtggggcactttctctttggtctggctaacgagaagagggctaaagagcttgaggccacttttggatgccgaatgtctcctgacatcaagcaggaactgttacagtgcaaagcccacctgcacgcaaataagccgttaagcgtaaccgatcttaaggaagtgctgggttgtctttacgagagccaagaagaagaactagctaaagtcgtagtcgctccctttaaagaaattagcatacatttgaccaatacctctgaggtcatgcattgctccttttcgctgaaacattgccaggatctgcagaaactctccctgcaggtagcaaaaggggtgtttctcgagaattacatggacttcgagctcgatatcgaatttgagcggtgtacctatctgacaattccaaattgggcacgccaggacctccgatctcttcggctgtggaccgacttttgttctctcttttcttcaaactcaaacttgaagtttctcgaggtgaaacagagcttccttagcgactcatcagtccgcatattatgcgaccacgtgactcggagtacatgtcatctgcaaaaagtcgagatcaagaacgtgacaccagatactgcttatagggacttttgcctggcattcatcggaaagaagaccctgacacatctcaccctggctggccacatagagtgggagaggaccatgatgttaatgctgtgcgatctgctgcggaatcataagtgtaacctgcagtatctgcgcttagggggacactgtgctacccctgaacagtgggccgagttcttctatgtgctcaaggccaaccaatccctgaagcatctccgtttgtccgctaacgttttactcgacgaaggtgcaatgctgctatataaaacgatgaccagacctaagcactttcttcaaatgttgagtctggaaaactgtcggctcacggaggcatcctgcaaagacttggctgcggtgctagttgtgtcgaagaaattaacccatctgtgtctggccaaaaacccgataggggatacaggagttaagttcctgtgtgaaggactgagctatcccgactgtaagctgcagacgttggtgctccagcaatgtagcatcactaaacttgggtgtagatatcttagcgaagcattgcaggaggcttgttcactgaccaatcttgatctttctatcaaccagatcgctcgagggctttggatattgtgtcaagccttggagaaccctaactgtaatctgaaacatcttaggctatggtcttgctcccttatgcccttttattgccagcacctggggagcgctctcttatccaatcagaagctggagactctggacctgggccagaaccatctttggaaatctgggatcatcaagctatttggcgtgctgcgacaaagaaccggttccctgaagattctgcgtctgaaaacttacgagacaaacctagagattaaaaaacttttggaagaggtcaaggaaaaaaatcctaaactaaccattgattgcaacgcatccggcgcaactgcccctccttgttgtgacttcttttgctag

SEQ ID NO: 49127 - DNA, 3114 bp, Artificial Sequence
  Description of Artificial Sequence: Synthetic coding sequence
atgaccagcccccagctggagtggaccctgcagaccctgctggagcagctgaacgaggacgaacttaagagtttcaagagcctgctctgggccttcccactagaagacgttttgcagaaaactccctggagcgaagtggaagaagcagacggcaaaaaactggccgagattttggtgaacacaagctcagaaaattggattcgcaacgccactgtcaatatactcgaggagatgaacctgaccgaactttgcaaaatggccaaagcagaaatgatggaggacgggcaggtccaggagatcgacaaccctgaactgggggacgccgaagaggactccgagcttgccaaacctggcgagaaggaaggctggcggaactctatggagaaacagtctcttgtgtggaaaaacaccttctggcagggagatattgacaacttccatgatgacgtgaccctccgcaaccaaagatttatccccttcctgaatccccgaaccccccgcaagcttaccccttacaccgtggtcctccacggccctgccggcgtgggtaaaaccaccttggctaagaaatgcatgctcgattggactgactgcaacctctcacctacactacgctacgcattttacctgagctgcaaagagctgtctcggatgggaccatgttcattcgctgaactcatatccaaggactggccagaactgcaagacgacatccccagcatcctcgcccaggcacagaggattctgtttgtagtggacggtctggatgagctgaaggttcctcccggcgcgctcatccaggacatatgcggagactgggagaagaaaaagccggtccccgtgcttctgggtagtctgctgaagcgaaaaatgctcccaagagccgccttgctggtcacaaccaggccccgcgccctgcgggatttgcaactgctggcacagcagccaatttatgttagggtggaggggttcctggaggaagatcgtcgggcgtattttctgagacacttcggggacgaggaccaggctatgagggctttcgaactaatgcggtctaacgcggcccttttccagcttggcagtgctcctgcagtgtgttggattgtttgcactacgctgaaactgcaaatggaaaagggcgaggatccagtccccacctgcctaactcgcaccggtctgtttcttaggtttttgtgtagtcggttcccacagggagcgcaactccgaggagccctgcgtactctctcactgttagctgcgcagggcctttgggcccagatgtccgtgttccaccgggaagacctggaacggctcggcgtccaagaaagtgacctaagattgtttctggatggagatatcctccggcaagatagggtgtctaaggggtgctactccttcattcatctgtctttccagcagtttctaaccgctcttttctatgccttggagaaggaagagggggaggacagagacggccacgcatgggacattggagacgtacagaagttgctttctggggaagaaagactgaagaaccccgacttgattcaggtgggccacttcttattcggtttggcaaatgagaagagagcaaaggaattggaggcaacctttggatgcagaatgagcccagatataaaacaggagcttttacagtgtaaagcacacctgcatgccaacaaacccctgtctgtgacggacttgaaggaggtgctgggctgtctgtacgaaagccaggaggaggagctcgccaaagtggtggtggcacccttcaaggaaatcagcatccacttaactaacacttctgaggtgatgcattgttcattttccctgaagcactgtcaggacttgcagaagctgtccctgcaggttgctaaaggagttttcttggagaactatatggacttcgagttggacattgagttcgagcgttgcacctacctcacaattcccaactgggcccggcaggacctccgctcgctccgcctctggacagatttttgttctttgttcagttctaatagcaatctaaagttcctcgaggttaaacagagtttcctgtcggactcctccgtgaggattctctgcgatcacgtgacccgaagcacctgccacttgcagaaagtggaaataaaaaacgtgaccccagacacagcctacagagacttctgtctcgcattcatcggcaagaaaaccttgacccatctgactcttgccggccacattgagtgggaacgcacaatgatgcttatgctctgcgacttgctgagaaaccacaaatgtaacctccagtacctccggctgggagggcattgcgccactcctgagcagtgggctgaattcttctacgtgctgaaagctaaccaatctttgaagcacctgagactatctgctaatgtacttctggatgaaggagctatgctcctttacaaaactatgaccagaccaaaacacttcctccagatgttatcactcgagaattgtagactgacagaagcttcctgtaaggatttagctgccgtgttggtcgtttccaaaaagttaacccacctctgcctggccaagaatccaattggggacacgggagttaaatttttatgcgagggactcagttatcctgactgcaagctgcaaaccctggtcctccagcagtgctctataactaagctgggctgcagatatctgtccgaggctctgcaggaagcatgttccctgacaaatctggacctcagcattaatcagatcgccaggggcctatggatcctttgtcaagccctcgaaaacccaaactgcaaccttaagcacctccggctgtggtcttgctcactgatgccgttttactgccagcacttgggtagcgcgctgctttctaatcagaaactcgagacgttagaccttggacagaatcacctgtggaagtccggcatcatcaagctgttcggtgttctgcggcagcggaccggaagcttaaagatcttgaggctgaagacgtacgagacaaacctggagataaagaagctcctcgaagaggtgaaggagaagaatccgaaactcacaatagactgtaacgcctccggagcaaccgcccctccctgttgcgattttttctgttag

SEQ ID NO: 49128 - DNA, 3114 bp, Artificial Sequence
  Description of Artificial Sequence: Synthetic coding sequence
atgaccagcccccagctggagtggaccctgcagaccctgctggagcagctgaatgaggacgagttgaaaagctttaagtctctcttatgggcgttcccactcgaggacgttctgcagaagactccatggtcagaggtggaggaagcggatggtaagaaactggctgaaatcctcgtcaatacttcatccgagaattggatcagaaatgcgactgtgaatattctagaggaaatgaacctgaccgagctatgcaagatggcaaaggcggaaatgatggaggatggtcaggtccaggaaatagataatcctgaactgggcgacgcagaggaagacagtgaactcgcgaaacccggcgagaaggaaggctggaggaatagcatggagaaacagtccctagtgtggaaaaatactttttggcagggtgatatcgataatttccatgatgacgtgacactacggaatcaacggttcattcctttcctgaaccctaggacaccacgaaagctgacaccttacaccgtggttctccatggcccagccggggtcggcaagactactttagccaagaagtgtatgctggactggacagactgcaatctttcgcccactctgaggtatgctttttacttaagctgtaaagaattaagccggatgggaccctgttccttcgcggaattgatctcgaaggactggcccgaattgcaggacgacattccaagcatcctggcgcaggcccaaaggatactcttcgtcgttgatgggcttgacgaactgaaggttcctccaggcgccctgatccaggatatatgcggggactgggaaaaaaaaaagccagtgccagtgctgcttggcagtctcctgaagcggaagatgcttccccgggccgccttgttggttaccacaagaccgagagccctccgggatttgcaactgctggcgcagcaaccaatctacgtccgtgtcgagggatttctggaagaggaccgcagggcgtacttcctccggcactttggcgacgaagatcaagcgatgcgagcctttgagctgatgagatcaaacgcagccctgtttcagcttggtagcgctcctgccgtgtgttggatagtgtgcaccacacttaagttgcagatggagaagggcgaggatcctgtccccacatgccttacaagaacaggtctgtttctgcgcttcctatgcagtcgcttcccgcagggagcccaattacggggggcactgagaaccctgagtctgcttgcggctcagggcttatgggcccagatgtccgtgttccatcgagaagacctggaacgcctcggagtccaggaaagtgatctgagactgttcctggatggagatattcttcgccaagaccgtgtctcaaagggatgttactctttcatccatctgtcctttcaacagttcctcacggcgctgttctatgcactggaaaaagaggagggcgaggacagagacggccatgcatgggacattggcgacgtccagaagctactgtccggcgaggaacgcttaaaaaatcccgatctcatccaggtaggccactttctgttcgggctggcaaacgaaaagagagccaaggagctggaagcaacattcggctgcagaatgagtccagacatcaagcaggaactcctgcaatgcaaggcacacttacatgcgaacaagccactatctgtgaccgatctgaaagaggtgctcggctgcttgtacgaaagtcaggaggaagaattggctaaggtagtggtcgcccctttcaaggaaatctcaattcacctgacgaacacgtctgaagtgatgcactgcagcttcagtctgaagcattgccaggatctacaaaaactgagtcttcaggtagccaagggtgtttttttggagaattacatggactttgaactagatatcgagtttgagcggtgcacatatctcaccatcccgaactgggctcgccaggacttgcgtagtctgcgcctgtggaccgacttttgtagtttgttcagtagcaatagcaaccttaaatttctcgaagttaaacagtctttcctgagcgatagctccgtgaggattctctgcgaccatgtcaccaggtctacctgtcatcttcaaaaagttgaaatcaaaaacgttacacctgacaccgcttacagggacttctgcttggcgtttatagggaagaagacattgactcacctgactctcgccggacacattgagtgggaacgtacaatgatgctgatgctatgtgacctgctgcggaaccacaagtgcaacctgcagtacctacgcctcgggggccactgcgccactcctgaacagtgggcagagtttttttacgttctgaaggcaaaccagtcccttaagcacttgaggctcagtgcaaatgtgttgctggacgaaggggccatgctattgtataaaacaatgacccgaccaaagcacttcctccagatgctgtcgctcgagaattgcagacttaccgaggctagctgcaaagatctcgctgcagtgctagtcgtgtccaaaaaactgacccatctgtgcttggccaagaatccgatcggggatacaggagtcaaattcctgtgtgaaggcctttcctaccccgactgtaaacttcaaaccctggtactccaacagtgctcaatcacgaagctgggctgcagataccttagtgaagcactgcaggaggcctgcagccttacaaatctagatctctccattaaccaaatcgctcggggtctgtggattctctgccaggcgctcgagaaccctaattgtaatcttaagcacctaaggttatggagctgctccctgatgcctttttactgtcagcacctcggctctgcccttttgagcaatcagaagctggaaactctggaccttggccaaaaccatctctggaagtcaggtattatcaaactgttcggagttcttcggcaacggacgggctccctgaagatactccgcctgaaaacttacgaaacgaacctcgaaataaagaagctcctcgaagaagtgaaagaaaagaacccaaaactgactattgactgcaacgcttcgggcgctacagctccaccctgctgcgactttttttgctag

SEQ ID NO: 49129 - DNA, 3114 bp, Artificial Sequence
  Description of Artificial Sequence: Synthetic coding sequence
atgaccagcccccagctggagtggaccctgcagaccctgctggagcagctaaacgaggatgagttaaagtctttcaagtcactgttatgggcttttcctctggaggacgttttgcaaaagacaccttggagtgaagtggaagaggctgatggcaaaaaactggcagagatactcgtgaataccagcagcgagaactggatccgtaatgccacagtgaacatcctagaagagatgaacctgacagagttatgcaagatggccaaggctgaaatgatggaggatggtcaggtgcaggagatcgacaatccggagctgggagacgccgaggaggatagtgagctcgccaaacctggcgaaaaagagggatggcgcaacagcatggagaaacagtccctggtctggaagaatacattctggcagggggatatcgataattttcacgacgacgtgacactccggaaccaaagatttatcccatttctgaaccctcgtacaccacggaagctgaccccgtacaccgtggtgttacacggtcctgctggagtggggaagaccactctggctaaaaagtgcatgctggactggaccgactgcaatctctctcctactctcaggtatgcattctatctgtcctgcaaagagctttccagaatgggcccgtgttcctttgctgagctgatctcgaaagactggccagagctacaggatgatatcccctccatcctggcgcaagctcagcggatcttgttcgtggttgacgggctggatgagctgaaagttccccctggtgctcttatccaagacatatgtggcgactgggagaaaaaaaagcccgttcctgtgctcctagggagcttgctgaagcgcaaaatgctgccaagagcagctctgttagttacaactcgacccagggctctgcgggatctccagctccttgcccagcagccgatttatgtgcgcgtcgagggattcctggaggaagaccggagagcctatttcctgcgacatttcggggatgaagatcaagccatgcgggcgtttgagctcatgaggtctaatgccgcactcttccagctggggtcggcaccggctgtatgttggattgtgtgcacaactcttaaacttcaaatggagaagggagaggatccagtccccacatgccttactcgcaccggcctttttctgcgctttctatgttcccgctttccccagggagcacaactgcgaggcgccttacggacacttagtctactcgctgcccagggtctgtgggcccagatgtcagtgtttcaccgtgaggatctggagaggctgggggtgcaggaaagcgacctgcgcctgttcctggatggtgacatattgcggcaggaccgggtttctaagggatgctactccttcatccatctgagcttccagcaattccttaccgcattattttatgccctggagaaagaagaaggcgaggatcgggacggccatgcttgggacatcggagacgttcagaagctgttaagtggcgaggaacgattgaagaaccctgacctcatccaagttgggcactttttgtttggcttggccaacgagaagagggcaaaggagctggaagccacctttggctgtagaatgtctcccgatatcaagcaggaacttctgcagtgtaaggcccatctccacgctaacaagccactctccgttactgatctgaaggaggtgttggggtgtctgtacgagtctcaagaggaggaattagctaaggtggttgtggcgccattcaaggagattagcattcacttaaccaatacatctgaggttatgcactgcagctttagtctcaaacattgtcaagatctgcagaagctgagcctgcaggtcgccaaaggagtcttcctggagaactacatggattttgagcttgacattgagttcgaacggtgcacttatcttactatccccaattgggcacgccaggacctgagatctctgaggctgtggacagacttttgctcccttttcagcagcaactccaacctcaagttcctggaggttaagcagagctttctgagcgattcttcagtgcgtatcctgtgtgaccacgttaccagatccacatgccacctgcagaaagtcgagataaaaaacgtcacccctgataccgcatatcgtgacttctgccttgcttttatcgggaagaagaccctcacccatcttaccctggccggccatatcgagtgggaaaggacaatgatgttgatgttatgcgatttactcagaaaccacaagtgtaacttgcagtatcttagactcggcggacactgtgctaccccagagcagtgggctgagtttttctacgtgcttaaagcaaaccaaagtctgaaacatctaagactgagcgctaatgtactgcttgatgagggcgcgatgctgttatacaagacaatgaccaggcccaagcattttttacagatgctgtctctcgagaactgtcgtctcaccgaggcctcctgtaaagaccttgcggctgtgctcgtagttagcaagaagctgactcacttgtgcctggccaagaaccctatcggcgataccggggttaagtttctttgcgaaggcttgtcttatccggactgtaagttacagacactggtactgcagcagtgctccattacgaaacttgggtgtagatatctctcagaggctctgcaggaagcctgctccctgacaaatctggatctatccatcaaccaaatagccagagggctatggatactgtgtcaggcattagagaatcccaattgcaacttgaagcatcttaggctgtggagctgctcgctgatgcccttttactgccaacacttgggctcagctctgctctctaatcagaagctcgagaccctcgatttaggtcagaatcatctttggaaatcaggcattatcaagctgtttggggttctccgccagcggactgggagcctgaagatcctgcggctgaaaacatatgaaactaacctggagataaaaaaactcctggaagaggtcaaggagaaaaatcctaaactgaccattgattgtaacgcttctggagccaccgctcctccatgctgtgatttcttctgctag

SEQ ID NO: 49130 - DNA, 3114 bp, Artificial Sequence
  Description of Artificial Sequence: Synthetic coding sequence
atgaccagcccccagctggagtggaccctgcagaccctgctggagcagctgaacgaggacgagttaaagagcttcaagtctttattatgggcgttccccctggaggacgtgctgcagaagacaccatggagtgaagttgaggaagccgatggcaaaaagcttgctgaaatcctggttaacacttccagcgagaattggattcgcaacgctactgtcaacatcctcgaggaaatgaatctgactgagctctgcaaaatggccaaagccgagatgatggaagatggccaggtacaggagatcgataatcctgagctgggggatgctgaggaggattcagagctagctaagcccggtgaaaaagagggctggagaaacagcatggaaaagcagagcctggtttggaagaacaccttttggcaaggcgacatcgacaattttcatgatgacgttactttgagaaaccagagattcatacccttcctgaaccctagaacccccagaaagttgacaccttacacagttgtcctgcacggacctgctggcgtgggtaaaactactctcgcaaaaaagtgtatgctcgactggactgattgtaacctctcacctacactacggtacgcattctacttaagctgtaaggaactgtctagaatgggaccgtgttcctttgcagagctgatctccaaggattggccagaactccaggacgatataccctccatactcgcccaggcacagaggatcctgttcgtcgttgacggcttagatgaactcaaagtgcctcctggcgccctgattcaggacatttgcggggactgggaaaagaaaaaacctgttcccgtgctccttgggagcttactgaagcgtaagatgctgcctagggctgcattgctggttaccactcgtccacgagctctgcgggacctgcagctgctcgcacagcagcctatctacgttagggtggagggctttctcgaagaggacaggcgggcctattttcttagacacttcggcgacgaagaccaagccatgagagccttcgagctgatgcgctctaatgccgcactatttcagcttgggtcagccccagctgtgtgttggatagtgtgtaccaccctcaaacttcaaatggagaagggcgaagatcctgtgcctacatgcctcactcggacaggtctgtttctgcgtttcctctgcagcaggtttccacagggcgcgcagttacggggtgcactccgaactctgtccctgcttgcagcacaaggcctgtgggctcagatgtctgtttttcatcgcgaggacctggaaagacttggcgtccaggagtcggacctccggctcttcttggatggagatatcctgcgacaagatagggtctctaaaggctgttactcattcattcacttatcattccagcagtttctcaccgccctcttctatgcactggagaaagaggaaggcgaagacagggatggacacgcctgggatattggggatgtgcagaaattgcttagtggagaggaaagactcaaaaatccagaccttatccaggtgggccacttcctctttggtctggcaaacgaaaaacgcgcgaaggagctagaagcgacattcggttgccgcatgtccccggatattaagcaggaacttctgcagtgtaaagcccacttacatgccaataaaccccttagcgttaccgacctaaaggaagtactgggttgcttgtacgagtcccaggaggaagaattggccaaggtggtggtggccccctttaaagagatttcaatccatctgacgaatactagcgaggtgatgcactgctctttttccttgaagcattgtcaggatttgcagaaactctctctccaagtggctaagggagtgttcctcgagaactacatggactttgagttggacatagaattcgagcgctgtacctaccttaccatacccaactgggcccgccaggacctcaggtcactgagactgtggactgatttctgtagcctcttttccagcaactccaacctgaagtttttagaggtgaaacaaagctttctgagcgactccagtgtgcgtatactgtgtgaccatgttaccagatccacttgccaccttcagaaagtggaaataaagaatgtgactcctgacaccgcttaccgggatttttgtctggcctttatcgggaagaagaccctcacgcacctgactctggctggccacatcgaatgggaacgaacaatgatgcttatgctgtgcgacctgttgcgaaatcataagtgtaatctccaatacttacggcttggcggtcattgtgccacaccagagcagtgggccgagtttttctatgtgctcaaagccaatcaatcgctcaagcacctacggttgagtgctaatgtcctccttgacgagggtgccatgctcttgtataaaacaatgacccgccctaaacatttcttacagatgctgtccctcgaaaactgccggctgacagaggcatcctgcaaggatttggccgccgtgctggtggtctcaaagaaattgactcacctctgcttggcaaaaaacccaatcggtgacacgggcgtgaaattcctctgcgaaggactctcttacccagactgtaagctgcaaacgttagtcctgcagcagtgtagcataactaaactgggatgccgatacctctccgaggctctccaagaggcttgcagcctaaccaacttggacttaagcattaaccaaatagcaagggggctgtggatcttatgccaggctctcgagaaccccaattgtaacctgaaacacctgcggctgtggagctgttccctcatgccattttactgtcagcatctgggcagtgctttactaagcaaccaaaagctcgaaacactcgacctaggacaaaaccacctgtggaaatccggaataattaaacttttcggggtcctaaggcaacggacaggctctcttaaaatccttaggcttaagacatacgagacgaacctggagatcaaaaaattgttagaggaagttaaggagaaaaatccgaaactcacaatagattgtaacgccagcggagcaactgcacccccctgctgcgacttcttttgctag

SEQ ID NO: 49131 - DNA, 3114 bp, Artificial Sequence
  Description of Artificial Sequence: Synthetic coding sequence
atgaccagcccccagctggagtggaccctgcagaccctgctggagcaactgaacgaggacgagcttaaatcttttaagtcactgttgtgggcctttcccctcgaggatgtccttcagaagaccccctggtccgaagtagaagaagctgacggtaagaaactggcagagatacttgtgaataccagcagtgagaattggatccgcaatgctaccgtaaatatcttagaggaaatgaatttgaccgagttatgcaaaatggccaaggccgagatgatggaagacggacaggtgcaggagatcgataaccccgaactgggtgacgccgaagaagactcggaactggccaaacccggtgaaaaggaggggtggcgaaatagcatggaaaagcagagtcttgtttggaagaatactttctggcagggtgatattgacaacttccacgacgacgtaacactgcgcaaccagaggtttatcccttttcttaacccaagaacccctcgcaagctgacaccttacacagtcgtgctccatgggcctgccggcgtggggaagactaccctggctaaaaaatgcatgctcgactggacagattgtaatttaagtcccactcttcggtatgcgttttacctcagttgtaaggagctttcccgtatgggaccctgcagtttcgccgaactgatctccaaagattggcccgaactgcaggacgacatcccgtcaatcctggcccaggctcagcgcattctgtttgttgtggatggccttgacgaactgaaggttccacccggagccctcattcaggacatctgcggggattgggaaaaaaaaaagcccgtgcctgtgctgctaggtagtcttctgaagagaaagatgctgccacgagccgccttgctcgttactaccagacctcgcgccctgcgggatcttcagctcctcgcccaacagccaatttatgtaagagtggagggctttctggaggaggatcgcagagcttacttcctccgccattttggggatgaggaccaagccatgcgggcgttcgagttgatgaggagtaatgcagccctttttcagctaggaagtgcccctgcagtgtgctggatagtatgtacaacccttaaactacagatggaaaagggcgaagatcctgtgccaacgtgtttgacacgcacgggtctctttcttagatttctgtgctcacgctttccccagggtgctcagttgagaggcgctctcaggactctgtccctgctagctgcacaaggcctgtgggcccagatgtccgttttccaccgcgaggatttggagcggcttggtgttcaggagtcagacctgaggctgtttctcgatggtgatattcttcggcaggatcgggtgtccaaggggtgctattcatttatccacctttcttttcagcagttcctcaccgctctgttttacgctttggaaaaggaggagggagaagatagagatgggcatgcttgggacattggagatgtgcagaaacttctcagtggcgaggagcggctgaagaatccagacctgatccaggtagggcatttcttgtttggactagcaaatgagaaaagagccaaggagctggaggccactttcgggtgcagaatgtccccagacatcaagcaggaattgctacaatgtaaggctcacctgcacgccaataagcccctgagtgtcaccgatttgaaggaggttctggggtgcctgtacgagtctcaggaagaggagcttgccaaggtggttgtggcccccttcaaggaaatctccatacatttgactaataccagcgaggtgatgcactgctctttcagtcttaagcattgtcaggacctccagaaactgtcattgcaggtggctaaaggggtctttctagagaattacatggattttgaattagacatcgaattcgagcgctgtacatacttgaccatcccaaattgggcccgacaagacctgagaagccttagactgtggacagacttttgctcattattctcttccaactccaacctgaagttcctggaggttaagcagagctttctgagcgactctagtgtgaggatattatgtgatcacgttactcgatctacctgccacctgcagaaagtggaaattaaaaacgtgactcccgacactgcatatagagatttctgtctggctttcatcggcaagaaaaccctgactcacctcaccctggcagggcacatagagtgggagagaacgatgatgctgatgctgtgcgatctgctgagaaaccacaagtgcaatttgcagtatttgaggctgggcgggcactgcgctacacccgaacagtgggcagagtttttttatgtcctgaaagcaaatcagagtttgaaacacctgaggttgagcgccaatgtgctgctggatgaaggggccatgttgctatataagaccatgacccggcccaaacacttcttgcagatgctgtcccttgagaactgtagattaactgaggctagctgcaaggatctcgctgcagtgttggtggtgtccaagaagctgacccatctgtgcctggcaaagaatccaatcggagacacaggagtgaaattcctgtgtgagggactgagctatccagactgcaaactgcaaacattggttttacagcagtgcagtatcacaaagctgggatgcaggtacctttccgaggcgctgcaagaggcctgctcactgaccaaccttgatttatcaataaaccagattgccagaggactatggattctgtgtcaagctttagagaatccaaattgcaaccttaagcatctgaggctgtggtcttgtagcctgatgccgttttactgccagcatctggggagcgctctgctttctaaccagaagcttgagaccctggacctggggcaaaatcacctttggaaaagtgggatcatcaagttatttggagttcttagacagaggactggatctctgaaaatcctgaggctgaagacctatgagaccaacctggaaatcaaaaaactgctagaagaggtcaaggaaaagaatccaaaactgacaatcgattgtaatgcctccggtgccacagcccccccgtgttgcgattttttttgttag

SEQ ID NO: 49132 - DNA, 1080 bp, Artificial Sequence
  Description of Artificial Sequence: Synthetic coding sequence
atgaacttcatcaaggacaacagccgggccctgatccagcggatggggatgactgtgattaagcagatcacagatgacctcttcgtctggaatgttcttaatagggaggaggtgaacatcatttgctgcgaaaaagtggaacaggatgcggctcgcggcattatacacatgatactcaagaagggttccgagagctgcaatctttttctcaaatccttaaaagagtggaactatcctctcttccaagacttaaatggacaatctggcctgaccgactcgctcggcaacctcaagaacctgacgaagctgatcatggataatatcaagatgaatgaagaagatgctatcaaactggcggaaggcttgaaaaacctgaagaagatgtgccttttccacctcacacacctaagcgatattggcgaaggcatggactacattgtcaagtcactgagctctgaaccttgcgacctcgaggaaattcagctagtgagttgctgtctctcagcgaatgccgtgaagattttagcacagaatctacataacctcgttaagctgtctattctcgacctcagcgaaaattatctggaaaaggacggaaacgaagcccttcatgaacttatagaccggatgaacgtgctagagcagctgactgccctgatgctgccatggggatgcgacgttcagggatccctgagttccttgctaaaacacctcgaagaagtgccacagctggtgaaacttggactaaaaaattggcggttgacagatactgagattagaatactgggcgctttctttggaaaaaatccattaaaaaactttcagcagttaaacctggctggtaaccgggtctcttctgatggctggctggctttcatgggtgtgtttgagaacctgaaacagctagtgttctttgatttcagcaccaaagagttcttgcccgacccagcactggtgaggaagctgtctcaggtgctgtctaagttgacatttctgcaggaggcccgcctggtcggatggcagttcgacgacgatgatctgagtgttatcacgggggcatttaagttggttaccgcatag

SEQ ID NO: 49133 - DNA, 5514 bp, Artificial Sequence
  Description of Artificial Sequence: Synthetic coding sequence
atggaccccgtgggcctgcagctgggcaacaagaacctgtggagctgtctggtgcgactgctcaccaaggaccccgagtggcttaatgctaaaatgaagttcttcttaccaaatactgacctcgactcacgtaatgaaactctggatccagagcagcgggtcatcctacagctgaacaagctgcacgttcaaggctccgacacttggcagtcatttatccactgcgtctgcatgcagctcgaggtacccctggacttggaggttcttcttcttagcacatttggatacgatgacgggtttacttcccagcttggagccgagggcaagtcccaaccagagtcccagctacaccacgggctcaaaaggccccaccagagctgcggctctagtccacgccgcaagcaatgtaagaagcagcagttagagctggctaagaagtatctccagctcctgcggacttctgcacaacagaggtatagatcacagataccagggagcggccagccccacgcgttccaccaggtatacgtgcctcccattctgcgaagagctaccgcatccctcgatacgcctgagggggccatcatgggggacgttaaggtggaggatggtgccgatgtgtctataagtgatttgtttaatacgagggtaaacaagggccctagagtgaccgtactccttgggaaggccggcatgggcaagactacactggcccacagactgtgtcagaagtgggctgagggccatttgaattgttttcaggctctgtttttgttcgaattcagacaactgaatctcattacccgctttctgacacccagcgaactcttgttcgacctttacttatcccccgaatctgaccacgatactgtcttccagtatttagaaaaaaacgcggaccaagtactgttgatattcgatggtctggatgaagccctgcagccaatgggtcccgacggtccagggccagtgcttacattgttctcccatctgtgcaatggcacactgttgccaggctgccgggtcatggctacctcccggcctggaaaacttcccgcatgcttaccagccgaggcagcaatggtgcatatgctcggattcgacgggccacgggtcgaagagtatgtgaatcactttttttctgcccagccatctcgggaaggcgcgttagttgaactacagaccaacggaaggctgcgaagtctgtgcgctgtcccagccttatgtcaggtggcttgcctatgccttcatcacctcttgcctgatcatgcacccggtcagagcgtggccctattgccaaatatgacgcagctgtacatgcagatggttcttgcactgtccccccctggccatctccctacttctagcctcctggatctcggtgaagtagccttacgaggtttagagaccggtaaggtgatcttctacgctaaggatatcgcaccccccttgattgcatttggagccactcacagtctgcttacatctttttgtgtgtgcaccggacctgggcaccagcagacaggctacgcattcacacacctatcactacaggagttcttggcagcactccacctcatggccagtccaaaggtgaacaaggacaccctaactcagtatgttacactgcactcacggtgggtgcagcgcaccaaggcaagactaggcctgtcggatcacttgccaactttcttggccggtcttgcctcatgtacctgccgaccttttctcagccacctcgcccagggcaacgaagattgcgtgggcgctaagcaagccgctgtggttcaggtcctgaagaaactggccacacgcaaactaacaggccccaaggtcgtggagctctgccattgtgtggatgagacccaggaacctgaactggcctcccttacggcacaatcactgccatatcaactcccatttcataatttccccttgacctgtacagatttagctacattgaccaacattctcgagcatagggaggcacctattcacctggacttcgacggttgtccactagaacctcactgtccggaggcactggtgggatgtggccagattgagaatctcagtttcaagtccagaaaatgcggcgacgcttttgctgaagctctgagccgcagcctgcccactatgggcagattacagatgctgggactggcgggctcgaagatcacggcccgtggaatctcccacctggttaaggcgctcccattgtgtccccagctgaaagaggtgtcatttcgcgacaaccagctgtctgaccaggtagtcctcaatattgtggaggtcttaccgcatcttccccggttacgtaaactagatctaagttctaattcaatttgtgtctcgactctgctgtgtctggcacgcgtagcggtgacatgcccaacagtcaggatgttacaggcccgagaggccgaccttattttcctgctgagcccgccaacagaaaccaccgccgagttacagagagcacctgacctccaggagtctgacgggcagcgtaaaggcgcacaatcccgaagcctaacattgagactccagaagtgtcagctgcaagtacacgatgccgaagcacttatagcactgctacaggaaggaccacacctcgaagaagtcgatctgtcaggaaatcagctggaggatgagggctgtcggctcatggcagaagccgcatcacagttgcatatcgcacggaagttagacctctccaataatggccttagtgtggccggcgtgcattgtgtactcagagccgtttcagcgtgctggactctagcggagctgcacatcagccttcagcacaaaacagtcatcttcatgttcgctcaggaaccagaagagcaaaagggtccccaagagagagccgccttcctcgacagcctcatgctgcagatgcctagtgagctcccgctgtcatcaaggcgcatgcgcttgacacattgcggtctgcaagaaaaacacctggagcagctatgcaaagctcttggagggagttgtcatttaggccacttacacctagatttctcagggaatgctctgggcgatgagggggcggcccgcttagctcagctactgccaggactgggcgcgctccagtcgctcaatctgtcggagaatgggctctctctggacgcagtcttgggactcgtccggtgctttagcactcttcagtggctgttccgcctggacatctcattcgaatcacagcatatactgctgcggggcgacaagacatctagggatatgtgggccacgggatccctcccagactttcccgccgcggcaaaatttctgggcttcaggcagagatgtattcctagatctctgtgccttagtgaatgtcccctggaacccccaagtttgacccggctatgcgccaccctgaaggattgccctggccccctggagctgcagctgtcttgcgagtttttatctgatcaaagcctcgagaccctgcttgattgcttgccccagctaccacagctgagtctgttacagctctctcagacaggcttatctccgaaaagtccatttttacttgcaaataccctgtcattatgtcctagagtcaagaaagtggatctgcggtccctgcaccatgcgacgctgcactttagaagcaacgaagaggaagagggagtgtgctgcggtctgtccgcaaacctcttaggagactctggcctacggtgcctgctggagtgcctgccacaggtacccatcagcggcctgctggatttatcccacaacagtatctctcaggaaagtgctctttacttgctcgaaaccctgccgtcctgcccaagggtccgagaggcctcagtcaacctggggtctgaacaaagcttcagaattcacttcagccgtgaagatcaggcaggcaaaaccttgcggttgtcagagtgctctttccggcctgagcatgtgtcgagacttgcaactggcctttccaagagtctgcagctgacggaacttacccttacccagtgctgcctgggccaaaagcagcttgctatcctgctttccctggtgggtaggcctgccgggctgttctcactcagggtgcaggagccttgggccgaccgggcgagggtgctatcactgctcgaagtttgtgcccaggcaagcggctctgtaacagagataagcatttcagagacccagcagcagctgtgtgtgcagcttgagttccccagacaggaagaaaatcccgaagcggtagccttacggctggctcactgcgaccttggagcgcaccacagcctgcttgtgggccaattaatggagacgtgcgcaaggctgcagcaactgagcttgtctcaggtaaatctgtgtgaggatgacgacgcctcatctctcctccttcagtcacttctgctgtccctcagcgaattgaagacattcaggttgacttcctcttgtgtttctacagaggggctcgctcacctggcctccggcttgggacattgccaccatctggaagagttggatctcagcaacaatcagtttgatgaagagggaacaaaagcactcatgagggctttggaaggaaagtggatgctgaagcggctagacctttcccatctacttctgaatagttccaccctggccttactaacacatcgcctgtcacagatgacgtgtttacagagcctccggctgaaccggaactctattggagatgtggggtgttgtcatctttctgaagcactgagggctgccaccagcttggaggagcttgatctttcccataatcagattggcgacgccggcgtgcaacacctggccaccattttgccaggattgcctgagctacgcaaaatcgatcttagtggcaattcgatttcttcagctgggggcgtgcagcttgctgagtccctggtgttatgccgtcgtctggaagaactgatgctgggctgtaatgctctcggcgaccctactgccctcggactggcgcaggaactgccgcaacatctcagggtgctgcatctcccctttagccacctggggccaggcggcgcactctcactcgcccaggccctggacggctcaccacatttagaggagattagtctcgccgaaaacaatcttgccggaggtgtcctgcgattctgcatggaactcccactgctgagacagattgatttggtgagctgcaaaatagataaccagacggcaaaactactcacgagtagcttcacttcctgccctgccctcgaagttatactcctatcttggaacctgctcggtgatgaggccgctgctgagctggcccaggttctgcctcagatgggcaggttgaaaagggtggacctagagaagaaccaaattacagccctcggcgcctggttattggccgagggcctagcacagggctcctctatacaggtgattcggctttggaacaatcctatcccttgtgacatggcccagcatctgaaatcccaagagcccagactcgacttcgctttttttgacaatcagccacaggccccatggggaacgtag

SEQ ID NO: 49134 - DNA, 2553 bp, Artificial Sequence
  Description of Artificial Sequence: Synthetic coding sequence
atggccagccccaaggtgaacaaggacaccctgacccagtacgtgactctgcacagtcggtgggtgcagagaaccaaagcaaggttgggattgagcgaccatctccctactttcctggctggactggccagctgcacatgtagacctttcttgtcacacctggcgcaaggaaacgaagactgtgtcggggctaagcaggccgctgtggtgcaggtgctaaaaaaacttgcgacacgtaaactgaccggtcctaaggtcgttgaattgtgtcattgcgttgacgagacccaggagccagagctggcttctctgacagcgcaatccttaccgtaccagttaccctttcataatttcccattaacatgcacagaccttgcaactctgacaaatatcctcgaacacagagaagcccctattcatttagacttcgacgggtgtcccctggagcctcattgccccgaagctctagttggatgcggccagatcgaaaacttgtcatttaaaagcaggaagtgcggagatgccttcgcagaggctctgtcgcgctccctcccaaccatgggccggctgcagatgctgggtcttgctggcagtaagatcactgcccgcggcatctcacacctggtgaaggcgctgccactgtgtcctcaactgaaagaggttagctttagagataaccagttaagtgaccaggtggtcctgaacattgtggaagtcctccctcatctgccccgtcttcgcaagctggacttgagctccaacagtatctgtgtttccactttgttgtgccttgcaagggtggccgtaacatgccccaccgttagaatgctgcaggcgcgagaggcggatttaatctttctcttgtctcctcctactgaaacgacagctgagctccagcgagcacctgatttacaagaaagtgacggccaaaggaagggtgctcagtctcgatcgttaacactgagactccaaaagtgccaattgcaggtgcacgacgcggaagcccttattgccctgttacaagagggaccccacctggaggaagtcgacctctctgggaatcagctggaggacgaaggttgtcgcctgatggctgaggccgcatctcagttgcacatcgctcgcaagctggatctgagcaataacggcttgtctgtggcaggggttcactgcgtcctgagagctgtgtccgcatgctggaccctcgccgaattgcacattagcctccagcacaaaaccgtgatcttcatgtttgcccaggagcctgaggagcagaaaggaccacaggaaagagcggccttcctggacagcctcatgcttcagatgccctccgagctgccactgagcagcaggcgaatgcgacttacccattgtgggctgcaggagaaacacttggagcaactctgcaaggcccttggagggagttgccaccttggacacctccatctggatttttccggcaacgcactgggcgatgagggcgctgctcgactggcacagttacttccagggctgggggcactgcaatcactaaacctgtctgagaacgggctgtcactggatgcagtccttgggctcgtgcgatgtttcagcactctgcagtggctgtttaggctggatatttcctttgaatcacagcacatccttctgaggggtgataagacatcatctctgtccgagtgtcccctagaaccaccatcactgacacgcctctgtgccacattaaaggactgtcctggcccgctggagttgcagctgtcatgcgaattcctgtcggaccaatctcttgaaacactgctggactgcctgccacagctgccccaactgagcctgcttcaactgtcccagaccggcctgagcccaaaatctccctttttgttggccaatacgctgagcctatgcccacgcgttaaaaaggtggatcttagatcgctacatcacgctaccctccacttcagatccaatgaggaggaggagggcgtttgttgtggattcacagggtgtagcctcagtcaagagcacgtggagagtttgtgctggctgctgtctaaatgcaaagatttgagccaggtggacctatcagctaatttgttgggcgactctggtctgaggtgtctgctcgagtgcttgcctcaggtacccatatccggcttattggatctcagccacaactccatctctcaggaatcggcattgtatcttctagaaaccttgccttcttgcccgcgggtgcgagaggcgtctgtgaatcttggatctgagcagtcgtttcgcattcatttctcgcgcgaggaccaggctggcaaaaccctgcggttatcggagtgctcctttaggcctgaacacgtctccagactggccaccggactctcaaaatcacttcagctcaccgaactcacacttacacagtgttgcctcggccaaaagcaactcgccatcctgttgtctctggttgggcgaccagcaggccttttctcactacgcgattcaacgcgacatactgaaaagctgtcgtttccaactctcgaggcctgtgcactcgggttcaaatag

SEQ ID NO: 49135 - DNA, 4656 bp, Artificial Sequence
  Description of Artificial Sequence: Synthetic coding sequence
atggaccccgtgggcctgcagctgggcaacaagaacctgtggagctgtttggttaggctcttgacgaaggaccctgagtggctgaacgccaagatgaagttcttcctgccaaacacagatctggactcgaggaatgaaacactcgatcccgaacagcgcgtgatcctgcagctcaataagttacatgtgcagggctccgatacatggcagagttttatccattgcgtgtgcatgcagctcgaagtaccgctagacctggaggtgttgcttctttctaccttcggctacgacgacggctttacctcacaactcggtgccgaagggaagtcacagcccgagtcccagctgcatcacggactgaagaggccacaccaatcttgtggatcctcgcctcgccgaaaacagtgcaaaaaacaacagttagagttagccaaaaaatacttgcagctgcttaggacctcggcgcagcagaggtaccggagtcagatcccaggcagcgggcagccccatgctttccatcaggtttacgttccaccgattctcaggcgcgctaccgcatctctagataccccagagggagccattatgggcgatgtaaaagtcgaggacggggccgatgtctccatctccgatctcttcaacacccgagttaacaaaggacccagagtaactgtgcttctcggcaaggcaggcatggggaaaacaacactggcacatcgtctgtgccagaaatgggccgagggccatctgaattgctttcaagcactcttcctgttcgagttccgtcaattgaacctgataactcgttttctcacgcccagcgagcttttgtttgatttatacctgagccccgagagcgatcacgacaccgtttttcaatacttggagaaaaacgccgatcaggtactgctgatctttgatggcctagacgaggccctccagcctatgggacctgatgggcctggaccagtgctcacattgttcagccatctttgtaatgggactctcctgcctggctgcagagtcatggccacctctcgccccgggaaattaccggcctgtctgcccgccgaagccgcaatggtccacatgcttggctttgacgggccacgagtagaggagtacgtcaatcacttcttttccgctcagccttcaagagaaggcgctctggtcgagctccagaccaacggccgcctgcggtcactatgcgcggtccccgctctgtgccaagttgcttgcttgtgtctacaccacctgctgcccgatcatgctccaggccaaagtgttgccctcctccctaatatgacccagctgtatatgcaaatggttctggcactaagcccccccggccaccttcccactagcagtctgcttgatctgggggaggtggcactgcggggcttagaaactggcaaggtcatcttctatgccaaagacatagccccaccactgatcgctttcggcgcaacccactcattgttaaccagcttttgcgtatgcacgggacccggccatcagcagacaggttacgcgttcacacacctgtcccttcaagagtttttagcagctctccatctgatggctagccctaaagtaaataaagacacccttacacagtacgtcacgctgcactcaagatgggtacagcgcaccaaggcgcggctgggcttgtccgatcatctgccaacgttcttggcaggtctcgcatcttgcacctgccgacctttcctgtcccaccttgcccagggtaacgaagactgtgtgggggcaaagcaggctgccgtggtgcaggtacttaaaaaactggctacgcggaagctgacgggccccaaggtcgtggaactttgccattgtgttgatgaaacacaggaacctgagcttgctagtttgacagcgcaaagcttgccctatcagctgccttttcacaacttcccgttgacctgtacggacttagcaacattaacaaacattcttgagcatagggaagcacccatccacctagatttcgacgggtgtcctctggagccgcattgcccagaggccctggtcggttgcggccaaattgagaatctgtccttcaaatcccggaagtgtggggacgcatttgccgaggccttgagcagatccctgcccactatggggcgcctgcagatgctaggccttgccggctcaaagataacggcccgggggatctctcatctggtgaaggccctgcccctgtgtccccaactgaaagaggtgtctttcagggataatcagctatccgatcaggttgtgctcaatatcgtagaggtgctaccccacttacctaggctgcggaaactcgacctaagctcaaattcaatctgcgtttccacgctcctgtgcctggcccgcgtggctgtgacatgcccaacagtgcgtatgctacaggcccgggaagccgatttgatcttcctcttgtctcctccaacagaaacaacagcggaactgcagcgcgctcccgacttgcaggaaagtgacggccagaggaagggagcccagtcgcggtctttgactctgaggttgcagaaatgccagttgcaagtgcatgacgccgaggccctcatcgctctactccaggagggccctcatctcgaggaggtggacctctctggcaaccagttggaggatgagggctgcagactgatggcggaagcagcctcacagctacacatagcccgaaaactcgatcttagcaataacggccttagtgtagcaggagtgcattgtgtattaagagcggttagcgcctgctggacactggccgagctgcacatcagtctccagcacaaaaccgtgatcttcatgtttgcacaggaacccgaggaacagaaggggcctcaggagagagctgcattcctcgactccttgatgctacagatgccttctgagctgcctttgagttcacggcgcatgcgcctgacccactgcggacttcaagaaaagcacctcgagcaactttgtaaggctctgggcggtagttgtcatctcggccatcttcacctggatttttcaggaaatgcgttgggcgacgagggggcagcaagattagctcaactcctgccaggattgggcgctttacagagcctgaatctcagcgagaatgggctgagtctagacgcggtgttggggttagtgcgctgcttctccactctacagtggctgttccggctagacatcagtttcgagagccagcatattctgctccgtggcgacaagacttctcgggacatgtgggctactggcagcctgcctgattttcctgcggcagcaaaatttctggggtttcgccaacggtgtattccccgatcactgtgcttaagcgagtgccccttagaaccaccatctctgacaagactgtgcgccaccctcaaagattgtcccggaccgctggagctacagctgagctgcgagttcctctctgatcagtccctggaaacattactggactgtctacctcaacttccacagctgagcctgctgcaactttcgcaaactggcttatctcctaaaagtccattcttgttggccaacacactgtccctgtgccccagagttaaaaaggtggatctgaggtcattacaccacgcaactctgcacttcagatccaacgaggaggaagagggtgtatgctgcggccggtttaccggctgtagcctttcccaggagcacgtggaaagcttgtgctggctgctgagcaagtgtaaagatttgtcacaggttgatctgagcgctaacctgcttggtgactctggcctgaggtgcctgctggagtgtctgccacaggtgcccatttcaggtctgctcgacctgtctcacaattccattagtcaggagagcgcactgtatctgcttgagaccttgccatcctgccccagagtcagggaggcctccgtgaacttagggtcggagcagtctttcagaattcattttagtcgtgaagatcaggccggcaagactctccgcctgtctgaatgcagcttccggcctgaacacgtgtccaggctggccacagggctgagcaaatctctgcagttgaccgagctgactctgacgcaatgttgcctcggacagaagcaactcgccattttactgtccctggtcggcaggcccgccggtctcttttcactccgagtacaggaaccttgggccgacagagcccgtgtcctttctctgctagaggtgtgtgctcaagcctccggctctgtgacggagatttcaatttctgaaacccagcaacagttgtgcgtgcaactggaatttccccggcaggaggagaaccccgaggccgtggcgctgcggttagctcactgcgatctgggtgcccaccatagcctgctggttgggcagctcatggagacctgcgcccgattacagcagcttagcctgtcccaagtaaatctgtgtgaagatgatgacgcctcaagcctcctgctccagagcctcttgctcagcctgtcggagctgaagaccttcagaatccagtccagtcaagaccctggccggctgctccccgatctactgcccttcgacccgcatcaagcggacttgcagctgtgtgagcacaggggcccacggcctccagggatttggagtggaccgttgccacctcttggcggagccggactggtctag

SEQ ID NO: 49136 - DNA, 60 bp, Artificial Sequence
  Description of Artificial Sequence: Synthetic coding sequence
atggaccccgtgggcctgcagctgggcaacaagaacctgtggagctgtttagtccgttag

SEQ ID NO: 49137 - DNA, 225 bp, Artificial Sequence
  Description of Artificial Sequence: Synthetic coding sequence
atggaccccgtgggcctgcagctgggcaacaagaacctgtggagctgtctggttcgcctgctgaccaaagatcccgaatggctgaatgccaaaatgaaattcttcttgccgaatacagatctggactccaggaacgaaacactagatcctgagcagagggtgatactccagttgaacaaacttcacgtgcagggcagtgacacatggcagtcattcatccattag

SEQ ID NO: 49138 - DNA, 1968 bp, Artificial Sequence
  Description of Artificial Sequence: Synthetic coding sequence
atggccatggccaaggcccggaagccccgggaggccctgctgtgggccctgtcagacttagaagaaaatgattttaagaagttaaagttctacctgagagatatgactctgtcagaaggccagccacccctggcgcggggtgaacttgaggggcttatcccagtcgacctggccgagctgcttatcagtaagtacggcgaaaaggaggccgtaaaggtggtgctcaagggactgaaggtgatgaatttgctggaactggtagaccagctgtcgcatatatgcctgcatgactacagggaggtgtatcgtgaacacgtccgctgccttgaggagtggcaggaagctggggtcaacggtcgctacaatcaggtgttgctcgttgccaaacccagcagtgagtcccccgaatcattagcctgtccctttccggagcaggagcttgaaagcgtgacagtggaagctctcttcgactctggagaaaagccttcactcgctcctagcctcgtggtgcttcagggttccgctggcacgggaaaaaccaccctggcgcgcaagatggtcctggattgggccactggcaccctttatcccgggaggttcgactatgtgttttatgtgtcttgtaaagaggtggtacttctgctggagagtaagctcgagcagctgcttttctggtgttgtggggacaaccaggctccagttaccgagatcttgcggcagcctgaacggcttttattcattctagatggatttgatgaactgcagagaccgttcgaggagaaattgaaaaaacgcggactttcccctaaggaatccctgctgcatctgctcattcgcaggcacactctgccaacttgctcattactcatcacaacccgcccacttgcacttcgtaatctcgagccacttctcaaacaggctcggcacgtgcacatcctgggtttcagcgaggaggaaagggcccgttacttctcatcatatttcactgatgagaaacaggctgatcgggccttcgatattgtgcagaaaaatgacattctgtacaaggcctgccaggtccccggcatctgttgggtggtctgctcatggttgcaaggtcagatggaacgcggcaaagtggtgcttgaaactcccagaaactctaccgacatctttatggcctacgtgtcaacctttctcccccctgacgatgacggagggtgcagtgaactgagccggcatcgcgtgctccgctccttgtgttcattggccgcagagggtatacagcatcagaggtttcttttcgaagaagcggagttaaggaaacacaatctggacggtccccgcctagccgcctttctgtcgtccaacgactatcagttaggactggccatcaaaaaattttactcgtttcgtcatatctcatttcaagactttttccacgctatgtcttacttggtgaaggaagaccagagcagactcggaaaggaatcaagacgcgaagtccagaggctgttggaagtaaaggagcaggaaggaaacgatgagatgaccctcactatgcaattcctgctggacatttccaaaaaggactctttttccaacctcgaactcaagttctgttttcgtatttcaccctgtctagcacaggacctcaaacactttaaagagcagatggaatcaatgaaacataaccgcacctgggacttggagttttccctgtatgaggcgaaaattaagaatcttgtgaaaggaattcagatgaataacgtttcttttaagattaaacactcgaatgagaagaagagtcaatcccagaatctgttcagtgttaaatcttccctgtcccacggtcccaaggaggagcagaaatgtccatcagtccatggtcagaaagaagggaaggacaatatcgcgggaacacagaaggaggctagcactggcaagggacgcggtacagaggaaacccctaaaaatacatatatctag

SEQ ID NO: 49139 - DNA, 201 bp, Artificial Sequence
  Description of Artificial Sequence: Synthetic coding sequence
atggccatggccaaggcccggaagccccgggaggccctgctgtgggcgctgagtgacctcgaggagaacgactttaagaaactgaagttctacttacgggatatgaccctttcggaaggacaaccccctcttgccaggggtgagttggagggacttatccccgttgacttggctgaactcttgatttctaagtacggttag

SEQ ID NO: 49140 - DNA, 2940 bp, Artificial Sequence
  Description of Artificial Sequence: Synthetic coding sequence
atggccgagagcgacagcaccgacttcgacctgctgtggtacctggaaaacttaagtgataaggaatttcagagcttcaaaaaatacctagcccgcaagattttagattttaaactgccccagttccccttgatccagatgacaaaagaggagttggcaaacgtgttgcccatatcttacgaaggacagtacatttggaacatgctgttctccatattctcaatgatgaggaaggaggatctttgtcgcaagatcatcgggcgccggaacaggaatcaagaagcctgcaaagccgttatgcggaggaagttcatgctccagtgggagtcacacaccttcggaaaattccattataagttcttccgcgatgtgtcttctgacgtgttttacatcctgcagttggcttatgacagcacaagctactatagtgcgaacaaccttaacgtttttctgatgggcgagcgggcttccggcaagaccattgtgatcaacttggccgtgctgagatggatcaaaggcgaaatgtggcagaacatgatctcatacgtagttcacctgacagcacacgagatcaatcagatgactaactccagcttagcagagctgatcgctaaggactggcccgatggccaggctcccattgcagacatcctgtctgatccgaaaaaactactgtttattcttgaggacttggataatattcgtttcgaacttaatgtaaacgaatcagctttatgctccaattctacccagaaggtgcctatcccagtgctgctggtcagcctgctgaagaggaagatggctcctggatgttggttcctgatcagcagccgccccaccagagggaataatgtcaagaccttcttgaaagaagtggattgctgtaccaccctgcaactatccaacggcaagagggagatttattttaactcttttttcaaagatcgtcagagggcaagcgcagcactgcaactggtgcacgaagacgaaatcttagtgggcttgtgcagggtagcaatcctttgctggataacctgcactgtgcttaaacggcagatggataaaggtcgggattttcagctgtgttgtcagacacccacagaccttcatgcccatttccttgccgatgcacttactagtgaagctgggttgaccgcaaatcaatatcatctcgggttgttaaagagattgtgtttgcttgccgcaggaggcctgttcttatctacactgaactttagtggcgaagacttgaggtgcgttggatttacagaggctgacgtgtctgtcttgcaagcggctaacattctgctgccctctaacacacacaaggataggtataagtttattcacctgaacgtccaagaattctgcaccgccatagcattccttatggccgtgcccaactatcttatccccagcgggtccagggaatacaaggagaaaagggagcagtattctgatttcaaccaggtcttcaccttcatcttcggcctgcttaacgccaacaggcgcaagatcctggagactagtttcggctatcaactgcccatggtggattcatttaaatggtacagtgtaggatacatgaagcatctggaccgtgacccagagaaactgacacaccacatgcccctgttctattgcctgtacgaaaatagagaagaggaatttgtcaagactatagtggatgccctcatggaggtaactgtgtatctccagtctgataaggacatgatggtatcactgtactgcttggattactgctgccatttgcggacccttaagctgagcgtccagcgcatctttcagaataaggagcctctaatccgccccaccgctcggctgagttacgtgagcacagcttccggcttcgaagacctgctgaaggctttggctaggaacagatcactgacgtacctaagcatcaattgtacatccatctccctaaacatgtttagccttctgcatgacatactccacgagcctacatgtcagattagtcacctgtctttaatgaagtgtgacctgcgcgcctccgaatgtgaagaaattgccagtctgcttatttctggcgggtcactccgcaaactgacattgagcagcaacccgctcagaagtgacggcatgaacattctgtgcgacgcactgctccaccctaactgtacactcatttccttggtgcttgtgttctgttgtctgactgagaactgctgctcagctctaggccgagtcttactgttctcccctacacttagacagctggatctctgcgtgaacaggttgaaaaactatggtgtcttacatgtgactttcccactcctatttcccacgtgtcagctggaggaactgcatctgtctggatgctttttttcaagcgatatatgccagtatatcgccattgtgatcgccacaaatgagaaactgcgctccctggaaatagggagcaataagatcgaggatgctggcatgcagttgctgtgcggcggactgcgccatcctaattgcatgctcgtgaacatcggtctggaggagtgcatgctgacctccgcttgttgtcgttccctggccagcgtgctaacaactaacaagactcttgaaagactcaatttgctgcagaaccacctcggcaatgacggagtcgctaagttgctcgaatctctgattagtccagactgcgtgctgaaggtggtcggtctaccccttaccggtctgaacacacagacccaacagcttctcatgacggtgaaggaaagaaaaccttcgcttatctttttgtccgagacctggagcctgaaggagggacgggagatcggtgtcacaccagcgtcccagccgggcagcatcataccaaacagcaacttggactacatgtttttcaaatttccgcgtatgtctgcggccatgaggacgtccaacacagcaagccgacagcctctctag

SEQ ID NO: 49141 - DNA, 3102 bp, Artificial Sequence
  Description of Artificial Sequence: Synthetic coding sequence
atggccgagagcgacagcaccgacttcgacctgctgtggtacctggagaacctgtctgacaaagagttccagtcattcaaaaagtatctcgctaggaaaatcctggactttaagcttccacagtttcctctaatacagatgactaaagaagaactggcaaacgtgctgcccatctcctacgagggccagtacatctggaacatgttatttagcatctttagtatgatgcggaaggaggatctctgcagaaagatcatcgggaggcggaaccgaaaccaggaggcttgtaaggcagtgatgcgccggaaatttatgctgcaatgggagtctcatacatttgggaagttccactataagttcttcagagatgtgagctccgacgtgttctacatactgcaactggcctacgactccacaagctattacagcgcgaataacctcaatgtgtttttgatgggcgaacgggcatctggcaagaccatagtgatcaatctcgcagtgctgcgatggatcaaaggagagatgtggcagaacatgatctcttacgttgtgcatctgactgctcatgagatcaatcagatgactaattcgtccctcgctgagttaatcgcgaaggactggcccgacggccaggcccctatagcggacattttatccgatccaaaaaagcttctattcatactggaggatctggacaacatcaggtttgaacttaacgtgaatgaatcggcattatgttctaactcaacacagaaggttccaattccagttctgctggttagcctgctgaagaggaaaatggccccgggctgttggtttctgatttcatcccggcccacacgcggtaacaatgtgaaaacctttctgaaagaagtcgattgttgtaccaccctccagctgagcaacgggaagcgtgagatttactttaactcttttttcaaggatcgacagcgagcaagcgctgccctccagttagttcacgaggacgaaattttggtgggattgtgccgagtcgcaatcctttgctggataacttgcactgtactgaagcgccagatggataaaggcagggattttcaactgtgttgccagaccccaaccgatctgcatgcgcacttcttggcagatgccttaacttctgaagcgggcctcaccgctaatcagtaccacttaggacttctgaagagactttgcctccttgcggctggtggcctcttcctgtctaccctaaacttcagcggggaggacctgcgctgtgtgggttttacagaggccgacgtgtcagtgctccaggccgcaaacatactactgccatccaacacccataaggataggtacaagttcatccatctgaatgtacaggagttttgtactgcaatcgctttcctgatggccgtcccaaactaccttattccatctgggtctagagaatataaagagaagagggaacagtattcggactttaaccaggtgttcacgttcatatttggcttgctcaacgcgaatcggagaaagatcttagaaacgtcttttgggtaccagctgcccatggtggacagtttcaagtggtattcagtcggatacatgaaacacctggatcgagaccctgaaaaattaacccaccatatgccactcttctactgtctctacgagaaccgagaggaggagttcgtgaaaacaattgtggacgcccttatggaggtcaccgtttatctgcagtccgataaagatatgatggtcagcctttactgcctcgactactgctgccatctcagaacgctcaagctcagtgttcagaggatcttccagaacaaagagcctctgatccggccaacggcttcacaaatgaagtctctggtgtattggagagagatttgtagtttgttttatactatggagagtctccgcgagttacacatttttgataacgatctcaacggcatttctgagagaattttgtccaaggcccttgaacactcttcatgtaaacttagaacgttaaagctgtcttatgtgagcacagcctccggcttcgaggacctgcttaaggcccttgcacgtaatcggtcactcacttatctgagcatcaactgcactagcatcagcttgaatatgttctcccttctccacgacatcctgcatgaaccaacctgtcagatctctcatctgagcttgatgaaatgcgatttgagagcgtcagagtgcgaagagatagcgagtctgctgatctccggcggctccctgagaaaattaactctctcctctaatcctctcaggtccgacggtatgaatatactgtgtgacgctctcttgcatcctaactgtaccttaataagtcttgtgcttgtgttctgttgtctgaccgaaaattgctgctcggccttaggcagagtacttctcttttcacccacccttcggcagctcgacctgtgtgttaatcgcctcaagaactatggcgtgctccatgtgacttttcctctgttgttccccacctgtcagctggaagagctgcacctttcaggttgctttttctcctcagacatctgccaatatatcgccatcgtaatagcaactaacgagaagctaaggagcctcgagatcgggagtaataagatcgaggacgcgggcatgcaactgctttgcggggggcttcgacatcctaactgtatgctggtgaatattggtttggaagagtgtatgctcacctcagcttgttgtcgatcactcgctagtgtactgaccacaaacaagacactggagcgccttaatctattgcagaaccacctggggaacgacggggtcgccaagctgttagaatccctgatatcccccgattgtgttttgaaagttgtgggtctccctctgacaggtctgaacactcagacccaacagctcttgatgacagtaaaagagcgaaaacccagcctaatcttcctcagcgagacttggtcacttaaagagggccgagaaattggcgtcactcctgcctcacagcctggctcgatcattccgaacagcaacctcgattatatgttcttcaaatttccaagaatgtcagccgccatgcgcacgtcaaatacagcctcaagacagcctttatag

SEQ ID NO: 49142 - DNA, 3132 bp, Artificial Sequence
  Description of Artificial Sequence: Synthetic coding sequence
atgaacttcagcgtgatcacctgccccaacggcggcaccaaccaggggctgttgccttatcttatggcattggatcagtaccagctggaggagttcaagctctgtctggagccacagcagctgatggacttttggtcagcaccccaggggcactttcctaggataccttgggctaacctgcgcgcggcggatcctctcaacctctcattcctgttggacgagcatttccctaaagggcaagcttggaaagttgttctgggaatctttcaaactatgaatctgacctctctttgcgagaaagttagagccgagatgaaagaaaatgtccaaactcaggagctgcaggaccccacccaggaggatttagagatgctggaggctgccgctggcaacatgcagactcaaggatgtcaggatcccaatcaagaggagctggacgaactcgaggaggagacgggcaacgttcaggcgcaggggtgccaagatcctaatcaggaagaacccgagatgttggaggaggcagaccataggcggaagtaccgggaaaatatgaaggcggagctactggagacttgggataacatttcctggccaaaagatcatgtctatattcgcaataccagcaaagatgaacatgaggaactgcaacgccttctggacccaaaccgtacaagggcacaggcccagactatcgtcctggtgggccgggccggggtgggcaagaccactctcgcgatgcaagcgatgttgcattgggcaaacggtgtgctgttccagcagcgcttttcctatgtgttttacctgagctgccataaaatccgatatatgaaggagacaacctttgccgaattgatttctcttgattggcctgacttcgatgctcctattgaagaattcatgtctcaacccgaaaaacttttattcataattgatgggtttgaagagataattatcagcgagtcccggtcagaaagtctggatgacggcagtccttgcactgattggtaccaggagctccccgtgacgaagatattgcatagcctcctgaaaaaggaactggtgcctctcgcaacccttctgattaccatcaagacctggtttgtgcgcgaccttaaagcatcgctcgttaacccgtgcttcgtccaaattaccggttttaccggggacgacctccgcgtgtattttatgcgccactttgatgattcctcagaggtggagaaaattttgcagcagttgaggaagaacgaaacacttttccattcctgctctgctcccatggtttgctggaccgtgtgtagctgtttaaagcagccaaaggttcgatattacgatctgcaaagcatcacacaaacgacaacttccctgtacgcatacttcttcagcaatctattctcaacagcagaagtggacctggccgacgatagttggcctgggcagtggagggctctctgctcactcgccatcgaaggcctgtggtccatgaacttcacatttaataaggaagacactgagatcgagggtctcgaggtgccttttatcgatagcttgtacgagttcaacatactccagaagatcaatgactgtggcggctgtacaacatttacgcacttgagctttcaggagttttttgcagcaatgtctttcgttctcgaggagccccgggaatttccacctcattccacgaagcctcaggagatgaagatgcttttgcagcatgttctgctggacaaggaggcctactggacaccagtggtccttttcttctttggcttactgaataaaaatatcgcacgcgaattggaggataccttgcactgtaaaatttccccccgagtgatggaagaattgcttaagtggggcgaagagcttggcaaggcggaatccgcctctctgcagttccacattctgagactgtttcactgtctccacgagtcacaggaagaagactttactaaaaaaatgctgggccgcatttttgaagtggacctgaacattcttgaagatgaggaactgcaggcatccagcttctgccttaagcactgtaaacgcttgaataagctgagactctcagtgagcagtcacatcttggaacgtgacctcgaaatcctggagacctccaaattcgatagccgcatgcatgcctggaactccatttgctcaactcttgtcacaaatgagaatctgcacgaactggatctgagcaactccaaactgcatgccagctcagtgaagggcctgtgtctggcacttaaaaaccccaggtgtaaggttcagaaacttacctgcaaatccgtgacgccggagtgggtgcttcaggaccttatcattgcactgcagggtaattccaaactcacacacttgaatttcagctctaacaagctgggaatgaccgtgcctctcattttgaaggccctgcgacattctgcctgtaatttgaagtacctgtgtctagagaagtgtaacctgagcgcagcgagctgccaggacctggccctcttcctgacatccattcagcacgtaacgcggctctgcctgggtttcaacagattgcaggacgatggcattaagttgctgtgtgcggcccttacccaccctaaatgcgcgctggaacgcctggagctgtggttttgccagcttgccgccccggcatgtaagcacctgtccgacgcactgttacagaatcgttcactgacccaccttaatttgtctaaaaattccctgagggatgagggcgtgaagtttttgtgtgaggcccttgggcgcccggacggaaacctacagtccttgaacctgagcgggtgctcttttacacgtgaagggtgtggggagcttgccaatgctctgtcacacaaccacaatgtgaagattctggacctgggggaaaatgacctgcaggatgatggggtaaaactactgtgcgaggcactgaagcctcatagagctctgcatacgctcgggctggcaaagtgtaatctaacgacggcttgttgccagcacctgtttagcgtgttaagctctagcaagtcactggtcaatttgaatctactgggcaacgaacttgataccgacggcgttaaaatgttgtgtaaagcattgaaaaaatccacatgccgactgcagaaactggggtag

SEQ ID NO: 49143 - DNA, 3282 bp, Artificial Sequence
  Description of Artificial Sequence: Synthetic coding sequence
atggccgacagcagcagcagcagcttcttccccgacttcggcctgctgctgtacctggaggagcttaacaaagaagagctcaatacctttaagctgttcctgaaagagaccatggagccggaacatggcctgactccatggaatgaggtcaagaaagcaaggcgggaagacctagccaatcttatgaagaagtattatccgggcgaaaaagcttggagcgtgtctctgaagatcttcggtaaaatgaaccttaaggacctgtgtgagcgggctaaagaagaaataaactggtccgcccagacaatcggaccagacgacgcaaaggcgggtgagacccaggaggaccaggaggctgtcctgggcgacggcaccgaatatcgcaaccgcattaaagaaaaattctgtattacgtgggataagaaatcacttgccggaaagccagaggacttccaccatggcatagctgaaaaagaccgcaaactcctggagcatctatttgatgtcgacgtgaaaaccggtgctcagccgcagatagtagtgctacagggggccgccggcgtgggaaagaccactttggttcgtaaggcgatgttggactgggctgaagggtcgctgtaccagcaaagatttaagtacgtgttttacttaaacggtcgcgaaattaatcagctgaaggagagatcgtttgctcagcttatctccaaggactggccttccacggaaggtcccattgaggagatcatgtaccagccttcatctctcctgttcattatcgatagttttgatgaactgaacttcgcctttgaggaaccagagttcgctctgtgtgaggactggacacaagaacacccagtgtcatttctcatgtcatccctgctgcgcaaggtgatgctgcccgaagcatcactcttggtcaccacccgactcaccacatctaagcggctcaaacagctactcaagaaccaccactatgtggagctgctggggatgagcgaggacgctcgcgaggaatacatttaccagttttttgaagataaaaggtgggctatgaaggtcttctcaagccttaagtccaatgaaatgctcttcagtatgtgtcaggtgccgctggtatgttgggctgcttgtacttgcctgaagcagcagatggagaaaggaggcgacgtgacactgacatgtcagactacaactgccctatttacgtgctatatctcaagcctctttactcctgtcgatggcgggtccccctccctacctaatcaggcgcagctccgacggctgtgccaagtggcggctaaaggaatctggactatgacttatgttttctatagggaaaacctgaggaggctggggctcacacagtccgacgtctcttccttcatggatagtaatatcattcaaaaagacgcggaatacgagaactgctatgtcttcacccaccttcatgttcaggaatttttcgccgcaatgttttatatgctgaaaggatcctgggaggccggaaacccctcctgccagcccttcgaagacctcaagagcctgctgcaaagcaccagctataaagacccacaccttacccagatgaagtgttttctgttcggcttgcttaacgaggaccgtgtgaaacaactagagcgcaccttcaactgcaagatgtctttgaaaattaaatctaaacttctgcagtgcatggaagtcttgggaaattctgactactccccaagccaattggggttcctagagctttttcactgcctttacgagacgcaagataaagccttcatcagtcaagctatgaggtgcttcccaaaagtggctatcaatatctgcgagaaaatacatctgctggtgtcttcattctgcttgaagcattgcagatgtctgaggacaattcgactgtccgtaaccgtggtttttgagaagaagatcctaaaaactagcctgccgaccaatacatgggacggtgaccgcatcacccactgctggcaggacctctgtagtgtgctgcacaccaacgagcaccttcgggaactcgatctgtaccactcgaatcttgacaagtcagcaatgaatattctccaccacgaattacgacaccccaactgtaaattgcagaaactgctgttaaaattcatcacgtttcccgacggctgtcaggatatttccacctccctcatacacaacaagaacctgatgcacctggatctgaaaggttctgatatcggcgataatggagtgaaatcgctttgcgaggccttaaagcatcctgagtgtaagctccaaactctgagattggaaagctgcaatctgaccgtgttttgctgtctcaatattagtaatgcattgattagatcccagtctctgatcttcttgaatctgagcaccaataacttactggacgatggagtgcagctgctgtgcgaagccttacggcaccctaaatgctatctggagagattgtcgctggagtcttgcggcctcaccgaagccggctgcgaatatctctccttagcgctgatctccaataaacgccttacacacctgtgcctcgccgataacgttctgggtgacggcggggttaagttgatgagtgacgcactacagcacgcccagtgtactcttaaatcgcttgtgctgcgacggtgccactttacgtctcttagttctgaatatctttccactagcctgctccacaacaaaagccttactcacctggacctgggcagcaactggttgcaagataacggcgtgaagttactctgcgacgtgttccgacacccttcttgtaaccttcaggacctggagctgatgggctgtgttctgactaatgcatgttgcctagatctcgcgtccgttatcctgaacaaccccaacctgcggagtttagacttgggcaataatgacctgcaagatgacggggtgaaaatcctctgtgatgccctgcgctaccctaactgtaacatacagcgactgggcttggagtactgcggtctcacctccctgtgttgccaggacctctcgagcgcccttatctgtaacaaacgactcatcaagatgaacctcacacagaatacccttggatacgaaggcattgtaaagctatacaaagtgcttaaaagcccaaaatgcaagttgcaggtgctcgggctgtgtaaggaggcatttgacgaggaagctcagaagctactggaggccgtcggagttagcaatccccacctcatcatcaagcccgattgcaattaccacaatgaggaagatgtaagttggtggtggtgtttttag

SEQ ID NO: 49144 - DNA, 2985 bp, Artificial Sequence
  Description of Artificial Sequence: Synthetic coding sequence
atggccgccagcttcttcagcgacttcggcctgatgtggtacctggaggagcttaaaaaagaagagttccgcaagtttaaggagcacctgaaacagatgactctgcagcttgaactgaagcagatcccttggacagaagtaaaaaaagcctctcgcgaagagttggccaatttgttgatcaagcattatgaagagcagcaggcctggaacattaccctccgaattttccaaaaaatggaccggaaagacctgtgcatgaaggtgatgcgggaaaggacgggctacaccaaaacctaccaggcccacgccaagcagaaattttcacgcctctggtcctccaagtcagttacagagattcacctttactttgaagaggaagttaagcaggaagagtgcgatcatttggaccggctcttcgcaccgaaagaggcaggcaaacagcccaggactgtcataatccaggggccacagggcataggaaaaactacactgttgatgaagttaatgatggcctggtctgataacaaaattttccgcgatcggtttctctacaccttctatttctgctgtcgagaacttagggagctcccaccgacttccttggcggacctgatcagccgagagtggcccgaccctgccgcaccaatcaccgaaatcgtgtcccaacccgagcggctgctttttgtgatagatagcttcgaggagcttcaaggtggactgaatgagccagattctgacctgtgcggggatctgatggaaaaaaggcccgtgcaggtcctcctttcctctctgctgaggaagaaaatgttaccagaagcctccctgctgatcgcaatcaagcccgtctgcccaaaagaactccgcgaccaggtgaccatctcagagatttatcagccaaggggattcaacgaaagcgataggttagtgtatttttgctgcttcttcaaggatccgaaaagggctatggaggcttttaacctggtgcgcgagtcagagcagctgttctctatctgccagatcccactgctctgttggattttgtgtacctcactgaaacaagagatgcagaaggggaaggacttggcgctcacctgccaaagcacaacaagcgtctattcttcctttgtttttaatttattcactcccgagggcgctgaggggcccactccacagacccagcaccagctaaaggctttgtgctcactggctgccgaggggatgtggaccgatacttttgaattttgcgaagatgatttgcggcgcaatggcgttgtagacgccgacatacctgcactgctgggtactaaaatactgctgaaatacggagaaagagagtccagctacgtcttccttcacgtatgcattcaggagttttgtgccgctctgttttacctcctgaagtctcatctagaccatccacatccagcagttcgatgtgtgcaggaattgctggtggcaaatttcgagaaggctcgcagagcacactggatttttctggggtgcttcctgacaggcctactgaataaaaaagaacaggagaaactggacgccttttttgggtttcaactgagtcaggagataaagcagcaaattcatcaatgccttaagagcctgggcgagaggggcaacccccaaggacaggtcgactccctcgctatcttttattgcctcttcgagatgcaggaccctgcgtttgtcaaacaggccgtgaatctgctgcaggaggctaacttccatataatagacaacgtcgatctagtcgtatccgcttactgtcttaagtactgtagcagcctgcgaaagctctgttttagtgtgcagaacgtgtttaagaaagaggacgaacactcgtccacaagcgactattccctgatttgctggcatcatatttgttccgtactgacgacgagcggccatctgcgggaattacaggtccaggattctacactgtccgaatcaaccttcgtgacctggtgtaaccagctgcggcacccctcttgccggctccagaaactggggataaacaatgtttcattcagcggacagtccgtgctgctttttgaggtccttttctatcaacctgatcttaaatatctttctttcacactgaccaagctgtccagagacgatatcaggtcactgtgcgatgcccttaattaccctgctgggaacgtgaaagagctcgctcttgtgaattgtcacctgagccccatagactgcgaagtgctcgcaggactgctgactaacaacaagaaactgacgtatctaaacgtcagttgtaaccagttagatacgggggtcccactgctctgtgaggccctctgttcacccgataccgtgctcgtgtatcttatgctcgcattttgccatctatccgagcagtgttgcgaatacatctccgaaatgctgctgaggaataaatccgttaggtatctggacctctccgcaaatgtcctgaaagatgaaggtctgaagactttatgtgaggccctaaagcatcccgattgctgcctggatagcctttgccttgtgaagtgttttatcactgcagcaggctgtgaggacctggccagcgccctgataagcaaccagaacctgaaaatcctgcagatcgggtgtaacgagattggtgacgtgggggtgcagctactttgtagagctctgacccacaccgactgtaggctcgagatactcggtctcgaggagtgcggcctgacatccacatgttgcaaggatctggcctctgttctgacgtgctcaaaaactctacagcagctgaacctgactctaaacaccctcgatcatacgggcgttgtggtgctgtgtgaagcacttagacatccagagtgcgcactccaagttcttgggctacggaaaactgacttcgacgaggaaacccaggccctcttgactgccgaggaagaacgcaatcctaatctcacaatcactgatgactgtgatacgatcactagggtagaaatctag

SEQ ID NO: 49145 - DNA, 2817 bp, Artificial Sequence
  Description of Artificial Sequence: Synthetic coding sequence
atggccgccagcttcttcagcgacttcggcctgatgtggtacctggaggagcttaaaaaagaggaattccgcaaattcaaggagcaccttaagcagatgactttacagctggagctgaagcagatcccctggacggaagtgaagaaagcttcacgggaggaactcgccaaccttctgattaagcattatgaagagcaacaggcctggaatattacacttaggattttccaaaaaatggaccggaaagacctttgcatgaaagtgatgcgcgagagaactggttataccaaaacataccaggctcatgccaaacaaaagttctcaaggctctggtcttcaaaaagcgttacagaaatccacctctactttgaagaagaagtcaaacaggaggagtgtgatcacctagacaggctatttgctccaaaggaggccggcaagcagcctagaactgttattattcaaggacctcagggaattggcaagacaactttacttatgaaactgatgatggcttggtctgacaacaagatcttcagagaccggttcctgtatactttttacttttgttgtcgcgaactgcgagaacttcccccgacctcgctcgccgatctgatctcacgggagtggcccgatccagctgcacccattacggagatcgtgtcacagcccgaaagactattgttcgtcatcgactctttcgaagagctgcagggcggattaaacgagcctgactccgatttgtgtggagacctgatggagaagaggcctgtgcaggtgttactgagcagcctactacgaaagaagatgcttccggaggctagcctattaattgccatcaagcccgtctgccctaaggagctgcgagaccaggtgaccattagtgaaatctaccagccccgagggttcaacgagagcgataggttggtttatttctgttgttttttcaaagacccgaagagagcaatggaagcatttaacctcgttagggagagcgagcaacttttttcaatttgtcagatcccattgctctgttggatcctctgtacaagcttgaaacaggagatgcagaagggtaaggatttggcccttacatgtcagtcaacaacaagtgtgtatagctcattcgtcttcaacctgttcaccccagaaggcgccgagggaccaaccccacaaacccagcatcagcttaaggcactgtgttcccttgccgctgaaggcatgtggacagacaccttcgagttctgcgaagatgacctcagacgcaatggggtagtggatgcagacattccagcgctcctcggtacaaagatccttctaaagtatggcgaaagagagtctagctacgtattccttcacgtgtgtattcaggagttttgcgccgcactattttacctactaaaatctcacctggatcatccccacccagcagtaaggtgtgtgcaagaactcttagttgcaaatttcgagaaggcacgccgggctcactggattttcctcggatgcttcttgactggactgctgaataagaaggagcaggaaaaacttgacgctttctttggttttcagttgtcgcaagagattaaacagcaaattcatcagtgtctcaaaagtctcggcgaacgaggcaacccccagggtcaagtggactcactagcgattttttactgcctatttgaaatgcaggacccagctttcgtgaaacaggcagttaacctgctgcaggaggcaaattttcacataatcgataatgttgacctggtggttagtgcgtactgtctgaaatactgttcttccctgcgcaaactgtgcttctctgtccagaacgtgtttaagaaagaggacgaacactctagtaccagcgactactcccttatctgttggcatcacatctgtagcgtccttacaacaagcggccacctgcgcgagctgcaggtccaggacagtacgctgtccgaaagtacattcgtgacttggtgcaatcagctccggcaccccagctgccgcctacagaagctggggatcaataacgtgagtttcagcggtcagtctgttttgttatttgaagtactgttttaccagccagatctcaagtacctgtctttcaccctgaccaaactgtctcgggacgacattcgctcactctgcgacgccctcaactacccggcaggaaatgtaaaggagctggcactggccttttgccaccttagcgaacaatgttgcgagtacatttccgaaatgctgctgcgtaataaatcagttcgatatctcgacctatccgcaaatgttcttaaggacgaggggctcaagacattatgcgaagcccttaaacacccagattgctgtctggactccctatgtcttgtcaaatgctttattacagcggccggttgtgaagacttggccagcgcattgatttccaatcaaaacttgaagatccttcagatcggctgtaatgagataggcgacgtgggcgtccagctgctgtgtcgtgctctgactcacacagattgcagactcgagatcctgggactggaggaatgtggactcacctccacatgctgcaaggatctggcgtcagtccttacttgttccaaaactctgcagcagctgaacttaactctgaacactctagaccacaccggtgtagtcgtgctgtgcgaagctcttcgacacccagagtgcgccctgcaagtgctcggactgcgcaaaactgattttgatgaggaaacgcaggcactgctgactgccgaggaggaacgtaaccctaatttgacgataactgatgattgcgacactattacacgcgtggagatttag

SEQ ID NO: 49146 - DNA, 3114 bp, Artificial Sequence
  Description of Artificial Sequence: Synthetic coding sequence
atgaccagcccccagctggagtggaccctgcagaccctgctggagcagctcaacgaagatgagctgaaaagctttaaaagtctgctatgggctttccctctcgaggatgtcttacaaaagactccctggtcagaagtcgaggaggccgacggcaaaaagctcgccgagatactcgtcaatacatcgtccgaaaattggatccgcaatgctacggttaacattcttgaggagatgaacttgaccgagctgtgtaagatggctaaagcagagatgatggaggatggacaggtgcaagaaattgacaacccggaactgggcgatgcagaggaagacagtgagctggccaaaccgggcgagaaggaaggctggcggaattcgatggagaaacagagtcttgtctggaagaacactttttggcagggagatatcgacaactttcacgatgatgtgacgctccggaaccagagattcattccatttttgaaccctcgcacaccacgtaaattgacaccttacacagttgtactgcatgggccagccggcgtaggaaagactacacttgcgaaaaaatgtatgctcgattggacggattgcaacctctccccaactctgcggtatgctttctacctgagctgtaaggagctttctcgaatgggtccatgttcattcgctgaactcatctccaaagattggcctgaattgcaagatgacattcccagcattctggctcaggctcaaaggattctgtttgtcgtggacggccttgatgagttgaaagttcctcccggagcccttattcaggatatctgcggggactgggaaaagaagaagccagtgcctgtcctgctcgggagcctactcaaaagaaaaatgctcccccgagcagccctgctagtgacgaccaggcctcgagccctccgcgacctgcagttgctggctcagcaacccatctatgtgcgagttgaggggtttctcgaagaagaccggagggcctactttctcagacattttggcgatgaggatcaggccatgagagcctttgagctgatgaggtcaaatgccgctctcttccagctcggctcagcccccgccgtatgttggatcgtctgcacaacattgaagctgcagatggagaaaggggaggatcctgtgccgacgtgtctgacacggactggcttgttcctccggttcctgtgcagtcggttccctcagggagcgcaactgagaggtgccttacggaccctatctctgttggccgcccaaggcctgtgggcccagatgtccgtctttcatagggaagacctcgagcgcttaggtgttcaggagtcagacctgcggcttttcctcgacggggacatccttcgacaggaccgagtatcaaagggttgctactctttcatccatctgtccttccagcaattcttgacagcgcttttctatgcgctggaaaaggaggagggagaagatagagacggccacgcctgggatatcggcgacgtgcagaaactcctgagtggcgaggagagactgaaaaatccagacctgatacaggttgggcactttcttttcggcctggctaacgagaaacgcgcgaaagagctggaggcaacatttgggtgcaggatgtcgcccgacatcaaacaagaattgctgcaatgcaaagcccacttgcatgcaaacaaacccctgtcagttacagatcttaaggaggtgctgggctgtctatacgagtcccaggaggaagagctcgccaaggttgtggtagctcccttcaaggaaataagcatccatctgactaatacctctgaggtcatgcactgctcgttttccctgaagcactgccaggacctgcagaaactgtctctgcaggtggccaagggtgtttttttggagaattatatggatttcgaattggatatcgaattcgagcgctgcacatatctgactattcccaactgggctcggcaggatctgagatcactgagattgtggacagatttttgttcgctatttagcagtaattctaatctcaagttcctcgaggtcaagcagagctttctttcagattcgtccgtgcggattctgtgtgaccacgtgacccggtccacttgtcacttgcaaaaagtagagattaagaacgtgacgcccgacaccgcctaccgcgacttctgtcttgctttcatcggaaaaaaaactctgacccacttgaccttggccgggcacatcgagtgggagaggactatgatgctgatgctgtgcgatcttttacgaaatcataagtgtaatttacagtacctgagattgggaggccactgcgccacccctgaacaatgggctgaattcttctacgtgttgaaagccaaccaatcccttaaacatctaaggctctccgctaatgtccttctggacgaaggggctatgctgctgtataagacaatgacaagacccaagcattttcttcaaatgctgtcactggaaaactgtagacttacagaggcctcctgtaaagaccttgcggccgtgcttgtcgtaagcaagaagttgacacacttgtgcttagcaaaaaaccctattggagacaccggagtaaaatttctgtgcgaggggctcagctatcctgattgtaaactccagacacttgtgctccaacagtgttctatcacaaagctgggctgtagatacctctcagaggctctacaggaagcctgctctctaaccaacctcgatctgtctattaaccagattgctcgaggcctgtggattctgtgccaagccctggagaatccaaattgtaacctgaaacatttaagactctggagctgttcgctgatgcccttttactgccaacaccttggctctgccctcctcagcaatcagaagctggaaacgttggacctcggccagaatcacctgtggaagagtggcatcatcaaacttttcggggtactgagacagagaactggttcacttaaaatcctccgcctcaagacatacgagactaatctggaaatcaagaagttgctggaagaggtcaaggaaaaaaacccgaagttgactatagattgcaacgctagcggcgcaaccgcgccaccctgctgtgattttttttgttag

SEQ ID NO: 49147 - DNA, 2943 bp, Artificial Sequence
  Description of Artificial Sequence: Synthetic coding sequence
atgaccagcccccagctggagtggaccctgcagaccctgctggagcaactaaacgaagacgagctgaagtccttcaaatccctgctatgggctttccccctggaggatgtgctgcaaaaaacaccgtggtcagaagttgaagaagccgatggcaagaaattggctgagatcctcgtgaataccagttcggaaaactggatcagaaatgccaccgtgaatattctcgaagagatgaacttgaccgagctctgcaaaatggcaaaagccgaaatgatggaggacggccaggtgcaggagattgacaatccggagctaggggacgccgaagaggatagcgaacttgcaaagccgggagagaaggaaggctggagaaacagcatggagaaacagagcctcgtgtggaagaacaccttttggcaaggggatatcgataacttccatgacgatgttactcttaggaaccaaagatttataccctttctgaacccaaggacacctcgcaagctcacgccatacaccgtggtgctccatgggcctgccggcgtgggcaaaaccactctcgccaaaaagtgcatgcttgattggaccgactgtaacctaagcccaacactgcgatacgctttttacttgtcctgtaaagaactgtccaggatgggcccttgctcattcgcggaactgattagcaaggattggcccgagttacaggatgatattccgagtatactagctcaggcccagagaattctctttgttgtggatgggctggatgagctgaaagtgccccccggcgccttgatccaagatatctgcggagactgggaaaagaaaaagccagtgcccgttctgctgggttcactactgaagaggaaaatgctccctcgtgccgcactattggtaacgaccaggcctagggctctacgggatctgcaactgctagcgcagcagcccatttacgtccgcgtagaaggtttcctagaggaagatcggagggcgtattttctgcgtcactttggcgatgaggatcaggccatgagggccttcgagctgatgaggagcaacgctgccttgtttcagttagggagcgctcccgctgtgtgctggattgtatgtacaactctgaagctgcagatggaaaagggagaagacccagtacctacgtgtctaactagaacaggcttgtttctccgatttctgtgctccagatttccacaaggggcacaactccggggggcgttacggactctcagcttgctcgcagcacaggggctatgggcacagatgagcgtatttcacagagaagatcttgagcggctgggcgtgcaggaatcagatttgcgcctgtttctggacggggatatcttgaggcaggaccgagtttccaagggctgttatagcttcattcacctgtctttccagcagttccttacggccttgttttacgcactggaaaaagaggaaggcgaggatcgcgacggccatgcctgggatattggggatgtccagaaattgctctccggggaagaacgactgaagaatcctgacctcattcaagtgggccatttcctgttcggtctcgccaatgaaaaacgggcgaaggagctggaggcaacattcggctgtcgtatgagcccggatattaaacaggagctgctgcagtgcaaagctcatttgcatgccaacaaaccattgagcgtcacggacctgaaggaggtcctagggtgtctctatgaatctcaggaagaagagcttgcaaaggtcgtggtggcccccttcaaagagatctcaattcatttgacaaacacatccgaggttatgcactgctcgtttagcctgaagcattgccaggacttgcagaagctgagtcttcaggtggccaaaggcgtattcctcgagaattacatggacttcgagttagacatcgagttcgaaaggtgcacgtacctgacgatcccaaactgggcccgacaggacctgcggagtctgcggctctggactgatttttgcagcctgttctcttccaattcaaacctgaaattcctagaggtcaagcagtcttttctctctgatagcagcgtgcgaatcctgtgtgaccacgtgactcggtctacttgtcacctccagaaggtggaaatcaagaatgttacgccggataccgcgtaccgagatttctgcctggcgttcattggaaagaagacattaacacacctcacgctggctgggcatatcgaatgggagaggactatgatgctgatgctgtgcgacctgctgagaaatcataagtgcaatctgcagtacttaaggctcggcggacattgtgccaccccggagcaatgggccgagttcttttatgtgcttaaagctaaccaatcactgaagcatctgaggttgtccgctaatgtgctgcttgacgagggagcaatgctgctttataagacaatgaccaggccaaagcatttcctgcagatgctgtcacttgagaactgccgcttaactgaagcttcatgcaaggacctcgcggctgtacttgtagtgtctaagaaactcactcatctttgtttggctaagaatcccattggcgatacaggggtcaagttcctgtgtgagggcctgagttatccagactgcaaattgcagaccctggtgctgcagcagtgttcgataactaaactcggctgccgatacctcagtgaagcccttcaggaggcctgcagcctcaccaatctggatctcagtattaatcagatagcaaggggcttgtggatactctgccaggcactggagaacccgaactgcaatctgaaacacctaagacttaagacctatgagacaaacctcgagatcaagaagctattggaggaggttaaagaaaagaaccccaagttaacaatcgattgcaatgcgagtggggcaaccgcacctccatgctgcgactttttttgttag

SEQ ID NO: 49148 - DNA, 2019 bp, Artificial Sequence
  Description of Artificial Sequence: Synthetic coding sequence
atgaccagcccccagctggagtggaccctgcagaccctgctggagcagttgaatgaagatgagctgaagtctttcaaatcacttctgtgggcctttccactggaggatgtgctccagaagactccatggtcggaggtggaggaagccgacggaaagaaacttgcagaaatcctggtgaacacgtcctctgaaaactggatccggaacgctactgtgaacatactagaagaaatgaacctaacagaactttgtaaaatggccaaggctgagatgatggaggaggatcgacgcgcttacttcctgcggcatttcggagacgaagaccaggcgatgagggcgttcgagctcatgcgcagtaacgcggccctcttccagcttggcagcgcccctgcagtgtgctggattgtgtgtaccactctgaaactccaaatggaaaagggagaagaccccgtgcctacttgtctaaccagaactggcctgttcctgagatttctgtgtagtaggtttccacagggcgcccagctgagaggggcgttgagaacactgtcgttacttgctgcgcagggactctgggctcagatgagtgtctttcaccgagaagatttggaacggctgggggtgcaggaatctgacctgcggctgttcctagacggcgatatcctcaggcaggatagggtatcgaagggatgctattcctttatccacctcagcttccagcaatttcttaccgcattgttctacgctttggaaaaagaagaaggagaggatagagatggtcatgcctgggatatcggggacgtccagaagctactgagtggcgaagagcgcttgaaaaacccagatttgatccaggtgggccattttctgttcggcctcgctaatgagaaacgagctaaagaattggaggcaaccttcggatgtagaatgtccccagatatcaagcaggaacttcttcagtgcaaggcccatctgcacgcaaacaaacccttgtctgtaactgacctgaaggaagtgctcggttgcctctacgagtcacaggaggaagaactggcgaaagtcgtcgtggccccattcaaagagatttccattcatctgacaaatacaagtgaagtcatgcactgttcattctcactcaagcactgtcaggatctccagaaactatcgctgcaagtcgccaagggagtgtttcttgaaaactatatggattttgagctcgacatagagtttgaacgctgtacttacctgaccatacctaattgggcacggcaagaccttcggtctctgaggctctggacagatttttgctcactattttcgtccaactccaacctcaagtttctcgaagtgaaacagagctttctctccgacagtagcgttagaatactttgtgaccacgttacacgctctacttgtcatctccaaaaagtcgagatcaagaacgtgaccccggatacagcttatagagatttctgtcttgcctttatcggaaagaaaaccttgacccatcttaccctcgctggacacatagagtgggagcgaaccatgatgttaatgctttgcgatctgttgcgcaatcataaatgtaatctgcagtacctgagacttggtggccattgtgccacgcccgaacagtgggccgagtttttctacgtgctgaaagcaaaccagagtctgaagcacctgaggctgagtgccaatgtgttgctcgacgagggcgctatgttactgtacaagaccatgactagaccaaagcactttctgcaaatgctgagccttgagaactgtagactgaccgaagcctcctgtaaggatctggcggcagttcttgtggtgtccaaaaaacttactcacctgtgcctggccaagaaccccatcggtgataccggagtgaagtttttgtgtgaaggtctgagttaccccgattgcaaacttcagccgcataagcccggcctggagtaccagcctgattcatcttggatcgtggattctcttagcggcatcagggaaagcaagctgtag

SEQ ID NO: 49149 - DNA, 3198 bp, Artificial Sequence
  Description of Artificial Sequence: Synthetic coding sequence
atgagccggaagcaccggctggaggcccggcccgacctgcgggagttctttagcttaaatctccgtagtcatactaggtccaccatgacgagcccccagctggagtggacattacagaccctattagagcagctgaatgaggacgagctgaagagctttaagagtctgctatgggcgttcccattagaagacgtgttgcagaaaacaccatggtctgaggtagaggaggccgacggtaaaaagctagcggagatccttgtgaacacaagctcagagaactggattcgaaatgccaccgtaaatatcctggaggagatgaatctgacggagctgtgtaagatggccaaggccgagatgatggaagacggtcaagtgcaggagattgacaaccctgagctgggagatgcagaggaggactcagagttagcgaagcccggagagaaggagggctggcggaacagcatggagaagcagagtctggtttggaaaaacactttctggcaaggcgatattgacaattttcacgacgacgttaccttacggaatcagaggtttattccattcctgaaccccaggaccccacgtaagctcacaccatacacagttgtgctgcatggacctgctggggtcggaaagactacgcttgccaagaaatgcatgttggactggacagattgtaacctgtcccccaccctcagatatgccttttacctcagttgtaaggagttgagcaggatgggaccctgcagctttgcagaactaatcagtaaagattggcccgagttgcaggatgatattcccagcatacttgcccaagctcagcgtattttgtttgtggtggatggactggacgagctcaaagtgccacccggcgcgctgatccaggacatatgcggagactgggaaaagaagaaaccagttcccgtgctgctgggtagtctcctgaaaagaaaaatgctccccagggctgcactactcgtcactacacggcctagggcgcttcgtgacctccaattgctggctcagcagcctatatatgtgcgggtcgaagggtttctggaagaagatcgacgtgcatattttctcaggcactttggggatgaggaccaggctatgcgtgcctttgaactgatgaggtccaacgccgctttgttccagctgggctctgcacctgctgtgtgctggattgtgtgcacaaccttgaagctccagatggagaagggagaagatcccgtccctacatgtcttactcgcaccggcctattcctccgcttcctttgctccaggtttccacagggtgcccagttgcggggcgcactccgtacactgagtttgctcgctgctcagggcctatgggcccagatgagtgttttccacagggaggatctagaaagactcggagtgcaggagagcgacctgcgactgtttctcgatggcgatatcctccgccaggaccgcgtctccaaaggttgctattcctttatccatctgtcattccagcaattcctcaccgcccttttttatgcactggaaaaggaagagggggaggatagggacggccacgcgtgggacattggtgacgtgcagaaactgttgtccggcgaggagaggctgaagaatcctgatctcatacaggtcggtcacttcctttttggactcgctaatgagaaacgagccaaagaacttgaggctacttttggatgtcgtatgagtcctgacatcaagcaggaactgttacagtgcaaggcccacttacatgctaacaagcctcttagcgtcacggacctgaaggaagtactcggctgcctctacgaaagccaagaagaggagttagccaaagttgtcgtggctccattcaaggagatttccattcatctgacaaacacctctgaggtcatgcattgctcttttagtttaaaacactgccaggaccttcaaaagctaagcttacaggttgctaaaggcgtctttctggagaactatatggactttgaactggacatcgagttcgagcgatgcacctatctgaccatccccaactgggccagacaggatttgaggtctctccgcctgtggacagacttctgcagcctcttctctagcaactctaatctcaagttccttgaagtcaaacaaagcttcctgagcgacagttcagtacggatcctctgtgaccacgtgacccgttcgacttgccatctgcagaaagtggaaatcaaaaacgtcaccccggatactgcctaccgcgatttttgtcttgccttcattgggaaaaagaccctaactcacctcaccttggccgggcacattgagtgggaacggaccatgatgctgatgttgtgcgatctgttacgaaaccacaagtgtaacctgcaatatctgaggcttgggggccattgtgccacacccgagcagtgggccgaatttttctatgtgctcaaagcaaaccagtcactcaaacatcttaggctcagcgcaaatgtcctgctggacgagggggctatgctcctgtataaaacaatgacccgaccaaaacacttcttgcagatgctgtctctggagaactgccgcttaacagaagcctcctgcaaagatctggccgcggttttagtggtttccaaaaagttgacccacctatgtctcgccaagaatccaattggagacactggcgtcaagtttctgtgcgagggcctgagctatccagactgcaaactgcaaactttggtgctgcagcagtgctccataacaaaactcgggtgccggtacctctctgaagcgctgcaagaggcttgcagcctgaccaacctcgacctttccataaatcaaattgctcggggattgtggattctttgccaggctctggaaaatcccaattgtaatctaaaacacctgagactgtggtcgtgttctttaatgccattctattgtcaacacctcggttccgctctgttgagcaatcaaaaattagaaactcttgatctgggccaaaaccatttgtggaaaagtggcataatcaaattgttcggagtgctgcgacagcgaaccggatccctcaaaatcctacgcttgaagacctacgagaccaatctggagatcaaaaaactgctggaggaggtgaaagaaaagaaccctaagctaaccatcgactgtaatgcctcaggcgccaccgcgccaccatgttgcgatttcttctgctag

SEQ ID NO: 49150 - DNA, 3030 bp, Artificial Sequence
  Description of Artificial Sequence: Synthetic coding sequence
atgaccagcccccagctggagtggaccctgcagaccctgctggagcagctaaacgaggatgagctgaaatctttcaaatcactgctgtgggcttttccactggaagatgtgctgcagaaaacaccttggtcagaggtggaggaggccgacggtaaaaagctagcagaaatattggtaaacacctcaagcgagaattggattcgtaatgcaacagtgaacatccttgaggagatgaacctgactgagctctgtaaaatggccaaagcagaaatgatggaagacgggcaggtgcaggagattgataaccccgagcttggagacgccgaggaggactcagaactggccaagcctggcgagaaggagggatggagaaactcgatggagaaacagagtctggtttggaaaaacacgttctggcaaggggatatcgataatttccacgatgatgtgactttgcgaaaccaacgattcattccttttctgaacccacgcacaccccgcaagcttacaccttacacagtggttctgcatgggcccgccggcgttggaaagacgacgctcgctaaaaaatgcatgctcgattggaccgattgtaacttgtcgcccacactgagatatgctttttacctttcttgcaaggaactgagcagaatgggaccatgttcattcgctgaactgatttcaaaggactggcccgagctgcaagacgacatcccctcaatactggcccaggctcagcgaatactttttgtggttgacggcctggacgaacttaaggtacccccaggagctctgatccaagatatctgcggcgactgggagaaaaaaaaacctgtacctgttctgcttggatccctgcttaagcgcaagatgctcccaagggctgccctgttggtaactactagaccaagagcgctccgcgacctgcagttgctggcccagcagccaatttacgttagggtcgaggggttcctcgaagaggataggagagcctatttcctaagacactttggagacgaggaccaggccatgcgtgcattcgagctcatgcggtccaacgctgctcttttccagctcgggagcgcccctgctgtgtgttggattgtgtgtactacccttaagttgcagatggagaaaggggaagatcccgtaccaacatgcctgacgagaacagggctctttctgaggttcctgtgtagtcggtttccccagggcgctcaattacgcggagccctcagaacacttagtctgctggcagcccagggactgtgggcacaaatgtctgtatttcaccgagaagacttagagagactaggggttcaggagtccgatctgagactgtttctggatggcgatattcttaggcaggaccgagtctccaagggttgttattcattcatccatctgtcgttccagcagtttctcaccgcacttttctacgcactggaaaaagaagagggcgaggatcgggatggacatgcctgggatatcggcgacgtgcaaaaactgctgagcggcgaggagagactcaaaaacccagacctcatccaggtgggccactttttgttcggattagccaatgaaaaacgcgccaaggagcttgaagccacattcggatgtcggatgagtccagacatcaaacaagagttactccaatgcaaggcgcatctgcatgccaacaagccactgtctgtaaccgacctgaaggaggtcctgggttgcctgtacgaatctcaggaagaggagctagctaaagtcgtcgttgctccattcaaggagattagcattcaccttaccaacacatcagaagtcatgcactgtagttttagcctaaaacattgccaggatctccagaaattgagcttacaagtcgccaaaggcgtgtttctggaaaattatatggatttcgagcttgacatcgaatttgagtcctcgaatagcaatctgaagttcttggaggtaaagcagagctttttgtcagatagctctgttagaatcttatgcgaccacgtaacccgttctacctgtcacctgcaaaaagtggagataaaaaacgtgacccctgatacagcctatagggatttttgtctggcgtttatcggcaagaagacactgacacatttgacgctggctggccacatcgagtgggagcgcactatgatgcttatgctgtgtgatctgctgagaaatcataaatgcaacttgcagtacctccggttagggggccattgtgcgaccccagagcagtgggccgagtttttctatgtgctgaaagcaaatcagtctcttaagcatcttcggttgagcgcaaacgtgttactggatgaaggggcaatgctcctatacaaaaccatgacccgcccaaagcattttctgcagatgctgtctcttgagaattgtaggcttactgaggcttcttgtaaggatttggcagccgtactggtggtgtctaagaagctcacacacctatgtcttgccaagaaccctatcggagatacaggagtgaagttcctgtgcgaaggtctgagctatcccgactgcaagctacagaccctggtgctgcagcagtgttctatcacaaaactcggttgtcgctacctaagcgaagcactccaagaggcttgttcactcactaacctggacctgagcattaatcagatcgcccgcggtctgtggatactctgccaggctctggagaacccgaattgtaatctgaaacatcttagactctggtcgtgtagcctaatgccgttttattgtcaacatctggggtccgcactgctttcaaatcagaaactcgagactttagatctgggccagaaccacctctggaagagtgggatcatcaagctctttggcgtacttcgacagcggaccgggagtttgaagattctgcggctgaagacctatgaaactaaccttgaaatcaagaagctgcttgaggaggtgaaggagaaaaatccgaagcttaccatcgattgcaacgcatcgggggcaaccgcccctccttgctgcgacttcttttgttag

SEQ ID NO: 49151 - DNA, 828 bp, Artificial Sequence
  Description of Artificial Sequence: Synthetic coding sequence
atggaggaggtgcgggagggccacgccctgggcggcggcatggaggccgatggccccgccagccttcaggaattaccgccctctccccgcagtccctctcccccaccaagccccccccctttgcccagcccgccttctctaccctccccagctgctccggaggcgcctgagctgcccgagcccgctcagccgagcgaagcccacgcaaggcagttactgctggaggagtggggacccttgtccggcggtctcgagcttccacagaggctgacctggaagctgctactgctgaggcgtcctctgtaccgcaatttgcttcgcagtccgaatccggaaggcatcaacatttacgagcccgcccctcccaccggaccaacacaacgccccttagaaacgttgggcaatttcaggggctggtatatcaggaccgaaaaactgcagcagaatcagtcttggaccgtaaaacagcagtgcgtggatctcttagctgagggtttgtgggaagagttattggacgatgagcagcccgctattaccgttatggattggttcgaagacagccggctggacgcttgtgtgtacgagctccacgtctggttacttgcggcggatcgcaggaccgtcatagcacagcatcatgtcgccccccggaccagtggacgtggaccaccaggccggtgggtccaggtctcccacgtatttcgtcactacggtcccggggtgagatttatccacttccttcataaggccaaaaacagaatggaacccggagggctgcggcgtacccgcgtgacagatagctcagttagcgtacagctgcgagaatag

SEQ ID NO: 49152 - DNA, 1413 bp, Artificial Sequence
  Description of Artificial Sequence: Synthetic coding sequence
atgggcctgtacgccgccgccgccggcgtgctggccggcgtggagagccggcaggggtccatcaaggggctggtttactctagcaactttcagaatgttaagcagctttacgctcttgtatgcgaaacccagcgctactccgctgtactggacgccgtgattgctagtgctggcttgctgcgggccgaaaagaagcttcgaccacacttggcaaaagttctggtgtatgaactcctacttggtaaggggtttcgcggaggcgggggaagatggaaagctcttctcggccgccatcaagctcggttgaaggccgaattagcacgacttaaagttcataggggagtcagtaggaacgaggatttgcttgaagtgggatctcgtccgggcccggcttcccaactcccacggttcgttcgcgtgaacactctgaaaacctgcagcgacgatgtggttgattacttcaagcggcaggggttcagctaccagggacgagcttcctctctggatgacctgcgcgccctgaagggcaagcacttcctacttgaccccttgatgcccgagctgctagtctttcctgcgcagaccgatctgcatgagcaccccctatatcgcgccggccacctgatcctccaagaccgggcgtcgtgcctgcccgccatgctgctggatccacctcctggctctcacgtgatagatgcatgcgctgcccctgggaataaaacaagccatttagccgcactgctgaaaaaccagggaaaaatcttcgcattcgatctggacgccaagcgcctcgcctctatggcgacactgctagcacgcgccggagtaagttgctgcgaactcgcagaggaagatttccttgcagttagtccttcggatccgaggtatcacgaggtacactacatactgctggatccgtcatgctctggctctggaatgcctagtagacagctagaggagcccggagccgggacaccatcccccgtgcgcctgcatgcgcttgccgggtttcagcagagagccctctgccacgccctgacatttcccagtcttcagcgactcgtctactccacctgcagcctatgccaggaagaaaacgaggacgtggtgcgcgacgctctgcagcagaatcctggagcttttcggctggctccagccctgccagcctggccgcacagagggctgagcacattccctggcgccgaacattgtctgcgcgccagtccagagaccacacttagcagcggatttttcgtggcggttatcgagcgcgttgaagtaccctccctgacggggcaatcaatctctactagaacgcacacccagccatcaccaaaggaaaaagaggagaccgcaaaatcccggtcccggtgcctgcatactgcactgcatattgctgaggctcctggttag

SEQ ID NO: 49153 - DNA, 1176 bp, Artificial Sequence
  Description of Artificial Sequence: Synthetic coding sequence
atgggcctgtacgccgccgccgccggcgtgctggccggcgtggagtccaggcagggaagcattaagggattagtatattcttccaacttccagaatgtgaagcagctctatgccctggtttgtgaaacccagcgctactctgctgtacttgacgccgtgatagcatcagccggtctactcagggccgagaagaaattacgacctcatctggctaaagtccaccggggagtgtcccgcaatgaggacctcttggaggtgggcagcagaccaggccctgcaagccaactccctcgattcgtgcgcgtgaacacacttaaaacctgttccgacgacgtggtcgactactttaaaaggcaggggttttcgtatcaggggcgcgccagctctttagatgacctgagggccttgaagggcaagcactttctcctggaccccctcatgcccgagctgctggtgttccccgcacagaccgatctccacgaacatcccctctacagggctggacatctaattttgcaggatcgggcatcttgtctgcccgctatgcttctggatccgcctccaggctcccatgtgatagatgcatgcgctgcccccgggaataaaacaagccatttggccgcactgctgaagaatcaagggaaaatattcgcctttgacctggacgccaagaggctggcctccatggctactctgcttgcacgcgccggcgtgagttgttgcgaattggcagaagaggactttttggcggtgtctcctagtgaccccagataccatgaagtccattatattttgctggaccctagctgctcaggctccggcatgccttctaggcagttagaagagcctggtgccggcactccctcaccagtgcgccttcacgctctggctgggttccagcaacgggctctctgtcacgcgctcacctttccctcattgcagcgcttggtttattccacgtgtagcctatgtcaggaggagaacgaggatgtagtccgggatgcactgcagcagaaccccggggctttccggcttgctcccgctctgcccgcatggccacatagaggcctgtccacattcccgggagcagaacactgcctgcgggcgtcgcctgaaactacattgtcaagcggcttttttgtggccgtgattgagcgcgtggaggtgccccggtag

SEQ ID NO: 49154 - DNA, 1023 bp, Artificial Sequence
  Description of Artificial Sequence: Synthetic coding sequence
atgctgacccagctgaaggccaagagcgagggcaagctggccaagcaaatttgcaaggtggtgctggatcacttcgaaaagcagtactcaaaagaactgggggacgcctggaacacggttagggaaatcttaaccagcccatcctgctggcaatacgcagtgctgttgaaccggttcaattaccctttcgagctggaaaaggaccttcacctgaaagggtatcacactctgtctcagggaagtttgcctaattatcctaagtcagtgaagtgttatctttccaggacacccggaagaattccttccgaacgccaccagatcggcaacctaaaaaaatactacctgttgaatgctgcatcccttctgcccgtgctggcactcgagctgagagacggcgagaaagtgctggatctctgtgccgccccgggagggaagagtatcgcactcctgcagtgcgcatgtcccggctatctgcactgcaatgaatacgactcactgagactgcgatggcttaggcaaactctagagagctttattcctcagcctctgatcaatgtgatcaaggtttctgaactagacggcagaaagatgggcgatgctcagccagagatgttcgacaaagtcctggtggatgcaccctgtagtaatgacagatcttggctgttctcttccgattcccagaaagccagttgccgcattagccagagacggaacttacccctgcttcagattgagctcttgcgttctgccattaaggccctgcgccctggaggcatcctcgtgtatagtacttgtacattgagcaaggctgaaaatcaggacgttatctctgaaatcctcaattcacacggcaacataatgccgatggacatcaagggcattgctcgcacatgttctcacgactttaccttcgcccctacaggccaggagtgcggcttgttagtgatcccggataagggtaaggcatggggacccatgtacgtcgccaagctaaaaaagtcgtggtcaacgggcaaatggtag

SEQ ID NO: 49155 - DNA, 1155 bp, Artificial Sequence
  Description of Artificial Sequence: Synthetic coding sequence
atggccgccctgaccctgcggggcgtgcgggagctgctgaagcgggtcgatctggcgactgttccccgacgccacaggtacaagaaaaagtgggctgcaacggagcctaagtttccagcagtccggctcgcactccagaatttcgacatgacctactcagtacagttcggagatctttggccctctatcagggtttctctcctcagcgaacaaaaatacggagccctggttaacaatttcgccgcatgggaccacgtgagtgcaaaattggagcaattatcagccaaggatttcgtgaatgaggctatcagtcattgggaactgcagagcgagggagggcaatcagcggctcctagtcccgcttcatgggcctgttctcccaatctacggtgttttacgttcgacagaggagacatttccaggtttccgcccgctcgacccggatccttgggtgtgatggagtattacttaatggatgctgcctctctgcttcccgtactggcgttaggcttacaacccggcgacatcgtcttggacttatgcgctgctcccggtgggaagacactagcactgctacagacgggatgttgtaggaatctggctgccaatgatctgagtcccagcaggatcgctcgcctgcagaaaattttacattcctatgttcctgaagagatccgggatggaaatcaggttagggtaacttcgtgggatggaaggaaatggggggagctggagggcgacacgtacgacagggttctggtggatgtgccgtgtactaccgataggcacagcctgcatgaggaggaaaacaacatctttaagcgatcaaggaagaaggagcgccaaattctccccgtgctccaggtgcaactactggcggccggactgcttgccaccaagcctggcgggcacgtggtctacagcacgtgttctctgtcgcacctgcagaatgaatacgtggtgcagggtgcaattgagctactcgccaatcagtatagcatacaggtacaggtggaagacctgacacacttcagaagagtgttcatggatacgttctgcttcttttcaagttgccaggtgggtgagcttgtcatccctaacctgatggcgaacttcgggcccatgtatttttgtaagatgcgaaggttgacttag

SEQ ID NO: 49156 - DNA, 1008 bp, Artificial Sequence
  Description of Artificial Sequence: Synthetic coding sequence
atgacctacagcgtgcagttcggcgacctgtggcccagcatccgggtctccttgctttcagagcagaaatacggagctctggtcaataacttcgctgcctgggaccacgtaagtgcaaagttggagcagctaagtgccaaagactttgtgaacgaggcaatctctcattgggaactccagtccgaaggtggccagagcgccgcaccttcccccgcctcttgggcctgctctcccaacctgaggtgcttcactttcgatcgaggcgatatttcacgcttccccccagcccgtcccgggtcgctgggtgtgatggaatactatctaatggatgctgcctccctactgcctgttctcgctctgggtctacagcccggcgacatcgtgcttgacctatgtgcggcaccaggagggaagacgcttgctctccttcagacaggttgttgccggaatttggccgccaatgacctttccccttcccgtatcgctaggctgcaaaagatccttcactcatatgtcccagaggagatcagagatgggaatcaggtacgggtgacttcttgggacggccgcaaatggggagagctggagggggacacatacgatagggtgttagtggatgtgccctgcacaaccgacaggcacagccttcacgaggaggaaaacaatatctttaagcggagcaggaaaaaggaaaggcagatcctacctgtgctccaagtgcagctgttggctgcaggcctgctagctacaaagcctggaggacacgtggtttactcgacctgttcactatcccatcttcaaaacgaatacgtcgtccagggcgccatcgagttgctcgccaatcagtacagtatccaggtgcaggtggaagacctcacacacttcagaagggtctttatggatacgttttgtttcttttccagttgccaggtgggagagctggtgataccgaacctgatggcaaattttggccccatgtatttctgcaaaatgcggcgtctgacctag

SEQ ID NO: 49157 - DNA, 1008 bp, Artificial Sequence
  Description of Artificial Sequence: Synthetic coding sequence
atgacctacagcgtgcagttcggcgacctgtggcccagcatccgggtgtctttactgtctgaacagaaatatggagcattggttaacaacttcgccgcctgggaccacgtctcagcaaaactggaacagctttcggccaaagatttcgttaacgaagccatcagtcactgggaactccaatccgagggaggacaatccgcagctccctcccctgcttcttgggcctgcagccccaatctcagatgtttcaccttcgacaggggtgacatttcacggttccctcccgcccgacctggatccctgggagtcatggagtattacctgatggacgctgcaagtctgctgccagtgctggcgttgggcctacaaccaggagacatagtgctcgacctgtgtgcggctccaggaggaaagacactcgcattgctccagaccggatgctgtcgcaatctcgcggcgaacgatctctcccccagtcggattgcacggctacagaaaattcttcactcatatgtgcccgaggaaattcgcgacggcaatcaggtaagagtgaccagttgggatggaagaaaatggggtgaactcgaaggcgacacctacgaccgcgtcctcgtggatgtcccctgtacaacagatagacactcgctgcatgaggaggagaacaacatattcaagcgttcaaggaagaaagagaggcagatcttgcctgtcctgcaggttcaactgcttgccgccggcctgctcgctacaaaaccgggcgggcacgtcgtgtacagcacatgctcactctctcacctgcagaacgaatatgtggtgcaaggagctatcgagcttttggccaatcagtatagcattcaggtgcaagtggaggacctgacccacttccgccgggtgttcatggacaccttctgtttcttctccagctgccaggtgggggagctcgtaataccaaacttaatggccaactttgggccaatgtacttctgcaaaatgcgccgtctcacttag

SEQ ID NO: 49158 - DNA, 1290 bp, Artificial Sequence
  Description of Artificial Sequence: Synthetic coding sequence
atgggcctgtacgccgccgccgccggcgtgctggccggcgtggagagccgccagggatctattaagggactcgtgtattcttcaaacttccagaatgtgaaacagctatatgccctggtgtgcgagactcaacgctactcagctgtactagatgccgtgatcgcaagcgctggcctgcttcgagctgagaaaaagctacgaccccacttagccaaagtgttggtctatgaactgttgctaggaaagggctttcgaggcgggggaggtcgctggaaggcccttctggggcgccatcaagcacgtttgaaggccgagctggccagactcaaagtgcacagaggtgtgtcccgaaacgaggacctgctggaagttgggagcagacccggaccggcctctcagctcccacgctttgtacgcgtcaatactctgaagacctgtagtgatgacgttgttgattacttcaagcggcaggggttttcctatcaaggcagggcttcaagtctagacgaccttcgcgcgctgaaaggtaaacatttcctactggaccccctaatgcccgaacttctcgtttttccagcccagaccgacctgcacgagcatcctctgtatagagcaggccacctgatcctgcaggatagagcctcatgcctacccgctatgttgctggaccctccgcctgggagtcatgtgattgacgcctgcgccgcgccagggaacaagacttcacatctggccgcattactaaaaaatcagggaaaaatttttgcctttgatcttgacgctaagcggttggcctctatggctaccctacttgccagagcaggcgtctcgtgctgcgagttggccgaagaggactttctggcagtgagcccaagcgaccctagatatcacgaagtgcactacattttgctggatccctcatgtagcggatcgggcatgccttcaagacagctagaagaaccaggcgccggtactccctctcccgtccgcctgcatgctttggccggtttccaacagagagcgctgtgccatgcattgacgttcccctccctgcagaggctcgtgtactccacatgtagtctgtgtcaggaagaaaatgaagacgttgtccgggacgccctccagcagaatcccggcgccttcagactggccccagccctccccgcttggcctcatagaggattatctacgtttcctggagccgagcattgcctgcgagcttctcctgagacaaccctgagtagcggcttttttgtcgcagtaattgaacgcgttgaggtgccacgctag

SEQ ID NO: 49159 - DNA, 1401 bp, Artificial Sequence
  Description of Artificial Sequence: Synthetic coding sequence
atgggcctgtacgccgccgccgccggcgtgctggccggcgtggagtccaggcagggatccataaagggactggtgtactcaagcaattttcagaatgtgaagcagttgtacgctctggtttgcgaaacccaacgctactctgctgtcttggatgctgtcatagccagcgccgggttactgcgagccgagaaaaagcttcgcccccatctggcaaaggtgctggtgtacgagctgctgctggggaaggggtttcgcggcggagggggcagatggaaagcactattggggaggcatcaggctaggcttaaagctgaattggctcgcttaaaagtgcacaggggagtgtcacggaatgaggatttgttggaagtcgggtctcggccaggccccgcttcccaactcccacgtttcgtgcgcgtgaacactttaaaaacttgcagtgacgacgtcgtggattactttaagagacaaggcttcagctatcaggggagagcctcaagtttagatgatctgagagccctgaaaggcaaacatttcctgttggacccccttatgcccgagctgctggtgttcccagcgcagacagacctgcacgagcatccgttgtaccgagccgggcacctcattctgcaagaccgtgcaagttgtcttcctgctatgctgttggacccgccacccggctcacatgtcattgatgcatgtgctgccccaggcaacaagacctcccatctggctgccctcctgaagaaccaaggaaaaatttttgcttttgatctggatgccaaacgactcgcaagcatggccaccctgctggcacgagcaggggtgtcctgttgcgaactggcagaagaggattttctggctgtgtccccctcggacccgcggtaccacgaagtgcattatatcttacttgatcctagctgttcgggttcagggatgcccagcaggcaacttgaggagcctggggccgggaccccctcacctgtgcgactccatgccctcgcaggtttccaacagagagccctgtgccacgccttaaccttccctagtctgcaacgcctggtatattccacgtgctcactgtgtcaagaagagaacgaggatgtggtccgtgacgcacttcaacagaaccctggagcattcagactggcccccgctttacccgcttggccccacagagggctgagcacgtttcctggggctgaacattgcctccgcgcctctcccgagactaccctgtccagcgggtttttcgttgcagtgatagaacgggtggaggttccaagcagtgctagccaggccaaggccagcgcccctgaacggacaccaagcccagctcctaaacgcaagaaacggcagcagcgcgctgccgctggcgcttgcaccccaccatgtacctag

SEQ ID NO: 49160 - DNA, 1410 bp, Artificial Sequence
  Description of Artificial Sequence: Synthetic coding sequence
atgagcatcttccccaagatcagcctgcggcccgaggtggagaactacctgaaagagggattcatgaacaaggagattgtgactgcattaggtaagcaagaggcagagaggaagttcgaaacactgctgaaacacctttctcaccctccatcctttacaactgtgcgagtgaacacacacttggcctcggtgcagcatgtgaaaaatttgctcctggacgagctccagaagcagtttaatggcttgagcgtgcccattttgcagcatccagatctgcaagacgtattgttaattcctgtgattgggcctaggaaaaacataaagaaacagcagtgcgaggctatcgtaggagcccaatgcggcaatgctgtgctccgcggggcccacgtctatgccccaggtatcgtgtccgcctcacagtttatgaaggctggcgatgttatctctgtatatagtgatataaaagggaagtgtaagaagggagctaaagaattcgatggcacaaaagttttcctggggaatggaataagcgaactcagcagaaaggagatcttctccggcctgcctgagctgaaaggtatgggcatcagaatgaccgaacccgtctatctctctccatcattcgactccgtgttacctagatacctgttcttacagaacttaccctcagctttagtgagtcatgtcctaaacccacaacctggggagaaaatccttgatctctgcgccgcaccaggcggcaaaaccacccacatcgccgcgctcatgcatgatcagggcgaggtcatcgcacttgacaagatctttaataaggtcgaaaaaattaaacagaacgcattgctgttgggccttaactccattagggctttttgtttcgatgggacaaaggctgtgaaattagacatggtcgaagacaccgagggggaaccccccttcctccccgaatcattcgatcggatcttgctggatgccccctgttccggcatgggacagagaccaaacatggcgtgtacttggtccgtgaaggaggtggccagttaccagcctcttcagcgcaaactcttcacagccgccgtccagctgttgaaaccagagggagtgttagtctactctacctgcacaatcacgttagccgagaatgaggaacaggtggcgtgggcccttactaagtttccctgcttacagctacagccacaggaaccacagataggaggagaagggatgcgaggagcaggtttgtcatgcgagcagctgaaacagcttcagcggttcgacccatcagctgttccattgcccgacaccgacatggacagtcttcgagaggctcgccgggaggatatgttgagactggcaaataaagactctattggtttctttattgcaaagtttgtcaaatgcaagtcgacatag

SEQ ID NO: 49161 - DNA, 2157 bp, Artificial Sequence
  Description of Artificial Sequence: Synthetic coding sequence
atgctgaacagcaccggcgagctggagttcagcaacgaggaggaccctgagataatctctcagctcacatcacttcctctttccggcggtaagtcgagcgctggagtgccagagaagacaggataccctgatagcgtttatgtgatggcagctaatatttttcagggtattaggatcgagaagtccgctcagaaagttctgattaagtacgggaatgagcctcttcggtcccttagtgagagcgaggatcaaagcttccagcgcctgtcctacgaacttgcattctccgctctgaagtatcaagatattttggagactattctcatcgactcttgcatatttccaagcaccaccattcctgaccacctctcctctctcatcatagtcatgttatacgactttcaggacaggaaatttcagacgagagtgctgtccgacaacgaggagccgattagcgaagtgcaggaagtggagaacttgctaaactcctttaagattaaactcgccgctgccctagctcgctgtaggataaaacatgacgcacttagcatttaccatattctcccagagactgtgagaaagcaagagctcagggccagcacacttcccttgtacgcctggattaatacttgcaagattagccccgaggaggtttataataatctcaagaggcgtggctataacaaagtgaagtccgtgctccatatcgacgataaggtttttgccgtggaccagcattgttatgatgtgttgatcttccccagccacttgaaaaacgacctgattaatatcgacctcttcaaagactacaaacttatttttcaggataaatcccggagcttggccgtgcacagcgtgaaggccttgttgaacatggacgacgatgtgctcatggtgaacaccggcagttggtataccgttagccacatgtctattcttactaacaataacacatcgaaagtctttgtctgtggggtccaaagtcaggcaaaagatcctgatcttaaaactctgttcacaaaaataggctgcaagaatatcgagattttgcatgaaaaattcatcaatatagagagcaaagatcacaggctccagaaagtgaaggtgattttgcttctccccagatgttccggtctgggggtgagtaaccccgtcgaattcatcctaaacgagcatgaagacactgaatttctcaaagaccattctcagggcggcatttcggtagacaaacttcatgttctggctcagcagcaatacgaacagctgacacacgctatgaaattcaccaaagcgcaggccgtggtttattgcacttgttctgtattccccgaggagaacgaggccgtggtgaaaaaggccttggaattccaggatttaggcaataaaggtcagccctacaggctctcaccccctgtcttgcccttatgttcactgaaggaaatccaactgagtaccgacaaattcttccgcatggaaccctccgaaatcaccaatggttgtttcctgagcattttaacacgcgaaagggacccctccgagacggtgtcggttaacgacgtattagcacgcgccgccgcgaagggattactggatggcatcgaattggggaaatcttctaagcgtgaaaagaaaaagaagaagagcaagactagtttaactaagggcgccactaccgacaatggtatacaaatgaagattgctgaattcttgaatcgggaaactaaagcttccgcgaacctgtccgaaacagtcacaaaaccacccctaccgcagaagaataccgcgcaggttggtgcttctagccagacaagaaaaccaaacaaactggcccctcatcccgcggtccctgccttcgtaaagaacacgtgcccctcccggccacgggagcgccagacccattttctcaggcctcgcccggaggacaggatggtggcattgaagccaattaaaattgttcttcccccagtttttatgccgttctcgtctccccagggcataaggtcaagaatgccaacccagcacctgtactgcaggtgggtagcacccaaagcactggtgcctacgtgtttacccacacactctctgtctcggaaggaagagaaacccaaagatgacaccccgtcttcattacttcgtcccccacgacggtggctatag

SEQ ID NO: 49162 - DNA, 711 bp, Artificial Sequence
  Description of Artificial Sequence: Synthetic coding sequence
atgtgcgtgacctaccacaacggcaccggctactgcaagtgccccgaggggttcctgggcgagtattgccagcaccgcgatccttgcgagaagaaccgatgtcagaatggcggaacatgcgtggcccaggcgatgctgggaaaggctacctgcagatgtgcttcaggcttcacgggcgaggactgccaatattcgacaagccatccatgttttgtgagccggccttgtctgaacgggggcacttgccatatgctcagtagggacacgtatgagtgtacctgtcaggttggattcaccgggaaagaatgccaatggactgatgcatgcctttcacacccctgcgccaatggaagtacctgtacaactgttgcaaaccagttctcatgtaaatgccttaccggatttacaggccagaaatgcgaaacagacgtcaacgagtgtgacattcccgggcactgccaacatggagggacgtgcctcaacttgccaggctcctatcagtgccagtgtctgcaaggtttcaccggccagtattgcgacagcctttatgtgccctgtgctccctctccttgcgtgaatggcggcacatgccgccagacaggcgatttcacatttgaatgcaactgcctgcccgaaactgtgaggagggggactgaactatgggagcgcgaccgagaagtctggaacggcaaggaacacgatgagaactag

SEQ ID NO: 49163 - DNA, 345 bp, Artificial Sequence
  Description of Artificial Sequence: Synthetic coding sequence
atgagccaggccgagctgagcacctgcagcgccccccagacccagcgcattttccaggaggctgttcgaaagggtaacacccaggaactgcagtctttgctgcaaaatatgacaaattgcgagttcaatgtgaatagtttcggaccagagggtcagaccgctcttcaccaaagcgtgatcgatggcaaccttgaactggtgaaactcctggtgaaattcggcgccgatatccgactagccaatcgggatggctggtctgccctccatattgctgccttcggcggccaccaagatatcgtgctctatctcataactaaggctaaatatgctgccagtggccgctag

SEQ ID NO: 49164 - DNA, 423 bp, Artificial Sequence
  Description of Artificial Sequence: Synthetic coding sequence
atgctgaccatcatgtgcggcttccagatgcagagccacctggccgctggcgatatgaaaaggctcgggtatgatttcgatcacttacttagccctgccctgccgatatctaccagtgtcgccagggaggggcccagcctgataacactgcgggccacccgagacgccgaatgcgcgctttcatctggagctggccagggcgcaggtcggggggagaaaactccagcttcgcctaccaaccagcaccctgggttggaagaattgcagcaagcagctgacagggagtttcacccccagcccgattctaggaattccgaagtccaggatagagcctcctgccggtgggaaccagggatggttggcgccgcttcctctgcggctggagaatctgtgtgtgtgcagggctgtcgcgtagcttgctag

SEQ ID NO: 49165 - DNA, 1602 bp, Artificial Sequence
  Description of Artificial Sequence: Synthetic coding sequence
atgatcagcagcagcagcgtgcacagccggaccttcaacaccagcaatgcgcttggtcccgtctgcaaacataagaagcccctttccgcggccaaagcttgtatcagtgagatactgccttctaaattcaagcctagactgtccgctccatccgcccttttacaggagcaaaagtctatcctcctgccatccgaaaaagcccaatcgtgtgaaaatctgtgtgtctctggtagcctgaatgacagcaaacgcggtttgcccttgcaggtcggtggcagtatcgaaaatttactgatgagatcccgccgcgactacgactccaaaagctcctctaccatgtctctccaggagtattcaaccagcgggcgccgcccatgtcctttaagcagaaaggccggaatgcagtttaccatgctctaccgcgacatgcaccaaataaaccgtagtggcctttttctgggctcaattagcagtagtagctcggtccgcgacctggcgtctcacttcgaaaaatctagtctggctctgtccaggggcgagctgggccccagccaggaaggcagcgagcatatccctaaacacacggtctcatctcgcataaccgctttcgagcaactgatccagcgatcacggtcaatgccttcgctggatttgagcgggagacttagcaagtcccccaccccggttctgtccaggggctctctgacctcagcccgatccgcagagtctctgttggagagcaccaaactgcaccccaaggaaatggatggtatgaacagctctggtgtgtatgcctcccccacatgtagcaatatggctcatcacgcattgagtttccgcgggctcgtgccttctgaaccactatctacctgttctgacgacgtcgaccgctgcagtaacatctccacggactcaagagaaggatccggaggatccgtccacggcgactttccaaagcacagactgaataagtgtaagggtacatgtcctgcttcatacacaaggtttaccacaattcgtaaacacgaacagcagcaaacctcaagacagcccgagtggcgcctggacgcccggggcgacaaatccacgctgctgagaaacatttacctgatgtctcccttaccttttcggctcaaaaaacctttacaccaccacccgcgccaaccctctccaggcgattcatcaggtttgttggtagggcagaaacccgatttgccgagccagcctcatcaggatcagcctccgtcggggggcaagccggttgtcccaactaggcttagctcccgccacacgatggcaagactgtcccgttctagcgagcctagtcaagagcgacccaccgctctggaagattatcctagggctatcaataatggaaactcagtcccttactctgaccacagcctggaccgaaataataatcctcagagcgaattagcaccctcccggggaggcggcattctctgcgtctgcctcgtgtctcctgcacgcccatccacccttctggccctgagccgaccccctctctgtccttggtgtagtttcagtggcttaagcttcgtcttttgcttgttttgtctagcaatcaaccatgggtcgtag

SEQ ID NO: 49166 - DNA, 4533 bp, Artificial Sequence
  Description of Artificial Sequence: Synthetic coding sequence
atggccacccgggtggaggtgggcagcatcacccccctgaccgccgtgcctggactgggagaaatgggtaaagaggagacgttgacaaggacttactttctgcaggcaggtgaggcgtccggagccccgccagcaaggatcctcgaggcgaagagcccacttaggtcaccagctcgccttcttcctctgccgaggcttgcccctaaaccgttctctaaagagcaagatgtaaagtcaccggtgcccagtctccgccccagtagcacaggcccgtctccctctggcggattgtcggaggaacctgctgcaaaggatttggataatcgtatgcctggactggtgggacaggaagtgggcagtggagagggccccaggacttcatcccccttgtttaataaggcagtgttccttcgtccctcttcttctacaatgatactgttcgagaccactaagagtggtcctgcgcttggtaaagccgtcagtgagggcgcggaagaggcaaagttgggagtgtctggtagtaggcctgaagtggccgccaaacccgcgctgcctactcagaagcctgcaggaacgctgcccagatccgcgccactctctcaagacactaagccgccagtaccccaggaagaggccggacaggaccatccaccttcaaaggcgtcctccgtggaggatactgcgaggcccctggtggagccacggccaaggctgaagcgccgtcccgttagcgccatattcacagagtctattcaaccccaaaaacccggccccggtgccgccgccacagttggaaaagtaccacccactccgcctgaaaagacctgggtaagaaaaccaagacccctgtctatggatctcactgcccggtttgagaacaaagaagccctcctgagaaaggtggccgacgaaggtagtggaccaacagccggtgatatggccggactggagcggccaagggcagcctcaaagcttgacagggattgtctggtcaaagccgaggcaccattgcacgaccctgatttagactttttggaggtcgctaaaaaaatccgggagcgcaaagaaaagatgctatcaaagcccgagatggggagccccagagcgctggtgggaggatccagtggcgtgacaccatccaacgaccagagcccatgggaggaaaaagccaaactcgacccagaacctgagaaagccgcagagtcgccatccccccgacttggcagaggcctcgagctggccgaagtcaaatccagggtggcggatggtgaagccgcagcaggcggtgaatgggctagccgtagatcagttagaaagtgcattagtctgtttcgcgaggatagcacactagcccttgccgttggctccgagagcccccttgctaccccagcaagtccatccgccgcacccgagccagagaaaggagttgtttctgtccaggagcgtatacgcgggtggacagcggagtctagtgaagctaagcctgaggtgcgcagaagaacgtttcaagcacgccctctgagcgccgatctcacaaaattgttttctagttctgcctccagcaacgaagtgaagtacgagaagtctgctgaactgtctggcgagttcccaaaggaaccacgagaaaagcagaaggaggggcacagcctggatggcgcttgcatccctcgcagtccctggaaaccaggaaccctgcgggacaagagtagacagactgagcaaaaggtctcaagcaatcaagacccggactcttgcaggggtgggagtagtgtcgaggccccttgcccctccgatgtcaccccggaagacgaccgcagtttccagactgtatgggccacagttttcgaacaccatgtcgaaagacatactgtggctgaccagtccgggaggtgtctcagcactactccacccggcgatatggctcatgcgcgcgtgagtgagccgaggccacgcccagaaatgggttcttggcttgggagagacccacccgatatgacaaaactgaaaaaggagaactctcggggttttgacaatccagaaacagagaaactcggaccaactacacttctcaatggggagctgcgcccataccacacgcctttgcgggataaataccccctctctgagaatcacaataataatactttcctcaagcacctggagaaccctcctacaagtcagagaattgagcccaggtatgatatcgttcatgcagtcggtgagcgggtgcatagcgaggcaatcagcccagcgccagaagaaaaagccgttacccttagatcgcttaggagttggcttagcctcaaagatcgtcaactgtctcaggaggtgacccctgctgacctggaatgtggactggagggacaggccggatctgttcagagagcctcccttatatgggaagcacgcggcatgcccgaagcctcaggtcctaagttcgggggcaattgccctttcccaaaatggaccggaggtgcggtggtgagtagccacaaagccacagttgcagtgtccgaggagcactgtgccccgggtgcgacaagtgtgcgggccatcaaagccgccatttgggaatcgcagcacgagggccccgagggagcaagaagcaaaccaggcgtgggtgccagggggcctcctcagggttgtccactcgacccactctccagggctactaatgggccctctgatagccaggctcgaacccatcccgacgcttttgccgttcagaaagggcccttcatagtggcggcccgagaaggagatccagggccagctcaggtccctcagcccgccgttcgaatgcgtaaagctggtgcaatggaccaaagaatggatcgatggcggcgccgcaccctgccacctaatgtgaagtttgataccttctcatcattggtgccagaggactcacctcatgtggggcatcggcgaactgactacgtgagccctactgccagcgctctaaggaagcctcagttatcacactatcgggtcgaaacacaggaggtgaacccaggagcctcgagggaccagaccagcccagctgtgaaacagggatccccagtggagccaaaggccaccttctttgccgtgacgtaccagatcccaaatacacagaaagctaaaggcgtggttctgtccggggccgagtcactgctcgagcacagtcgaaagatcactccacccagcagcccacactccttgacttccactctggtgagccttggccacgaggaagccctggagatggctggcagtaagaactggatgaagggcagagaacacgaaaatgcctctattctaaagacactgaaaccaacagaccgacccagtagtctgggggcctggtctttagaccccttcaatggtagaattatagatgtggatgctttatggtcccacagaggcagcgaagatggtcctaggccacagtcaaattggaaagaatcagccaacaaaatgagtcccagcggaggtgcaccacagactacacctacattgcgatcccggccgaaggacctccccgtgaggaggaaaaccgatgtcatctcagataccttccccgggaagatccgggacggttatagaagcagtgtgcttgatatagatgccttgatggccgagtatcaagagctgagtttgaaggtccccggcgaggcacaggagcgtcggagcccaacagtagaaccttccacactacctagagagaggcccgtgcagctcggaggcgtggagcagaggaggcggtccctgaaggaaatgccagacacaggcggcctttggaagccggcgtcctctgcggaaattaatcattcattcacaccaggtttaggaaagcagctcgccgaaacattggagacagccatgggcaccaagagctctccacctttctgggctctgcccccgtctgccccctcagaacggtaccccggaggaagtcctataccggccgacccacggaaaaaaaccggctttgccgaggacgatcgcaaagcgttcgctagtaagcatcacgtggctaagtgccaaaactacctagccgaatccaagcctagcggtagagaagatcctggatcaggcgtcagggtttcgcccaaaagtccacccactgaccagaagaaggggacaccaaggaagagcaccgggcgaggcgaggaagacagtgtcgcccagtggggtgatcacccacgcgactgtggaagagtgccactagacatcaagagggcttattccgagaaaggcccacccgctaatatcagggaaggactttctatcatgcatgaggcaagagaacgacggagagagcaaccaaaagggaggccatctctgaccggagaaaaccttgaagctaagatgggaccttgctggtgggagagtgggaccggcgatagccacaaggttctcccacgagacctggaaaaggaagatgctccccaagaaaaggaaagacccctccagcaagtgagcccggtggccagcgtgccgtggaggtcacacagcttctgtaaggaccggaggtcaggcccgttcgtgtag

SEQ ID NO: 49167 - DNA, 390 bp, Artificial Sequence
  Description of Artificial Sequence: Synthetic coding sequence
tgaatcagcgcctacttcgccaccggcagcagcatgacctaccactttcaggaacactacactctgtcagaaaattccagctccctggtttctagcctgcacagggatgtgaccctgactagggaaatgattaccctgtcgtttaggaccactagaacaccgtcactccttctttacgtgtctagcttctatgaagagtacctgagtgtgatactggcaaacaacggatcactgcagattagatacaagctggacagacatcagaaccctgacgctttcacctttgattttaaaaacatggctgacggtcaattgcatcaggtgaagatcaaccgggaggaagccgtagtcatggtcgaagtaattccgcaaatgcagaaatcaaattag

SEQ ID NO: 49168 - DNA, 543 bp, Artificial Sequence
  Description of Artificial Sequence: Synthetic coding sequence
tgacgggacgtgaccctgacccgggagatgatcaccctgagcttcaggactacacgcactcctagcctgctcctgtatgtgtcgtctttctacgaggagtatctgagcgtaatcttggccaataatgggtccctgcagattaggtacaaactggatcggcaccagaacccggacgcttttacctttgatttcaaaaacatggcagatgggcagcttcaccaagtgaaaatcaacagagaggaagccgtcgtcatggtggaagtaaatcagtcggcgaagaaacaggtgatactaagcagcgggaccgaattcaacgcagtcaagtcactgattctcggcaaagtgttagggaggagcgggcctgtggatgagggggagcctctggtaaatgctgatagaagagacagcgccgtgattggcggcgtcattgccgtagaaatttttattctgctctgcatcactgccatcgcgattaggatttaccagcagagaaagctgagaaaggaaaacgagagcaaggtaagcaagaaggaagagtgctag

SEQ ID NO: 49169 - DNA, 873 bp, Artificial Sequence
  Description of Artificial Sequence: Synthetic coding sequence
tgaatcagcgcctacttcgccaccggcagcagcatgacctaccactttcaggagcactatacattgtctgaaaactcaagcagcttggtatcatcccttcaccgagatgtcaccctcaccagggagatgattaccctatctttccgaaccactcgaacaccatctttgcttctgtacgtatcaagcttctatgaagagtatctgtctgtgatccttgctaataatgggtcacttcagattcgttataagctcgaccggcaccagaacccagacgcattcacattcgatttcaaaaatatggccgacgggcagctgcaccaagtcaagatcaacagagaagaggctgtcgttatggtggaggttaaccagagcgcaaagaaacaggtcatcctgtcttccggcactgagttcaatgccgtgaagtcgctaatcttgggcaaggtccttgaagctgccggtgccgaccctgatacacgccgggctgctacgtcggggtttacaggttgcctcagcgccgttaggttcgggtgtgcagcacctttaaaggcggcgctgcggccgagcgggccttcacgggttaccgtccgcggccacgtggcgcctatggcccggtgcgcagccggagccgcctccgggagccctgctagagaactagcaccccgcttggccggcggagcagggaggtcaggccctgtcgatgagggagaaccattagtcaatgctgatcgccgcgactccgctgtgattggcggtgtgatcgccgttgagatctttatcctcttgtgcattacggcgatagccattcggatttaccagcagcgtaagttgaggaaggaaaacgagagtaaagtctccaagaaagaagaatgctag

SEQ ID NO: 49170 - DNA, 273 bp, Artificial Sequence
  Description of Artificial Sequence: Synthetic coding sequence
atgtggcactacatcggcgccgccgagtgcccctacctgcagctgccacgatgcaggggaagctccaccaggtattggcacaagaagagtaggggcaggctgacgtggccatggctgctgatgagccagcttcgtacttgccacattaacagccccttccccctcgctgtcacctgtggggtcaagttcagcgaggcagcagtcccagttcacctctctggctgcgtccaaaagatgaatatctgcctgcagcttcagttctctaacgattag

SEQ ID NO: 49171 - DNA, 312 bp, Artificial Sequence
  Description of Artificial Sequence: Synthetic coding sequence
atgcccctggagaagttcgtggacatggagttcctggaccagatgatcctccggggaacgtgcttggaggcagacctgtgtccgcagtacactaattcaccctttaacgcacacaccgaccaaattacacagacccacctgcctccgcagcaccttgattcgagccactctacacacacatgtctgccagtgcacaggcacattcagcggcataccgataaacatcatagcaaaaagatgttcccaagaacacatggccatccaaacccaaggatcatccgattgtctcagcgccatgtttgcaccgcatag

SEQ ID NO: 49172 - DNA, 186 bp, Artificial Sequence
  Description of Artificial Sequence: Synthetic coding sequence
atggaggccagcctgggcggccccgagcccaacggcgtgatcaacgaggaggctaaagcaggcgccacggggaagaggcgaggtagggccccagctaacgggggtcgagcctcgggcgagaacagagcgttcccagtcttgcagctaccgggtaactggcattgccggcgaagacaggggtgttag

SEQ ID NO: 49173 - DNA, 342 bp, Artificial Sequence
  Description of Artificial Sequence: Synthetic coding sequence
atgggcagccccttctactgcaacggcggctactggctgcagcggacagagtgttggcgaaccatgaatgaattccattttcggtctgctcagctggccgtgcctggtcgccagccgcaggagttatttaggcgacacagagcgacgtccgcgtggtcctccaggcgaaggagtgccctcgtggtggggaccatcggcccgggtcacggcagacttcaggacccatcttgtactaaattaccctctcctccggcttggttccctttttttatgaacagaagcatgggacactcccaggttgggatgcatgtgtttcatcgaatgggaactactagctcatag

SEQ ID NO: 49174 - DNA, 780 bp, Artificial Sequence
  Description of Artificial Sequence: Synthetic coding sequence
atgaccatcaacatgctgaacgtgttcggcaacgaggacttcgactgccacggggaccttaagaccgatcagctcaagatggacatcctgatcaagaaactgaagcagaaattcgatgatctgacagctgaaaaggaggccctaagttcaaagtgcgtgaacctggccaaagataaccaggtgctgcagcaagagtttttgagcatgaagaaggtccagcaacagtgcgaaaaactggaagaagataagaaaatgctgaaggaagagattctgaacctgaagacacatatggagaataatagagtagaactgtccaagctgcaggaatacaagctcgagctggacgagaaggcaatgcaggctgtggaaaagctcgaggagattcatctgcaagaacaggcacagtatgagaagcagcttgagcagttgtctaaagacaacatggcttccctgaataaaaaggagctgaccctaaaagatgtggagtgcaaattcagtgaaatgaaaacagcctatgaagaggtgacaactgaactcgaggaatataaggaggcatttgctgccgccttaaaggcgaacaattctatgagcaaaaagctgactaaatcaaataaaaagattgcagtgatatccatgaaactgctgatggaaaaggaacagatgaagtacttcttgagcgcccttcctaccagacgtgatcctgaatccccttgcgtagaaaacttgaccagcataggacttaaccggaaatatatcccccagactcccatccgcatctag

SEQ ID NO: 49175 - DNA, 519 bp, Artificial Sequence
  Description of Artificial Sequence: Synthetic coding sequence
tgatacaagaagctgctggagatgaccatcaacatgctgaacgtgttcggtaatgaagattttgactgccacggggacctgaaaacggaccagttgaagatggacattctgatcaagaagctcaagcagaaagagcaggcccaatatgaaaagcagctggagcagctctctaaagacaacatggcctctctaaacaagaaagaattgactctgaaagacgttgaatgcaaattttccgagatgaagaccgcatacgaagaggtcaccacggaactcgaagagtataaagaggccttcgcagctgcacttaaggctaataactccatgtctaaaaaactgaccaaaagcaataagaagattgccgtgatatctatgaaactgctgatggagaaggaacagatgaaatacttcttatccgccctgccaacccgacgagaccccgaaagcccctgtgtagagaacctcaccagtataggcttaaataggaaatatatcccacaaacgcccatcagaatctag

SEQ ID NO: 49176 - DNA, 1602 bp, Artificial Sequence
  Description of Artificial Sequence: Synthetic coding sequence
atgagccagaccagcctgaagcagaagaagaacgagcccggcatgcgctcgagtaaagagagtctagaggccgagaaacgaaaggagtcagacaagactggggttagactgtcaaatcaggggtcccaggaaagtagtctcaggaagaccgatagccgcggttacctggtgcgtagccagtggagtcgtatctctcgctcccctagcacaaaggccccgtccatcgatgaaccgagatccagaaacacctcagccaaggtggaattaccctctagttccactagctcgcgcacacctagcacttccccctccctccacgacagcagtccacccccccttagcggccagcccagtctgcagccacctgcgagccctcagcttccacgttccttggattcgcggccccccacacccccagagcctgaccccgggtccagacgtagtacaaagatgcaggagaatccggaagcctgggcacaaggcatagtgcgagagataagacagacgcgggattcccaaccactggagtattctcggacatcaccaactgaatggaaaagcagctctcagcgcaggggaatttacccggcaagcacccagcttgacagaaattcgctctctgagcaacaacagcaacagagagaggacgaggacgattatgaagctgcatattgggcaagtatgcgctcattttatgaaaagaacccaagctgttctcgcccttggccacctaagccaaagaatgcaatcactatagctcttagcagctgtgctctgttcaacatggtagacgggcgtaaaatttatgagcaggaggggctggagaagtatatggaataccagctcaccaacgagaatgtgattttgacgcctggacccgccttcagattcgtgaaagctcttcaatacgtgaacgcgcggttgagagacctgtacccagacgagcaggacctattcgatatcgtgttaatgactaacaatcacgcccaggtgggagtacgcctgatcaatagtgtgaatcactacggactcctgatcgataggttttgcttaactggagggaaggatcctatcgggtatttgaaagcatatctgaccaacttatacatcgctgccgattccgagaaagtgcaagaagcaatacaggaaggtatagcctcggccacaatgttcgatggggctaaggacatggcttactgcgatactcaattgcgcgtggctttcgatggagatgctgtgctgttttccgacgagtccgagcattttacgaaggagcacggcttggacaagttttttcagtatgacactctgtgcgaaagcaaacccctcgcccaggaggagccaagattggacgtgttaatcaacaatgcaggtatatttcagtgcccctatatgaagaccgaagatgggtttgagatgcagttcggggtgaaccacctggggcactttttgctgaccaacctgctgctgggccttctaaaaagttccgcgcctagcagaatcgtggtagtgtctagcaagttgtacaagtacggcgacattaactttgatgatctgaactctgaacagagttataataaatctttttgctacagccgttag

SEQ ID NO: 49177 - DNA, 1809 bp, Artificial Sequence
  Description of Artificial Sequence: Synthetic coding sequence
atgagccagaccagcctgaagcagaagaagaacgagcccggcatgcggagcagcaaagaaagtttggaggctgagaagcgcaaagaaagtgataagacaggggtccggttgtcaaaccagatgagacgagcagtgaaccccaatcactcattgagatgttgcccattccagggccatagctcttgcagaaggtgtttgtgtgccgcagaagggacagccctcggtccttgtcataccattcggatctacattcacatgtgtcttctgtgggagcaaggacagcagataactatgatgcgcggcagtcaggagagctctctgagaaagacagatagccgcggataccttgtgagatcccaatggagtcggatctcgaggtctccttccactaaggccccatcaatcgatgagcctcgatctagaaataccagcgcaaagctgccctccagcagcacctcctccagaacgccctctacatctccttctcttcacgatagctcacccccacccctgtcgggacagccttcactccagcctcccgcatctccccagctgccccgctcactggacagtcgccctcccaccccaccagaaccggaccccggctcgaggagatccaccaaaatgcaggagaaccccgaggcctgggcccaaggaattgtaagagaaatccgccaaacacgtgactcacagccattggagtattcaagaacgtccccaactgagtggaagtcaagttcacaacggcggggaatataccctgcctccacccaattagaccgcaatagtctcagcgaacagcagcagcagcagcgggaagatgaggacgattacgaagcagcctactgggcaagcatgcggtctttttacgagaagaacccatcctgttcacgcccatggcccccgaaacccaagaatgccatcaccatcgcactcagctcatgcgcattgtttaacatggtggacggacggaaaatttacgagcaggagggattggaaaagtatatggagtaccagctgacaaatgagaacgtcattcttaccccagggcctgctttccgcttcgtgaaggccctccagtatgtcaacgcacgcctacgcgatctatatccagatgaacaggatctgttcgatatagtgcttatgactaacaatcatgcccaggtgggagtccgattgatcaacagtgtcaaccactacggtctgctgatcgatcggttctgtttgaccggcggcaaagaccccattgggtacctcaaggcatacttgacgaatttgtacatcgcagcggatagcgagaaagtccaagaggcaatacaggagggaattgcctccgcaactatgttcgacggcgctaaagatatggcttattgcgacactcagctcagagtggcttttgacggagacgccgtgctgttttcagatgagagcgaacactttacaaaagaacatgggctcgataaattcttccagtacgacactttgtgcgaatccaagccactggcccaggggcccctaaagggcttccttgaggacctgggacgactccaaaaaaagttttatgccaagaatgagaggctgctgtgtccgattcgcacctacctggtgacagccaggtctgctgcctccagtggcgcccgcgtcttaaaaacattacgtcgttgggggttagagattgatgaggctttatttctggccggtgcccccaaaagtcccatcctggtcaagataaggccgcacatcttcttcgatgatcacatgtttcacatagagggagcccagcgcaagtctctcggctggatgagctag

SEQ ID NO: 49178 - DNA, 1887 bp, Artificial Sequence
  Description of Artificial Sequence: Synthetic coding sequence
atggagagcctggtgttcgcccggcggagcggccccacccccagcgccgccgagctggcccgccctctggccgaggggttgattaaaagcccaaaaccactcatgaagaaacaggccgtcaagcgacatcatcacaagcacaacctgcgccaccggtacgaattcctggagaccctgggtaagggcacttatggcaaggtgaagaaagcacgggagtcttcaggacggctggtggctattaaaagcattcggaaggataaaataaaagacgagcaggacttgatgcatattaggcgcgaaatcgagatcatgtcttcccttaatcacccccacatcatagccatccacgaggtgttcgagaatagcagcaagatcgtaatcgtgatggagtacgcaagcaggggtgacctctacgattacatttctgaacgccagcaactgagcgagcgcgaggccagacattttttccggcagatagtcagtgcagtccactattgtcaccaaaaccgcgttgtgcaccgggatctgaagctcgaaaatatcctgcttgatgccaacggaaacatcaaaatcgccgattttggactgtcaaacctatatcatcagggaaaattccttcagaccttctgcgggagccccctgtacgccagtccagaaattgtgaacggcaagccatataccggtccagaggtagacagctggagcctgggcgtgcttctgtacatcctggtgcacggcacgatgccatttgatgggcacgaccataagatcctggtgaaacagatctctaatggcgcctatcgcgaacctcccaagcccagcgacgcttgcggacttataagatggctactgatggtcaaccccacccggcgtgcaacactcgaagacgtggcctcccattggtgggtgaattgggggtacgccactagggtgggcgaacaggaggctcctcatgaaggtggacatccaggcagtgattccgctcgcgcgtcgatggctgattggctcagaagatcttcgcgacccctactcgaaaatggcgcaaaggtttgctccttctttaagcagcacgcacctgggggcggaagtaccacacccgggctcgagcgccagcattcactgaaaaaatcaagaaaagagaacgatatggctcagagtctccacagtgacacagctgatgacacagcacacaggccaggaaagtctaacttaaagctgccaaaagggatcctgaagaaaaaagttagcgcgtcagccgaaggcgttcaggaagatccccccgagctctcacccattcctgcaagccccggacaggccgcaccactgctgccaaagaaaggaatcctgaagaagcctcgtcaaagggagtcggggtactattcgagtccagagccaagcgagtcaggcgaactgttggatgccggggatgtgtttgtatctggagatcctaaggaacagaagccgccacaagcgagtggactgttgctgcaccgtaaggggatcttgaaactgaatggcaaattctctcagacagcgttggagctggccgctcccaccaccttcggcagcctcgacgaactggctcctcccagaccacttgcccgggcatctcggcctagcggcgcagtgtccgaggactccatcttgtccagcgaatcttttgaccagctcgacctcccggaacgccttccagagcctccactgagaggatgtgtttcggtggataatctgacggggttggaggagccccctagcgaagggccgggctcctgtctacgcaggtggcggcaagacccactgggtgactcttgcttcagtctgactgactgccaggaagttactgcaacatatcggcaagccctgcgggtgtgttccaagctgacatag

SEQ ID NO: 49179 - DNA, 462 bp, Artificial Sequence
  Description of Artificial Sequence: Synthetic coding sequence
atgagcaaggacctgaagatcctgtgcaaggaccccgccctggagctgagttgttatcgagaccaccagttctcaggtcgcaagtttcaacaggagaaactcctgaaggaatcaagtacccttaacatgggcaacctgtctttctatactaccgaggagaaaattcacgagctgttttccaggagcgacattcggaatatcttcatgggtctggacaagattaagaagacagcatgcggtttttgctttgtggaatgccacaaccgggccgacgctgaaaatgccatgcgtttcctgacaggcacatgtctggatgaatggattatttgtacagattgggatgtagggtttagggagggacagcaatatggaagggggaagtcaggtggccaggtccgagatgagtttagggaggattttcacagtggacggggtggctttggtagacagacccagatttag

SEQ ID NO: 49180 - DNA, 831 bp, Artificial Sequence
  Description of Artificial Sequence: Synthetic coding sequence
atgcccaagacctgccagtgctacgtgggcaccaagaccaccaacccctctgcctggccaagcagggaaatgaagaaaaaaaaattgccaagcgattccggggatttggaggccttggagggcaaggacaaggaaaaagagagcacagtccacatcgagacacatcaaaatacctcaaagaatgtggccgccgtccaacctatgaagcgaggccagaaaagcaagatgaagaaaatgaaggagaagtataaggatcaagatgaggaggatcgggaactgatcatgaaactcctcggctcagcgggatcaaataaagaggagaaaggcaagaagggaaaaaagggcaaaacaaaagacgaacccgtgaaaaagcaaccacaaaagccaaggggcgggcagagagtaagcgacaatatcaagaaggagacaccatttctggaggtgattacgcatgagctgcaggactttgcggtggatgatccacacgatgacaaggaagagcaagatctggatcaacaaggcaatgaggagaacctgtttgactcccttaccgggcaacctcaccctgaagacgtcttgcttttcgccattccgatctgtgctccatacaccaccatgaccaattacaaatataaagtgaagttgacccccggagtccagaaaaaggggaaagccgcgaaaactgccttaaactcttttatgcacagtaaagaagcaaccgcccgggagaaagatcttttccgtagtgtcaaggatactgacttatctcggaacatccccggaaaagtgaaggtgagtgccccaaaccttttgaatgtcaagaggaagtag

SEQ ID NO: 49181 - DNA, 2349 bp, Artificial Sequence
  Description of Artificial Sequence: Synthetic coding sequence
atggacagccgggtgatgagcaagtggatgaagaacctgaagctgaaaggctatatcatccaaaaaagagaaataaagccttctttggaggcagacaagccggtcgaagacatactcacctatgaagaattccacccattcttgttttcccagcattcccagtgtccttacattgaatttgaatcatttgacaaggctgtggacgagttttactcaaagattgaagggcaaaagattgacttgaaagcactgcagcaggaaaaacaggcactaaagaaacttgataatgtgcggaaggaccatgagaatagactggaagcattacagcaggcgcaagagattgataagctaaagggcgaactgatcgagatgaacctccaaattgttgatcgggccattcaagtggtgcgctcggccctcgccaaccagattgattggacagaaattggtctcattgttaaagaagcccaagcccaaggcgaccccgtggcaagcgcgattaaagagctaaaacttcagaccaaccacgtcactatgttgttaagaaatccatatttgctcagcgaggaggaggacgacgacgtcgacggcgacgtgaatgtggagaaaaacgaaacagagccccctaagggaaaaaagaaaaaacaaaagaataaacagcttcagaaacctcaaaagaacaaaccgcttttagtggatgtcgacctgtctttatccgcctatgccaacgctaaaaagtactatgaccacaagagatatgcagccaaaaagacacagaagactgtggaggcagccgaaaaggcttttaaatctgctgaaaaaaagaccaaacagacattaaaggaggtccaaacagtgaccagtatacagaaggcccgcaaagtgtattggttcgaaaaattcttgtggtttatctcctccgagaactaccttatcatcggcgggagagaccaacagcagaacgagatcattgtaaagaggtacttaaccccagagggagatatttatgttcacgcagacctgcatggcgccacaagctgtgtcataaaaaatcctacaggggagccaattccccctaggacactcaccgaagccgggaccatggccctgtgttacagcgctgcttgggacgctagagtgatcaccagtgcctggtgggtttaccaccatcaggtgtcgaagaccgctccgaccggcgagtacttgaccacagggtctttcatgattaggggcaaaaaaaattttctccctcctagctaccttatgatgggcttcagcttcctgttcaaggtcgatgaatcatgcgtgtggaggcatcagggtgagcgcaaggtcagagtgcaggatgaggacatggagacgctggcgtcgtgcacgagtgagcttatctccgaagagatggagcagctcgatggtggcgacacaagctcagatgaagataaggaagaacacgaaacccccgtggaagtggagctgatgacacaggtggaccaggaggacatcactctccaatccggacgggatgagctaaacgaagagctgatccaagaagaatcttcggaggacgagggcgaatatgaagaggtgcgtaaggatcaggattcagtgggagagatgaaggacgaaggcgaggaaacactgaattatcctgataccaccattgacctcagccacctacagcctcagcgttctatccagaaactggcttcaaaggaagagtcaagcaattcttccgactctaaaagccagtcacgacgccacttgtctgctaaggagaggagggagatgaagaagaagaagctccctagcgacagcggggacttggaggctttggaagggaaggataaagagaaggagagcaccgtccatatcgaaacccatcaaaatacctccaaaaacgttgccgcagttcaaccaatgaaacggggccagaaatcaaaaatgaagaagatgaaagaaaaatacaaggatcaggatgaagaggacagagaactgatcatgaaactactgggctctgccgggtcaaataaggaggaaaaaggtaagaagggaaagaagggcaaaaccaaggacgagccagtcaagaagcaaccccagaaacctcgaggtggccaacgtgtgagtgataatatcaagaaagagaccccattcttggaggtgatcacacacgagctgcaggacttcgcggtggatgatcctcatgacgataaagaggaacaagacctggaccaacaaggcaacgaggagaacctgttcgattctttaacaggccagccccatcctgaggatgtgctgctgtttgcaattcccatctgcgccccatatacaaccatgaccaattataaatag

SEQ ID NO: 49182 - DNA, 3105 bp, Artificial Sequence
  Description of Artificial Sequence: Synthetic coding sequence
atgaagagccggttcagcaccatcgacctgcgggccgtgctggccgagctgaacgcctcccttttgggtatgcgtgtgaataacgtgtatgacgtggacaataagacctatctgatccggctccagaaaccggactttaaggctacacttctgttggagagtggaattcgtatccacaccacggagttcgagtggcccaaaaatatgatgcctagctccttcgcgatgaagggcaatatcgtgctgaccgattacgaatacgtaatcctgaacatcctgcgtttccgtacagatgaggcagacgacgtaaagtttgcagtcagagagcgatatccattggatcacgcacgggctgccgagcccttactcactctggagaggctcacagaaatcgtcgcttcagctcctaagggagagttattgaagcgtgtcctgaacccactcctgccctacggcccagctctgatcgagcactgtctcctggaaaacggcttttccggtaatgttaaagtggacgagaaattggagacaaaggatattgagaaggtgcttgtctctttgcaaaaggctgaggactacatgaaaaccaccagcaatttctcgggtaagggctatattatccagaaacgggagattaaaccatccctagaggcagacaaaccagtggaagacattctcacctacgaggaatttcatcctttcttattttcccaacactctcagtgcccgtacatagagtttgaaagctttgataaggctgtggatgagttttattcgaagattgagggtcagaagatcgacctgaaagccttgcagcaggaaaagcaggctctgaaaaaactcgacaatgtgcggaaggatcacgagaacagactcgaggcattgcaacaggcacaggaaatcgataagctcaaaggtgaactgatcgaaatgaacctgcagattgtggacagagctattcaagtggtgaggtccgcgctggccaatcaaattgactggactgaaatagggctgattgtgaaagaggctcaggctcagggggaccccgtggcaagtgctattaaagaacttaaattacagactaatcacgtgaccatgttgcttcgcaacccatacttgctttctgaggaggaggacgatgatgttgacggtgacgttaatgtggaaaagaatgagactgagccccctaaaggaaagaagaagaaacagaaaaataaacagctccagaaaccacagaagaataagcctctgcttgtggatgtagacctgtccctgtccgcttacgcgaacgcaaagaagtactatgatcacaaacgttatgccgcgaagaaaacgcaaaagacagtggaggctgcagagaaagcctttaaatctgcagaaaaaaaaaccaaacagaccctgaaggaagtgcagactgtgaccagcatccagaaggcaagaaaggtctactggttcgaaaagttcttgtggtttataagcagtgaaaactatctgatcatcggaggcagagatcagcagcagaacgagatcattgtaaaaaggtatcttacccccggcgacatctatgtccacgcagacctgcatggcgcgacctcttgcgttatcaagaacccaaccggcgagcccataccgccccgaactttgacggaagccggcacaatggcattgtgttactctgctgcctgggacgccagagtcattacctccgcatggtgggtgtaccaccaccaggtctccaaaactgccccaaccggggaatacctgaccaccggttctttcatgattcggggaaaaaaaaactttctgcctcccagctacctgatgatggggttctcatttctgtttaaggtagatgaaagttgcgtatggaggcatcaaggagaaaggaaagttcgagtgcaagacgaggatatggaaacactggcatcttgtacctcagaactgattagcgaagaaatggaacagctggatggaggtgacacctctagcgatgaagataaggaagagcatgagacccctgtagaagtggagctgatgacgcaggtggaccaagaggacatcactctacagagtggccgagacgaactcaatgaggagctcattcaggaggaatcctccgaggatgagggggaatacgaagaagtgaggaaggaccaagatagcgtgggcgaaatgaaagatgaaggtgaggagaccctgaattatccggacacaaccatcgacctctcccatctgcaaccccagcggtctatccagaagctggcttccaaagaggaatccagcaactcttccgatagcaaatcccagagtaggcggcatctgagcgctaaggagcgcagggagatgaaaaagaagaaactgccatcagattcgggagatctcgaggctcttgaagggaaggacaaagagaaggagagcaccgtccatatcgagacgcatcaaaatacatctaaaaacgtggcggccgttcagccgatgaagcggggccagaagtctaagatgaaaaaaatgaaagagaagtataaggaccaagatgaggaagaccgtgagttgatcatgaaactccttgggtccgccgggagcaacaaggaggagaaaggaaagaaaggaaaaaaaggaaagacaaaagatgagcccgttaaaaagcagccacagaaaccaaggggcggccagagggtgtccgacaacatcaaaaaagagacgccgttcctcgaggtgatcactcatgaactgcaggacttcgccgtagatgatccacatgacgataaagaggagcaggacctggaccagcagggaaacgaagaaaatttatttgactcgttgactggccaacctcacccagaggacgtgcttctcttcgccatacctatctgcgcaccatacactacaatgaccaactacaaatataaggtcaagctcactcccggcgtgcagaagaaggggaaggctgctaaaaccgctctgaattccttcatgcactcgaaggaggcgacggctcgggagaaggacctgtttcggtctgtcaaggacacggacctgtcgcggaatatacctggtaaggtcaaagtgagcgctcctaatctgctgaatgtaaagaggaagtag

SEQ ID NO: 49183 - DNA, 3168 bp, Artificial Sequence
  Description of Artificial Sequence: Synthetic coding sequence
atgaagagccggttcagcaccatcgacctgcgggccgtgctggccgagttaaatgcttcactcttagggatgcgcgtgaataatgtgtacgacgtggacaataagacctacttaatcagacttcaaaagccagatttcaaggccacactgctcctagaatccgggatccgcatccataccaccgagtttgagtggccaaaaaatatgatgccaagcagcttcgcgatgaagtgcagaaaacacctaaagtcccggagactggtgagcgccaaacaactgggagtcgatcgcatcgttgattttcagttcggttctgacgaggctgcatatcatctgatcatcgagctgtatgatagggggaacattgtgctgacagattacgagtacgttattttgaacattctccgctttcggacggacgaagcagatgatgtcaaattcgccgtcagggagcgctaccctctggatcatgcgagggcagccgagccactgctgactcttgaaaggctcacagaaatcgtggccagcgctccaaaaggcgagcttctgaagcgagtgttgaaccctcttctgccctacggtcctgcgcttattgagcattgcctactcgaaaacgggtttagtggaaatgtgaaggttgatgagaagttagaaacgaaggatatcgagaaggtgctggtgagtctgcaaaaagctgaggactacatgaagaccacctctaatttctccggcaaggggtatatcattcaaaaacgagagatcaagccttctttagaggccgacaaacccgtggaggacatcttgacctacgaagaatttcacccctttttgtttagtcagcattcacaatgcccatatattgagtttgaatcctttgacaaagccgttgacgagttttactccaagatcgaagggcagaagatcgacctcaaggccctccagcaggaaaaacaggcccttaaaaaactggataacgtgaggaaggatcatgagaaccggttagaggctctacagcaggcccaggagatcgacaaactcaagggggaactcattgagatgaacttgcagattgtagaccgggccatccaagtggtcagatcagcattagcaaatcagattgactggacagaaataggactgatcgtcaaagaagcccaggcacagggtgaccctgtagcaagtgccattaaagaactgaagcttcagacgaatcacgttaccatgttgttacgaaatccttatctactgagcgaggaggaggatgatgatgtagatggagacgtgaacgttgagaaaaacgaaaccgagcccccaaaaggtaagaaaaagaagcaaaaaaacaagcagcttcagaagccccaaaagaataagcctttgctggtggacgtggatttatcactgtcggcatatgctaatgctaaaaaatactatgatcataagcgatacgcagcaaaaaaaacccagaaaaccgtagaggcggccgagaaggccttcaaatcggcagagaagaaaacgaaacagaccttgaaagaagtacagactgtgacaagcatccagaaagcacggaaagtctactggtttgagaagttcctctggttcatatccagcgagaactaccttatcatcgggggaagagaccaacagcaaaatgagattatagtcaagcgctatctgactcccggcgagccaatacctccacggacactgactgaggcgggcaccatggctttgtgttactccgctgcttgggacgcccgggtcattaccagcgcctggtgggtatatcaccatcaggtcagtaagaccgcacccacaggcgagtatttgactaccggctcattcatgatccgcggcaagaagaacttccttcctccatcctacctaatgatgggattctcattcctgtttaaagtggacgagtcctgcgtctggcgccatcagggagaacgtaaggttcgcgtccaagatgaggatatggagacgctggcatcttgtacgtctgagctgatctccgaggagatggagcagttggatggaggcgatacctcatctgacgaggacaaagaagagcacgagaccccagtcgaggtggagttgatgacccaggttgatcaagaggacattactctgcagtccgggcgagatgaactcaatgaggagctgatacaggaggagtcctcggaggacgaaggagaatatgaggaagtgagaaaggaccaagattctgtaggtgaaatgaaagatgaaggggaagagaccctcaactacccagacaccacaatagacttgagtcatctccagccgcagagatcaatacagaagctggcatccaaggaggaaagctccaactcaagcgattcgaagtcccagtcaagacgtcatctgagcgccaaggagcggcgggagatgaagaagaagaaactgccttcggattcgggggacctggaggccttagaaggcaaggataaagagaaagaaagcacagtccacatcgaaacacaccagaacacgtccaaaaacgtggcagctgtgcagccaatgaagaggggccagaagagtaagatgaagaaaatgaaagaaaaatataaagaccaagacgaggaagaccgagagcttatcatgaagctgcttgggtctgctggtagtaacaaggaggagaaaggtaagaagggaaaaaaaggaaaaaccaaggacgaacccgtcaaaaaacaacctcagaagccgcgtggtggccaacgggttagcgacaatatcaagaaagaaacgccgtttctggaagtgatcactcatgagctacaggattttgcggtggatgacccccacgacgataaggaagaacaggacttggaccaacaggggaacgaagagaacttattcgactcgcttaccggacagcctcacccagaggatgtgctgctatttgctattcctatctgcgcaccctatactaccatgactaattataaatacaaggtgaagctgactccaggggtccagaagaaaggcaaagccgcgaagacggcactcaactcgtttatgcattcgaaagaagccacggctcgggagaaagatctgtttcgtagtgtcaaggacactgatctgtcccgaaatatccccggtaaggtcaaggtgtctgccccgaatctgcttaacgtgaagcgcaagtag

SEQ ID NO: 49184 - DNA, 1383 bp, Artificial Sequence
  Description of Artificial Sequence: Synthetic coding sequence
atggccttccagacccaggccggcgcccagatccccatcgagcggcttgcttctgagcgggccatcacagtgaaagtcccaaacaatagtgactgggcagccagaggccatcggagttcggccaactccgttgtcgtccaaccccaggccagtgtgggtgcagtcgtcacgttagacagcagcaacccagccgccgtcctgcacctccagctaaactatacacttctggatggccggtacctttcagaagaaccagagccatatcttgctgtatacctgcatagtgagccgcggcccaacgagcataactgctcagcatctcgccggataaggcctgagagcctccaaggcgccgatcacaggccctatacgttttttattagccccgggactagagatcccgtgggcagttataggttaaacctctcaagccatttccggttaagcgcactggaagtgagcgtcggcctctacacaagcctctgtcagtatttttccgaagaagatgtggtgtggaggacagaaggtctcctgcctctggaagaaacctctccaaggcaagccgtgtgtctcactaggcatctcaccgctttcggagcgagtttatttgtcccgccttcccacgtgcggttcgtattccccgagccaactgcggatgtgaactacatcgtgatgctgacatgtgcggtttgcttggtcacatacatggtgatggcggccattctacacaaactggatcaactcgatgcgagccgaggcagagctattccgttctgcggccagaggggacgcttcaagtacgaatccagcagcagacaggccggtgccggagcccaggtacctaggccaacttgggcctcatgttgcatgggctggacagcaggagctgcgactggcacttggatggccactgagccctccaccgccacagcatggaccagtagtggtagtccgccgagaacggcctgggtggcctgcggacgctcagagtgcggaacgaccaaaggctcagcattgcccgggtcctgttcaacttcgtcctcaggtacgtgcaggcgacatacggcaccaagcagttggtctatgaccgggttccggtggcggaggcggcctaccggagcctggtggaggcgaagatgctggccacgggtcacacagccctgttgcgcttccggagcttgttggtggctctcttgctctgcagcttctcttacaagcacctctggctccccgtacggtactggcagattagtcgccgtctcgctggcgtcacggggccctcccgctgctttttcctcctccgcttcgagttgggccccgactccatgtgggacagggctcctggttaccttgcctacagctagagggatgtgtccagggtag

SEQ ID NO: 49185 - DNA, 1332 bp, Artificial Sequence
  Description of Artificial Sequence: Synthetic coding sequence
atgcggctgcggttctggctgctgatctggctgctgctgggcttcatctctcatcagcccacccctgtcatcaacagtctcgcggtgtatagacatcgcgagactgattttggagtgggcgtgagagaccaccccgggcagcatggcaaaactcctagcccccagaagctggataacctcattattatcatcataggattcctaaggcgggacacatttacgatcctattttgcaccagttacctgtgtgtgtctttcttaaaaacgatattttggagcagaaatgggcatgatggaagcaccgacgtccaacagcgagcttggaggagcaatcggtccagacaaaagggactgaggtccatttgcatgcatactaaaaaacgtgtcagtagcttcagaggcaacaaaattggactgaaggatgtgattacactgcgccggcacgtcgaaaccaaagttcgcgccaagatccggaagcggaaagtgaccaccaagattaaccgacacgacaagattaatggcaagcgaaagaccgcccgtaagcagaagatgttccagcgagcccaggagctaaggcgtcgcgccgaggactatcacaagtgcaagattccgccttcagccaggaagcccttgtgtaactgggtccgtatggccgccgcggagcatagacactcctctggcctgccttgttggccatacctgacagccgaagcactcaaaaacaggatgggaaggcagccgccgccacccacacaacaacacagcattacggataatagcctgtctctcaaaaccccacctgaatgcctgctccatccactgccacctagtgtggacgacaacattaaggaatgcccactggcgcccctgcctcctagtgtcgatgataacctgaaagaatacctcctggtccctctcccccccagtcccctacctcctagtgtggatgataacctgaaagactgcctgtttgtccctctgccccctagtcctctgccgccctcggttgacgacaatctcaaaacccccccactagccacacaggaggccgaggccgagaagccaccaaagcctaagcgctggagggttgatgaagttgagcagagccctaagcctaaacgaaggcgtgccgatgaggtggagcaatcacctaagccgaaacggcagcgcgaagcagaggcccaacagctgcctaaaccaaagcggcgcaggctgtctaagctgcggactaggcattgtactcaggcatgggcaattcggatcaacccctgggtagagaaaaagaagaagattaagaagcagaacaagacccacgcccccaaaaccaattag

SEQ ID NO: 49186 - DNA, 1983 bp, Artificial Sequence
  Description of Artificial Sequence: Synthetic coding sequence
atgttccagcgggcccaggagctgcggcggcgggccgaggactaccacaaatgtaaaatcccaccaagtgctcgtaaagccctatgcaattgggtgagaatggctgccgcagaacatcggcattcctcgggcctgccctattggccctatcttacagccgagacccttaagaaccgaatgggtcatcaaccccctccacctacgcagcagcacagtattactgataattcactctccctcaagacacctcccgaatgccttctgacacctctgccaccttcagcagatgacaacctaaaaactcctcccgagtgtgtcctgactccgctaccacctagcgctgacgataatttaaagaccccgcccgagtgcgttcttacaccactgcctccctccgccgatgataatttaaaaacacctcccgagtgtctgctgacaccactcccgcccagcgccgatgacaacttgaaaaccccacccgagtgtttgctcactccgctgccgccttctgcactcccttcagctccccctagcgccgacgataatctgaaaactcgggcagaatgcctcctgcatccattaccaccaagtgcagacgacaacctcaaaaccccatcagaaaggcagctgacaccactaccaccctccgcaccacccagcgcggatgataacatcaagacgcctgcctttcatccccagaggatgattagtcggcatttaccatccgtgtcatctctgccgttccacccgcagctgcatccacaacagatgatcatctcaaggtacctgttgagtgtgtgtgggtttaggtttcatcaccagcccatgatcatctcacgacacctgccatccgtgtcaagccttccctttcacccacaactgcatccccaacagatgatcatatcacggcatctgcttagtgtgtgcggaggcaggtttcaccctgaaaggatgatcatctctcggcacctgcctagcgttagctctctgccctttcacccgcagttgcaccctcagcagatgatcatctcgaggcatttgccgtcagtgtgcggcggcagattccacccccagcgcatgatcattagccgccacctgccctcggtttcttcactgcctttccatccacagctccatcctcagcagatgatcatctcacgccacctgcccagcgtgtgcggaggtagatttcacccccagcagatgatcataagcagacacctgccctctgtgtccagcttaccatttcacccgcagctccaccctcagcagatgatcatttctcgccacctcccatctgtttgcggaggtagatttcatccgcagcggatgattatcagtcgacatctgccgtctgtgagctctctgccctttcatccccagctacacccccagcagatgattattagtaggcacctgcccagtgtgtgtggcgaacgtctgcggggtccccttccaccctccgccgatgataatctgaaaacacccagtgagcggcaactgaccccactgcctccttcagcacctcctagcgccgatgacaacatcaagactccagctgagagactccgcgggccactgcctccatctgctgacgacaatctgaagactccccccctggctacacaagaggcggaggccgagaagccacggaagccaaaaagacagcgagcggcggagatggagcccccacctgagcctaagcggcggcgagtgggcgacgtcgagcccagccgcaaacctaaaaggcgaagagcggccgacgtagaaccttcatcacctgaacctaaacgtagacgcgtgggagatgtggagcctagccgcaaacctaaaagacggcgggcagccgacgtggagccttctagccccgaacctaagcgccggcgggtaggagacgtggagcctagtcggaagccgaagcgaaggcgggccgctgatgttgagccatcccttcccgaaccaaagcgaagacggctatcctag

SEQ ID NO: 49187 - DNA, 3189 bp, Artificial Sequence
  Description of Artificial Sequence: Synthetic coding sequence
atgcacaccaagaagcgggtgagcagcttccggggcaacaagatcggactgaaggacgtaattacactccggagacacgtggaaaccaaggtgagagccaaaataaggaaacgcaaagttacaacaaagattaaccaccacgataagattaacggtaaaagaaaaaccgctaggaaacagaagatgttccagcgggctcaggagctgagacgcagagctgaggactaccacaagtgcaaaattcccccaagcgcccgcaaagccctgtgtaattgggtccgcatggccgccgctgagcatcgacatagctctgggcttccgtattggccttacctgaccgctgaaacactgaaaaacaggatgggccatcagccgcctccaccaacccagcaacatagcatcacagacaacagcttgtcactcaagacgccacctgagtgtcttctcacacctctgcccccctctgcagatgacaacctgaaaacgccaccagaatgtgtcctgacaccgctgcccccttccgccgacgacaatctaaagacaccccctgaatgcgtcctgacacctctcccaccttctgcggatgacaatctgaagacacctcccgagtgtctacttacgccactgccccctagcgctgacgacaacttgaaaaccccaccagagtgtctcctcactccactccctcccagtgctctgccgtcagctccccccagcgccgacgataatttgaagactagggcagagtgcttacttcaccctctgcctcctagcgcagacgacaacctcaagaccccctccgaacggcagctgacccctttaccaccatcagcccccccctctgctgatgataacattaaaacgcctgctgaacgtctgcgcgggcctcttcccccctctgctgatgacaatcttaaaaccccttctgaaagacagcttaccccattgcctccctcggcacctccatccgcagacgataacattaaaactcctgcagagaggctgagagggcctcttcctccctccgctgatgacaatctgaagaccccgtctgagaggccactgcccccttcagcaccgccatctgctgatgataatatcaagacacccgccgagagattgcgagggccattgcctccctccgccgatgacaatctcaaaacgccttccgagaggcacataatgccctttcccagcgccgatgacaacattaatacccctgcagagcgcctgaggggcccattacccccttcagcagacgacaatcttaaaacacccagtgaacgccagctcacccccctgcctcctagtgccccaccttcagctgacgataacattaaaacgcccgcagaaagacttcgtgggcccctgcccccaagcgcagatgataacttgaagaccccatccgagagacagctcactcctctgccaccatctgctccgcccagcgcggacgataacatcaaaacgcccgccttccatccgcagagaatgatcagccgccacttgccctccgtcagctcactgcccttccacccgcaacttcatccccaacagatgatcatttccaggtacctcctgtctgtctgcggcttccggttccaccatcagcccatgattatatccaggcatttgccatccgtttctagtcttccttttcacccacagctgcacccccaacagatgatcatcagccgccatttgctatccgtgtgcggagggcgatttcacccggagagaatgataatcagtcggcacctgccgtcggtgtcctcactcccttttcatccgcagcttcacccacagcaaatgatcatctcacgacatcttccgtctgtgtgtggagggcgtttccacccgcaaagaatgattatctccagacaccttccctcagtaagttcacttcccttccacccacagctgcatcctcaacagatgataatctccagacacctgccatccgtgtgcggggggcgctttcacccacagcaaatgattatttccaggcacctgccttcagttagctcccttcccttccacccacagttgcatccccagcagatgattatatctcgccatttgcccagtgtctgtggaggacgtttccatccacagaggatgatcatctcgagacacctcccctctgtcagcagcctcccattccatccccagttacatccccaacagatgattatttctagacatcttccatccgtatgtggagaacgacttagagggccgctgcccccgagtgcagatgataacttaaaaacgccttccgagaggcaacttactcctctcccgcccagtgcccctccaagcgccgatgacaacatcaaaacacccgctgaaaggcttcgcggtcctcttccccccagcgccgatgataatctgaagactccttcagaacgtcagctaaccccattgcctccatcagcccctccatcggctgacgacaatattaagacccctgcagaacggcttagggggccattacctccatctgccgacgacaaccttaaaaccccatcagagcggcagctaaccccacttcctcctagcgccccccctagcgctgacgacaacatcaaaactcccgccgagagacttaggggaccgctgccaccctcagctgacgacaatcttaaaactcctagcgaaagacaactgaccccattgcctcctagcgctccgccatctgccgacgataacatcaagactcctgcggagcggctgcggggcccattaccaccgtccgctgacgacaacctgaaaactcctagcgaacgtcagctgacacctctcccccctagcgcgccgccctccgccgacgacaatattaaaaccccagcagaaaggctgcgtgggcccctgcctccaagcgcagatgataacctgaagacgccgcccttagctactcaagaggccgaagcagagaaacccagaaagccaaagcgacaacgcgccgccgagatggaaccaccaccagaacctaagagacgtagagtgggagacgttgaaccatcgcgcaaacccaagcgtcgcagagccgctgatgtggagccttcctcacctgaacccaagaggcgccgcgtgggggatgtggaacccagtaggaaacccaaaaggagaagggctgccgatgtcgagccctctctcccggaaccgaagcggaggcgcctctcctag

SEQ ID NO: 49188 - DNA, 2547 bp, Artificial Sequence
  Description of Artificial Sequence: Synthetic coding sequence
atggtgaagctgagcatcgtgctgaccccccagttcctgagccacgaccaaggacaactgacaaaagagcttcagcagcatgtcaagagtgttacctgcccttgcgagtatttgaggaaggttattaacacgctagcagatcatcatcaccggggaacggacttcggcggctcaccatggctccatgtaataatcgccttcccaactagctacaaggtagttattacgctctggatcgtctatttatgggtctctttgctcaagaccattttctggtctcgtaatggtcacgatggatccaccgatgtgcagcaacgggcatggcgtagcaacaggaggagacaagaggggctacgcagtatctgcatgcacacaaaaaaaagagtgagcagctttcggggaaataagatcggtctgaaagacgttataacccttcggcgacacgtggaaaccaaggtcagggccaaaatccggaagcggaaggtgacaacgaaaatcaatcatcacgacaagattaacggaaagagaaagaccgctcgcaagcagaagatgtttcagagagctcaagagctcaggaggcgggcggaggattatcacaaatgtaaaattcccccgagcgccaggaaagctctgtgtaattgggtccgcatggccgccgcagaacataggcactcttccggcttaccctattggccatacctcacagctgaaactctcaagaataggatgggacaccagccgcctcctcctacccaacagcattcaatcactgacaatagcctcagtctgaagacccccccggaatgccttctaacaccgctgccacccagtgccgacgataacctaaagactcctcccgaatgtgtgctcacacctcttccaccctccgctgacgacaatctgaaaacccctcctgagtgcctgctcacaccattaccgcctagtgcacttcctagtgcacctccatcagccgacgataatctcaagacccgcgccgaatgtctgcttcacccactcccaccatctgctgatgataatctcaagacaccaagtgagaggcaattaacgccactcccgcccagcgctcccccttccgcggatgataatatcaaaacaccagctttccatccacagaggatgataatatctaggcatctgccatccgtctcctcactaccattccacccacagcttcatccccagcagatgatcatctcaagacacctgccttctgtgtgcggcgggaggtttcacccccaaccaatgatcatctcgcgtcacctcccctccgtctcatccctgcccttccaccctcagcttcacccgcagcagatgatcatatcccggcatctcctttcagtttgtggaggcaggtttcatccggaacgaatgatcatcagccggcatttgccttcagtgtcttctctgcccttccatcctcaactccacccccagcagatgatcatatcaaggcacttgccaagtgtgtgtggcggcagattccatcctcagcgaatgatcatctcccgtcacctcccaagcgtgtcttcgttgccttttcatccacagctccacccccagcaaatgatcatcagtcgacacttacctagcgtgtgcgggggccggttccacccccagcagatgatcatctcccgacatctgccttcagtgagttcattgcctttccaccctcaattacatccgcaacagatgattatctctagacacctccctagtgtgtgcgggggaagattccacccgcagcgcatgatcatatctcgtcacctgcctagcgttagttctctccctttccatccccaactgcacccacaacagatgatcatttctcggcacctgccgtcagtgtgcggggagcgccttaggggccctctgcccccctcagctgacgacaacttaaaaactccatcagagagacagcttacgccgttgcctccttcagctcctccctcagctgacgacaacattaaaacacctgccgagagactacggggacctctgccccccagtgccgacgataacctcaagactccaagtgaaagacagctcacgcctctgccgcctagcgctccgccatccgccgatgataatatcaaaacacccgcagaacgtctcagagggcctctgcccccgtcagcagatgataatctgaaaactcccccattagctacccaagaagccgaagccgaaaaaccacggaaacccaagagacagcgggccgctgaaatggaacctccacccgaacccaagcggagacgggttggcgacgtggagccttcccgcaagccaaagaggcgccgggcagctgatgtggagcccagtagtcctgaaccgaaacgacggcgggttggggacgtggagcctagccgcaaacccaaaaggcgtagggctgccgacgtggaaccttcttcccccgagcccaagcgccgccgggtgggagatgttgagcctagccggaagccaaaacgccggcgagccgcagatgttgagccaagcctcccggagcccaaaagacgcagattatcgtag

SEQ ID NO: 49189 - DNA, 2949 bp, Artificial Sequence
  Description of Artificial Sequence: Synthetic coding sequence
atgttccagcgggcccaggagctgcggcggcgggccgaggactaccacaagtgtaaaatcccgccatctgcgcggaaggcgttatgtaattgggtacgcatggccgccgctgagcatcggcactcctctggactcccatactggccatacctgacggccgaaactctaaagaatcggatggggcaccagccaccgccacctactcagcaacacagtattacggataactccctgtccctcaaaaccccacccgagtgcctgttgacccccctgccaccctcagccgacgataatctgaagaccccgcctgagtgcgtgctcacacctctgccacctagtgccgatgacaatttaaagacaccgcctgaatgcgtcttaacaccactccccccaagcgccgacgacaacctgaaaacccctcctgaatgcctcctgaccccactgcccccatccgctgatgataacttaaagactccaccagagtgcctgctgacaccactccccccatccgccctgccatccgcgcctccttcagccgacgacaacttgaagacccgtgccgaatgcttattgcaccctctgccaccatcagcggatgacaacttaaagaccccaagcgagcggcagctaacgcctctcccgccgtccgcccctccgagcgccgacgacaatataaagacaccagcagagcgactgcgaggccctctgcccccatcagccgatgacaacctcaagacaccttcagagcgccagttgacacccctcccacccagcgccccacctagtgccgatgacaatatcaagacccccgcagagcggctgagggggccgctgccccctagcgctgacgataatctgaaaacccccagcgaacgccgaacccctctccctcccagtgcccctcctagcgcggacgataatatcaagactcctgctgagcgacttcggggaccactgccgccttctgcagatgataaccttaaaactccctcagaacggcacatcatgcctccaccatcggccgacgacaacattaacacacctgctgagaggctccgtggccccctccccccgtcagcagacgacaacctcaaaactccttctgagaggcagctgacccccctcccaccatctgcagacgataacattaaaactccagcagagcgcttacgtggaccccttccccccagtgcagacgataaccttaaaacaccgagtgagcgacaactgacacccctgccaccttctgcgccgccaagcgcggacgacaatatcaagatcccggctgagcgactgcgaattccgctgccccccagcgcagacgacaacctcaagacaccttccgagcggcagctgaccccacttccaccctctgcgccgcccagtgccgatgataatattaaaacgcccggttttcacccagagaggatgattatttcacggcacttgccctccgtctcttcgctgccatttcatcctcagttacaccctcaacagatgataatatccagacatttgccatccgtgtgtggaggcagatttcatcctcagcgcatgattattagcaggcatcttccgtcagtatctagtctgcctttccatcctcagctgcatccccaacagatgattattagcagacaccttcccagcgtttgtggaggtcggtttcacccccagcagatgatcatctctcgccatctgccatcagtcagctccttacccttccaccctcaactgcacccccagcagatgattatttctagacatctgccgtccgtttgcggcggacgatttcaccctcagcggatgattatctcccgacatctaccgtccgtgagttccctgccttttcacccacagctgcatccccaacagatgataattagcagacacctgccatcagtatgcggcgggcgctttcacccacagagaatgatcatttcacgccaccttccgtcggtgtcttctctcccattccatccccagctgcatccacagcagatgatcatctcgcggcacctcccaagtgtgtgcggcccactccccccaagtgcagacgacaacctgaagactccttccgaacggcaactcactcccctccccccaagcgcgcctcctagcgccgacgataacataaagacaccagctgagcgtcttagaggaccgctaccccctagcgccgacgataatctcaagacgcctagcgagcggcaactcaccccactgccgccaagcgctccaccatcagccgacgacaatattaaaactcctgctgaacgattgcgaggcccattgcccccctccgctgatgataatctaaagaccccaagcgagcgccagttgacacccctccctccatctgctcctccttcagccgacgataatataaagacgcccgccgaacggcttagaggacccctgcctccttccgcagatgacaatttaaaaactccttccgaaagacagctgaccccgttacccccatcggctccgcccagcgccgacgataacataaagacaccggccgagagattaagggggcccctgcccccatctgccgatgacaatctaaagacgcctcctttagccacccaggaagctgaggccgagaagccaagaaagcccaagcggcagcgggccgcagagatggaaccacctccagagccgaaaagaaggagggtcggggatgtcgagccatctaggaagcccaaaagaaggcgggcggccgatgtggaaccttcatctccagaacccaagaggaggcgggtgggcgacgtagagcctagccgcaaacccaaaagacgaagagcagcggacgtggagcccagcagccccgagccgaagaggagaagagtgggggacgtggagccatcccgaaagcctaagcggcgaagggctgccgatgtggagcctagtctccccgagccaaagagacgcagattgtcttag

SEQ ID NO: 49190 - DNA, 1263 bp, Artificial Sequence
  Description of Artificial Sequence: Synthetic coding sequence
atggccgccgccgagcaccggcacagcagcggcctgccctactggccatacctcactgctgagacgctgaagaacaggatgggacaccagccccctcctccaactcaacagcactcaattaccgacaacagcctgagccttaagacaccgcccgagtgcctccttactcccttgcctccatccgctgatgacaacctgaagaccccccccgagtgtgtgttaacccctctgcccccgagcgcagatgacaatcttaaaactcctcccgagtgtgttctgactcccctccctcccagtgccgatgataacctaaaaaccccccctgaatgtcttctaacccccctgcccccaagcgcagatgacaacctgaaaacacccccagaatgtctgcttactccactgcctccttcggccctgcctagcgccccgccatcagccgatgacaacctgaagacaagggcagaatgtcttttgcacccactccctcccagtgcagatgataatctgaagacgcccagcgagcgacagttgacacccttgcctccttcagcccctccttcagctgacgacaacattaagactccggctgaaagactcagaggtcctctgcccccaagcgccgatgacaacttaaagacccctagtgaacgccagttaacgcctctgcccccctccgccccgccatctgccgatgacaacataaaaactcctgccgagagactccgcggaccactacctccgtcagccgatgataaccttaaaacaccctccgagaggcagctgacccctctacctccatcggcacccccctcagcggatgataatattaagactccagctgaaaggctcaggggccccctgcctccgtcagcagatgataaccttaaaacacctcccctagccacgcaagaggccgaggctgagaagccaagaaagccaaaaagacagagagcggcagagatggagccacctccggagcctaaaagacgcagagtaggcgatgtcgaaccatcccgcaagccgaagcgccgccgggccgccgacgtggagccgagctcacccgaacccaaacgccgccgtgtcggcgacgtggaaccaagccggaagcctaaaaggcgcagggcagcagacgtagagcctagctctccagaaccaaagcgcaggcgagttggggatgttgagccctcacggaaaccaaagagaagaagagcagctgatgtggagccttccttgcccgagccgaagagacgccggctctcctag

SEQ ID NO: 49191 - DNA, 462 bp, Artificial Sequence
  Description of Artificial Sequence: Synthetic coding sequence
atggccgccgtggagcaccggcacagcagcggcctgccctactggccatacctcaccgctgaaaccctgaaaaaccggatgggacatcagccaccccccccaacccaacagcattccattattgacaacagtctgtccctgaaaactccgtctgagtgtgtgctgtaccctctgccgccaagtgcagatgataatctgaagactccacccgaatgtctcctgacacctctgcctccctctgcacttccgtctgctgacgacaatctgaaaactccggctgaatgccttctatatccgctccccccctccgccgatgacaacctcaaaacccctcccgagtgtcttttgactccactgccaccaagcgcacccccctcagcagacgacaacctgaaaaccccgcccgaatgcgtctgcagtcttcccttccaccctcagaggatgatcatttcaagaaattag

SEQ ID NO: 49192 - DNA, 528 bp, Artificial Sequence
  Description of Artificial Sequence: Synthetic coding sequence
atgaaggtgaccaccaaggtgaaccggcacgacaagatcaacggcaaacggaagaccgctaaggaacatttgcgaaagctttcaatgaaagagcgagaacaccgggaagaggagaggcaggttagcgaggctgaggaaaatggtaaattggatatgaaggaaattcacacctacatggaaatgttccagcgtgctcaagccctgcggagaagagccgaagactattatcggtgtaaaattacaccctctgctaggaaaccactttgcaacagggtgagcctgctggtgttcttggccttcggccatagtttgccaggacaagacatggatacctttttttccctgcgactctgcgcgcaagcccttcagagagagatggcggagagaaaggccgcctacaagcatcattctcccataccggttgggaactgcgtcgcacaaaagcatctacatccccacccagttggtccaccttctaacatcctttccgttaggggatcggtgttcgtcatcgcaaatggcccatag

SEQ ID NO: 49193 - DNA, 1062 bp, Artificial Sequence
  Description of Artificial Sequence: Synthetic coding sequence
atgcggctgcggttctggctgctgatctggctgctgctgggcttcatatcacaccaacctacacctgtgagttttctgaagaccattttttggtcaagaaatgggcacgacgggtccatggatgtacaacagcgagcttggcgatccaatagatctcgtcaaaagggcctccgcagcatatgtatgcacacaaagaaaagagtcagttcattccgtggcaacaagatcgggctgaaggacgtgattaccctcagacggcacgtcgagactaaagtgcgagcaaagatcagaaaacggaaagtgactaccaaaatcaaccggcacgataaaattaatggtaaacggaagacggctagaaagcaaaagatgttccagcgggcacaagaactaagacggagagctgaagactaccataaatgtaaaataccacctagtgcacggaaaccactgtgcaactgggtcagaatggccgccgctgaacaccgacattcatccgggctcccttactggctgtacttgaccgcagagaccctgaagaaccgaatgggtaggcagccacctcccccaacccagcagcactctattactgacaactctctgagtctgaaaacaccacccgagtgccttctgacaccccttccaccttccgtcgacgacaacattaaagaatgcccactggcacccctcccaccctccccacttccaccgtccgtcgacgacaacctaaaggaatgcctttttgtccctctgcctccgagtccactcccccctagcgtagatgataatcttaaggagtgtctgtttgtgcccctgccaccaagtcccttacccccctctgttgacgacaacctgaaaacccctcccctggcaacacaggaagcggaggttgaaaagcctcctaagcctaaacggtggcgcgtcgacgaggtcgaacagtctcctaagcccaagcggcaacgtgaggcagaagcccagcagctgcctaagccaaagagacggaggttatcgaagctgagaaccaggcattgcactcaggcctgggctatccggatcaacccctag

SEQ ID NO: 49194 - DNA, 294 bp, Artificial Sequence
  Description of Artificial Sequence: Synthetic coding sequence
atggaggcccccgccgagcgggccctgccccggctgcaggccctggccagaccaccacctccaattagttacgaggaggagctatacgattgtctagactactattacttacgtgacttccccgcctgcggagccggtagatcgaaaggccgtacccgccgggaacaggcacttcgtacaaattggcccgcgcccggtgggcacgagcggaaggtcgcacagaagctgttgaacgggcaaagaaagcgacgccagagacagctgcacccgaagatgcgcacgcggttgacatag

SEQ ID NO: 49195 - DNA, 1845 bp, Artificial Sequence
  Description of Artificial Sequence: Synthetic coding sequence
atgaacaccttccaggaccagagcggcagcagcagcaaccgggagccacttttgcggtgctccgacgctagacgggacctcgagctggccattgggggcgtgcttcgggcagaacaacaaattaaagacaacctgagagaggtgaaagcacaaatccattcttgcatttctcgccacctggaatgtctgagaagccgggaggtgtggctttatgaacaggtagatttgatataccagcttaaggaagagacactgcagcagcaggcacagcagctgtactccctgctcggtcagttcaactgcttgactcatcagcttgagtgcactcagaataaggatctggcgaaccaggttagcgtgtgtctggaaagattgggcagtctgaccctcaagcctgaggattctacagtcctgctctttgaggcagacactataaccctgaggcagacgattacgacctttggcagtctcaaaaccatacaaatccccgagcacctgatggctcacgcctcatctgccaacatcggtccctttctggagaagcggggctgtatcagtatgcccgaacagaagtctgcttcagggatcgtagccgtgcccttcagcgaatggctgctaggctcgaaaccggcctctggttaccaggccccgtatattcctagcaccgatcctcaggactggctgacacaaaagcagactttggagaactcacaaacttcgtccagagcatgtaatttcttcaataatgtgggaggaaacctaaagggcttggagaattggctactgaagagcgagaaaagctcctatcaaaagtgtaactctcactccacaaccagctcctttagcatcgagatggagaaggttggggaccaggaactgccagaccaggacgaaatggatctgtctgattggctcgtgactcctcaggagtcccacaaactgaggaaacccgaaaacggctctcgcgagacctctgaaaaattcaagctgttgtttcagtcttacaatgttaatgactggctcgtgaagaccgattcctgtaccaactgccaaggaaaccagcctaaaggtgtggaaatcgagaacctgggcaacctgaagtgtttaaatgatcacctggaggccaagaagcccctcagcacaccaagtatggtgaccgaggactggttggtccagaaccatcaggatccatgcaaagtggaggaggtgtgccgcgctaacgagccatgtacctctttcgccgagtgcgtgtgcgatgaaaactgtgagaaggaggctctctataagtggctgttgaagaaggagggaaaagataagaatgggatgccagtggaacctaagccagagcctgagaagcacaaagattcgctaaacatgtggctgtgccctagaaaagaggtcatcgagcagactaaggcccccaaagctatgacacccagcaggatcgctgatagtttccaggtgataaaaaactcaccgttgtccgaatggctgatccggcctccctacaaggagggcagccccaaggaagttcctgggaccgaggaccgggctggcaagcagaaatttaagagtccaatgaacaccagctggtgctccttcaacaccgctgactgggtcttgccaggaaagaaaatgggcaacctgagccaactgtcctccggagaggataagtggctgttaaggaagaaagcccaagaggttcttctgaattcgccactccaagaagagcacaattttccaccggatcactatggcctgccggcagtctgcgatttgttcgcctgcatgcaattgaaggtggacaaggagaagtggctgtacaggacacccctccaaatgtag

SEQ ID NO: 49196 - DNA, 1845 bp, Artificial Sequence
  Description of Artificial Sequence: Synthetic coding sequence
atgaacaccttccaggaccagagcggcagcagcagcaaccgggagcctctgctgcggtgcagtgacgcaagaagagatctggagttagccattggcggcgtgctccgcgccgagcagcaaatcaaagacaacttaagagaggttaaggcacaaattcatagctgcatcagcagacatctggaatgcctcaggtctagagaggtatggttatacgaacaagtggatctgatttatcagctgaaagaagagacattgcagcaacaggcccagcaactgtactcattgttgggccagtttaattgcttaacccaccaacttgaatgcacccagaataaggatctcgcaaaccaggtgagcgtctgtttggagaggctcgggagtttgacccttaaacccgaggatagcacagttctcttgttcgaagccgacacaattacccttaggcagacaatcactacatttgggagcttgaagactattcagatccctgagcacttgatggctcacgcctcctcagcaaacatcggccccttcctggagaaacgtgggtgcatctcgatgcctgagcagaagagcgcctccggaatcgtggcagtcccgtttagcgagtggctgctgggctcaaaacccgcatctggctaccaggccccctacatccctagtaccgatccacaggactggttaactcagaagcagactctagaaaattctcaaacaagctccagagcctgcaatttctttaataacgtcgggggtaacctcaaggggctcgagaactggttgttgaagagcgagaagtcttcctaccagaagtgtaactcacacagcacaactagcagcttctctattgagatggaaaaggttggcgaccaggagttgccggatcaggacgaaatggacctaagcgactggctggtaacgcctcaggaaagtcataagctccgtaagcccgaaaatggctctagagagacatctgagaagtttaagttactctttcaatcttataacgtgaacgattggctggtcaaaacagactcctgcacaaactgtcaggggaaccagcccaaaggggtcgaaatagaaaaccttggcaacctcaagtgcctcaacgatcacctggaggccaagaagcctctgtccacgccgagtatggtgacggaagattggctagtgcagaaccaccaggacccttgtaaagtggaagaggtgtgtcgggcaaatgaaccttgcacgtcctttgctgagtgcgtatgtgatgagaactgcgagaaagaagctttgtacaagtggcttctaaagaaggaagggaaggataaaaatgggatgcctgtcgaaccaaagcccgaaccagagaaacacaaagattctttgaacatgtggctgtgccctcgcaaagaagttattgaacagaccaaagctcctaaggccatgacgccatccaggatagcggactcatttcaagtgatcaaaaattctccgctatctgaatggcttattcggccaccttataaggaaggcagccctaaggaggtgccagggacagaggaccgagccgggaagcagaagttcaaaagtccgatgaatacttcctggtgcagcttcaataccgctgactgggtgctacccgggaagaagatgggtaatctcagccagctgtcatccggggaagacaaatggctcctgaggaaaaaagcccaggaagtccttctgaactcccccctgcaagaggagcacaactttccaccagatcattatggactccccgcagtgtgcgatctcttcgcctgtatgcagctcaaggttgacaaggagaaatggttgtaccgcactcctttgcagatgtag

SEQ ID NO: 49197 - DNA, 1845 bp, Artificial Sequence
  Description of Artificial Sequence: Synthetic coding sequence
atgaacaccttccaggaccagagcggcagcagcagcaaccgggagccactgctgcgatgctccgatgcccgcagggatttggagctggccatcggcggtgtgctcagagcggagcagcagatcaaggacaatcttcgtgaggtgaaagcccaaatacattcctgtataagcagacatctggagtgcctccggagcagagaggtctggctctatgaacaggtagatttgatttaccagttgaaggaggaaaccctgcagcagcaggctcaacagctttattccctactcggacagttcaactgtctgacccatcagctggagtgcacacagaataaggacttagcgaaccaggtatccgtgtgcttggaacgcctgggcagcttgaccttaaaaccagaggactccacagtgctgctctttgaagccgataccattacgctacgccagaccatcactacatttggttctctgaagactatacagattccggaacacctgatggcacatgctagttccgccaacattggtccttttctggaaaaacggggatgcatctccatgcccgaacaaaagagcgctagcggaatagttgcagtccccttctccgaatggctgctaggatccaagcccgcatcaggctatcaagctccctacattcccagcaccgatcctcaggactggttgacccagaagcagactcttgaaaattcccaaacaagttccagggcttgtaatttcttcaacaacgttggcgggaaccttaaagggctggaaaactggctcctaaagtccgagaaaagctcctatcagaagtgcaatagtcattcaaccacctctagcttttccatcgagatggaaaaggtgggcgaccaagagcttcccgatcaagacgagatggacctatctgactggctcgttacacctcaggagagccacaaactcagaaaacctgaaaacgggagtcgtgagacctcggagaaattcaagctcctctttcagtcctacaatgtaaatgactggttagtgaagactgatagctgtactaactgccaaggaaaccagcccaaaggggtagagatcgaaaacctgggtaacctgaaatgcctgaacgaccacttggaggccaaaaaacctttgtccactccgagtatggtcacagaagattggcttgtacaaaatcaccaagatccttgtaaagttgaggaagtgtgcagagctaacgagccttgcacaagcttcgcagagtgcgtttgtgacgagaattgtgagaaggaagctctgtacaagtggttgctgaaaaaagaaggcaaggacaagaacggcatgccagtggagcccaagccagagccagaaaagcataaggattccctgaacatgtggctttgtccacggaaggaggttatcgagcagacaaaagcccccaaagcaatgaccccatctcgaatcgcggactcttttcaggtgatcaagaacagcccactgtcagaatggctgattcgcccaccatacaaagaaggttctccaaaggaggtcccaggaaccgaggaccgcgctgggaaacaaaagtttaagtcgcctatgaacacgtcttggtgtagtttcaataccgctgactgggtgctgccgggcaaaaagatggggaatctgagccagttgagcagtggagaagacaagtggctactgcgtaaaaaggcccaggaggtgctcctcaactcccctcttcaagaagaacacaattttccacccgatcattacggactccccgccgtgtgtgacctttttgcctgcatgcagcttaaggtcgacaaggagaagtggttgtaccgaactcccctgcagatgtag

SEQ ID NO: 49198 - DNA, 1209 bp, Artificial Sequence
  Description of Artificial Sequence: Synthetic coding sequence
atgccccacagcgccggcggcaccgccggcgtgggcctggaggccgcggaaccaacagctctgttaacgcgagcagagccaccatctgagccaactgagatcagaccccagaagagaaagaaggggccagcccccaagatgctcggaaacgaattgtgttcagtttgcggggataaagcttccggatttcactataatgtattatcctgtgaaggatgtaaagggttttttaggcgctctgtgatcaaaggcgcacactacatctgccactcagggggacactgccccatggatacatacatgcgcagaaagtgccaggagtgccgtttgcgcaaatgcaggcaggcaggcatgcgtgaagagtgtgtgctgtccgaggagcagatccgcttaaaaaaacttaaacgccaggaggaggagcaggcgcatgctacatcccttcccccaagggcctccagccccccgcagattttacctcaactttcccccgagcagctcgggatgatcgaaaagctggtcgcagcccagcaacaatgtaacaggaggtcattctcagatcgcttgcgagtcacgccttggcctatggccccagatcctcactctagagaagcgcgccagcagcgctttgcacattttacggagttagcaatcgtatcagtgcaggaaatcgtcgactttgcgaaacagctacccggctttcttcaactgtcgagagaagaccagattgccttgttgaagaccagcgcaatcgaagtgatgctgctggaaacgagccgcaggtacaacccaggcagcgaatcaatcacttttctgaaggatttctcatataacagagaggacttcgcaaaagctgggcttcaggtggaatttatcaatccgattttcgagttcagtagggctatgaatgagctgcaacttaacgacgcagagtttgcactcttgatcgcgatctccatcttctctgcagacagacctaacgtgcaagaccaactgcaggtcgagcgcctgcagcacacctacgtcgaagccctgcatgcatatgtgtccatccatcacccacatgatcgcttaatgtttccccggatgctgatgaaactggtttccctgagaaccttgagttcggttcacagcgaacaagtgttcgcccttcggctgcaggacaaaaagcttccccccctgctcagcgaaatctgggatgtgcatgagtag

SEQ ID NO: 49199 - DNA, 1164 bp, Artificial Sequence
  Description of Artificial Sequence: Synthetic coding sequence
atgagcctgtggctgggcgcccccgtgcccgacatcccccccgactccgcggtggaactttggaaaccgggggcccaggatgccagctcgcaagcacagggtgggtcttcatgcattctgcgtgaggaagcgagaatgcctcactcagccggaggaaccgctggagtcggcctggaggccgctgaaccaacagcccttctaacacgggctgaaccaccctctgagcccaccgagattcggccacaaaaaaggaaaaagggacccgcacccaaaatgctgggaaacgaattgtgctccgtgtgcggcgacaaggcctcagggtttcattacaacgtgctatcttgcgagggttgtaagggattcttccgccggagcgtcatcaagggagcccactacatctgtcatagcgggggccattgccctatggatacctacatgcggcggaagtgtcaggagtgccgcctgaggaagtgtaggcaggccgggatgagagaagagtgcgttctttctgaggaacagatccgactcaaaaagctgaagaggcaggaagaggagcaggctcatgcaacgagtctgccccctcgggccagttcacccccacagatcctgccacagctctcccctgagcagctcggcatgattgagaagctggtggctgctcaacagcagtgtaatcgaaggagctttagcgacagattgcgcgtcactgtcatgctactggaaacatctagacggtacaaccctgggtccgagagcattacttttctgaaagatttctcatacaaccgcgaggactttgcaaaagctggactccaagttgagttcatcaatcccatttttgagttctctcgtgcaatgaacgagttacagctgaatgacgcagaattcgccttactgatcgccatcagcatcttctccgccgacagacccaacgtccaggatcagctccaagtagagcgcctccaacatacgtatgtggaagcccttcatgcatatgtgtccatccatcatccacatgaccgcctcatgttcccacgtatgcttatgaagctggtctctcttagaacgctctccagtgtccattccgaacaggtgttcgcccttcgccttcaggataaaaaactgcccccactgctgagtgagatctgggacgtgcacgagtag

SEQ ID NO: 49200 - DNA, 1164 bp, Artificial Sequence
  Description of Artificial Sequence: Synthetic coding sequence
atgagcctgtggctgggcgcccccgtgcccgacatcccccccgactccgcggttgaattatggaagcctggtgcacaagatgcgtccagccaagcacagggcggctctagctgcattctgagagaagaagcgagaatgccccatagcgccggcggaactgctggtgtgggtttagaggccgctgagcccacagccctgttaacccgagctgagcccccttccgaaccaactgagattcggccacagaagaggaaaaagggacctgccccaaagatgctcggaaatgagctgtgctctgtctgtggcgataaagcttctggattccactacaacgttttgtcctgcgaggggtgcaagggctttttccggcgcagcgttatcaaaggtgcccactatatatgtcattccggcggccactgtccaatggacacctacatgcgccgtaagtgtcaggaatgtcgtttacggaagtgccgacaagccggtatgagggaagagtgtgtgctgagcgaggagcagattagactgaaaaagctaaagcgtcaggaggaggagcaggcacacgcaacatctctgcctccaagggcgagttcacctcctcagattctgccccagctatcaccggagcagcttggcatgatcgaaaagctggtcgctgcccagcaacagtgcaaccgacggagcttttcagatcggctgcgagttacagtgatgctgctggagacctcccgacgatacaatcctggctcagaaagtattacgttccttaaggatttttcctacaaccgcgaggattttgctaaagctggactgcaggtggagtttatcaatcctatattcgagttctctcgtgcaatgaatgagctgcagttaaatgacgccgagtttgccctcttaatagcaatctccatattttccgccgaccgacccaacgtgcaagaccagttacaagtggaaagactgcagcatacatacgtcgaagccctgcacgcttatgttagcatccaccatccccacgatcggttaatgttccctaggatgctgatgaagctggtaagccttcggaccctgtcatctgtccattctgaacaggtgtttgcacttagactgcaggacaagaagctccctcctctcctcagcgagatttgggatgtgcatgagtag

SEQ ID NO: 49201 - DNA, 609 bp, Artificial Sequence
  Description of Artificial Sequence: Synthetic coding sequence
atgagcctgtggctgggcgcccccgtgcccgacatcccccccgactccgcagtcgagctgtggaagccaggagcacaagatgcttctagccaagcgcaaggcgggtccagttgtatccttagggaagaggcgcggatgcctcacagcgcgggcggcacagcaggtgtgggtctggaggccgctgagcccacagctttgctgacaagggccgaaccaccatccgagcctaccgagattcgcccacagaaacggaagaagggccctgcacccaagatgctgggaaatgaactgtgctcagtatgcggcgataaggcttcaggctttcattacaacgtcctatcctgtgaaggatgcaaaggcttctttcggcgctccgtcatcaagggagcccactacatctgccactcagggggccattgccctatggacacatatatgagaaggaagtgccaggaatgtagactcaggaaatgcaggcaagctggcatgcgcgaggagtgtgtcctctccgaggagcagatacgactgaagaaactgaaacgacaggaggaggaacaggcgcatgcaacctcactgcctccaagagcgtcctcccctccacaaatttag

SEQ ID NO: 49202 - DNA, 207 bp, Artificial Sequence
  Description of Artificial Sequence: Synthetic coding sequence
atgagcctgtggctgggcgcccccgtgcccgacatcccccccgacagcgccgtggagctctggaaaccaggggctcaagatgcctcctctcaggcgcaggggggtagtagctgtattctgcgcgaggaggcccgaatgcctcacagcgccggtggcacggcaggggtcgggttagaagcggctgaaccaaccgctctgctgacgtag

SEQ ID NO: 49203 - DNA, 1344 bp, Artificial Sequence
  Description of Artificial Sequence: Synthetic coding sequence
atgagcctgtggctgggcgcccccgtgcccgacatcccccccgacagcgccgtcgaactgtggaagccgggagcccaggatgcatcttcccaggctcagggtggctcctcctgtattctgcgcgaggaggcacgcatgcctcactctgctggaggaaccgccggagtgggactggaagccgccgaacctactgccctgttaacgcgggccgagccaccaagcgaacctaccgagattcgaccacagaagagaaaaaaagggccagctccgaagatgctcggtaacgaactgtgttcagtgtgtggcgataaagcaagtggttttcattacaacgttttgagttgtgagggctgtaagggcttctttagaaggagcgtgatcaaaggggctcattacatttgccatagtggagggcattgtcccatggatacgtatatgcgcagaaaatgtcaggagtgcagactccggaaatgtagacaggccggaatgcgggaagagtgcgtgctatctgaagagcagattcggctgaaaaaacttaagcgccaggaggaggagcaagcccacgccaccagcctgccccccagagcaagtagtcccccccagatcttgccccaattatcacccgaacagcttggaatgatcgagaagctcgtggccgctcagcagcagtgtaacaggaggtcattcagcgaccggcttagagtgactccatggccgatggccccggacccacatagtcgcgaagctagacagcagcgatttgcacactttaccgaactcgccatcgtgagtgtacaagagattgtggatttcgccaaacagctccccgggtttctccagttgagtagggaggaccagattgccttgctcaagacatccgctatagaggtgatgctcctggagacttctcgacgatataaccccgggagcgagtcgatcacattcttgaaggatttctcatataatagggaggactttgctaaagccggtctccaggtggagtttattaatccgatctttgagttcagcagggccatgaatgagctgcagctgaacgacgccgagtttgccttgcttatcgcaatttccattttcagcgccgaccgaccgaatgtgcaggatcagctacaggtcgaacggctgcagcacacctacgtggaggcattgcatgcttatgtgtcaatccaccatccgcacgatagactaatgttccccagaatgttgatgaaacttgttagcctccgaactttgtcatcagtccactccgaacaggtgtttgccttacggctccaagataagaaactgcccccactgttgtccgaaatatgggatgtgcacgagtag

SEQ ID NO: 49204 - DNA, 585 bp, Artificial Sequence
  Description of Artificial Sequence: Synthetic coding sequence
atgagcctgtggctgggcgcccccgtgcccgacatcccccccgactccgccgtggagttgtggaaacctggcgctcaggatgcaagttctcaggcccaaggtggcagtagttgtatcctgcgcgaggaagctaggatgccgcattcagcaggaggcactgccggcgtgggcctggaagcagctgaacccacagcccttttgacacgggcggaaccaccttcggaacccaccgagatcaggccccagaaaaggaagaagggcccagcacctaaaatgctcggcaatgaactctgtagtgtctgtggagacaaggcgagcggcttccattataatgtcttatcttgtgaaggatgcaaggggtttttccggagatcggtgatcaagggggcacattatatctgccactctggcggccattgcccaatggacacttacatgcgccgtaaatgtcaggagtgccgcctgcgtaaatgcaggcaggctggcatgcgcgaggagtgtgtcctgtctgaggagcagattagactgaagaaactgaagcggcaagaagaagagcaggctcatgctacatctctgcctccctag

SEQ ID NO: 49205 - DNA, 618 bp, Artificial Sequence
  Description of Artificial Sequence: Synthetic coding sequence
atgagcctgtggctgggcgcccccgtgcccgacatcccccccgactccgctgtggaactctggaagccaggtgcacaagatgcatcatcccaagctcagggaggatcctcttgtatcctcagagaagaggctaggatgccgcattccgcaggaggaaccgccggggttgggctagaagcggctgaacccactgcactactgactagggctgagcccccatctgaaccaaccgagattaggccacagaaacggaagaagggtccagctcccaaaatgctcgggaacgagctgtgctccgtttgcggtgacaaggcctcaggcttccattacaacgtcttgagttgcgaaggctgcaaggggttcttccgacggagcgtcatcaaaggggcacactacatttgccatagtggaggtcactgcccaatggatacctacatgagaaggaaatgtcaggagtgcaggctacgtaagtgtaggcaggcaggcatgcgagaagagtgcgtgttgtctgaagagcagatccgcctgaagaagctgaaacggcaagaagaggaacaggcccatgcaacatcgctccccccccgagcttcaagtccaccccagatcctacctcaatag

SEQ ID NO: 49206 - DNA, 234 bp, Artificial Sequence
  Description of Artificial Sequence: Synthetic coding sequence
atgagcctgtggctgggcgcccccgtgcccgacatcccccccgactcagcagttgagttatggaaaccgggggcccaagacgccagctcccaagctcaagggggcagtagttgcatcttaagagaagaagctaggatgcctcacagtgctggcggcacggcgggcgtgggcctggaagctgctgagccaaccgctctcctcacacgcgccgaaccaccaagtgaacccacgtag

SEQ ID NO: 49207 - DNA, 1344 bp, Artificial Sequence
  Description of Artificial Sequence: Synthetic coding sequence
atgagcctgtggctgggcgcccccgtgcccgacatcccccccgactctgctgtcgaattgtggaaacccggcgcacaagacgcatctagccaagcacaaggcgggagctcatgtattctgagagaagaggctcgtatgcctcactctgccggggggacagcgggtgtcgggctggaagccgcggagcctaccgctctgctaacccgggcggaacctccctctgagccaacagaaatcagaccccagaagagaaagaaagggccagcgccaaagatgttgggaaacgagctgtgcagtgtttgcggagataaggctagcgggtttcattacaacgtgctgagctgcgaaggttgtaaaggtttcttccgaagatctgtgattaagggggcgcactacatctgtcattctggcgggcactgtccaatggatacatatatgcgtcgaaaatgccaggagtgtaggcttagaaagtgcaggcaggcaggcatgagagaggaatgcgtgctgtctgaggagcagattaggcttaaaaaactaaaacgccaggaagaggaacaggcacacgccacttccttacctccacgcgcctcgagccctcctcagattctgccacagctttcgccggagcagctggggatgattgagaaactagtggcggcacagcagcagtgtaatcgtcgctccttttccgaccgcctcagagtcacgccttggccaatggcgcccgacccccattcgcgcgaggctagacagcagcgatttgctcactttacagagctcgccatagtctcagttcaggagatcgtggatttcgccaagcagcttcccgggttccttcagctatctcgtgaggaccagatagccctgctgaagacctccgcgattgaagtgatgctgcttgagacatctaggaggtacaatccaggctccgaaagtattacattcttgaaggatttctcctataaccgagaagacttcgccaaggcggggcttcaggtggagtttatcaacccaatctttgaattctcccgcgccatgaatgaactgcaactgaatgacgccgagttcgctcttctgatcgctatatcaatcttttcagctgacagacccaacgtccaggaccagctccaggtcgagcggctccaacatacttatgtggaagccctccatgcgtacgtgtctatccatcatccgcacgataggctgatgttccctcgtatgctgatgaagctggtcagtctgaggaccctgtcaagcgtgcactcagaacaggttttcgcactgcgactacaagataaaaaactgccaccactgctgtcagagatttgggatgtccacgaatag

SEQ ID NO: 49208 - DNA, 1881 bp, Artificial Sequence
  Description of Artificial Sequence: Synthetic coding sequence
atgtgcagcaccctgaagaagtgcggcacctaccggaccgaggtggcagaatgtcacgatcatggctctaccttccagggcagaaagaagggcggcagtagcttcagagacaattttgacaagcgcagttgccattatgagcatggtggctacgagagacctccatcccactgtcaggagaatgatggaagcgtggaaatgcgcgatgttcataaggatcagcagctgcgccatactccctatagtatccggtgcgaacggagaatgaaatggcactcagaagatgagattaggatcactacctggagaaatcggaagcctccagagaggaaaatgtcccagaatactcaggacggttatactaggaattggttcaaagtcaccatcccttacggcatcaaatacgataaggcatggttgatgaattcgattcagtctcactgtagcgacagattcacacccgtggacttccattacgtgcggaatcgggcttgtttctttgtgcaagatgcatccgcagcctcagccctgaaggatgtgtcctacaaaatatacgacgatgagaatcaaaagatatgtatcttcgttaaccactctacggccccttactccgtcaagaacaagctgaagccaggacagatggaaatgctgaaactgaccatgaataagcggtacaacgtttctcagcaagccctggatcttcagaatctaaggttcgatcccgatctaatgggtcgcgatattgatattatccttaatcgaaggaattgcatggcggccaccctgaagatcatagagaggaattttcctgagcttctgtcactgaacctatgtaataataagctgtaccaactcgatggtctctccgatatcaccgagaaggctcccaaggtgaagactcttaacctgtcaaagaataagctcgagtcagcgtgggagttgggcaaagtgaagggccttaagctcgaagagttgtggctggagggaaacccgctatgctccacgttctctgatcagagtgcgtacgtgtcagctattagagactgctttcctaagctccttaggctggatgggagggaactctcagcccccgtgattgtggacatcgactcctcggagaccatgaaaccatgtaaggagaattttaccggcagcgaaacactgaagcacctggtattacagtttttacagcagtactattccatttatgacagcggtgaccggcagggtcttctcggcgcctaccacgacgaagcttgtttcagcttggcaattccatttgatcccaaggactcagcaccatctagtctctgcaaatactttgaggactcacgcaatatgaagacactgaaggacccatacctcaagggcgagttgctaaggcggacaaaacgggacatcgtcgattctctgagtgccttacccaaaactcagcatgatctgtcctccatcttagtggatgtttggtgtcagacagagcgaatgttatgttttagcgtcaatggagtgttcaaggaggtggaaggccagtcccaggggtccgttctggcttttacacggacttttattgcgacccctggaagtagttcatcactctgtatcgtgaacgatgagctctttgtgcgtgacgcttcgccacaggagacccagtctgctttttctattcctgtgtcaacactgtcctcctcttccgagccaagtctgtcccaagagcaacaagagatggtgcaagcgttttctgcacaatcaggtatgaaactggaatggagtcagaagtgcttacaggacaacgagtggaactacaccagggcggggcaggcctttacaatgctgcagacagagggcaaaatacccgcagaagcattcaaacagatcagctag

SEQ ID NO: 49209 - DNA, 1881 bp, Artificial Sequence
  Description of Artificial Sequence: Synthetic coding sequence
atgtgcagcaccctgaagaagtgcggcacctaccggaccgaggtggccgaatgtcacgatcacggatcaacctttcagggtagaaagaagggggggagctctttccgcgacaacttcgataagcgctcctgtcattacgaacatggcgggtacgaaaggcccccatcccactgccaggagaacgatggaagcgtggaaatgagagacgtccacaaggatcagcagctccggcacaccccttactctatcaggtgcgagcgcagaatgaaatggcattcagaagatgaaatccggataactacctggcgaaatagaaagccccccgaaaggaagatgtcacagaatacacaggatggttacaccagaaattggttcaaagtgaccatcccctatggcattaagtacgacaaagcctggctcatgaatagtatccagtcacattgttccgataggtttacaccagtggactttcactacgttcgtaatcgcgcgtgtttcttcgttcaggacgccagcgctgcatctgcgctgaaagacgtgtcctacaaaatctatgacgatgagaaccagaagatttgcatattcgtaaaccactctactgctccttacagtgtcaaaaacaagctaaaaccagggcagatggaaatgctgaaactgaccatgaacaagcgatacaatgtcagtcagcaggcccttgatcttcagaacctccgtttcgatcctgaccttatgggccgcgacatcgacatcattctgaacagacggaactgcatggctgccaccctgaaaatcatagaaaggaacttccctgaactgctgtctcttaatttgtgcaataataagttatatcagctcgatggcctcagcgacattaccgagaaagcaccaaaagtcaaaacattgaacctgtcaaaaaataagcttgagtcagcttgggagctgggcaaggttaaggggctgaaactggaagagctgtggctggagggaaatcctctgtgctctacatttagcgatcaaagtgcttacgtttccgcaattagagactgttttcctaaactgctgcgtttagatggccgggagctttccgccccagtcattgttgacatcgacagctcggaaactatgaagccctgcaaggagaatttcaccggcagcgaaacgctcaaacaccttgtcctacaattcctgcaacagtactacagcatatacgattccggcgatcgccagggtctcttaggtgcctaccatgatgaagcctgtttctccctcgcaattccttttgaccccaaagattccgcaccctccagtctttgcaaatattttgaggatagccgcaacatgaaaacgctcaaagatccatacttgaaaggagaactgctgcgaagaaccaagcgtgatattgtcgactctctgagcgcactccccaagactcaacatgatctgtcatctattctcgttgacgtatggtgtcaaactgagagaatgctgtgtttctccgtcaacggggtcttcaaggaggtggaaggacagtctcagggaagtgtgcttgcttttacccgaacatttatcgcaacgccaggatcgtcctcaagcctttgtatcgtgaacgacgagctgttcgtgagggacgcgagccctcaggaaactcaaagcgctttctcaatccccgtttctaccctatcaagctcctcggagccaagtttgtcccaagagcaacaagagatggtgcaggccttttccgcccagagcgggatgaaactggaatggtcccaaaagtgtctgcaggataacgagtggaattacacaagggcaggacaagccttcaccatgctccagaccgaaggtaaaatcccggcggaagctttcaagcaaataagttag

SEQ ID NO: 49210 - DNA, 471 bp, Artificial Sequence
  Description of Artificial Sequence: Synthetic coding sequence
atggtggacatcctgggcgagcggcacctggtgacctgcaagggcgcaaccgtggaggccgaggctgccctccaaaacaaagttgtggcactgtactttgccgcagcacgctgcgctccaagtagagactttaccccactcttgtgcgacttctataccgctctggtcgccgaagcccgcagaccagcgccattcgaggttgtttttgtgtccgcagacgggagctctcaggaaatgctggattttatgcgcgagctacacggggcctggcttgcactgcctttccacgacccatacaggcacgagctaagaaaacgatacaatgtgacagcaatccccaaactggtgattgtcaaacagaatggtgaggttattaccaataaaggaagaaagcagatccgtgaaagaggcttggcttgcttccaggattgggtagaggccgccgacatttttcaaaacttcagcgtttag

SEQ ID NO: 49211 - DNA, 408 bp, Artificial Sequence
  Description of Artificial Sequence: Synthetic coding sequence
atggtggacatcctgggcgagcggcacctggtgacctgcaagggcgctacagtcgaggccgaggctgcactccagaacaaagttgtcgcactatattttgccgcagcaaggtgcgcgccttcaagagatttcacgcctctgctgtgcgatttctacacagccctggttgctgaggcccgcagacctgctccctttgaagtggtgtttgtctctgcagatggttcctctcaggaaatgctggactttatgagggagctccacggcgcctggctggccctgccatttcatgatccttatcgccaacgcagcctggctctgctccctcggctcgaatgttctggcgtgattctcgcccattgcaacctgtgtctgctgggctcctccgacagcctcgccctggcatcttag

SEQ ID NO: 49212 - DNA, 687 bp, Artificial Sequence
  Description of Artificial Sequence: Synthetic coding sequence
atggcccggcacgtgttcctgaccggcccccccggcgtgggcaagacgacactgatccacaaagcgtccgaggtgctcaaatcttccggcgtgcccgtggatggcttttacaccgaagaggtccggcagggaggcaggcggattggctttgacgtggtgacactcagcggaactcgcgggccgttgtcaagagtgggcctagagccacctcccggaaaacgcgagtgtagggtgggccagtatgtcgtggacctgacatccttcgaacagctggctctacccgtcttgcggaatgcagattgctcttccggccccgggcaaagggtgtgcgtcattgacgagatcggtaaaatggagctgttctcacagttgttcatccaagccgtaagacaaacactgtcaactccgggaacaattatcctgggcactatccctgtaccaaaggggaaaccactcgcccttgtggaggagatccgcaacaggaaagacgtgaaagtattcaatagcccctactgcgtgattgaagaccaaagtaaattttcaagttgcgtgtcccagtctactttgactgagccgggttggaggcagaagctcttgcaatcattactgaactcagaatggaagaagagggcccctgtggtacccacttcagtgtccccgcctttctacctgcgttggatcccatag

SEQ ID NO: 49213 - DNA, 573 bp, Artificial Sequence
  Description of Artificial Sequence: Synthetic coding sequence
atggcccggcacgtgttcctgaccggcccccccggcgtgggcaagacaaccctcatccataaggccagtgaagtgctgaagtcgtccggcgtgcccgtggacggcttttataccgaggaggtccggcaaggaggtcggagaattggcttcgatgtcgtcactctgtctggaacccggggacccctgagccgtgtgggcttggagcccccgccagggaaacgcgaatgcagggtcgggcaatacgtggtggatctaacatccttcgaacagctcgcccttcccgtcctgcgtaacgctgactgctcttctggccccggccagagggtttgcgttattgatgagattgggaagatggaactttttagtcagctattcatccaggctgtgaggcaaaccctttccacaccaggaactattatactgggtacgatccccgtgcctaaaggaaaaccacttgccctggttgaagaaattaggaaccgcaaggacgttaaagtgttcaatgtgactaaggagaatcggaaccacttgcttcctgacattgttacgtgcgtccagagctctaggaaatag

SEQ ID NO: 49214 - DNA, 324 bp, Artificial Sequence
  Description of Artificial Sequence: Synthetic coding sequence
atgatggagggcctgggcgagcacagcaccgccggcgagatgggccccttgttgggagcggtcgcagccactgcctcaccccagtccctcatggagtactcgtcagatgccgactttattgagagtctccctttggtggtgaaatatagggtttatacgttaaagaaactgcaggccaagtgtgccgtgttggaagcaaagtatctgcgagaattccatagtgttgagcgaaaatttgcgactatttacggtccactgttggaaaagagaagacagatcaccaatgcgctctacgaacccaccaaagaagaatgcgagcgttag

SEQ ID NO: 49215 - DNA, 3042 bp, Artificial Sequence
  Description of Artificial Sequence: Synthetic coding sequence
atgtgcagccaggaggccttccaggcccagcggagccagctggtggaacttttagtttcggggagtttggaaggcttcgagagcgtactcgattggcttctgtcctgggaggtactgtcttgggaggactacgagggttttcacctgctgggccaaccactgagtcatctcgcccgcaggctcctggatacggtttggaacaaggggacatgggcctgccagaagctaattgccgccgcccaagaggcccaggctgatagtcagagccctaagctacatggctgctgggaccctcactcactgcaccccgcccgcgatctgcagtcacatcgccccgccatagtgaggaggctacattcgcacgtagagaacatgctggacctagcgtgggaacgaggctttgtgagtcagtatgaatgcgacgagattcgactgccgatattcacccctagtcagcgggctcgccgcctgctcgacctggccactgtaaaagccaacggactggccgcctttcttctgcaacatgtacaagagttgccagttccacttgcccttccactagaggcagccacttgtaagaagtatatggcgaaactgcgaacaaccgtctcagcccagtcacgttttctgtccacctacgacggagccgaaactctgtgtctagaggatatctatacagagaacgttcttgaggtgtgggccgatgtgggaatggccggccccccccagaagtccccggcgactcttggcctggaggagcttttcagtactcccggccatttgaacgacgacgctgatacggtgctcgtagttggcgaagccggcagtgggaaaagtaccctgcttcagaggctccatttactatgggcagctgggcaagactttcaggagtttctttttgtgttccccttctcatgccggcaattgcagtgtatggctaaaccactgagcgtgagaaccctgttgtttgagcactgttgctggcctgatgtggggcaagaggatattttccaattgctactagaccatcccgacagagtgctcctgacgttcgacggcttcgacgaatttaaattcagattcacggatcgagagagacattgcagccccaccgatccaactagcgtgcagaccctactcttcaacctgctccaggggaacttactgaaaaatgctcgaaaagttgtgaccagtcgccccgctgctgtgagcgcatttttgcggaagtatatcagaacggagttcaacctcaaggggtttagcgaacaggggatcgagctatatcttaggaagagacatcacgagccaggcgtggccgacaggctcatacgcctgctgcaagaaacgagcgctctccacggtttgtgtcacctgcccgtattcagctggatggtttcaaagtgtcaccaggaactgttactgcaggaaggcgggtcccctaaaacaacaacagatatgtatctgctgattcttcagcatttcctgttgcatgccaccccacctgatagcgcatcacagggcctagggccaagcttgctgagagggcggttgccgactctgctgcacctgggccgcctcgccctgtggggactgggcatgtgctgctatgtgttttctgcacagcaattacaggcagcccaggtatccccagacgatatctcgttagggtttctcgtgcgagccaagggtgtggtgcccggctccacagctccattggagtttctgcacataacatttcaatgcttctttgccgcgttttacctcgccttgtctgcggacgtgcctcctgctctcctgaggcacctgtttaactgtggaagacccggaaattcccctatggctaggctactgcccaccatgtgtatccaggctagtgaggggaaggactcctcagtcgccgccttgctccagaaggcagagcctcacaacttgcagatcacagctgcattcctcgcaggcctgttgtcccgggaacattggggcctgcttgcggaatgtcagacaagcgagaaggcattgctgcgcaggcaggcttgtgcccgctggtgcctggccaggagcctgcgcaagcactttcacagtatccctcccgctgcaccaggggaagcgaagtccgttcatgctatgcctggcttcatatggctgatccgatcactgtacgagatgcaggaggaacggctcgccagaaaagccgctcgaggtctgaatgttggccacttaaaattgacattctgcagcgtagggcctacagaatgcgccgccctcgctttcgtcctgcaacacttgagacgtccagtagcccttcaacttgactacaactctgttggggatataggggtggagcagctgctcccatgtctcggagtgtgcaaggccctttatctccgggacaacaatatctccgatagaggaatttgcaagttgatagagtgtgccctgcactgcgaacagctgcagaagcttgcattgtttaacaacaaactaaccgacggctgcgcccacagtatggccaaactgctggcctgccgacaaaactttctggctctcaggctgggcaataattacatcaccgccgccggcgcgcaggtgcttgcagaggggttacggggtaatacctcattgcagttcctggggttttgggggaacagagtaggcgatgagggagcccaggccttggcggaggcccttggggatcaccaaagtctgagatggttgtcccttgtgggtaacaatattggcagcgttggggcccaggccttagcgctaatgctcgctaaaaacgtgatgttagaagaactgtgcctcgaggaaaatcatctccaagacgagggcgtctgttcactggctgaaggactaaaaaaaaatagctctttaaaaattctaaaattgagtaacaattgtatcacttaccttggtgccgaagccttactgcaggccctggagagaaatgacaccatcctagaagtatggctgcgcgggaatacttttagcctggaggaggtcgataaactcggctgccgagacacacgtctgctcctctag

SEQ ID NO: 49216 - DNA, 441 bp, Artificial Sequence
  Description of Artificial Sequence: Synthetic coding sequence
atgtgcagccaggaggccttccaggcccagcggagccagctggtggaacttctcgtctcaggcagtctcgagggtttcgagtctgtcctagactggctcctaagttgggaggtgctctcgtgggaggattacgaagggtttcacctgctcggacagcccctatcacacttggcacgccgattactcgatactgtgtggaataaaggtacatgggcatgtcagaaattgatcgccgctgcccaggaggcccaggccgacagtcaatcccccaagttacacgggtgctgggaccctcacagtcttcaccccgctcgggatctgcaaagccaccgccccgccatcgtccggagattacattcccacgtggaaaacatgttggatctggcctgggagcgaggtttcgtgtcacagtatgagtgtgatgagattcgcctgccttag

SEQ ID NO: 49217 - DNA, 1752 bp, Artificial Sequence
  Description of Artificial Sequence: Synthetic coding sequence
atggaggtggccgccaactgcagcctgcgggtgaagcggcccctgttagaccccaggtttgagggctacaagttatcactagagccccttccctgctaccaactggagttggatgcagcggtggctgaggtgaagctccgggacgaccagtacacattggagcacatgcacgctttcggtatgtacaactatctccactgcgatagttggtaccaagactctgtctactatattgacacactgggaagaattatgaatttgacggtgatgctggatacagcgctaggtaaaccccgagaagtcttcaggctgccaactgacttgaccgcatgtgacaacagactgtgcgcctctatccacttcagctcctcgacctgggtgaccctgtccgatgggacaggtcggctgtacgtaatcggaacgggggagagaggcaatagcgcgtccgaaaagtgggagatcatgttcaatgaggaacttggtgacccctttatcatcatccacagcatctccctgctgaatgcggaagagcattcgatagccacacttctccttcgaattgagaaagaggagctagacatgaaaggaagtggcttttatgtttccctcgagtgggtgaccataagcaaaaaaaatcaggataataagaagtacgagatcatcaagcgcgatatacttaggggtaagtctgttcctcactatgctgctatcgagccagatggcaatgggcttatgatcgtctcctacaagtcgcttactttcgtgcaggccgggcaggatctagaggagaacatggacgaggatattagcgaaaaaattaaagaacccttgtattactggcagcagacagaggatgatctgaccgttacaatcaggctgcccgaagacagcactaaagaagatatccagattcagttcttgcccgaccacattaacatcgtcctgaaggaccatcagttcctcgagggtaagctgtactcgtccatcgaccatgaatcctcaacgtggatcataaaggaaagtaacagtctggagatcagtctgatcaagaagaatgaaggtctcacctggcctgagctggttattggcgacaaacaaggagagctgatccgggacagcgcccagtgcgctgctatcgccgagcggctgatgcacttgacttcagaggagctcaacccgaatccagacaaagaaaagcctccttgcaatgctcaggaactggaggagtgcgatatctttttcgaggagtccagctcactgtgcagatttgacggcaacaccttgaaaactactcacgttgtgaatctgggttctaatcagtacctgtttagtgtcatcgtggacccgaaagaaatgccatgtttctgtctccggcacgacgtcgacgccctgctgtggcaaccccacagcagcaagcaggacgatatgtgggaacatatcgctacattcaatgctctcggatatgtgcaggccagcaaaagggacaagaaatttttcgcgtgcgctccgaactacagttacgccgccctctgcgagtgtcttagacgtgtgttcatttataggcagcctgcgcccatgagtactgtcctgtataatagaaaggagggccgccaggtcggccaggtcgcaaagcagcaggtagcgtctcttgaaacaaacgaccctatacttggcttccaggctaccaatgaaagactctttgttctcacaacaaaaaacttgtttctcatcaaggtcaatacggaaaattag

SEQ ID NO: 49218 - DNA, 1665 bp, Artificial Sequence
  Description of Artificial Sequence: Synthetic coding sequence
atgctgtacctgcagggctggagcatgcccgccgtggccgaggtgaagctgcgggacgaccagtataccctcgaacacatgcacgctttcgggatgtacaactatctgcactgcgattcatggtaccaagattcagtgtactacatcgatactctggggcggattatgaacctgacagtcatgctggacaccgcactgggcaaaccgcgcgaggtttttaggctgcctactgaccttacagcctgtgataatcgcctgtgcgccagtatccacttcagctccagcacatgggtgactctatctgatggaaccgggaggctgtatgtgattggaactggagaacggggtaatagcgcctctgagaagtgggaaattatgttcaatgaagagttgggcgaccctttcatcatcatccatagcatttccctattgaatgctgaagaacattctatcgctacacttctgctgaggatagagaaagaggagctcgacatgaagggttccgggttctacgtgtctctggagtgggtgaccatcagcaaaaaaaaccaggataataaaaagtacgaaattataaagcgcgacatcttacggggcaagtccgtcccgcactacgccgcaatcgaacccgatggcaacggcttaatgattgtcagctacaagtctctgacatttgtacaggccggacaggacctggaagaaaatatggatgaggacatcagcgagaagatcaaagaacccctatactattggcaacaaaccgaggatgatctgacagttacaatcaggttgccagaagattcaaccaaggaggacattcaaatccagtttctacccgatcatattaatattgtattgaaggaccatcaatttttggaaggtaaattgtattccagtatcgaccatgagagttcgacttggatcatcaaggagtccaatagtctggagattagcctgatcaaaaagaatgaaggtttaacatggcctgagctggtgatcggggataagcagggagagctcatccgggacagcgcgcagtgcgccgctatcgctgaaaggctcatgcatttgacaagtgaagagctgaatccaaaccccgacaaggagaaacctccttgcaacgcacaggaactggaagagtgtgacatcttcttcgaagaatccagcagtctgtgtagattcgacggcaacactctgaaaaccactcacgtagtgaacctgggctcgaaccagtacctcttctcagtgatcgtggacccaaaggaaatgccctgcttctgtctgcgccacgatgttgacgcgcttctctggcagccccattccagtaaacaggacgatatgtgggaacacatcgccacctttaacgcgctaggttacgtgcaagcgtcaaagcgcgataagaaattcttcgcctgcgccccaaattattcatatgccgctctgtgtgagtgtctgcggagggtgttcatctatcggcagcccgctcctatgtcaacggtgttgtacaatcggaaagagggcaggcaggtcggacaagtggctaagcagcaagtcgcatcactcgagaccaatgaccccatcctggggttccaggccactaacgaacgcctcttcgtgctgacaaccaagaacctatttcttatcaaagtgaacacagagaattag

SEQ ID NO: 49219 - DNA, 474 bp, Artificial Sequence
  Description of Artificial Sequence: Synthetic coding sequence
atgagcgcccccttcgaggagcggagcggcgtggtgccctgcggcacgccttggggccagtggtaccagacactggaagaagtgtttatagaggtacaggtgccccctggcacaagagcccaggacattcaatgcggactgcagtctcgccacgtcgctctgtctgtgggtggtcgggaaatccttaagggcaagctttttgactcaacaattgccgatgaagggacatggactctcgaggacagaaaaatggtcagaatagtactcacgaagaccaagcgcgatgcggcaaattgctggacctccctcttggagtctgagtacgcagccgacccgtgggttcaggaccagatgcagcgcaagctgaccctggaaagattccaaaaggagaaccccggcttcgatttctccggcgccgagatctctggcaactatacaaagggcgggcccgacttctccaacctggagaagtag

SEQ ID NO: 49220 - DNA, 1086 bp, Artificial Sequence
  Description of Artificial Sequence: Synthetic coding sequence
atggagaccggcgccgccgagctgtacgaccaggccctgctgggcatccttcagcatgtaggaaacgtgcaggacttcctgcgtgtgctgttcgggtttctctatagaaaaaccgacttttacaggctcctgaggcatccaagtgaccggatggggtttcctcctggcgccgcacaggccttagtgctgcaggtgttcaaaacgtttgaccacatggcccggcaggacgatgagaagaggcggcaggagcttgaagagaagatccgacgcaaggaggaagaggaagccaagacagtgagcgccgcagccgccgaaaaagaacctgtacctgtacccgtgcaggagatcgaaatagattcaaccaccgaactggacggacaccaggaagtggaaaaggttcaacccccagggccagtgaaggagatggcccacggctctcaagaagctgaggcgccaggtgccgtcgcaggggccgctgaggtccccagggagcctcctatcctgcccagaattcaggaacagttccaaaagaatcccgatagttacaatggagccgtccgcgagaattacacttggtcccaagactacaccgaccttgaggtgagagtacctgtgcccaaacacgttgtgaaaggaaagcaggtcagtgtggctctttccagctccagcatcagggtggccatgttggaggagaatggagagcgagtcctgatggagggaaaattgactcacaagattaacaccgaatccagcctctggtccctcgagccgggcaaatgtgtgctggttaatctgtctaaggtgggggaatattggtggaatgctatccttgaaggggaggagcctatcgacatagacaagatcaataaagagcggtccatggctacagttgatgaagaagaacaggctgtgctggacagattaactttcgactaccaccagaagctacaggggaagcctcaaagccatgagctaaaggtccacgaaatgctcaaaaaaggttgggatgctgagggtagcccctttcgcggccagcgctttgatccagcgatgttcaacatcagcccaggggccgtgcagttctag

SEQ ID NO: 49221 - DNA, 495 bp, Artificial Sequence
  Description of Artificial Sequence: Synthetic coding sequence
atgaagtgcaagcccaaccagacccggacctacgaccccgagggcttcaagaagagagcagcttgtctttgttttagatctgaaagggaagatgaggtcctcctggtttcctctagtcgctatcccgaccgctggattgtccccggcggcggcatggagcccgaggaagagcccgggggagccgcagtacgagaagtatatgaggaggcgggtgtgaaaggcaagttgggccgtctgctgggcgtgtttgagcagaatcaggatcccaagcatcggacctacgtgtatgtgttaacagtcacagagctcttagaggactgggaggacagcgtgagcatcggaagaaagcgcgagtggtttaaagtggaagacgcaatcaaggtgcttcagtgtcacaaaccagtgcatgctgagtacttagagaaactcaagctcggaggatcaccaacaaacggaaacagcatggccccctcatctcccgactctgacccgtag

SEQ ID NO: 49222 - DNA, 495 bp, Artificial Sequence
  Description of Artificial Sequence: Synthetic coding sequence
atgaccgccagcgcccagccccggggccggcggcccggcgtgggcgtcggcgtggtagttacatcatgtaagcatccgcggtgtgtgttgctgggaaagaggaaagggtccgttggcgccggttcctttcagctccccggcgggcaccttgaatttggggaaacatgggaggaatgtgcgcagcgagaaacttgggaggaggctgctcttcatttaaaaaatgtacacttcgcctcagttgtgaactcctttatagagaaggagaactatcactatgtgacgatcctcatgaagggtgaggtcgatgttacccacgattcagagcctaagaacgttgaaccagagaagaacgaaagttgggaatgggtcccctgggaggaactgccgccactcgatcagttgttctggggccttcgctgtctcaaagagcagggctatgatcctttcaaagaagatctcaaccacctggtcggctacaagggcaaccacctctag

SEQ ID NO: 49223 - DNA, 987 bp, Artificial Sequence
  Description of Artificial Sequence: Synthetic coding sequence
atggccgaggtgcgggtgcagctgctgctgagccggcggcccgagtcagtgtcattcgcacgatctgtttgcggactactcggggcgggaccggggctgggtacatggcccatccattgtagtctgaagcgcggccggctggtgctttcctcccgcccgttcccaggcgcttcagctaggctgccgcttcagcggccccctttttgtccatttgcggctctcgaggagagaccccgggtacctggcgcagaattaccgaccgatcgcggggtcgatctgggcgtggccgtaatccttcaaagtagcgacaagacggttctgctgacccgtcgtgcacggactctgtccgtcagtccaaacctgtgggtacccccaggcggacacgtagagcttgaagaggagcttctggacggggggctgagggaactctgggaggaaagcggactgcatctcccacaagggcagttctcatgggtgccccttggactctgggagtctgcctaccccccccgtttgtcttggggcctgcccaagtaccaccatatcgtactttatttgttagtgatctcacaggaatctcagcagcagcttcaggcacggattcaacctaacccaaacgaggtaagcgcactgatgtggctgacccccgatgtcgcagccgctgttgccgctgcagaggacggaacagaaacccccggactactgccacaggacctcccacccagtgtcttggctgtagagctagaggaagacgggcgagccaggccgctggtgctgcacatgtccacactgctgagaatgatcccaaccatggctgaagataaggaacgggtttcaacggggacaaagtttgccctcaagctgtggctgcaacatctagggcgtacccctccaccatgcaaatctgcggcatacttggatccaggaccagccaaggaggagtggaacatggaccccttaccgcctaatcaaggtagcggcaagtag

SEQ ID NO: 49224 - DNA, 555 bp, Artificial Sequence
  Description of Artificial Sequence: Synthetic coding sequence
tgagccgtgatcctgcagagcagcgacaagaccgtgctgctgaccaggagggcccggacactgagcgtctcccctaacctgtgggttcccccaggaggactcagagagctttgggaagagagcggattacacctgccacagggccaattctcctgggtgcctcttggactatgggagagcgcttatcctccccgtttatcatgggggctcccgaaataccatcacatagtgctgtatctcctggtgatatcccaggagtctcagcagcagctgcaggccaggatccagcctaacccaaacgaggtttcagcattgatgtggttgactcctgatgtggccgccgcagtcgctgccgccgaggatggaacagagactcccggtctccttccgaggacaagagggggatggaaaagtcctacctccggccccgctcacgttcaccccccagctgacgatcccaaccatggacggggtcagagagaatcccagcattggaaccaggtgtgcccacaagctcttgctgccacatccggtcaaaacactccaactgtgtag

SEQ ID NO: 49225 - DNA, 972 bp, Artificial Sequence
  Description of Artificial Sequence: Synthetic coding sequence
atggccagcgagggcctggccggcgccctggccagcgtgctggccggccaagggtccagcgtgcattcctgcgactccgcccctgctggggaacctcctgctcccgtcagactgaggaaaaatgtttgctatgtggttttagctgtttttctgtcggagcaagacgaggtgctgttgattcaggaagcaaaacgggagtgccggggaagttggtatttgcctgctggccgaatggaaccaggtgaaactattgtggaggctctccagagggaagtaaaggaagaggctggcctgcactgtgaacctgaaacattgctttctgtggaagagcgcgggccaagttgggtccggtttgtttttttggccaggcccacgggcggtattctgaaaacaagcaaagaagccgacgccgaatccttgcaggctgcttggtaccctcgcactagtcttccaacccccctgagagcacacgatattttgcacttggttgaactggctgcgcagtacagacagcaggcgcgacatcctctgattctaccgcaagaactgccttgtgacctggtgtgtcagaggttggtggctaccttcacctcggcacagacagtgtgggttcttgtcggaaccgtgggcatgccgcacctcccagtgaccgcctgtggcctggacccaatggaacagaggggaggaatgaagatggccgtgttacgactcctccaggaatgcctaaccctgcatcatctggttgtggagatcaaggggctactgggtcttcagcatcttggtcgcgaccacagcgatggaatatgcctcaatgtgctagttacggttgcatttaggtctccaggcatccaggatgagccccccaaggtacgcggcgagaacttcagttggtggaaggttatggaggaagatctccagtcccaactgctccagagactgcaggggtcatcagtggttcccgttaatcgttag

SEQ ID NO: 49226 - DNA, 180 bp, Artificial Sequence
  Description of Artificial Sequence: Synthetic coding sequence
atggccagcgagggcctggccggcgccctggccagcgtgctggccggacagggcagctccgttcatagttgcgatagtgctcctgcgggagaaccccccgcccctagagcaggatgcggacggacgtgtgcaacctggtgttggccctgcagttctgccagtagaatgcgatgctactag

SEQ ID NO: 49227 - DNA, 741 bp, Artificial Sequence
  Description of Artificial Sequence: Synthetic coding sequence
atggagcccggcgagaccatcgtggaggccctgcagcgggaggtgaaggaagaagctgggctccattgcgaacctgagaccctgctatccgtagaagaaagagggccatcctgggtcagattcgtctttcttgcccggccgactggaggaattctgaagaccagcaaggaagctgacgccgagtcactgcaggcagcatggtatccacggacaagcctgcccacccctttgcgcgcccatgacatcctccatctagtagagctcgccgcccaatacaggcagcaggcaagacacccactgatcctgcctcaagaactgccctgcgacctcgtgtgtcagcgcctggttgcaacctttacttctgcccagacggtctgggtgctcgtcggaacagtcggaatgcctcacttgccagttaccgcctgcggacttgacccaatggaacagagggggggaatgaaaatggctgtcctgcgcctgctgcaggaatgcctgacccttcatcacctagtagtagaaatcaaagggctccttggattgcagcacttgggaagagatcatagcgacgggatctgtctgaatgtgttggtgaccgtcgccttcagaagcccaggaatccaggatgagccgccaaaagttcgcggggaaaacttctcgtggtggaaggtgatggaggaggatctccaatctcagctcctccagaggctccagggtagtagtgttgtccccgtgaataggtag

SEQ ID NO: 49228 - DNA, 1128 bp, Artificial Sequence
  Description of Artificial Sequence: Synthetic coding sequence
atgagcagcagcctgcggcccggccccagccggtggcggcgggccgccagcatcgttttggccgccggatggagtcgacccgagactgctacccctccttccagacctcctcccgctgagggctttaggttgcttcttcttcagcggagtcctcatcaaggtttcatgccaggggcccacgtgttcagcggcggcgtcctcgatgcagccgatagatcagccgattggttaggactattcgccccccaccacggcccacccaggtttggtttaggcccagccccttttagtaggacagctttcccctcgcttccagacactgatgatcataaaaccgataatactggaaccctgcctgaggatgtcgctttcaggatttgtgccgtccgtgaggcctttgaagaagcaggggttttgctgctcagacctcggactagtcctccgggtcctgcccctgggcccgggctggccctggaaccacctcccggattagcatcatggcgtgaccgcgtgcggcaggacccccgacactttcttcgtctgtgtgcccacctggactgtaccccagacatctgggcgctccataactggtcagcatggcttacaccatttcttcgggggactacaaggaggtttgataccgcctttttcttatgttgccttcgagaaccacccccagtgtatccagacctagcggaagttgtgggctatcagtggtcatcgccgagcgaagcgaccgagtcattcctctctaaggagatctggctcccaccacctcaattctacgaagtgaggagactggctaactttgcctccctgtcagaccttcataagttctgcttgggccgggctctcgagggcctggagcgatggttgccaattatccttctgacggcagacggcatggtccatcttctccccggagatgaactataccttgaagatagtgattttctggaaaacctaatgtccactgagaaaaagacagaagagataatgaaggaagggaaacagttccaccgtattgtgacgtatcaccggcacctatatgacattcatgtgacagtacagcctaagtacaagcacgtctatcccaaaaactctgtggtcagaaagtcccacctttag

SEQ ID NO: 49229 - DNA, 912 bp, Artificial Sequence
  Description of Artificial Sequence: Synthetic coding sequence
atggaccccgaggtgaccctgctgctgcagtgccccggcggcggcctgccgcaagagcaaattcaggcagagctttcccctgcccacgatcggcgcccccttccaggaggcgatgaggcaataacggctatctgggagacaaggcttaaggcccagccctggttgttcgacgcaccaaaatttagacttcatagtgcaacgctggctccaattggctcccggggtccacagcttctgctgcggctcggtttgacatcttaccgcgatttcttggggacgaattggtcaagcagcgctgcctggctgcgccaacagggcgctacggactggggagatacacaggcgtatctggctgaccccctgggggtcggggcggccttagccaccgctgacgacttcttggtcttcctgagaagatctcgtcaggtggcggaagctcccggcctagtggacgtccccggcggccaccctgaaccacaggccctgtgtccaggtggctctccccaacatcaagatttagccggccaactggtggtgcacgagcttttcagctcagtgctgcaggagatttgtgacgaggtgaacctgccccttctgacccttagccagccgctgctgctcggcattgctaggaacgagacctccgcaggacgcgcgagcgctgagttttatgtccagtgtagcctaacttctgaacaggtcagaaagcactatctgtctggcggaccagaggctcacgagtctacgggcattttctttgttgaaactcaaaacgtgcagcgccttttagagactgaaatgtgggctgaactttgtccttcggccaagggagcaatcatactttacaatagagtacagggatcccccaccggtgcagccctaggttctccagcactactgccacccttatag

SEQ ID NO: 49230 - DNA, 813 bp, Artificial Sequence
  Description of Artificial Sequence: Synthetic coding sequence
atggaccccgaggtgaccctgctgctgcagtgccccggcggcggcttgcctcaggagcaaattcaggcagaactgtcacccgcccacgatcgcaggccgctgcccggaggcgatgaagctatcaccgcaatttgggaaactcgcctgaaagctcagccctggctatttgatgctcctaagtttcggctccactctgcaacactggctccaataggctcacggggcccacagctcttgctacggttgggattgacaagttatcgcgactttctcggcactaattggagctctagcgctgcttggctgaggcaacaaggggccactgactggggagatactcaagcctatcttgccgaccccctaggagtaggggccgctctagcaacagcagatgactttctggtgtttctgcggcgatcccgtcaggtggccgaggcccctggcttagtcgacgtgcctggggggcaccctgaacctcaagtcaacctgcccctcctgactctgtcacagcctctgctgctggggattgccagaaatgaaacaagtgctgggcgggcaagtgcagagttctatgtccagtgtagtctgacaagcgaacaggttaggaagcactatctgtcaggggggccggaagctcatgaatcgacaggtatattctttgtggaaacacagaatgtgcaaaggctgctggaaactgaaatgtgggccgaactgtgccccagtgcgaagggtgccattatattatacaatagagtgcaggggtcaccaactggggcggcactggggagcccagccctgctgcccccgctgtag

SEQ ID NO: 49231 - DNA, 639 bp, Artificial Sequence
  Description of Artificial Sequence: Synthetic coding sequence
atggaccccgaggtgaccctgctgctgcagtgccccggcggcggcctaccacaggagcagatccaggctgagctgtcccctgcccacgatagacgtccccttcccggcggggacgaggccataacagcaatctgggagactcggttgaaagctcagccttggctttttgatgctcctaaatttcggctacactctgcaacactagcacctatcggaagcaggggcccacagctgttgcttcgtctcgggcttacttcatatagagatttccttggcaccaactggtccagctctgctgcctggttgaggcagcagggggcgaccgactggggcgacacacaggcctatctggcagatccactgggagtgggggcagccctggcgaccgctgacgacttcctcgtgtttctcaggcgctcacgccaagtggccgaagctccagggcttgttgatgttccaggtgggcatccagagcctcaagttcgatttcaggcaggccataaggatcctgactcgagcagggaactccagcttagcactctccccatcctgccagccctggtcagtagtctcaagggaaaacttgcctggtacttctctggctccttgttgcgtgccgtccaccttcccccccattag

SEQ ID NO: 49232 - DNA, 375 bp, Artificial Sequence
  Description of Artificial Sequence: Synthetic coding sequence
atggaccccgaggtgaccctgctgctgcagtgccccggcggcggcctgccccaggagcagatacaggcagagctaagtccggctcatgatagacgcccactccccgggggcgacgaggccatcacagccatttgggaaacaagactgaaggcacagccatggctgtttgatgccccgaagttccgactgcactcagccactctggcccccatcgggagcagagggcctcaactgttactccgcctaggacttaccagctaccgcgatttcctcggtacaaactggtctagtagcgctgcctggctgagacagcagggggccactgactggggcgacacacaggcctacctggctgatccccttggggttggctag

SEQ ID NO: 49233 - DNA, 546 bp, Artificial Sequence
  Description of Artificial Sequence: Synthetic coding sequence
atgatgaagttcaagcccaaccagacccggacctacgaccgggagggcttcaaaaaaagggccgcctgtctgtgcttcaggtctgagcaagaagatgaagtcctcctcgtcagttcttctcggtatcccgaccagtggattgtgcctggaggtggcatggaaccagaggaggagccaggcggggccgccgtccgggaagtttacgaggaagctggggtgaaaggtaaactggggagactattggggatctttgaacagaaccaggaccgaaagcataggacttacgtctatgtgctgaccgtgacagagatactggaggactgggaagacagcgtgaacatcgggagaaagagagagtggtttaaggtcgaggacgcgatcaaggttctgcagtgccacaagcccgtgcacgctgaatatctggagaaattaaaactgggatgctctcccgccaatggcaacagcacggttccatcgctgccagataataatgcgttgtttgtaactgccgcccagacctcaggtctaccctctagcgttaggtag

SEQ ID NO: 49234 - DNA, 543 bp, Artificial Sequence
  Description of Artificial Sequence: Synthetic coding sequence
atgatgaagttcaagcccaaccagacccggacctacgaccgggagggatttaaaaagcgggctgcctgcctgtgcttccgttccgaacaagaggacgaggtcctcttggtgagctcatctaggtatcccgatcaatggatcgtccctggggggggaatggagcctgaggaggaaccagggggggcggctgttagagaggtttatgaggaagcaggcgtgaaagggaagctggggcgtcttttagggatattcgaaaaccaggaccgcaaacatcgcacctatgtgtatgtgctgactgtcactgaaattctggaagattgggaagacagcgtgaacatcggaagaaagagagaatggttcaaagtcgaagacgccataaaggtgctacagtgtcacaagcctgtccacgccgagtaccttgaaaaactcaaactcgggtgcagtccggctaatgggaatagcactgtccctagcctccctgataacaacgccctctttgttacagctgctcagacatccggactgccttcgtccgttaggtag

SEQ ID NO: 49235 - DNA, 390 bp, Artificial Sequence
  Description of Artificial Sequence: Synthetic coding sequence
atggagcccgaggaggagcccggcggcgccgccgtgcgggaggtgtacgaggaggccggtgtgaagggcaaattgggtaggctgctcggaatttttgaacagaatcaagaccgtaaacatagaacatatgtttacgttctcacagtgactgagatccttgaagactgggaggattccgtaaatattggacggaagagggagtggttcaaagtcgaggacgccatcaaagtcttgcaatgccacaagcctgtgcatgccgaatacctggaaaagctgaagcttggctgctccccagccaatggaaacagcacagtgcctagcctgcccgataacaatgcattattcgtgaccgctgcacaaaccagtggcctcccaagcagcgttaggtag

SEQ ID NO: 49236 - DNA, 543 bp, Artificial Sequence
  Description of Artificial Sequence: Synthetic coding sequence
atggagagccaggagcccaccgagagcagccagaacggcaagcagtacatcatttccgaggagctgatctcagagggaaagtgggtcaaattagagaagactacctatatggatccaactggcaagactaggacctgggagagcgtaaagcggacaacacgaaaggagcagaccgccgacggtgtcgctgtgattcccgtgctgcagcgcaccttacattacgagtgtatcgtactagttaagcagtttagacctcctatgggcgggtattgcatcgaattcccagccggactcatcgacgatggtgagacacccgaggcggcagccctacgagagctggaggaagagaccggatacaagggggacatcgccgagtgttccccagctgtctgcatggaccctggactctccaattgcaccatccatattgtgaccgtcaccatcaacggagatgacgcagagaacgcacggcctaaacccaaaccgggggatgggggcatgttttgcaacagctggtggccgtctgtttacgacctggtctag

SEQ ID NO: 49237 - DNA, 699 bp, Artificial Sequence
  Description of Artificial Sequence: Synthetic coding sequence
atggagagccaggagcccaccgagagcagccagaacggcaagcagtatattatctccgaagagctcattagcgaagggaagtgggtgaagttggagaaaacaacctacatggatcctaccggcaaaaccagaaggaacaaggaaaaaaccacaacactcctgattctacgcacgtgggagtctgtcaaacgaacaactagaaaggaacagacggccgacggggtggcggtcatccctgtgctgcaacgtaccttgcactacgagtgtatcgtcttggttaagcagtttagacccccaatgggcggatattgcatcgagtttccagcaggcctgatcgacgatggcgagaccccggaggctgcagccctccgggagcttgaggaggaaacggggtataaaggggatattgccgagtgtagcccggccgtttgcatggaccccggtttaagcaactgcaccattcacattgtcactgtgaccattaacggagacgacgcagaaaatgcgaggcccaaacccaagcccggggacggtgagtttgtcgaggtcataagccttcccaagaacgacctgcttcaacggctcgacgcgctggttgcggaagagcatctgactgtggatgcccgagtctactcttacgctctcgcattgaaacatgccaacgctaagcctttcgaagtccccttcttgaagttttag

SEQ ID NO: 49238 - DNA, 561 bp, Artificial Sequence
  Description of Artificial Sequence: Synthetic coding sequence
atggagagccaggagcccaccgagagcagccagaacggcaagcagtatatcatctccgaagaactcatttcagagggaaaatgggtaaaactggaaaaaaccacctacatggaccctacgggcaagacgagaacctgggagagcgtcaagcgcacaacgagaaaagagcagaccgcagatggtgtggctgtgatcccagtcctgcagcgcacgctccactatgagtgcattgtcctggtaaagcagtttcggcccccaatgggtggatactgcatcgaatttcctgccggactgatcgacgatggggaaactcccgaggctgcagccctgcgggagttagaggaagaaactggctacaaaggcgacatcgcagaatgctcccctgccgtatgtatggatcctgggctttcgaattgtaccatccatatagtcaccgtcaccattaatggagacgacgctgaaaatgcccgaccaaagccaaagcctggcgatggcgaattcgtggaggtgatctctctgccaaaaaacgacctactgcagaggctggatgaaaccctgtag

SEQ ID NO: 49239 - DNA, 297 bp, Artificial Sequence
  Description of Artificial Sequence: Synthetic coding sequence
atggagagccaggagcccaccgagagcagccagaacggcaagcagtatatcatcagcgaggagctcatctccgaaggtaaatgggtgaaactcgagaagaccacatatatggaccccacaggaaaaaccagaacttgggagagtgtaaaaaggaccaccaggaaagagcagactgcagatggaagaagtgctaacctgttccagccttttaggaaagaggtttccacttgtgatagggtggctgtgatccctgtgctgcaacggactctgcactacgaatgtatcgtgttagtgtag

SEQ ID NO: 49240 - DNA, 660 bp, Artificial Sequence
  Description of Artificial Sequence: Synthetic coding sequence
atggagagccaggagcccaccgagagcagccagaacggcaagcagtacattataagtgaagagttgatctccgaggggaaatgggtcaagctggaaaaaacaacctacatggatcccaccgggaagacaagaacctgggaatcagtgaaaaggacgaccagaaaagagcagactgctgacggcgtggcagtcattccagtgctgcagaggacactgcattacgaatgcatcgtgttggtgaaacagtttcggccccctatgggtggttactgtatagagttccccgccggccttatagatgacggcgagacacctgaggcagccgcgctccgggagctggaggaggagacaggctataagggggatattgcagagtgttctccagcagtgtgtatggatcccggcctgagtaactgcaccatacatatcgtcaccgtgaccattaatggcgacgatgctgagaatgcaaggcccaaacctaaacccggtgacggagaattcgtggaagtgatatctctgccaaagaatgatctgttgcaacgacttgatgctctggtggccgaagagcatctgacggtggatgcccgggtctatagttacgccctggccttgaagcatgccaatgctaaacccttcgaggtgccatttcttaagttctag

SEQ ID NO: 49241 - DNA, 660 bp, Artificial Sequence
  Description of Artificial Sequence: Synthetic coding sequence
atggagagccaggagcccaccgagagcagccagaacggcaagcagtacattatttctgaggaactgatttccgagggcaagtgggtgaagttggagaagacaacatacatggaccccacaggcaagacacgaacttgggaatcggtgaaaagaactacgagaaaggagcagacggccgacggggttgcagtgattccagtactgcagcggaccctgcactatgaatgtattgttctcgtgaaacagttccggcctccaatggggggatactgcatagagttccccgcgggcttgattgatgacggcgaaacccccgaagcagccgctttgcgagaactagaggaagagacggggtacaaaggagatattgctgaatgtagccctgcagtatgcatggacccaggattatctaattgtaccattcatattgtcactgtgaccattaacggtgacgacgcggaaaatgcacgaccgaagccaaagccaggggatggggagttcgtggaagttatatccttacctaaaaacgacttgctgcagaggctcgatgccctggtcgctgaagaacacctgactgtggatgctcgcgtgtactcttatgcactggcactcaagcacgccaatgcaaagccttttgaagtcccattcctgaaattctag

SEQ ID NO: 49242 - DNA, 717 bp, Artificial Sequence
  Description of Artificial Sequence: Synthetic coding sequence
atgagccggctgggcctgcccgaggagcccgtgcggaacagcctgctggatgacgcaaaggctaggctgaggaagtacgacataggagggaagtacagccaccttccctataacaaatatagcgttctcctcccactggtcgccaaggaggggaaattacatctcctgtttacagtcagaagcgagaagctcagacgggcccctggcgaggtctgctttccaggcggtaagcgggatccgactgatatggatgacgctgccactgctttgcgcgaagcacaggaggaggtgggcttacgcccgcaccaggtggaggtggtttgctgccttgtgccatgcttgattgacaccgacaccctaatcacacccttcgttggactcattgaccataacttccaagcccagcccaaccccgctgaggtcaaagatgttttcctggtccctcttgcatactttctgcatccccaggtgcacgaccagcattatgtgacaagactcggccacaggttcattaatcatattttcgaatataccaatcccgaagacggtgtcacttaccagataaagggaatgacagctaacctggccgtgttagttgccttcatcattctagagaagaaacctacctttgaggtgcagtttaacctgaatgacgtcttggcatcgtcagaagagcttttcctaaaagtccataaaaaggccactagcaggctgtag

SEQ ID NO: 49243 - DNA, 558 bp, Artificial Sequence
  Description of Artificial Sequence: Synthetic coding sequence
atgagccggctgggcctgcccgaggagcccgtgcggaacagcctgctggacgatgccaaggccaggttgagaaagtatgacatcggcgggaaatactcccacttaccttataataaatatagcgtgttgctccccctggtcgccaaggagggcaagcttcacctgctgtttacggttcgtagcgaaaaaacagatactcttatcacgccattcgttggactgattgaccacaatttccaggcacagccaaatccggcagaagtcaaggacgtgttcctggtacctctcgcctactttctgcacccacaggttcacgatcagcattacgtcacccgcctgggccatcggtttatcaaccacatctttgagtacacgaacccagaggacggagtgacctaccagatcaaaggaatgacagcaaaccttgcagtgttagtggctttcataatcttggaaaagaaaccaacatttgaagtgcaattcaatctcaacgacgtcctagcctccagcgaagagctcttcctgaaggtacataagaaagccaccagcaggttgtag

SEQ ID NO: 49244 - DNA, 513 bp, Artificial Sequence
  Description of Artificial Sequence: Synthetic coding sequence
atgagccggctgggcctgcccgaggagcccgtgcggaacagcctgttggacgatgcgaaggctcgactcaggaaatatgacattggcgggaagtattcccaccttccctacaataaatactccgtcttgctcccactggtagcgaaggaagggaagttgcatttactgttcacggttcggagcgaaaagctaaggcgcgccccaggagaagtgtgctttcctggaggaaaaagagacccaaccgatatggatgacgctgccaccgcactccgggaggcccaggaagaagtgggcttgagacctcatcaggtcgaggtggtgtgctgtctggtgccatgcctgatcgaccggtggggctcccggtacgtggacgaggcaggcttagaactccttgcttctagcgatccccctacctcagcctcccagtcagctgggatcaccgacagatacatagataactctatctgcggatttaatcggcctcagctccccggcccagccgagagttgttag

SEQ ID NO: 49245 - DNA, 822 bp, Artificial Sequence
  Description of Artificial Sequence: Synthetic coding sequence
atgcggctgcccggcgtgcccctggcccggcccgccctgctgctgctcttgccactgctggcgcccctcctgggtacaggagcccccgctgagctccgagtcagagttcggctccccgatggccaggttacagaggagagccttcaggctgactcagatgctgatagtatctccctggaactcaggaagccagacgggaccttggtctcattcaccgccgatttcaagaaggacgtgaaagtctttagagccctcatactgggagaacttgagaaggggcagtcccaattccaggccctgtgttttgtcacgcagctccagcataatgagattatcccatcggaggctatggccaagctgaggcagaagaatcctcgcgcagtccggcaggccgaagaggtgcgaggcctggagcaccttcatatggatgtggcagttaacttctcgcagggcgctctgctgtctcctcatcttcacaacgtgtgcgcagaggccgttgatgcaatatacacgcggcaggaggacgtgcgcttttggctggagcagggagtcgattcttctgtgttcgaggctctgcctaaagcatccgagcaggccgaactgccacggtgccggcaagtgggagaccatggcaagccttgcgtctgcaggtatggcctgtcccttgcttggtacccatgcatgctgaagtactgtcattccagagacaggcctacaccttataagtgtgggatccgctcttgccaaaaatcttactcattcgacttttacgtaccccagaggcagttatgtctctgggacgaggacccttacccagggtag

SEQ ID NO: 49246 - DNA, 2205 bp, Artificial Sequence
  Description of Artificial Sequence: Synthetic coding sequence
atgcggcccgccgtgctgggcagccccgaccgggccccccccgaggacgagggccctgtcatggtgaagttggaggattccgaggaggaaggtgaggccgccctgtgggatccaggtcctgaggctgctagactacgttttagatgcttccggtatgaggaagccacaggccctcaggaagctctggcccaactgagagagctttgtagacagtggctgagacctgaggttcgtagcaaggagcagatgctggagttgctggtgctcgaacagtttttgggcgccctcccgccagagatccaggctcgggttcagggccaacgacctgggagccccgaggaagcagccgctctcgtcgacggcctccggcgcgagcctggcggcccacgccggtgggtgacagtccaggtgcagggtcaggaggtcctgtccgaaaagatggagccctcctccttccaaccccttccggaaaccgaacctcctacaccagaacctggaccaaagacgcctccacggactatgcaagagtctcccctcggtctgcaagtgaaggaggaatcggaggtgaccgaggatagtgacttcctcgaaagtggcccattggcggccacacaggagtccgtgccaacgctccttcctgaagaggctcagagatgtggcaccgtgctcgatcagatctttcctcattctaaaaccggaccagagggaccaagttggcgcgagcatcctagggccctctggcatgaggaggcagggggcattttctcccccggctttgcactccagctggggtctatctccgctggccctggaagtgtatctccgcacctccacgtgccttgggacttgggtatggccggactctccgggcagatccaatccccatcacgggaaggtgggttcgcccacgcgttgcttctgccttccgatcttagaagcgaacaggaccccaccgatgaggatccatgccggggagtaggacctgccctgatcaccaccagatggcggagtcctaggggccgttcacgcggaagaccatcaactggagggggggtggtacggggtggtcggtgcgacgtctgtggaaaagtgttcagccagcggagcaatcttttgcgccaccagaagatccacaccggtgagcgacccttcgtgtgtagcgagtgcggacggtctttttctaggagtagtcatctgctgagacatcagttgacccataccgaagaacgcccattcgtgtgcggagattgcggacagggatttgttcggtctgccaggctagaggagcacaggagagtgcacacaggggaacaaccttttcgatgtgccgagtgcggacagtcattcaggcagcggagcaatctgctgcagcatcaacgcattcacggtgatccccccggcccaggagctaagccgcctgccccaccaggcgcacccgagccaccaggaccctttccctgttcagagtgtcgcgagtccttcgcccggagagccgtcctgttagaacaccaggctgttcatactggggacaagtcttttggctgcgtggaatgcggagaaagatttggtcgaagatcagtgttgctgcagcaccgccgggtgcattcaggcgagaggccttttgcctgcgcagagtgtggccaatcttttaggcagagatcaaacctgacacagcatcggaggattcacactggggaacggcccttcgcctgtgctgaatgcgggaaggcatttcggcagaggccaacactgacccaacaccttcgggtccacactggcgagaagcccttcgcttgcccagagtgcggacagcggttctctcagaggctgaagctcactaggcatcaacgaacccacaccggggagaaaccttatcactgcggcgagtgcgggctcggcttcacacaagtttctagattgacagagcaccagcggatacacactggcgagagacccttcgcctgtcccgagtgtggccagagtttccgacagcatgccaacttgacccagcataggaggatccataccggcgaacggccatatgcttgtcccgaatgcggcaaggcattccggcagcgccctaccctgacccagcacctgcgcactcacagacgagaaaaaccgtttgcgtgtcaggattgtggtaggaggtttcaccagtctactaagctcatacagcatcagagggtccattcggccgagtag

SEQ ID NO: 49247 - DNA, 135 bp, Artificial Sequence
  Description of Artificial Sequence: Synthetic coding sequence
atgggcatgtacccccccctgctgctgaagatctacctgagccggcatatctctatcctgttttacctgaagattttgtataaaagtggaattatttggttaagctggtacagcttcattttgttagtgttatag

SEQ ID NO: 49248 - DNA, 957 bp, Artificial Sequence
  Description of Artificial Sequence: Synthetic coding sequence
atggagcggggcgaccagcccaagcggacccggaacgagaacatcttcaactgtctctacaaaaatcccgaggccacattcaagctaatctgtttcccttggatggggggaggatctactcactttgccaagtggggacaggacacccacgacctcttagaagaaactgccagccaccacgtggccaaagctggccttaaactccgacgttcttcagacccgcctgcctccgcctacccctgcgcaggggtgagtcatcgccgccgcgagcctccttgcctggcaaagattttgggtctgttctggatacttatattctttatgcactccctgagactgcctggcagggaaagcagggttgaggagcctcttgaaaacgatatatctcaactcgtcgacgaggtggtgtgcgccctccaacccgtgatccaagataagccttttgcctttttcggtcatagtatgggatcctacattgcgtttcgcaccgcactgggtctcaaagaaaataatcagcctgagcccctccacttgtttttgtctagtgcgacaccggtgcacagcaaggcttggcaccgcatcccaaaagacgatgagctaagcgaggaacaaatcagtcattacctgatggaattcggcggtacacctaaacattttgcagaggccaaagaatttgtcaagcagtgtagcccgatcattcgggcggatctcaacatcgtgagatcctgtacctcgaacgtccctagtaaagccgtgttgtcatgtgatctgacctgcttcgttgggtcggaagatattgctaaagacatggaggcctggaaggatgtgacgtccggaaacgcgaaaatataccagctgcccgggggacacttctatctactggacccagcaaacgagaagctcattaaaaactacatcataaaatgcttggaggtatcatccatatctaatttctag

SEQ ID NO: 49249 - DNA, 414 bp, Artificial Sequence
  Description of Artificial Sequence: Synthetic coding sequence
atggagcggggcgaccagcccaagcggacccggcaggccaccccctgtgcgacaagactattcctgcacccacgagggagtgacactttacccctgaacgaaaatatttttaattgcctttataaaaacccagaagcaaccttcaaactgatttgcttcccatggatgggaggtgggtcaacgcattttgctaagtggggccaggacacgcacgatctgctcgaggttcattcacttagactcccagggcgcgagagtcgggtagaggaaccactggagaatgacattagccagcttgtggacgaagtggtgtgtgccctgcagcccgtgatccaggataagccgttcgctttttttgggcatagatacctgatatcagtgctgaaagatttccgcggtgttagctcaatttag

SEQ ID NO: 49250 - DNA, 798 bp, Artificial Sequence
  Description of Artificial Sequence: Synthetic coding sequence
atggagcggggcgaccagcccaagcggacccggaacgagaacatcttcaattgtctgtataagaatcctgaagctaccttcaaattgatctgctttccttggatgggggggggcagcacccactttgctaagtggggtcaagatacccatgatttgcttgaagtgcattccctacgcctgcctggacgcgaatcccgtgtggaagaaccgctcgagaacgacataagccagcttgttgacgaggtggtctgcgcacttcagccggtcattcaggacaagccatttgctttcttcggccatagcatgggtagctatatagcgttcaggactgcccttggtctgaaagaaaacaatcagccggagccattgcacctgtttctctctagcgccacccctgttcatagtaaggcctggcatcgcattcccaaagatgatgaactctcagaggagcaaatctcccattacctaatggagtttggagggacaccaaagcactttgccgaggccaaagagtttgtaaaacagtgcagtcctatcattcgcgctgacctcaacatcgtccgcagctgcaccagtaacgtcccgtccaaggccgtgctcagctgcgatttaacgtgttttgtgggcagtgaagacatagcaaaagatatggaggcctggaaggatgttacatctggaaatgccaagatctaccagctgccaggcggccacttctatctcctcgacccagccaacgaaaagctgattaagaactatatcatcaagtgtctagaagtgtccagtatttctaacttttag

SEQ ID NO: 49251 - DNA, 291 bp, Artificial Sequence
  Description of Artificial Sequence: Synthetic coding sequence
atggagcggggcgaccagcccaagcggacccggaacgagaacatctttaattgtctctataagaaccccgaggctacctttaaattaatctgcttcccgtggatgggcggcgggtccacccacttcgctaaatggggtcaggacacccatgacctccttgaggagaccgcgagccatcatgtggcaaaggccggactgaaacttaggagatcctccgatccgccagcctcggcctatccgtgcgcaggagtgtcgcacaggaggcgcgaacctccctgtctcgccaaatag

SEQ ID NO: 49252 - DNA, 432 bp, Artificial Sequence
  Description of Artificial Sequence: Synthetic coding sequence
atggagcggggcgaccagcccaagcggacccggaacgagaacatcttcaactgtctgtataagaacccagaggcaacatttaaactgatttgctttccatggatgggaggaggttccacccattttgcaaagtggggccaggacactcacgacctgcttgaagtccactccctaagactccccggacgtgagagtagggtggaagagccgctcgagaatgatattagccagctggttgacgaggtagtgtgcgcgctgcagcctgtgatccaagataagccctttgccttttttggccactccatgggaagctacattgccttccgcactgcgctagggctgaaagaaaacaaccagcccgagcctcttcatctctttttatctagcgctacacccgtgcactccaaagcttggcatcggattcctaagtag

SEQ ID NO: 49253 - DNA, 546 bp, Artificial Sequence
  Description of Artificial Sequence: Synthetic coding sequence
atggagcggggcgaccagcccaagcggacccggaacgagaacatctttaattgcttgtataagaatcctgaggcgaccttcaagcttatctgctttccctggatgggtggggggtctacacatttcgcaaagtggggtcaggacacacacgacctgctagaggttcactccctccgcctacccggccgcgaatcacgggtggaagagcccctggaaaatgacatttcacaactcgttgacgaggtggtctgtgccctgcaaccagtcatccaagataagccctttgccttcttcgggcactcgatggggtcctacatcgccttccggaccgcattaggactcaaagaaaataatcaacccgagcccctccatctgttcctgtcttcggcaacccctgtgcattctaaggcatggcaccgtatccctaaagacgatgaactttctgaggagcagatttcccactatctgatggagttcggcggtactcctaagcacttcgcggaggcaaaggaattcgtcaaacagtgctcgccaattattcgctag

SEQ ID NO: 49254 - DNA, 957 bp, Artificial Sequence
  Description of Artificial Sequence: Synthetic coding sequence
atggccgccgccgccctgcccccccggcccctgctgctgctgcccctagtgttactgctttcaggccgccccacacgggcagatagcaaagtctttggggacctggaccaggtgcggatgacttctgagggctccgactgtagatgtaagtgcattatgaggccattatccaaggatgcatgcagtagagtgcggtccggccgggctagggttgaagacttctataccgtggagactgtgagctctggcacagattgcagatgctcttgcactgcacctccatcttcactgaacccctgcgaaaacgagtggaagatggaaaagcttaaaaaacaggctccggaactacttaaatccatcaaggccaacctgtcgagagaaaacgaggtggtgaaggactctgttagacatctgagtgaacaactgcgacactatgagaaccactcggccatcatgcttggcattaaaaaagagctgtctcgcctgggtctgcagctgttgcaaaaagacgccgctgcagcccccgctacccctgcgacgggtacaggctccaaggcacaggacaccgctagaggaaaaggtaaggatatctctaagtacgggtccgttcaaaagtcttttgccgatcgcggcttgccaaaaccccccaaagagaaactgttacaagtggagaagctccgaaaagagtccgggaagggctccttcctgcagcctacagctaagccacgcgctcttgcacaacaacaggcagtcatcagaggctttacctactataaggccggtaagcaagaggtcacggaagctgtagccgacaataccctccagggaacttcttggttggagcaattgcctccaaaagttgaagggagaagcaactccgcagagcctaatagcgcggagcaggacgaagcagaacccagatcttctgaaagagtggatctggcctccggcacctag

SEQ ID NO: 49255 - DNA, 987 bp, Artificial Sequence
  Description of Artificial Sequence: Synthetic coding sequence
atgaagctgtggatggagagccacctgatcgtgcccgagacccggccctcaccgcgaatgatgagcaatcagacccttgtcaccgaattcatactccaggggtttagtgagcaccccgaataccgagtgttcctcttcagttgctttctgttcctctatagcggcgctctaactggcaacgtgctgatcacactggcaataacgtttaatcccgggctccatgctccgatgtatttctttctactcaatctggctaccatggacataatttgtacctctagcattatgcctaaagcgcttgcttccttagtgtctgaagagtccagtatctcctacggaggctgcatggcccagctgtattttctaacgtgggctgcctcttcagagctgttgctgctaacggtcatggcgtacgataggtacgccgccatctgtcatccgctgcattattccagcatgatgtccaaagtgttttgcagcgggctcgcaacagctgtttggttactgtgcgcagttaacactgccatccacacggggctcatgttgcgcttggacttctgtggaccaaatgtgatcatccattttttttgcgaagtaccccctctgctcctgcttagttgcagctctacttacgtgaatggcgttatgatcgttctagccgatgccttttatggaattgtgaactttctcatgactatcgcctcctacggcttcatagtctcttccatcctgaaagtgaagaccgcttggggtcgtcagaaagctttctctacctgctcttcacacttgactgttgtgtgtatgtactatactgccgtgttttatgcctatatctccccagtgagcggttattctgccgggaagtctaaactcgccggcctcctctatacggtacttagcccgacactcaaccctttaatctatacgctccgcaataaggaagttaaagccgctctccggaagctctttccgtttttcagaaattag

SEQ ID NO: 49256 - DNA, 903 bp, Artificial Sequence
  Description of Artificial Sequence: Synthetic coding sequence
atgggccagaaccagaccagcatcagcgacttcctgctgctgggcttacctattcagccagaacagcagaatttgtgctacgccttatttctggcaatgtatctgaccacattgctggggaaccttcttatcattgtcctaatcaggcttgatagccatcttcacactcctgtgtatctttttctgtcgaatctctctttctctgacctttgtttcagctccgttaccatgcccaagctgctccagaacatgcaaaatcaagacccatcaatcccatacgccgattgtttaacacagatgtacttctttctttatttttccgacttggaaagcttcctgctggttgccatggcctacgaccggtatgtagctatttgtttccctatgcactacacagccattatgtcccccatgctgtgcttgtctgtcgtggccctgtcctgggttcttacaaccttccatgcaatgctgcacaccctactgatggctagactctgcttttgcgccgacaacgtgatcccccacttcttttgcgacatgtcggcactgctcaagttggcatgttccgacactcgcgtcaatgagtgggtcatatttattatgggggggctcatccttgtgatcccctttctacttatcttgggatcgtacgctcgcatcgtctccagcatcctcaaagtgccgtctagcaagggcatttgcaaggctttttccacctgtgggtcacatctttctgttgtctctctgttctacggaacagtgataggcctgtatctctgcccatcggcaaacagcagtaccctgaaggataccgtcatggcaatgatgtacaccgttgtgacacctatgctcacccccttcatatattcattacgcaaccgcgatatgaaaggcgcattgtag

SEQ ID NO: 49257 - DNA, 948 bp, Artificial Sequence
  Description of Artificial Sequence: Synthetic coding sequence
atggagatcgtgagcaccggcaacgagaccatcaccgagttcgtgctgttaggattttacgatatccccgagctccattttctattttttattgtttttacagctgtttatgtgttcattatcatcggcaacatgctgattattgtagccgttgtctcctcacaacgcctgcataaacccatgtacattttcttagccaacctgtccttcctcgacattttgtatacctccgccgtgatgcctaaaatgttggaggggtttttgcaggaagccaccatcagcgtagctggatgcctgcttcagttcttcatctttggctctctcgccacagcagagtgtctgctcctagctgtgatggcgtatgatcgctacctggccatatgttatccattacactaccctctgctgatgggtccccgacggtatatggggctggtcgtaaccacatggttgagtggattcgtcgttgatgggctagtggtggcactcgtcacccagctcaggttctgtgggccaaaccacattgaccaattttactgtgactttatgctgttcgtgggactggcctgtagtgaccccagagtcgcacaggtgaccaccctcatcctgtctgttttttgtctgacaatacctttcggcttgatcttgacctcttacgctcggatcgtagtggcggttctccgggttccggctggggccagcagacgcagagccttcagtacatgttcaagccacctggctgtggtcactaccttctacgggaccctgatgatcttctacgttgccccctctgcagttcacagtcagcttctgtccaaggtgtttagtcttctctacacagtggtgaccccactgtttaatcctgttatttacaccatgcgcaataaggaagtgcaccaagccctgcgcaagatactctgcattaaacagacagagactctcgactag

SEQ ID NO: 49258 - DNA, 948 bp, Artificial Sequence
  Description of Artificial Sequence: Synthetic coding sequence
atggagatcgtgagcaccggcaacgagaccatcaccgagttcgtgctgctgggcttttatgacattcctgagttgcacttcctgttttttatagtgtttaccgccgtgtatgtatttatcatcatcggaaacatgcttatcatcgtagccgtcgtaagcagccagaggctgcacaagccaatgtatattttcctcgccaaccttagcttcctggatattctttacacttccgcagtgatgcctaaaatgctggagggctttttgcaagaggccaccatttccgttgccggttgtctgctccagttttttatcttcggcagcctagccaccgccgaatgtctgctgttggctgtcatggcctacgaccgctacctggctatctgttaccccctacactacccattactgatgggcccaagacgatacatggggcttgtggtaactacctggttaagtggctttgtcgtggacgggttggtagtggcgctagtaactcaattgagattttgtggccccaaccacatcgaccaattctattgtgactttatgttgtttgtaggactggcttgttccgacccacgggttgctcaagtgactaccctgatcctttccgtgttctgcttgaccatccctttcggattaattttaacctcttatgcccgaatcgtggtggctgttctgcgggtgcctgccggcgcatctaggaggagagctttttccacttgctctagtcatttggccgtggtgactactttctacggcaccctgatgatcttttacgttgcaccttcggctgtgcattctcagctcctttctaaggttttttcactgttgtacaccgtggtgacccccctgtttaaccctgtgatctatacaatgaggaataaggaggtgcatcaggcactgcgcaagatactgtgcattaaacagacagagaccctcgactag

SEQ ID NO: 49259 - DNA, 948 bp, Artificial Sequence
  Description of Artificial Sequence: Synthetic coding sequence
atggagatcgtgagcaccggcaacgagaccatcaccgagttcgtgttgttgggattctacgatataccagaactccacttccttttcttcattgtttttaccgccgtctatgtcttcattattataggcaatatgctgataatagtcgccgtcgtatcgtcccagcgcctacacaagcccatgtacatttttctggcaaacctgtcatttcttgacattttatacacttctgccgttatgcccaaaatgctcgaggggttcctccaggaagccactatcagcgtagccggctgcctcctccagtttttcatcttcgggtctttggctacagccgaatgcctgctgctcgctgtcatggcgtacgacagatatctggcgatctgctaccctctgcactatcccctgctcatgggccccagacggtacatggggttagtcgtgaccacctggttatccggcttcgtggtcgatggactggtggtggctctggtgacacagctccgtttttgcgggcccaatcacattgatcagttctactgcgactttatgctcttcgtcggattggcatgctctgatcctagagtggcccaggtcactaccttgatcctctccgtcttttgtctgaccattcccttcgggcttatcctgacgtcttacgccaggatagtggtggccgtgctgcgcgttccagctggcgcatcacgacgcagagcattctccacctgttcttcccatctggccgtggtgaccacattctacgggaccctgatgattttttacgtggcccccagcgccgtccactctcaactgctgtctaaggttttttcgcttttgtataccgtcgtgacccccttgttcaaccctgtaatttacactatgcgcaacaaagaggtgcaccaggccctccgcaagatcctgtgcattaaacagacagaaacgctcgactag

SEQ ID NO: 49260 - DNA, 924 bp, Artificial Sequence
  Description of Artificial Sequence: Synthetic coding sequence
atgctgaacaccaccagcgtgaccgagttcctgctgctgggcgtgaccgatatacaggagctgcagccatttctgtttgttgtcttcctgaccatttattttatttctgtgaccggtaatggcgccgtcctcatgattgtgatctccgatcctaggctgcacagccttatgtactttttccttgggaacctgtcctacctcgacatctgctattccactgtgaccctgcccaagatgctgcagaatttcctctccacccataaagccatctcttttctcggctgtatctcccagctccatttcttccacttcctgggatccacagagagcatgctgtttgctgtgatggctttcgacctctcggttgccatttgcaaaccactccggtatactgtcatcatgaatccccaactttgcacccagatggccatcactatttgggtaattggattttttcatgcgttgttgcatagcgtaatgacctctagacttaacttctgcggatcaaaccgaatacaccatttcctatgcgacatcaagccgctgttgaagttagcatgtgggaacacggagcttaaccagtggctcttatccaccgtgaccggcacaatcgccatggggccatttttcctgacactgctgagctacttctatatcatcacctatttgttttttaagacccgctcgtgctcaatgctgtgtaaagcactgtccacgtgcgccagccattttatggtggtcattctcttttacgcccccgtactgtttacctacatccacccagcgttggagagctttatggatcaggaccggattgtggctataatgtatactgttgtgacccccgtcctcaatcctttgatctatactttgcggaataaagaggtgaagggggcactgggaagggtcattcggaggctgtag

SEQ ID NO: 49261 - DNA, 924 bp, Artificial Sequence
  Description of Artificial Sequence: Synthetic coding sequence
atgctgaacaccaccagcgtgaccgagttcctgctgctgggcgtgaccgacatccaggagctgcagcccttcctgtttgtggtcttcttgactatctactttatttcagtcactggtaatggagcggtcctcatgatagttatatccgacccaagactgcattccctgatgtattttttcctgggaaatctgtcatacttagatatctgttattccacagtgactttgcctaagatgctgcagaattttctgtcgactcacaaagcaataagtttcttaggctgcatcagccagcttcatttcttccactttctcggatctactgagagtatgctcttcgccgttatggcctttgacctgagtgtggcaatttgtaaacctctcagatacaccgttatcatgaatccacagctctgcacccagatggctattactatttgggtgattggcttctttcatgccttgctacatagtgtaatgaccagcaggctgaatttttgtggctcgaacaggattcaccacttcttgtgcgatattaaacccctgctgaagttggcctgcggaaataccgaattgaaccaatggctcctgagcaccgtcactggaacaattgcaatgggcccgttttttcttaccctattaagctacttctacatcattacctatctttttttcaagacacgatcctgtagcatgttgtgtaaggccttgtcaacatgtgcaagccacttcatggtggtcatcctcttctatgcccctgtgctgtttacctacattcatcccgcccttgagtcttttatggatcaggacagaatcgtggccattatgtataccgtggtgacaccagtcttgaatcctctaatctacactctgagaaataaagaagtgaaaggagctctgggccgggtgattcgccggttgtag

SEQ ID NO: 49262 - DNA, 924 bp, Artificial Sequence
  Description of Artificial Sequence: Synthetic coding sequence
atgctgaacaccaccagcgtgaccgagttcctgctgctgggcgtgaccgatatccaggagctccagccattcttgtttgttgtattcttgacaatttacttcattagcgtgaccggcaatggggcagtactgatgatcgttatctcagatccccgtctacattctttgatgtacttctttctagggaaccttagctacttagacatctgctatagtacagttactcttccaaagatgctgcagaatttcctatctacgcataaggccatctcatttctggggtgtatctcccaattgcattttttccatttcctgggtagtacagagtcaatgttgtttgcggttatggcatttgacttgtccgtggccatttgtaaacctctaagatacaccgtcattatgaatccccaactttgcacgcagatggcaattaccatctgggtgattgggttttttcatgcactgctgcattcggttatgacaagccgcctgaacttttgcggatccaaccgaatccatcacttcctgtgcgatattaagccactcttgaagctcgcctgcgggaatacagagctaaaccagtggttgctgagcactgttaccggcaccattgcaatgggtcccttcttccttactctgttgagctacttctatatcattacctatctgttttttaaaacccgaagttgctctatgctgtgcaaagcgctgtccacttgcgccagccactttatggtggtgatactgttttacgccccggttttgtttacttacatccatccagctctggagagctttatggaccaagaccgcattgtggccattatgtacaccgtagtgacgcctgtgctaaaccccctgatatacactctcaggaacaaagaagtgaagggcgccctgggtagggtgataaggcgtttgtag

SEQ ID NO: 49263 - DNA, 951 bp, Artificial Sequence
  Description of Artificial Sequence: Synthetic coding sequence
atggagaacgtgaccaccatgaacgagttcctgctgctgggcctgactggggtccaggagctacagccatttttctttggtatctttctgataatatatttgatcaatttaattggaaacggatcaatacttgtgatggttgtgctcgaaccacagctgcattccccgatgtatttcttcctcgggaatctgtcttgcttagacatttcctatagttccgtgactctccctaaacttcttgtgaacctagtttgcagcagaagggcaattagtttcttaggctgtatcatccagctgcacttttttcattttctaggttctaccgaggccattctgcttgcgataatggcatttgacagattcgttgctatctgcaacccacttagatataccgtgatcatgaacccacaggtatgtatcctcctggccgccgccgcctggctgatcagcttcttttacgctttaatgcactcagtcatgaccgcccatttaagcttttgtggcagtcagaagctgaatcacttcttttacgacgtaaaacccctcctggagcttgcctgctcggacacactgctaaatcagtggttgctgagcatagtgaccggttccatttccatgggcgcattcttcctgacattgctttcttgtttctacgttatagggttcctcctatttaagaaccgctcctgcagaatactacataaggcactgtctacttgcgccagccactttatggtggtctgcctgttctacgggcctgtggggttcacttatattcgccccgccagcgccaccagtatgattcaggatcggatcatggcaataatgtactccgccgtgactccagtcctgaatcccctgatctatactctccgcaacaaggaagtcatgatggccctcaaaaaaatattcgggcggaaattgtttaaagattggcagcagcaccattag

SEQ ID NO: 49264 - DNA, 951 bp, Artificial Sequence
  Description of Artificial Sequence: Synthetic coding sequence
atggagaacgtgaccaccatgaacgagttcctgctgctgggcctgactggcgtacaggagctccagcctttcttcttcggtatcttcctgatcatttaccttattaacttgattggaaacgggtcgattctggtgatggtagtactggagccccagctccattccccgatgtacttcttcctgggcaacctgagctgtctcgacatcagctactcttccgtaactctaccaaagctgctcgtgaacctggtttgttccagacgcgccatctctttcttggggtgcattatccagttgcatttcttccactttcttggaagcaccgaagcaattcttttggccatcatggctttcgataggtttgtcgcgatttgcaacccactgcggtataccgttatcatgaacccacaagtctgcattctacttgccgccgccgcctggctgataagcttcttttatgctctcatgcactccgtgatgaccgctcacctctcgttttgtgggtcccagaaactgaaccactttttttacgacgtgaaacccctcctagaactggcttgttccgacacactccttaaccagtggctgctttccattgttaccggatcaattagtatgggagccttttttctgacactgttgtcatgcttctatgtgatcggcttccttcttttcaagaaccggagctgccgcattctccacaaggctctgagtacatgcgcctcccatttcatggttgtgtgcttgttctacggcccagttggtttcacttacattcgacccgcttcagcaacatccatgattcaggacagaatcatggccattatgtattccgccgttaccccagtgctgaaccctctgatctacaccctgcgcaacaaagaagtgatgatggccctgaaaaagatattcggtagaaagctttttaaggactggcaacagcaccactag

SEQ ID NO: 49265 - DNA, 951 bp, Artificial Sequence
  Description of Artificial Sequence: Synthetic coding sequence
atggagaacgtgaccaccatgaacgagttcctgctgctgggcctgacgggcgttcaggagctgcaaccctttttcttcggcattttcttgattatttacctgatcaacctcatcggaaatggatctattttggtcatggtcgtactcgagccacagttacattctcccatgtactttttcctgggcaatttgagttgtctggatatatcctactcatctgtgaccctgcctaagctcctggtcaacctggtgtgctctcgcagagccatctctttccttggttgcatcatccagctccacttcttccattttttgggttcaacggaggctatcctactggcaattatggccttcgaccgctttgtggccatctgcaaccccttgaggtatacagtgatcatgaatcctcaggtttgtatcctactggcagcagcggcttggctaatcagttttttctacgctcttatgcactcagttatgaccgctcatctgtccttttgtggcagtcagaagctgaaccatttcttctacgacgtgaaacctctgttagagctggcctgcagtgatactctgctcaatcagtggctcctctctattgttacagggagcatctccatgggcgcattttttctgaccctcttgagttgtttctacgtgatagggttcctcctgtttaagaataggtcctgtcgtattctccacaaggcactgtctacctgtgcctcccacttcatggtcgtgtgtctgttttacgggccagttggctttacttacatccgaccggcgagtgctacctcaatgatccaagatagaattatggccattatgtactctgccgtgactccagtgcttaatcctctgatatacacacttcgcaacaaagaagtgatgatggcgctgaagaagatcttcgggaggaagctgttcaaggattggcagcagcaccactag

SEQ ID NO: 49266 - DNA, 951 bp, Artificial Sequence
  Description of Artificial Sequence: Synthetic coding sequence
atggagaacgtgaccaccatgaacgagttcctgctgctgggcctgaccggtgtgcaagaactacagccctttttttttggcatttttcttataatctatctgattaatcttataggcaacggatccattttggttatggtggtcctggaaccccagcttcattcccccatgtacttttttctgggtaatctgagctgtctggacatttcttacagctccgtgactctacctaagctgttggtgaacttggtgtgttcccgccgcgccatatcattcctcggatgtattatccagctgcatttctttcacttccttggtagcactgaggcaatcttattggccatcatggcgttcgaccggttcgtagccatttgcaacccactccggtacacagtgatcatgaacccgcaagtttgcattctgcttgctgcagccgcctggctcatctcttttttttatgcactcatgcattcagtgatgaccgcacacctcagcttttgcggatcccagaaactgaatcacttcttttatgacgtcaagcctctcttagagctggcatgctcggacactctgctcaaccagtggctcttgagtatagttaccgggtctatatctatgggcgcattcttcctaaccctcctgtcatgtttttacgttatcgggtttctgctgttcaagaataggagctgtcgcatccttcataaggcgctgagtacctgcgcaagccattttatggtagtgtgtttgttttatggccctgtggggttcacttacattagaccagcatctgccaccagcatgatccaggaccgcatcatggcaattatgtatagcgccgtgacgcctgtgctgaacccactgatttacacgctgaggaacaaggaagtgatgatggcattgaaaaagatcttcggccgaaagctgttcaaggactggcagcagcaccattag

SEQ ID NO: 49267 - DNA, 936 bp, Artificial Sequence
  Description of Artificial Sequence: Synthetic coding sequence
atggacaacctgaccaaggtgaccgagttcctgctgatggagttctctggtatttgggagctgcaggtgctccacgctgggctgttcctgctgatttatcttgccgtgttggtgggcaacctgctaatcattgccgtgatcactctggatcaacacttgcacacgccaatgtatttttttctaaagaatctgtctgtcctggatctctgctatatatctgtgactgttccgaagagcatccgcaattcccttacgcggcggagttcgatttcatacctgggttgtgttgcccaagtgtatttcttctctgcatttgcgagcgccgagctcgcttttttgacggtgatgagttatgacagatacgttgccatctgccatccattgcagtatagggcagtaatgacctctggggggtgttaccaaatggccgtgacaacgtggctttcatgcttctcgtacgctgcggtgcacaccggaaatatgtttcgcgaacacgtctgcaggtcttctgttatccaccaatttttccgggatatcccccacgttctcgcactggtatcttgcgaggtttttttcgtggagttcctcacgctggccctatcctcgtgcctggtgctgggatgctttatactgatgatgatcagttacttccaaattttctccaccgtgctcaggatccctagtggtcaatcacgggcaaaagccttttccacgtgtagcccccagctcatcgtgattatgttgttccttacaaccggcctgtttgcagctcttgggcctatagcaaaggccctttctattcaagatttggtgatcgccctgacatatacagttctccccccgttcctcaaccctataatttactcattgcggaataaggaaattaaaaccgccatgtggaggcttttcgtgaaaatctacttcctacagaaatag

SEQ ID NO: 49268 - DNA, 966 bp, Artificial Sequence
  Description of Artificial Sequence: Synthetic coding sequence
atggtgaacctgaccagcaccagcggcttcctgctgatgggcttctccgatgagcgtaagttgcagatcttacacgcactggtgttcctcgtgacatatttgctggcattgacggggaatcttctaatcattaccataataactgtagacaggagactccactcccctatgtactacttcctgaaacacctgtccctcctggatctgtgctttattagtgtcacagtgccacagtccatcgcaaactctctcatggggaacgggtatatatctttggttcagtgcatactacaagtcttcttctttatcgctcttgccagcagcgaggtcgcaatcctgaccgttatgtcttacgacagatacgctgcaatctgccaacctcttcactacgagaccatcatggaccccagagcctgccgacatgccgtgatcgcagtgtggatcgctggcgggttaagtggactgatgcatgccgcaataaatttttcaataccactgtgtggtaaacgagtcatccatcagttcttttgcgacgtgccacagatgctcaagttggcttgtagctatgagttcatcaatgagatagcattggcagccttcactacctccgctgccttcatttgcctcatctctatcgttctgtcttacatcagaatttttagcaccgtgttacgcattcctagtgccgagggcaggaccaaagtgttttccacatgcctgccccatctgttcgtggccaccttcttcctttctgccgctggctttgagttcttgcgtctcccaagcgatagcagctctactgtggatctcgttttttctgttttttacaccgtgatcccaccgacactgaacccagtgatctacagtctacggaatgattcaatgaaagccgcgctgcgtaaaatgttgtcaaaagaggaactgccccagagaaaaatgtgtctaaaagcaatgttcaagctgtag

SEQ ID NO: 49269 - DNA, 966 bp, Artificial Sequence
  Description of Artificial Sequence: Synthetic coding sequence
atggtgaacctgaccagcaccagcggcttcctgctgatgggcttcagtgacgaaaggaagctacagattctccatgccttggtgtttctggtgacttatctactcgccctgactggaaacctgcttattatcactatcattactgtcgatcgccgcctgcattcacccatgtactacttcctgaaacatctttctcttctggatctgtgctttatctctgtgaccgtgcctcaaagtattgcaaactcactgatgggaaacggatatatatcactggtacagtgcatactgcaggtcttcttttttatcgccctcgcatcttcggaggtggccatcttaactgtgatgtcttacgatcgttacgctgctatctgtcagccactccactacgaaactataatggacccaagggcctgcaggcacgctgttattgccgtgtggatcgctggaggcctatccggtctgatgcatgcggctatcaacttttctatcccgctttgcgggaagagggtaatccaccaatttttttgtgacgtgccacaaatgttgaaactggcttgcagctacgagttcattaacgaaatagccctagcagcatttaccacctccgctgctttcatatgcctcatcagcattgtcctgtcctacatccggattttctccacggttctgaggatcccaagtgctgaaggccgcactaaggtcttctccacttgcctacctcacctttttgtggccaccttctttctgagcgcagcgggatttgaattcctacggctcccttcagattcaagttccacagttgatctggttttttcagtcttttatactgtaattccaccaaccctgaacccagtgatatacagtttgcgcaacgattccatgaaggccgccctccgaaagatgctatccaaggaggagctgccccagcggaagatgtgtctgaaggccatgtttaaactctag

SEQ ID NO: 49270 - DNA, 966 bp, Artificial Sequence
  Description of Artificial Sequence: Synthetic coding sequence
atggtgaacctgaccagcaccagcggcttcctgctgatgggcttcagcgacgagcggaaactacagattctgcacgctttagtatttcttgtgacttacctgctcgcgctaaccggtaacctgctcatcattaccatcataacagtcgatagaagactccacagccctatgtactatttcttaaagcatctgtctctccttgatctttgcttcatttccgtgacggtgcctcagtcgattgcaaacagtctgatggggaacggatacatctcactcgtgcagtgcatcctacaggtgttcttcttcatcgccttagctagcagcgaggttgccattctgactgtaatgtcatacgaccggtacgctgcaatttgtcagccactgcactacgaaactataatggatccaagggcatgtaggcacgccgtgatcgccgtctggatcgccggagggctctccgggttgatgcacgctgccatcaatttctctatccctctttgtggcaagagagtcatccaccagttcttctgtgatgtgccccaaatgctcaaacttgcttgctcctacgagtttattaatgagatcgccttggcagcttttactacaagcgccgcatttatttgcttaatcagtatcgttttgtcgtatatccgtattttctctacagttctgagaataccaagtgcagaaggccgcaccaaggtcttcagcacctgtctgccacacctgttcgtcgccacgttctttctctctgctgctggatttgaattcctgaggctccccagcgacagctcttccacagtcgacctcgtgtttagtgtattctacacagtgatcccccccaccttgaatccagttatatatagtctgcggaatgacagcatgaaggccgctctgcggaagatgctgtccaaagaggagctgccccagcgtaagatgtgcctaaaggccatgtttaaactgtag

SEQ ID NO: 49271 - DNA, 966 bp, Artificial Sequence
  Description of Artificial Sequence: Synthetic coding sequence
atggtgaacctgaccagcaccagcggcttcctgctgatgggcttcagtgacgaaaggaagctgcagattttacacgctctggtcttcctggttacataccttttagccctcaccgggaacctcctgataatcacaattatcacggtggaccggcggctccattctcccatgtattactttcttaaacacctgagtctgctcgatttatgttttatctcagtgaccgtgcctcaaagcatcgcgaactccctgatgggtaacggatacatttcactggttcagtgcattctccaggtcttcttttttatagcgctggccagcagcgaggttgccatcctgaccgttatgtcatacgaccggtacgctgctatttgtcagcctttacactatgagaccattatggatcctagagcctgtcggcatgcagtgattgctgtgtggatcgccggcgggctgtccggactgatgcatgcagccataaatttttctattccactgtgtggaaaacgcgtgatacaccagttcttctgtgatgtgccacagatgctgaaactggcttgtagctacgaattcataaatgagattgctctcgctgcctttaccacctccgccgcctttatctgcctcatctcaatcgtattaagttatattcgcatctttagcactgttctgagaattccaagtgcggaggggagaaccaaggtattcagcacatgcctaccccatttgtttgtggctacttttttccttagtgcagccggttttgagttcctccgccttccttctgactcctcttccactgtcgaccttgtgttctcagtgttctacaccgtgatcccccctactttgaaccccgtaatatattccctgcgcaatgatagtatgaaggcagctctgcgaaaaatgctgagtaaggaggagttacctcaacggaagatgtgcctgaaggccatgttcaagctctag

SEQ ID NO: 49272 - DNA, 939 bp, Artificial Sequence
  Description of Artificial Sequence: Synthetic coding sequence
atggtgaaccagagcagcacccccggcttcctgctgctgggcttcagcgaacacccagggttggaacgaaccctattcgtggttgtgttcacctcttaccttcttacgctggtgggaaataccctgatcatcctgctcagtgtgcttgaccctaagctccatagcccaatgtactttttcctgtcaaacctgtcctttctggatctctgttttaccacatcttgcgtcccccagatgctggtcaatctctggggccccaaaaaaactatcagctttctagactgtagcgtgcagatatttattttcctatctttaggcacaaccgaatgtatcctgctgaccgttatggcgtttgacaggtacgtcgccgtgtgtcagcctctacactacgcaaccatcatacaccccagactctgctggcagttagcatctgttgcatgggtgatcggtctggtcgaaagcgtcgtccagacgccctctacgttacacctgccattctgtccggacaggcaggttgacgattttgtatgcgaagtacccgccctgatacgactgagttgtgaggataccagttacaatgagatacaggtcgcagttgcctccgtttttatactcgtcgtacctttatccctgattctagtgtcttacggggcgataacctgggcagtgctcagaataaactcagcaaaggggcggcggaaagccttcggaacttgttcctctcatctcaccgtggtgacgctgttttattcctctgtgatcgctgtgtacctgcaacccaagaacccatacgcccaggagcgggggaagtttttcggccttttttatgcagtagggacccctagcctgaaccctcttatctacaccctgcggaataaggaagtgaccagggccttccgacgactcctcggaaaagaaatgggtttaacacagagctag

SEQ ID NO: 49273 - DNA, 939 bp, Artificial Sequence
  Description of Artificial Sequence: Synthetic coding sequence
atggtgaaccagagcagcacccccggcttcctgctgctgggcttctctgagcatcctggattggaacggaccttgttcgtcgtggtgttcaccagctatctactgactctggtggggaatacccttataattctcctgtccgccctagatccaaagctgcattcccccatgtatttttttctctccaatctctcttttctggatctgtgtttcaccacatcctgtgtgccccagatgttggttaacctatgggggccaaagaagacaatttcttttttggactgcagcgtgcagatttttattttcctctccctgggcactactgaatgtatattgctgacagtgatggcctttgatcgctacgtggctgtgtgccagccactgcattacgctacaataatccacccccggctgtgctggcagcttgcaagcgttgcctgggtgatagggctcgttgagtcagtagttcaaacccctagcaccctccatctgcctttttgtcccgaccgccaggtcgacgatttcgtttgtgaggtgcctgcgttgatacgcctgagctgtgaggacacctcatacaatgaaattcaggtcgcggtggcctctgtatttatcctggtggtgccactatcacttattcttgtgtcctacggagccatcacttgggcggtgctgcggattaacagcgcgaaaggccgcaggaaagcattcggcacttgcagtagtcacctcacagtggtaactctattctattctagcgttatagcagtctacctccagcccaaaaacccctatgcgcaggagcgtggcaagttttttggactgttctacgccgttggcacaccgtctctgaatcctctgatttatacactccggaataaggaggtaacgcgtgcatttagaagactgctaggaaaagagatgggtctgacacagagctag

SEQ ID NO: 49274 - DNA, 939 bp, Artificial Sequence
  Description of Artificial Sequence: Synthetic coding sequence
atggtgaaccagagcagcacccccggcttcctgctgctgggcttctcagaacatcccgggttggaacggactctgttcgtagtggtgtttacgagctacctcctcactcttgtgggtaatactctgatcatcctgctgtcagttctggatcccaagctgcactcacccatgtattttttcctgtcgaacctgtcatttctggacctctgctttacaacctcatgtgtgccccagatgctggtaaatctttggggacctaagaaaacaattagcttcctggattgctcagtgcagatatttatctttttgtcattaggaactactgagtgcatattgcttactgttatggcctttgatagatacgttgctgtttgccagccccttcattatgccacaatcatccacccacggttgtgctggcagcttgcctctgttgcttgggtcatcggcttggtcgaatccgtggttcagacccctagcacgcttcacctgccattttgccccgataggcaggtagacgactttgtatgcgaagtgcctgcattaattagactgtcctgcgaagatacttcttataatgaaattcaggtggcagtcgcttccgtgttcatcctcgtcgtgccactgtcgctgattctggtgagctacggtgccatcacttgggcagtgctaaggatcaatagcgccaagggccgtcgcaaggcgttcgggacctgcagctcccatctgacagtggtgactctgttttacagcagtgtgattgccgtgtatctgcaaccaaagaatccttacgctcaggagcgagggaagttcttcggcttgttttacgccgtgggaacaccctctcttaatcctttgatctatactctgagaaataaggaggtgacccgcgccttcagacgccttctggggaaggagatgggactgacacagagttag

SEQ ID NO: 49275 - DNA, 939 bp, Artificial Sequence
  Description of Artificial Sequence: Synthetic coding sequence
atggtgaaccagagcagcacccccggcttcctgctgctgggcttcagcgaacaccccggactggagcggaccctcttcgtggtcgtgttcacaagctacttgctcactctagtaggtaataccctgataatcctcctcagcgtcctggacccgaaactgcatagtcctatgtacttttttcttagcaacctgtcttttcttgatctgtgtttcacaacatcttgtgtgccccaaatgttggtaaatctgtggggaccaaaaaaaaccatttcctttcttgattgttccgttcaaattttcatctttctatctcttggcacaaccgaatgcatcttattgaccgtgatggcctttgatcgatatgtggctgtttgccagccgttgcattacgccaccatcatacacccgagactttgttggcagttagccagtgtcgcctgggttatcggtctcgttgaaagcgtggtccaaaccccgtcaaccctgcatctgcctttttgcccagaccgccaggtggatgacttcgtctgtgaggttcccgccctcatccgcttgagctgcgaggatacgtcatacaacgagattcaggttgctgtcgccagcgttttcattttagtcgtcccactgagcttgattttagtgagctacggagctatcacatgggcggtcctccgcatcaatagcgcgaaaggtcgcaggaaagctttcggcacttgtagctctcaccttactgtggtaacccttttttatagctccgttatcgctgtatacctccaacctaagaacccttacgctcaggaaaggggaaaattttttggcctgttctatgcagtgggtacccctagcctgaacccgttgatctataccctgcggaataaggaggtgacccgagcgtttcgtcgtctgctagggaaggagatgggactgacacagagctag

SEQ ID NO: 49276 - DNA, 939 bp, Artificial Sequence
  Description of Artificial Sequence: Synthetic coding sequence
atgctgatgaagaagaacgccagcttcgaggacttcttcatcctgctggggttctccaattggccccatctagaagtggtcctcttcgtggtgattctaattttctacctgatcactttgatcggcaacctatttatcattatattgtcttaccttgattcccatctgcatactccaatgtattttttcttgtctaatctcagtttcctggacctgtgttataccaccagctccattccacagctcctcgtgaatctgtggggacctgaaaagacaattagttatgccggttgtaccgtgcaattatatttcgtcctggccctgggaacagccgaatgcgtgctgctggtggtaatgtcgtacgatcgttatgcggcagtgtgtaggccactgcactataccgtactcatgcaccccaggttctgcagactactggcagcagcctcatgggtatctggcttcacgactagcgctctccacagtagttttaccttctggatccctctgtgtcggcatagactggtcgatcatttcttctgtgaggtccccgcccttcttaggttatcatgtgttgacacccaagctaatgaactcaccctcatggtaatgtctagtatttttgtactcataccactcatcctgatcctcaccagttatggagcaattgcccgggccgttttatccatgcagtctacaacaggtctgcagaaggtgttgaggacctgcggggcacacctgatggttgtctcactgtttttcatccccgtgatgtgcatgtatctccaaccaccaagcgagaactctcaggaccagggtaaattcatcgcactgttctatactgtggtcactccctctctgaatccactcatttacacattccgcaacaaagatgttagaggcgccgtgaagcgcttgatgggctgggagtggggcatgtag

SEQ ID NO: 49277 - DNA, 939 bp, Artificial Sequence
  Description of Artificial Sequence: Synthetic coding sequence
atgatgatcaagaagaacgccagcagcgaggacttcttcatcctgctgggtttcagcaactggcctcagctggaggtggtgctgtttgtcgtcatactgatcttctacttaatgacacttactggaaacctcttcatcatcatcctgagttatgtcgattctcatctgcacaccccaatgtacttctttctgagcaatctttccttcctcgatctgtgctacaccacctccagcattcctcagctgctggttaacctacgaggtcccgaaaaaacgatctcttacgccggctgcatggtgcagctgtacttcgtgttagctctgggtatcgctgagtgcgtactcctggtggtcatgtcttatgacaggtacgtggccgtatgcaggcccctgcactacactgttttgatgcacccccgcttttgccatttgcttgtggcagcctcctgggtgattggcttcacgatatcagctttgcactcgagttttactttttgggtgccattgtgcggccacaggctcgtagatcattttttctgtgaggtgcccgccctgctcagactgtcctgcgtagacacccacgctaatgaacttactttaatggtgatgagctcgatattcgtcttaatcccccttatcctgattttaaccacctacggggccattgcccgggctgtgctatccatgcaatccacgactggtttacagaaggtgtttcgaacgtgtggagcacacctgatggttgtgtctctgttctttattccagtcatgtgcatgtacctccagcccccctcagagaattcgcctgaccagggtaagttcatcgcgctattttacacagtggtcacccccagcctgaaccctcttatttatacccttcgaaacaagcacgtgaaaggcgctgcgaagcgcctcctgggctgggagtggggtaaatag

SEQ ID NO: 49278 - DNA, 939 bp, Artificial Sequence
  Description of Artificial Sequence: Synthetic coding sequence
atgatgatcaagaagaacgccagcagcgaggacttcttcatcctgctgggattctcaaattggccccagttagaggtcgtgcttttcgtggtcatccttatattttatctgatgacactgacgggcaatctgttcatcatcattctgtcatacgtcgatagccacctgcatacccctatgtacttttttctatccaaccttagcttcctagacctctgctacaccacctctagcataccacagctgctggtgaatctgcggggtccagagaaaacgattagttatgccggctgtatggttcagctgtactttgtccttgcacttggcatcacagaatgtgtgttacttgtggttatgtcctatgatcgatacgtcgctgtgtgcagacccctgcattacaccgtcctcatgcatcccaggttttgccatttattggtcgccgctagttgggtgatcggttttactatctctgcactccactcaagcttcaccttctgggttcctttgtgcggacacaggctggtggaccactttttctgtgaagtcccggccctcctgagactaagctgcgtggatacccacgccaacgagttgacactgatggtgatgagttctatcttcgtgctaataccattgatcctcatcctgaccacctacggggcgatagcaagagcagtattgagcatgcagtctacaactggcctacagaaagtctttaggacatgcggggcccacctgatggtcgttagtctatttttcatccccgtaatgtgtatgtacctccagccaccttctgagaattcccctgatcaagggaaatttattgccctgttttacacagtggtgaccccatctctgaatcctctgatctatacgctgcggaataagcatgtgaagggggccgcgaagcggttgcttggttgggagtggggaaaatag

SEQ ID NO: 49279 - DNA, 939 bp, Artificial Sequence
  Description of Artificial Sequence: Synthetic coding sequence
atgatgatcaagaagaacgccagcagcgaggacttcttcatcctgcttgggttctcgaattggccacagttagaagtggtcttgttcgtcgtcatcctgattttctacctcatgactcttacaggcaatctatttattattattctgtcatacgtcgacagccatttgcatacacctatgtacttctttctgagcaacttgtcctttcttgacttgtgttatactaccagcagtattcctcagctattggtaaacctccgaggccccgagaagactatttcatatgcaggctgtatggttcaattgtacttcgtattggcactgggcatagctgaatgcgtgctgctggtagtaatgtcctacgatcgctatgtggctgtgtgccggccactgcattacaccgtccttatgcacccaaggttttgtcaccttcttgttgcagcaagttgggtgataggcttcaccatttcggctctccactccagcttcactttctgggtgcctctgtgcggccatcgtctggtggaccactttttttgcgaggtgcctgctctcctgcgcctcagctgcgtggacacgcacgcaaatgaactaacactgatggtaatgtctagcattttcgttcttatcccccttatccttatcctgacaacatacggggccatcgccagggccgttctgtccatgcagtccaccactggtctgcagaaagttttccgcacatgcggggcgcacctgatggtcgtatctctcttctttataccggtcatgtgtatgtacctgcaacccccctcagagaatagtccagaccaggggaaattcattgccctattttacactgttgtgaccccgagcctgaatccactgatttatacgctcaggaataaacacgtcaagggtgcagccaaaagattacttggctgggaatgggggaaatag

SEQ ID NO: 49280 - DNA, 936 bp, Artificial Sequence
  Description of Artificial Sequence: Synthetic coding sequence
atgaacgacgacggcaaggtgaacgccagcagcgagggctacttcatcctggtagggttttccaattggcctcacctggaggtggtgatcttcgtagtggtgctgatcttctaccttatgaccttgatcggaaatctatttattattatcctaagctacctagactcccacctgcacacccccatgtatttctttcttagcaatttgtcatttctggacctgtgctacactacaagctcaattccgcagcttcttgtgaatctgtggggtccagaaaaaacaatatcctatgctgggtgcatgatccagttgtatttcgtgcttgcgctgggaacaaccgagtgtgttctgctcgtggttatgtcctatgaccgatacgctgccgtctgcaggcctctgcactacaccgtgctcatgcacccaagattttgtcacttgttggctgtggcctcctgggtgtccggcttcaccaactccgctctgcatagctccttcaccttttgggtgcccctgtgcggccatcgccaggttgaccatttcttttgcgaggtgcccgctctactgcgcttgtcctgcgtggatacccatgtgaacgaacttacccttatgatcacgtcttccattttcgttctaattcccttgatcctgatcttaactagctacggggccattgtgcgcgccatcctgcggatgcagtccaccacaggtctgcagaaggtgttcgggacatgtggcgctcacttgatggcagtttcacttttcttcatcccagcaatgtgtatgtatctgcaaccccctagtggtaattcacaagatcaggggaaattcatagccctcttctacacggttgtgacacctagtctcaacccccttatttatacactccgcaataaggtcgtcaggggtgccgttaagagactgatgggatgggaatag

SEQ ID NO: 49281 - DNA, 939 bp, Artificial Sequence
  Description of Artificial Sequence: Synthetic coding sequence
atggagaacggcagctacaccagctacttcatcctgctgggcctgttcaaccacacgcgggcccaccaagtgctttttatgatggtgcttagcattgttttgacatccttatttggcaactcgctaatgatccttctgatccattgggatcaccgcctgcatacacctatgtacttccttttatcacaactgagcttaatggacgtcatgctcgtaagtacaaccgtccctaagatggctgcagactatctgaccggctctaaggccatctcgagagcagggtgcggagctcagatcttctttctgcccacattaggcgggggagaatgcttcttgctggcagccatggcatatgatcgatacgccgccgtatgccaccccttgcgatatccaaccctgatgtcttggcagctttgtctgaggatgaacctctcttgttggttactgggcgctgccgatggcctgctccaggcagttgctacactcagttttccctactgtggtgctcacgaaatcgaccactttttctgcgagacaccagtactggtgagactggcctgtgctgacacctccgtgtttgagaatgctatgtatatatgctgtgtgctcatgttgctggtgccttttagcttaattctctcgtcatatggtttgatcctggctgctgtgctgcacatgaggtcgaccgaggcccggaagaaggccttcgccacttgttcttcacatgtggccgttgtaggtctcttttacggggcagcgatatttacctacatgcggcctaaaagccacagatctaccaaccatgataaggtggtgtctgccttctacacaatgtttaccccgctgttaaacccactcatttacagcgttaaaaatagcgaggtgaagggcgctctcactcgatgcatgggtcggtgcgtggccttaagtcgagagtag

SEQ ID NO: 49282 - DNA, 930 bp, Artificial Sequence
  Description of Artificial Sequence: Synthetic coding sequence
atggagaacagcaccgaggtgaccgagttcatcctgctgggcctgactgacgacccaaacctccaaattccattgttacttgcctttctgttcatctacttaattacgctgttaggtaacggcgggatgatggtcattatccattcagactcacacctgcatacacctatgtattttttcctgagtaacctttcattagtggacctgggctattcatccgccgtagccccaaagacggtggctgccttgagatctggtgacaaagcgattagctacgacgggtgcgctgcccagtttttcttcttcgtgggtttcgccactgtagagtgttaccttctggcctcgatggcctacgatcgccacgcggccgtgtgcaggccacttcactataccaccactatgacagccggagtgtgcgcactcttagccacaggtagttatgtctctggctttctgaacgcctcgatccacgcagccgggaccttcaggcttagtttctgtgggtcaaacgagatcaatcactttttctgtgatatacctcccctcttagctctaagctgcagtgacactagaatctccaaactcgtggtattcgtggcggggtttaacgtgtttttcaccctcttggttatcttaatcagttatttctttatttgtatcaccattcagcggatgcattctgccgagggacagaaaaaagttttttcaacctgtgcttcccatctaacggccctgtccatcttctatggaacaatcatcttcatgtacctccagcccaactccagtcagagtgtggataccgataaaattgcatctgtgttctacactgtcgtgattccaatgctgaatcccttaatatattctctacgaaataaagaggtaaagtctgccctgtggaagatcctgaataagctttatcctcagtattag

SEQ ID NO: 49283 - DNA, 942 bp, Artificial Sequence
  Description of Artificial Sequence: Synthetic coding sequence
atggaggaggagaacgccaccctgctgaccgagttcgtgctgaccgggttcctctatcagccgcagtggaagatccctctgtttcttgcttttctggtgatttatctgattaccatcatgggtaatctcggactgattgcagtgatttggaaggatcctcacttacacattcccatgtacctccttctgggtaatctggcctttgttgatgcctggatcagcagcaccgttactcctaaaatgctgaataactttcttgccaaatcgaagatgatttccctaagtgagtgtaaaattcagttcttttcctttgctatttctgttacaaccgagtgttttctgctcgcaactatggcttacgataggtatgtagctatctgcaagcctctcctgtaccccgcaatcatgacaaacggactgtgcattaggttgctaattttaagctatgtcggagggatattacacgccctcatccatgagggatttttgtttcgactcaccttctgtaactcgaatatcgtgcaccacatatattgcgataccatacccctgagcaagatatcgtgtaccgattcaagcattaattttctgatggtctttatcttctccggtagcatccaggtattctcaatagtaacaattctggtctcgtatacgttcgttctattcgccatattgaaaaaaaaaagcgacaagggggtgaggaaagcttttagcacatgtggcgcccatctctttagcgtgagcctgtattacggccccttgctgtttatttatgtaggtcccgccagtccacaagcagatgaccaggatatggtggaaccactgttctacacagtaattatccccctcctcaaccccataatctacagcttacgtaacaagcaggtcaccgtgagctttacaaagatgttaaagaaacatgttaaagtgtcctactag

SEQ ID NO: 49284 - DNA, 942 bp, Artificial Sequence
  Description of Artificial Sequence: Synthetic coding sequence
atggaggaggagaacgccaccctgctgaccgagttcgtgctgaccggctttctatatcagccacagtggaagattcctctttttttggccttcttagtgatatatctgattactattatgggtaaccttggcctgatcgctgtgatctggaaagacccgcatctgcacattccgatgtacctgctgttgggtaatctcgcctttgtggatgcttggataagctctacggtgacacccaaaatgctcaataatttcctcgctaagtcaaaaatgatttcactgtcggagtgcaagattcagtttttctctattgctatcggcgttacaactgagtgcttcctgctcgctactatggcctacgataggtatgtcgcgatttgtaagcccctactgtatcccgctattatgaccaacggcctgtgtattcgccttctgattctgagctatattgccgggatactgcatgcgctaattcatgaagggttccttttccgactgacattttgcaattctaatattgtgcaccacatatactgcgatactatccctctgagcaaaattagctgcacggacagctccataaactttctgatggttttcattttctccgggagcatccaggtgttctctatcgtgacgatcctcatcagctatacgtttgtgctttttaccgtgctggagaaaaagagcgataaaggcgtgaggaaagcattcagcacttgcggtgcccacctgttctctgtctgcctgtattacgggcccctgttgttaatgtatgtggggcccgcttcgcctcaagctgatgggcaaaacatggtggaacctttgttctatacggtgattatccccttgctgaatccaatcatatacagtctgaggaataaacaggtgatcgtgtcattcattaagatgctaaagcgcaacgtgaaagtcagctactag

SEQ ID NO: 49285 - DNA, 933 bp, Artificial Sequence
  Description of Artificial Sequence: Synthetic coding sequence
atggaggaggagaacgccaccctgctgaccgagttcgtgctgaccggattcctctatcagccccagtggaaaatacccttgtttttggcttttttagtgatttacctgatcacaattatgggcaatttaggcttgatcgctgtcatctggaaagatccacacctgcatattcccatgtatcttctcctcggcaatttggccttcgtggacgcttggataagctcgactgtaactcctaaaatgttaaataactttttggccaaaagcaaaatgatctcattgtctgagtgcaagattcaatttttctccattgctataggggttactaccgagtgtttcctcttggccaccatggcctatgatcgttatgtggccatttgcaaaccgctgttgtatcctgcaatcatgactaacggactgtgtattcgactactgatcctctcatatatcgccggcatccttcacgctctgattcacgaggggttcctgtttaggcttaccttctgcaattctaacatcgtccatcacatttactgtgataccatcccactttctaagatcagctgcaccgactccagtattaacttccttatggtgtttatcttctctggctctatccaggtgttcagcatcgtgacaattctcatcagttacacatttgtgttgttcacagtgctggaaaaaaaaagcgataagggagtcagaaaggccttttccacatgtggcgctcacctgttttcagtgtgcctgtattatgggcctttgctgctgatgtatgtgggaccggcatcaccccaagcagatgggcagaacatggtggagccacttttctataccgtgatcatcccactactcaatccaatcatttatagtctcaggaacaaacaggtgatagtgagcttcatcaaaatgctaaaacgcaacggcatctag

SEQ ID NO: 49286 - DNA, 966 bp, Artificial Sequence
  Description of Artificial Sequence: Synthetic coding sequence
atgaacaaggagaaccacagcctgatcgccgagttcatcctgaccggatttacttatcatcctaagctgaaaaccgtactctttgttgtgttcttcgcaatctatctaattactatggtcggaaacattggtctggtggctctgatctacatagaacaacgactacatacccccatgtatatcttcttaggtaatctcgtcctgatggactcatgctgttcctctgccattacccctaagatgctggagaactttttcagtgaagataaaaggattaccctctatgagtgcatggcacaattttacttcctatgcctggctgagactaccgactgttttcttctggccgctatggcctacgattgttacgtcgccatctgtaatcccctgcagtaccatactatgatgagtaagacactttgcattcagatgaccgccggcgcctacctcgcgggaaacctgcaccccatgatcgaagttgagttccttttgcggctgaccttctgcggatcacatcagatcaaccattttttttgcgatgtgctccctttgtaccgcctgtcatgtataaatccgtacattaacgaactcgtgcttttcatcctggcaggcagcatccagatcttcacaatcgtcttagtctcatacttttatatcctgttcacaatcttcactatgaagagcaaagaaggtcgcggcaaagccctgagcacatgcgcgtcccactttctgtccgtgagcatattctgcgactcattactgtttatgtatgcccgacctggagctgtgaacgagggtgacaaagatattccagtggccatcttttatacactggttataccactcctgaaccccttcatatattccttaagaaataaggaagtgataaacatcatgaaaaaaattatgaaaaagaggaagttctgtcatatcctgaagcagatgtcatcacccctggccacctag

SEQ ID NO: 49287 - DNA, 966 bp, Artificial Sequence
  Description of Artificial Sequence: Synthetic coding sequence
atggtgaacctgaccagcatgagcggcttcctgctgatgggcttctccgacgagagaaagctacaaatccttcacgccctcgtgttcctggttacctacctgctggcactgactgggaacctgctgatcattaccattataactgtggacagacgcttgcactcacctatgtactactttctcaagcatctgagcctgctggacttgtgtttcattagcgtgaccgtgccccagtccatcgcaaacagtctgatggggaatggttatatatcactggtgcagtgcatcctgcaggtcttcttcttcattgccctcgcctcgagcgaagtggccattttgaccgttatgtcatacgatcggtatgccgcaatatgtcaaccactccactatgaaacaatcatggatcctcgagcctgccgccatgccgttatcgcagtgtggatcgcaggggggctttccgggctcatgcacgccgcaattaatttttctattcccctatgcggcaagagggtgatacaccagttcttctgcgacgtgccacagatgctaaaactcgcatgttcttacgagttcatcaacgagatcgctctggcggcattcacgactagcgccgcatttatttgccttatctctatcgtactctcctacatcagaatttttagtacggtgctgcggattcctagtgccgagggtcggactaaggtcttcagcacatgtttgccgcatctgttcgtagccacattctttctctcagctgcaggcttcgagtttctccgactgccctctgattctagctccacggtggatttggtattttcagtcttctataccgttattcctccaacgctgaatcctgtcatctactccctgaggaacgatagcatgaaagccgctttgagaaaaatgctgtctaaagaagagcttcctcagaggaaaatgtgtctgaaagccatgttcaagctgtag

SEQ ID NO: 49288 - DNA, 966 bp, Artificial Sequence
  Description of Artificial Sequence: Synthetic coding sequence
atggagcggaagaaccagaccgccatcaccgagttcatcatcctgggattcagtaaccttaatgagtggcagttcctgctatttaccatcttcttcttgacatacttctgcactcttggtgggaacattctgatcatactcaccactgtcactgaccctcatctccatacccctatgtattacttcctgggaaatctagcattcattgacatatgctacacaacgtcaaacgtacctcagatgatggtacaccttctgtctaaaaaaaagtcgatctcttacgtggggtgtgtagttcagctgtttgccttcgtattcttcgttggtagcgaatgcctccttctggccgccatggcatatgatcgatacattgccatatgtaaccctctgcgatacagcgttatcctttccaaagtgctctgtaaccagctcgccgcctcctgttgggccgcaggattcctgaacagcgttgtgcatacagtgttaacattttgtctccccttttgcggtaataatcagatcaactatttcttttgtgacatccctccactgcttattctcagttgcggtaacacctccgtgaatgaattggccttgcttagcactggagtgtttatcggctggacccccttcctgtgcatagtgcttagctacatttgtataatctctactattctgagaattcaatcttccgaggggcgtagaaaggccttcagtacttgcgctagccatctggcgatcgtgttccttttctacgggtctgcgatttttacgtatgtaagacctattagcacctatagtctgaaaaaagaccggctggtgagcgtcctgtacagtgtcgtcaccccaatgctgaaccccataatctacaccttgaggaacaaagacatcaaagaagctgtgaagacaattggaagtaagtggcagccgcctatatcttcactggattctaaactcacctattag

SEQ ID NO: 49289 - DNA, 966 bp, Artificial Sequence
  Description of Artificial Sequence: Synthetic coding sequence
atggagcggaagaaccagaccgccatcaccgagttcatcatcctggggttctctaatctgaatgaactgcaatttctgctcttcaccatatttttcctgacatatttctgtacactgggcggaaacatactgatgatcctaacgaccgtgacagacccacacctgcacacgcctatgtactactttcttggcaacctcgcatttatcgacatttgttacacaacctctaacgtgcctcagatgatggtgcatttattgagcaaaaagaagtccatctcttatgtcggatgcgtagtccagctgtttgctttcgtgtttttcgtgggcagtgaatgcttgctcttggccgcgatggcgtatgatcgttacatagccatttgtaacccactgaggtattcggtcatcctttcaaaagtgctgtgcaatcagttggccgcttcatgttgggccgcaggcttcttgaatagcgtggtccataccgtgctgactttctgtctacctttttgcggcaataaccagattaattactttttctgtgatattccccctctgttgatcttaagttgcggaaacacctcagtcaatgagttagctctacttagtactggtgtgtttattggctggaccccctttttatgcatcgttctttcttacatctgcattatttccactatattgagaatccaaagctccgagggtagaagaaaggccttctccacatgcgcgagccatctggccatcgttttcctcttctacggaagtgccattttcacttacgtcaggccaatttccacttactccttgaaaaaagatcggctcgtgtccgtgttgtactccgtggtcactccaatgctaaatcctatcatttatactctgagaaataaagatattaaggaagctgtcaaaactatcggctccaaatggcagcctccaattagctcgttagatagcaagctgacatactag

SEQ ID NO: 49290 - DNA, 966 bp, Artificial Sequence
  Description of Artificial Sequence: Synthetic coding sequence
atggagcggaagaaccagaccgccatcaccgagttcatcatcctggggtttagcaatctgaatgagctccaattcctgctgtttaccatctttttcctgacttatttttgcactctggggggaaacatcctgatgatcctcacgaccgtcactgatccccatttgcacactccaatgtactatttcctcggcaatctagcattcatcgacatttgttataccacttcaaacgtgccacagatgatggtgcatctgctgtcaaagaagaagtcgatctcttacgtggggtgcgtggtccagctgttcgctttcgttttctttgtgggctccgagtgcctgctgctagccgcaatggcctacgatagatatattgccatctgcaatccactgagatacagcgtgattttgagcaaagtcctttgtaatcagctggccgctagctgttgggcagcaggtttccttaacagtgttgttcacaccgtcctgaccttctgcctgcccttctgtggcaacaatcaaatcaactatttcttttgcgatatccctccgcttctaattctctcttgtggcaacacctctgtcaatgaactggcactcctcagcaccggcgtcttcatcggttggacccctttcctatgtattgtgctttcatacatttgcattatctctaccattctccgcatccagtcgtctgagggcagacggaaagccttctcaacttgcgcttcccacttggccattgtgtttcttttctatgggagcgccattttcacctacgtccgtcccatcagcacctattctctaaaaaaggaccgcctggtgtcagtcctgtattcggttgtgacacctatgttgaacccgataatctatactttgagaaataaggacatcaaggaggctgttaagaccattggtagcaaatggcagccgcctatcagcagccttgatagcaagctcacatattag

SEQ ID NO: 49291 - DNA, 966 bp, Artificial Sequence
  Description of Artificial Sequence: Synthetic coding sequence
atggagcggaagaaccagaccgccatcaccgagttcatcatcctggggtttagtaacctcaacgagctgcagtttctactgtttactatcttttttctgacctacttttgtactctgggcggcaatatactgatgatcctgaccacagtcaccgaccctcacctgcacactcccatgtactactttctggggaacctggccttcattgatatatgctataccacttctaatgtgccacagatgatggtgcacttgctctccaagaaaaaatcaatatcctatgtaggttgcgtggtgcagttgtttgcttttgtcttttttgtgggaagcgagtgcctactcttagctgccatggcttacgatcgctacattgccatttgcaaccccctgcgatacagcgtaattctttctaaagttctttgtaaccagttagctgcgagctgctgggcagctggttttttgaatagcgtggtacatactgttctgaccttttgtctgccattctgtggtaataatcagattaattattttttctgtgacatccccccactgctgattctgagctgcggcaacacctctgtgaacgagcttgcattgctctccaccggcgtgttcatcggctggactccattcttatgtattgtactgagttacatttgcataatttctactatcctcagaattcaaagctccgaaggacggaggaaagccttcagcacctgcgcttcccacctggctatcgtgttcctcttttacgggtccgccatcttcacttatgtgcgcccaatcagcacttattcccttaagaaggacagactcgtaagcgtactgtactcagtcgtgaccccgatgcttaatcctatcatctataccttgcggaataaggacatcaaggaagctgttaaaaccatcggcagcaagtggcagcccccgatcagctccctggatagcaagctcacctactag

SEQ ID NO: 49292 - DNA, 939 bp, Artificial Sequence
  Description of Artificial Sequence: Synthetic coding sequence
atggagatcctgagcaacagcaccagcaagttccccaccttcctgctcactggtatccctgggctcgagagcgcgcacgtttggatctccatcccattttgctgcttttacgctattgctctcagcgggaatagcgtgatattgtttgtgattatcacacagcagagcctgcatgagccgatgtattacttcttgttccgtctgagtgccaccgatcttggcctgacagtctcaagtctttctactacactggggattctctggtttgaggctagagaaatcagcctctattcttgcatcgtgcagatgttttttctacatggcttcacctttatggaaagcggcgtgctcgtcgcaaccgccttcgacaggtacgtcgcaatatgtgacccactgcgttacactacgatcctgactaattccagaatcatccagatgggattactgatgataacacgcgctatcgtccttattcttcctttgttacttctgctcaagcctctgtatttctgccgcatgaacgctttaagtcacagctactgctatcaccccgatgtcattcagctagcatgcagtgacataagggcgaatagcatatgtgggcttattgatctgatcctgacgaccggaatcgatactccttgcatcgtgctgtcatacatcttaatcatccactctgttcttcggattgcaagtcccgaggagtggcacaaggtcttttccacttgcgtcagtcatgtgggggctgtggcattcttctacatccatatgctgagtctcagtctggtctatcgctatggaagaagtgccccacgggtggttcactcagtgatggctaatgtgtatctgctgctgccccctgtgctcaacccaataatagatagcgtcaagactaagcaaattagaaaagccatgttgtcactattgctcaccaagtag

SEQ ID NO: 49293 - DNA, 960 bp, Artificial Sequence
  Description of Artificial Sequence: Synthetic coding sequence
atgctgcagaaccaggacaccatggagatcctgagcaacagcaccagcaagttcccaaccttcctgctgactgggattccaggtttggagtctgcccatgtctggatatccatacccttttgctgtttttatgctatagccctctccggcaacagcgtcatcctgtttgtcattatcacccagcagtctctgcacgaaccgatgtattactttcttttcaggctctccgctacggaccttgggttaacggtttcaagcctgtccactacacttggcattctgtggttcgaggcacgtgagatctctctgtactcttgcattgttcaaatgttcttcctgcatggctttaccttcatggaaagcggtgttctggtggcaaccgcattcgacagatacgttgccatttgcgaccctctgagatacaccacaatcttaaccaattctcgcattatccagatgggacttttaatgatcacgagagcgattgttcttattctgccgcttctgcttctacttaagcctttgtacttttgtagaatgaatgctctgagccattcatactgctatcaccccgatgtaatccagctggcatgcagtgatatccgggcgaattcgatttgcggcctgatcgacctaatactgacaacagggatcgatacaccctgtattgtcctgtcatatattcttatcatacactcagtgctacgcatagcttcgcccgaggagtggcacaaagtgttctccacctgtgtgagtcacgtgggggctgtggcctttttctacattcatatgctgtccctgagcctcgtttaccgatacggaagaagcgcgcctcgtgtagtccactccgtcatggccaacgtctacctactcctcccccccgtgctcaaccccatcatagactccgtgaaaaccaagcaaattcgaaaagccatgctgtctctgctactgacaaagtag

SEQ ID NO: 49294 - DNA, 981 bp, Artificial Sequence
  Description of Artificial Sequence: Synthetic coding sequence
atgagcgtgcagtacagcctgagcccccagttcatgctgctgagcaacattacacaatttagcccaatcttttatctaacctcctttcccggcctagaaggaatcaaacactggatcttcatccccttcttttttatgtatatggtggcgatttctggcaattgttttatccttatcattatcaagactaacccccgcctgcacacccccatgtactaccttctgagcctccttgcccttacggatctaggcttatgcgtgagcacactgcccaccacaatgggcatattctggttcaacagccacagcatctattttggcgcctgtcagatacagatgttctgcatccattccttttctttcatggaaagcagtgtgttgctaatgatgtcgttcgatagactcgttgccatttgtcaccctctcaggtatagcgtgattatcactggtcagcaggttgtgcgggccgggctcattgtaattttcagaggacctgtggcaacaatccctatcgtgctcttgttaaaggcttttccatactgtggctcagtggtcctcagccactctttttgtctacaccaggaagtgattcagcttgcatgcacggatattacctttaacaatctctatggcttgatggttgtcgtctttactgtgatgctggatttggttctaatagcgctttcctacggccttatcctgcataccgttgccggcctggcttcccaggaggagcagaggagagcgtttcagacctgcaccgcgcccctatgcgctgtgcttgtattttttgttccaatgatgggtctgtcgctcgtgcatcgctttgggaagcacgccccacctgctatacacctgctgatggcaaatgtatatctgtttgtgcctccgatgttaaaccccattatctactcgataaaaacaaaagagatccacagggccattattaaatttctgggactgaagaaagcttctaagtag

SEQ ID NO: 49295 - DNA, 945 bp, Artificial Sequence
  Description of Artificial Sequence: Synthetic coding sequence
atgaagaacaagagcatggagatcgagttcatcctgctgggcctgactgacgatccgcagttgcagattgtgatctttttatttctgttccttaattacaccctgagccttatgggcaatcttatcattattattctgacgctgttggacccccgcctcaagacccctatgtatttcttcttgcgcaatttctcttttcttgaagtcatctttaccaccgtctgcatcccgcggtttttaataactattgtcacaagagataaaacaattagttacaacaactgcgcaactcagctgttcttcatcctgttaccaggtgtaacagagttttatttactggccgcgatgagttacgatcgttatgtagctatttgtaaaccccttcattatccaattataatgagtagtaaggtatgttatcagctggtgttatctagctgggtgactggattcttgatcatttttccaccactggttatggggctgaaattggatttctgtgcttccaaaacaatagatcactttatgtgcgagactagtcctattctacagatttcatgcacggacacacatgtccttgaactgatgtcgtttacccttgccgtggtcacactggtggttaccctggtgttggtaattctgtcgtacacctgcataatcaaaactattcttaagtttagctcagcccagcagcgcaataaagcattcagcacctgtacctctcatatgatagtggtctccatgacctacggatcctgcatttttatgtatattaaaccttcagccaaggaacgggttactgtgagcaaaggtgttgctctgctgtacacgtctattgcccccctgctgaaccctttcatctacactctacgaaatcaacaggtcaaagaggtattctgggacgtcctccagaagaacctgtgcttttctaagcgtccattttag

SEQ ID NO: 49296 - DNA, 939 bp, Artificial Sequence
  Description of Artificial Sequence: Synthetic coding sequence
atgaagaaccggaccagcgtgaccgacttcatcctgctgggcctgactgacaatccgcagttacaggtcgtgatcttctccttcttgttcctcacatacgtattgagtgtcacgggtaatttgactattatctccctgacactcctggacagccacctgaaaacaccgatgtacttcttcctgaggaacttctccctggagattagtttcacatccgtgtgtaaccctaggttcctcatcagcattctgaccggcgataagtcaatatcctataacgcctgtgcagcacagttgtttttcttcatatttctcggctccacggagttctttcttctggcttctatgagttacgactgctacgttgcgatttgcaagcccctccactacaccactattatgagtgatcgcatttgttatcaattaattatttccagttggctggcaggattcctggtgatatttcccccgttggccatgggtctccagttagacttttgcgacagcaacgtgattgaccattttacttgcgacagcgcacccttattacagatctcttgtacagatacaagcacccttgagctcatgtccttcatcctcgcgctgtttactctgatctcaaccctgattctggttatactttcgtatacatatatcatccgcaccatcctgcgtatcccctctgcgcagcaaagaaaaaaagcttttagcacttgctcatcacatgtaatcgttgtttctatttcatacggatcttgcattttcatgtatgtaaagacctccgccaaagagggtgtcgcactcacgaagggcgtggcgattcttaatacaagcgtcgccccaatgctcaatcctttcatttatactttgaggaatcaacaagttaagcaagcattcaaggacgtgctccggaaaatttcccacaagaaaaagaagcattag

SEQ ID NO: 49297 - DNA, 114 bp, Artificial Sequence
  Description of Artificial Sequence: Synthetic coding sequence
atgatcaccgacgtgcagctggccatcttcgccaacatgctgggcgtgtctctgtttctgctggtggtactataccactacgtcgctgttaataaccccaaaaagcaagagtag

SEQ ID NO: 49298 - DNA, 330 bp, Artificial Sequence
  Description of Artificial Sequence: Synthetic coding sequence
atgagcatcaccgacgtgctgagcgccgacgacatcgccgccgccttacaggagtgccaggacccggatacgttcgagcctcaaaagttttttcagacctcgggcctcagtaaaatgtctgccagccaggttaaggatgtgttcaggtttatcgataacgatcaatcagggtacctggatgaggaagaattaaaattcttcctccaaaagtttgagtcgggagcccgagagctgaccgaatccgaaaccaaatctctcatggctgcggctgataatgatggcgacggcaaaatcggcgctgaggaattccaggagatggtacacagctag

SEQ ID NO: 49299 - DNA, 372 bp, Artificial Sequence
  Description of Artificial Sequence: Synthetic coding sequence
atgaagaccatcctgggcttcaagggcctgttctacctgcacagcttaatctggacttgcgctggagattggagtgcgatccaggttcactgtacacagttctggtttttcgctcgcattaaaccgacgattttctacaatctgtatgtgaatcctgacgaagtttttctcggggatggatgccatgtcacccatgtactgccaaatgtgtactatgagttcttctatcatccacacgattgtggtatagttactcagccacttcaggaagtactcctactgaagacgaagattcgctacatctcaagagactcaactgtcagaagtgaaatgccccttagctgtgtggtccataagcagaaatgtcagtag

SEQ ID NO: 49300 - DNA, 1356 bp, Artificial Sequence
  Description of Artificial Sequence: Synthetic coding sequence
atgggcaacctgctgggcggcgtgagcttccgggagcccaccaccgttgaggattgcgactccacctggcagactgatagcgagcctgagcccgaagagccagggccagggggcggtagtgaaggaccagggcaggaatcagagcagcctgcccagcctccagaacaggctggcgggagacccggtgcatcccccgcaccagatgaagatgcagaggcggccggagcagagcaagggggggacagcacagaagcaaccgccaaacctaagcgatcgttctacgcagcccgggacctgtacaaatacaggcaccaatatccaaacttcaaggacatcaggtaccagaatgacctgagcaacctgaggttctacaaaaataaaatcccatttaaaccagatggagtgtacatagaggaagttctttcaaaatggaagggtgactatgagaagctagagcacaaccatacttacatccaatggttgtttcccctacgagagcagggactcaacttttacgccaaagaactaactacatacgaaatcgaagaattcaagaaaaccaaggaggccatacggcggtttctcctggcttacaaaatgatgctggagttctttggcataaagcttaccgacaagaccggtaatgtcgcaagggctgtgaactggcaggaaaggttccagcacctcaacgagtctcagcacaattacctacgcattacgaggatcctcaaaagcctcggtgagctgggctacgagagcttcaaatctcctctggtcaaattcatactgcacgaagctctggtggaaaatacgatccccaatatcaagcagtcagccctcgaatactttgtctacacaatcagggacaggagagagagaaggaagctcctgcgattcgcacaaaaacactacactccatccgagaacttcatctggggaccaccaaggaaggaacagagtgagggatctaaggcccagaaaatgtcttctcccttggccagctctcataacagtcagacttcaatgcacaaaaaagctaaagacagcaagaactcttccagtgccgtgcacctaaactcaaagacagccgaggacaagaaggtggccccaaaggaacccgtcgaggagacagatcgcccctcccctgaaccctcaaacgaggcagccaagcctcgcaacacagaaaaggatagtaatgccgagaacatgaattctcagccggagaagaccgttactactcctaccgagaagaaggagagtgtgtccccggagaacaatgaggagggtggcaacgacaaccaggataatgagaaccccggcaatacaaattgtcacgatgtggtgctcgtccagtag

SEQ ID NO: 49301 - DNA, 570 bp, Artificial Sequence
  Description of Artificial Sequence: Synthetic coding sequence
atgatcaacacccaggacagcagcatcctgcccctgagcaactgcccacagctgcagtgttgtcgccacattgtaccaggacccctctggtgcagcgatgcccctcatcccctcagcaagatacctgggggtaggggagggggtagagaccccagcctgtcagccctgatttacaaggacgagaagttgacggtcacccaggacctcccagtgaacgatggcaagccgcacattgtccactttcagtatgaggtcactgaagtcaaagttagctcctgggacgccgtgctgagctcccagagcctctttgttgagatccccgatggcctgttggctgacgggagcaaggaaggcctcctggctctgctggagttcgctgaagaaaagatgaaagttaactacgtatttatctgtttccgcaagggaagggaagaccgcgccccactgctcaagactttctcttttctcggctttgagattgttcggcccggtcacccatgcgtcccaagcagaccagatgtgatgtttatggtataccccctggatcagaatttgtcagatgaggattag

SEQ ID NO: 49302 - DNA, 7035 bp, Artificial Sequence
  Description of Artificial Sequence: Synthetic coding sequence
atgatcccctggagcatcttcctgctgcacgtgctgctgttcagcctgcaagaatacatatgtgccagtagcatactgatggggacaagcaagaacggctttaatgagaatcggcagaagcgggctttgctggctgcccaatttgaggcaacgtccccccggtactttttccatgacgccatcaactggggcgaatccaaaatcaagggatcatgcccctatgaatgcctgaacggcgcgttttgcagtaagaccggcacctgtgactgccagatcttccaagcactcgggaccagatgccagatcatcccaaacatggggaacggtcgggacggcatctgtaaaacctgggggcagtatcactttgagacctttgacggaatctattattacttccccggcaactgcagttatatatttgctaaggactgtggcgatctggaacctcgttacacagtctgggtccataattctcccaaatgtttaggctccgtgtacagctgctacagatctatctccctcttcttctctaaccaagaagaaataagaatttacggacatgagattaagaaaaacgggatatcgctcactctgcctcagaccatagggcaaatattcatcgagaagctcgcggactacatccttgtcaagactacattcggcttttctttggcctgggatggcatctccggcatctacttgaagttgagcgaagaccataaggggaagtcttgtggactgtgcgggaattacaacgacatccagtccgatgactttatcatcctgcaggaggattatactgaggacatcgcaatgttcgcaaacagttggtcagtgcaaactccggatgacactaagtgcgtattaaccccatccgattttcccaatccttgtagtagcggaatgcctgcattcgaggcaatcttcttcaaatgccagatcctgctccagtttccgtttctttcctgtcatgagtatatcgatccatacttgtatatcgcgtcctgtgttaatgatttatgtaaaacagacgatgacgagacttattgtagagccgccaccgagtatgcccgtgcatgtagccacgccgggtacccaatacaagattggagagatgacttcccggcttgtaccgataagtgtgacgactcctttgtccatcgggattgtatatcttgctgccctccaacatgcacatttgagaagcagtgcctcggctcaaatcttcattgcctagacgggtgctactgtcctgacggtttggttatggacaacggcacctgcatatctctggagaattgcccctgcggcttccatggcctggcctattccgtcgggagtaagattgagcaggaatgcacagagtgcgtttgcgtcggcggcgtatggaactgcacagaacaggactgccctgtgcaatgcagcgtcgtgggagatagtcacttcactacttttgatggcagacattactccttcatcggaatgtgccagtatattctggtgaagggcacaggcaaggataaattcaccatcaccctacagaaggcgccttgcgagcagaatctaggcctggtctgtctgcagtcaattacactcatcctggaagatgatttcaacaagcaagtgaccctcggtagaggaggacagattctaacctcgccaaaccagggtttcaacctgaatgggatagttgagattcagaccctgtccagcttgttcattctccttaagacaacatttggacttaaaatcttgtttgccatcgacggtgaaaggatttatatacagctaacctctgcctggaaaaggcggaccctcggcttgtgcgggacctttaatggtaacatacgggacgattttttatccccgagtgggatgatagaggggacaccccagcttcatgccaacgcatggagggtgagctctacttgctttgcccctgtgcatgttcctgtcgtcgacccttgtaacatcaatcaacaaaacatcggttatgcagctcattgcgatgtgatccaccaagagctgtttgcgccttgccatatttacataagcccaggcctgtattaccaactgtgtcgacacgacgcctgcaagtgcgggagcagctgtttatgcaacgccttagcacactatgcctatttgtgcggacaacacggagtgcccatcgacttcagaacacagatctctttttgtgccgtggtttgccagaaaggaatgttgtatcatcattgttcttctttctgcctgcactcctgcatcagcctatcaagtccggaacagtgtagtgacgattgtgctgaaggatgtaactgccccgaaggtaagttttacgaggataccttaaacttttgcgtgcctattttccattgtagatgtcactacagaggttcagtgtaccagccgggtgagctgatccctactccaagcgggctatgccaatgttctaatgggactgtaaagtgtgatgagctggcaactccaagtgccgtgcacatctgccctgagggcaaagagtacttcgactgcagattcccggatccagagctcccggctggaggagtgaattgtgagaccacttgcgcgaatttagcgatgaatttcacctgcactccttcctcaccttgtatcagcggctgtgtgtgcgcacccggaatggctgagcatcgagggaaatgctatgtccctgaatcttgtccctgtatctggaaagactgggagtatctgagtggcgaagtgatcgctaccccctgctatacctgcgtttgcaggcgcggtatgtttaattgtacatattacccatgtcctgcagtatgtaccatatatggggacaggcactattactcgttcgacggcctggaatacgattacattagtgattgccaggtctttctcatcaagagtgctgatgactccgatatttctgtgatcgctcagaacaaaaagtgcttcgataatgacattgtctgcagtaagtctgtactgatctcggtgggcgacactgagatctacttgaatgacacaccatataaacagaagcagagcgggttttttctggagaacaagtctacctaccagttgtggaaggctggctactatatagtagtctactttccagagaaagatatcacgatattgtgggatcgcaagaccaccatccacattaaggtaggtccccaatggaaaaataagttgagcgggctttgtgggaacttcgacaagtgcaccagcaacgatatgacaaccagcaataatctagaagtcagaaacgccagagtctttggcgattcctgggccctgggacagtgcgagagccccgacgagaccatcaaaccttgcgaagcgcaccagaacaagtttccatacgctaagaaagagtgcagtattctttactctgacatattcgcttcgtgcaggaacgttattgacgtgaccagctttgccaagaactgtcatgaggacacttgtaactgcaacttagggggagattgtgagtgtctctgcacctccatagcggcctacgcatataaatgctgccaagagggcatctccatccactggaggagctccacagtctgtagtttggactgcgaatactacaatgaaggccttggagagggtccctacatgctggcttcatatggccaatcaggacttgtgctcggagctaatatgacatcccggtccgtgttctgtttgccaagatcctccgttcatacttccctgttcttttatttcatgattacacctggtcttttcaaggaaaaggtcagcagtctggccctcgtttctttggagagcgctgagaggcctaactatttcctctatgtccatgacaacgacacattgagtttggagctgtgggaggcaaactcagccttccatcgcagagccacgttctttcaccaccagggtttgtggattcctggctattccgcctttgaactgtacagcaagaaagggttttttatcatattcaccgattcctccgtaaaggcctctaagtatgacgatagcgaggaattcaagcattcttcatcattcagcattgaagagattcaggcagcggtgccataccgcaagatgtgtgagtggagatacgagccctgtgccacaccgtgcttcaagacttgttcagaccctgaagccttagcctgtaagttccttcctcctgtagagggctgcctgccctattgccccaaaaatatgattctggatgaggtgaccctaaagtgcgtttaccctcgcgattgcatccctgttattccaacagaacctaccctgatgcccccagcaaaaccaacagtgccgatgtttactgtatgggagatgattacaccgtctgacatcacagtatttgacatgctaacgccaacgactgggctggaatgcgagccccagaaattcgaccctgtatatgattgcagccagtatatttgtctaaatatggagtggcaactgtacaattggagcctcaactgccccaaagatgttgaaatgccggactgcggattcagaggccgccctgttcaggtcaattccgatatctgttgtccagagtgggagtgtccctgccgctgcagtatgctgtcagagctctccattatcacttttgacggtaataacgcggccctctactcaatggcatcatacatacttgtaaggatccccggggagatcattgttgcccatatcgaaaagtgctccatgaaccagaacggcaacagtttgaagaagttagctcctagtggcaggatctctggattgtgctttaagaaactgaacgtgaccacccccatccataagataattgtgaatcgtctcgcccgcaaagtggaggtcgactccattgtggtgcccctgccattttcttctcaagagctgtcaatcgaagatagcggttcaatgtatgtaatcacaacacctgctgggctgatcatcaaatggtcccacttaactggtatcatagatatccactttggatttaggtttaatctcagcagttacacagagggactgtgcggcatctgcaacgaggatcccgatgatgacctccgcatgcagaatggaaccatcatcaccaatatggaagacattggcctttttattgaaagctgggagatcgagaaatcttttgaggtgacgatgagaagacccgtccgcaattgcaccgaacatgattgttcacagtgcatcgacctactgaaccggagaatctttatcccttgtcatgacaaggtgtcaccagaggacttctgtgaaaagatgtggataaattacacctacttctggaattacgaatgcgacgccctttctgcttatgtcgccctgtgcaacaagttcgatatctgtatccaatggagaactcctgattattgttcattgagttgccccgaaggtaaggaatatcagccctgtgtccggccctgcgaggctcgaacgtgcttaaaccagtggttctacggccatacatcctgtctgaacctccgcgaggattgtgtttgcaaagtgggtaccattctgcatcggcctcacagcgcgcaatgcatcccagaaaaggaatgcgcctgcaccgactcagaagaccagcccagaacggcgggcgaaatctggaacggtgggatcgatgaatgcacgctgtacaagtgcctggagaacggcagtatcattcccattgaaccagattgcgacgaagaaccgaccccggtgtgcgaacgcgaggccgaagtcgtaatgggaataatcgacaaatggacctgctgcagtaaggaggtgtgtgggtgcgatacaacgctgtgtgagacaagcatccccacttgcactaattcacagaaactaatcgttgggcatagcccattaagttgttgcccacagtacaaatgtgagtgtgacccactaaagtgcccttccatttcaacacctgagtgtcgtgaagatcagttcatgattcaagtgcgccaggaagaaccctgctgtttttcgcctttttgcgtgtgcgagagttgtacgaagcccgtaccactgtgtcacgatggcgaattcctgactgtggacctaaatagcacgcacttttgctgtcctcagtactactgtgtttgcgaacctaatttatgccccatgccactgttgaattgcgctgaggacatgaacttggtgaaggaaaacgtcagcggacaatgttgtcccacctggcattgcgagtgtaactgcgaaaacctgattatgcccacatgtgaagttggcgagttcaccgcaattgatcacaactttcaatctgattgtggatgcattcagtatttgtgcgaaaaagacgatgtgtgcgtgttccaggaggtcagtgtgctgaaccccggccagtccatgattaaatatctagaggaagacttttgttacgcaatagagtgtctggaggaaaaggataaccacactggattccacaccctgaattttaccctcgtcaactgcagtaagaaatgtgatgttcaccaagtgtacactccgagcccctccgattacggctgctgtggcacttgcaagaatgtgtcttgcaagttccacatggagaatggaacatcagtagtgtacgccgtcgggagcacctggcattacaactgtactacatatgaatgtgtgaaaacagatgaaggggccataattctaaactatactatggtctgcccgccttttaatgaaacggagtgtaaaatgaacgagggaatcgttaaactgtacaacgaggggtgctgtaaaatctgcaaaagggaggagaggatctgtcaaaaagtaataatcaaatccgtgattagaaagcaagattgtatgtcccagagccctattaacgttgcctcctgcgacggcaagtgtccttcagcaaccatttacaatataaacattgagtcacacctgcgattctgtaagtgttgccgtgaaaacggcgtgcgaaatctctccgttccactctactgcagcggcaatggtacagagattatgtacactctacaggagccgatcgattgtacatgccagtggaattag

SEQ ID NO: 49303 - DNA, 1434 bp, Artificial Sequence
  Description of Artificial Sequence: Synthetic coding sequence
atgtggatgttcagctggctgtgcgccatcctgatcatcctggccattgcaggaatgaacaccatcgccaaaaccacacctcatacaaagttcactaagaagtcagaggaacgggagatgccaaagggccttaagccttcctcgggccccccccctgaagaagaggagaccctgttcaccgaaatggccgaaatggccgaacccatcaccaaacccagtgctctggatagcgtgttcggtactgcaacactgtctccctttgagaattttaccctcgaccctgcggactttttcttgaactgctgtgactgctgttcccccgtgcctggtcagaagggtgaaccgggcgagactgggcagccagggcccaagggcgaagccggcaacctggggatcccaggaccgcccggtgtggttggcccccagggtcctaggggctacaagggagaaaaaggtctgaagggagaaaggggagatcagggcgtccctggctaccccgggaagcccggtgcgcagggagagccgggccccaagggggataagggaaatatcggcctgggaggagttaagggtcagaagggctccaaaggcgacacctgtggaaattgtactaagggggagaaaggggaccagggagcaatgggaagcccaggcttgcatggtggtcctggtgctaaaggagaaaagggagagatgggggagaagggagaaatgggagataaggggtgctgcggtgacagtggcgaaaggggtggcaagggacagaaaggtgagggcggaatgaaaggagagaagggcagcaagggagactcagggatggaagggaaatccggcagaaatgggttgcccggcgcaaaaggagaccctggtattaagggagagaaaggagagctaggtcctcctggactgctggggccaaccggacccaaaggagacatcggaaataaaggagttaggggtcctactggaaaaaagggtagccgtggattcaaggggtcgaaaggcgagcttgccagggtgcccaggtcggcattctctgctggattatccaagccttttccccctcccaacattccaatcaagtttgaaaagatcctttacaacgaccagggtaattattccccggtgactggtaaattcaattgctctattccagggacatacgtcttttcctatcatattaccgtgcgcggtcggcccgctcgcataagcttggtggctcaaaacaagaagcagttcaagagcagagagaccctatacggacaggaaattgatcaagctagtcttctagtgatcctcaagctctctgccggagaccaggtatggttggaggtttccaaggactggaatggtgtgtacgtgtcagcagaggatgactccatattcactggattcttgctttaccccgaggagaccagtgggatctctccatag

SEQ ID NO: 49304 - DNA, 1716 bp, Artificial Sequence
  Description of Artificial Sequence: Synthetic coding sequence
atgaccatcctgcccaagaagaagccccccccccccgacgccgaccctgctaacgagcctcctcctcccggccctatgcctcctgccccacgtaggggcggcggggtgggggtcggcggaggcggtaccggagtggggggcggcgaccgagaccgcgactctggggtcgtcggtgcccgccctagggcttcacccccgccacagggcccactgcccgggcctccaggagcactacacagatgggcactcgccgtgccaccaggcgccgtggcaggaccaaggccacagcaggctagtcctcccccctgcgggggacctggcggtcctggaggcggacccggggatgccctgggagccgccgccgcgggggtgggggcagcaggagttgtggtcggagtaggtggagcagtgggggtcgggggatgttgttctggccctggacactctaagcgccgaagacaggcaccaggagtcggcgctgtgggtggaggaagccctgaacgcgaagaggtgggtgccggatacaactcagaagacgaatacgaggccgccgctgcccgtatcgaggccatggatccagccaccgtcgagcagcaggaacactggttcgagaaggctctccgcgataagaaaggattcataatcaaacagatgaaagaggatggcgcttgtcttttcagagcggtagctgatcaggtgtacggggatcaggacatgcacgaggtcgtccggaaacattgcatggactacctgatgaaaaacgccgactatttcagtaattatgttacggaagactttactacttacattaaccggaaaagaaaaaacaactgtcatggaaatcacatcgaaatgcaggcgatggccgaaatgtacaaccggccggtggaggtttaccagtacagcacaggtacttctgcagtggaacccattaacaccttccatggaatccatcaaaatgaggatgagccaataagagtgtcctatcaccgcaacatccactacaattcagttgtcaatcccaataaagcaacgattggtgttgggctgggcctcccatcattcaaaccaggcttcgccgaacaatcactgatgaaaaacgctataaagacatctgaggagagctggatcgagcaacagatgctggaggacaaaaagcgggcaaccgactgggaggccaccaatgaggctattgaggagcaagtggcccgagagtcctatctgcaatggctgagagatcaggagaaacaggctaggcaggtgcggggtccctctcaaccaaggaaggcaagtgccacttgcagctccgctacagctgccgcaagctccggccttgaggaatggacttctcgctctccgaggcaacgttcctcggcttcaagcccagagcaccctgagctccacgctgagttgggcatgaagccacccagccctgggacggtcctcgccctggcgaaacctccaagcccctgtgcgcccggtacttcttcccagttttcagccggggcagaccgcgccacatccccgctagtgtccctctatcctgctctggaatgcagggccctcatccagcaaatgtcaccctccgcattcgggctgaacgactgggacgacgacgagattctggctagtgtcctggcagtctcgcagcaggaatacctcgactctatgaaaaaaaacaaagtacatagagatccaccgcccgacaaatcctag

SEQ ID NO: 49305 - DNA, 1701 bp, Artificial Sequence
  Description of Artificial Sequence: Synthetic coding sequence
atgaccatcctgcccaagaagaagccccccccccccgacgccgacccagcgaatgagcccccaccacccggcccaatgcctcccgcgcccagacgcggtggcggggtgggcgtgggaggcggcggtacgggcgttggcggcggcgatcgtgatagggatagcggggtggtgggtgcaagaccgagggcctctccacctcctcagggtccgctacctgggccaccaggggcgctgcatcggtgggcactggctgttccgccaggcgcagtcgctggccctcgcccccagcaagcctctcctcccccatgtggaggtcccggggggccgggaggaggccctggagacgctttgggagccgctgcagctggcgtcggggctgccggcgtggtagtgggcgtagggggagctgttggcgtgggaggctgctgttcgggcccaggtcactccaagcggagacgacaggccccaggagtcggcgctgtaggaggagggtcccccgagcgggaagaagtcggagccggatacaattccgaggacgagtacgaggccgccgccgcaaggattgaagcaatggatccagctaccgtggaacaacaggagcactggttcgagaaagccctgcgggataagaaggggttcattatcaagcagatgaaggaggacggagcctgtctctttagggctgtggccgatcaagtgtacggagatcaggacatgcacgaagttgtgcgcaagcattgtatggattacttgatgaagaacgccgattacttcagcaattacgtgacagaagacttcacaacatatattaaccgcaaacgcaaaaacaactgtcatggcaaccacattgagatgcaggctatggcagagatgtacaaccgccctgtcgaagtctaccaatatagcacagagcccattaacacattccacggcattcatcaaaacgaggatgagcctatacgcgtcagttatcaccggaacattcactataattctgtggtcaaccctaataaggcaactatcggggtcggcctcggcctcccatcattcaagccaggctttgcagaacagtccttgatgaagaacgcgattaaaacgtccgaagagtcttggatcgagcagcaaatgctcgaggataaaaagagagctaccgactgggaggcaacaaatgaagctattgaggaacaggtagcccgcgaatcatacctccagtggctgagagaccaagagaagcaggcacgccaggtgagagggccctcccagccacgaaaggctagtgcgacgtgcagcagtgctactgcagccgcctcgtcagggctggaggagtggacgtcacgctcaccgcgccagcgcagttcagcctctagcccagagcaccccgagctccatgctgagctgggtatgaagccccccagtcccggaaccgtactggcgctggcaaagcccccatcaccttgtgcacccggtacctcatctcagttttcagcaggcgccgacagagctacctctcccttggtttcactgtatccagccctggaatgtcgcgccctcattcaacagatgagcccttctgctttcgggctaaacgattgggatgatgatgagatcttagccagcgttctggccgtcagccagcaggagtacctggatagcatgaagaaaaataaagttcaccgggaccccccccccgataagtcttag

SEQ ID NO: 49306 - DNA, 762 bp, Artificial Sequence
  Description of Artificial Sequence: Synthetic coding sequence
atgggcagcgacgcctgggtgggcctgtggcggccccaccggcccagaggacctatagctgcgcattacggtgggccggggcccaaatataaacttcctccaaacaccggttatgcgcttcatgatcctagtcgcccgagagcccctgcattcacctttggagctaggtttccgacccagcagactacttgtgggcctggtccaggtcacctcgttcccgcgcggatgacggtaaggggcaccgacggagctcccgcttattctatctacggccgccctcgtaggagcgccccatttttgactcccggccctggccggtatttccccgagcgagcaggcaatgccacttacccaagcgctccacgtcatacaattgcccctcggaattggggagttcaagcggagcagcagtcacccggcccagcagcatatactgtaccctctctgctgggccccagagtgatcggaaaggtgtcggcccccacatgcagtatctacggcagacgcgccgccggatcgttcttcgaggatcttagcaagacacccggcccctgcgcatatcaagtggtttccccgggcgtctacaaaagtagagctccgcagtttactatacttgcacgcacttcattaccacaggacaacaccagaaaacccggccctgccgcctataatgttgaccagcacaggaagccccgcggatggagttttgggattagacattccgactacttggctcccctggtgaccgacgcagacaattag

SEQ ID NO: 49307 - DNA, 762 bp, Artificial Sequence
  Description of Artificial Sequence: Synthetic coding sequence
atgggcagcgacgcctgggtgggcctgtggcggccccaccggccccgtggaccaatcgctgcccattatggaggccctggccctaaatacaaactccccccgaataccggctatgctctccacgacccaagccgaccgcgggcccccgccttcacctttggagctcgctttcctacccaacagacaacatgcggtccagggcccgggcacttggttccagccagaatgaccgtgcggggcacagacggagccccagcctattcgatctacggtcgcccccgacggagcgctcctttcttgacaccaggaccaggaaggtactttcctgagagagccggcaatgctacatacccaagtgcgccaagacacactatcgcaccccgtaactggggcgtgcaagctgaacagcagagccctggtccagccgcctacaccgttccctctctcttgggtcctcgagtgatcgggaaggtgtcggcacccacctgctcgatatatggcagacgggcagctggctccttctttgaagatctaagcaagacccctggcccctgtgcttaccaggtggtttcaccaggcgtgtacaaaagtagggcccctcagtttacaatcctggcaaggacatccctgccacaggataacacgaggaagcctggtcccgctgcatacaacgtggatcagcaccggaagcctaggggctggagcttcggaatccgtcattccgattatctcgccccactggttactgatgccgacaactag

SEQ ID NO: 49308 - DNA, 465 bp, Artificial Sequence
  Description of Artificial Sequence: Synthetic coding sequence
atgctgcccggctacgccctgcaccccgtggccgccgcccggccccggctgcacttgcgtcgggcccttcctcatgcagcagatgatgtccgcccaagggcacggccccccggcgctagaagtcacgatagggccagacaccgtcgccgccccagactgctgcacctcagaccacctacgcccctgtccgccctgcctcattccgggacctggtctggcccaccgggcccttggcctccccagagacggactgcatctagagaggcccaccttggaacacctgacctcaacccagagagcccctccgacacattgacttattcagtccccccctatccagatctaaagtcgcagacgcccccgcgcgggttcgacaaaagctggctccgcctccccacttcaccacgcaccccctcccgggtacccacgagactgcccagatctagctcacctccacatccatag

SEQ ID NO: 49309 - DNA, 825 bp, Artificial Sequence
  Description of Artificial Sequence: Synthetic coding sequence
atgaagctgcccaagggcacccggagcagcgtgtacttcgcccagcacccagaaaaggagccactgccaagccggcaagaggtgaaacaaacaccggtgattatggcaaaaattaagggtcctgggcccgccaagtatctcagacccagctgtaccggatacatcgatcatgacatctcaatgtttaaagcccctgcctacaccctgcacagcaggcattctgagaagaggatggtctgccactccagccccggtccgtgctatcttttggaccctaaaattacacgctttggtatgtcaagttgccctcaagtaccaatggaagagaggattagcaacttgcgcctcaatccaacccttgcctcctgccaatactacttcgaaaaaatccacccccccggtgagaggagagccccccagtacacttttggatacaggagaccataccgggtgatggacctgaacccagccccgaaccagtaccagatgcccttgctacttggtccaaatacgcccgtgtctcgggccgccccttgctactctctcgcaagtagagataagaattggttttataaggaggatgtagcaggaggccctggaccaaccacttatgcacgccccgaaccatctatttaccagaacagatccccaacatatagcatggctaaacggttcgcctatccactcgatctcacccccagacccggcccaggcagccacgaagtccaacaggtaactgtccacaaacctcatatacctgcgtttactatgggcattaagcacagcttgcacttgtgccctttggtgatcgatatccgggattag

SEQ ID NO: 49310 - DNA, 870 bp, Artificial Sequence
  Description of Artificial Sequence: Synthetic coding sequence
atgggcaccctgagctgcgacagcaccccccggctggccaccgcccctttaggccggcgagtaaccgaaggccagatccccgaaacggggctgcgcaaaagttgtggtactgccactcttgagaacggttctgggccgggcctatatgtgcttccttctaccgtgggctttattaatcatgattgtacaagagtagccagcccagcatactctctggtgcgtcgaccatccgaggcgcctcctcaggacacttctcctggccccatttacttcctggatcctaaagtgactcggtttgggagatcctgcactccagcttattctatgcagggccgcgcaaagtctagaggtccagaggtcactcctggccccggagcttatagccctgaaaaagtccctcctgtccgacacagaaccccacccgccttcactctaggatgccgactgcccctcaagccccttgataccagtgccccagcccccaacgcctataccatgcctccactgtggggcagtcaaatatttaccaagcccagcagcccatcttatactgtggtagggaggacaccccctgcccggccgcctcaggatcctgccgagatccccggccctggccagtatgatagcccagacgctaacacttatcggcaacggctgcccgcattcaccatgctcggacgccctcgggccccacggcccttggaagagacccccggccccggtgcgcattgtccagaacaggtgaccgtgaataaggctcgggctcccgccttcagcatgggaatacggcactctaagagagcaagtactatggcagccaccacaccatctcgccccgccgggcacagactcccgggacgctgttgctag

SEQ ID NO: 49311 - DNA, 762 bp, Artificial Sequence
  Description of Artificial Sequence: Synthetic coding sequence
atgggcaccctgagctgcgacagcaccccccggctggccaccgcccccctcggacggcgagtgaccgagggtcaaataccagaaacaggtcttagaaaatcatgtggaacagcaaccctagagaatgccccgccacaggacacttccccagggccaatctattttcttgacccaaaggtgaccagattcggcaggagctgcacccccgcatattcaatgcagggacgtgcaaagtctcgagggccggaggtgactcccggaccgggcgcatactctcctgaaaaggtgcccccagtgcgacaccgcacccctcctgcctttaccttgggatgtaggctccccctgaagccactggacacgagcgccccagcaccaaacgcctatacaatgccccctttgtggggctcccagattttcaccaagcccagctcccctagttatacggtagtcggccggacacctccagcaaggccacctcaggaccccgcggagataccgggacccggtcagtatgattcacctgatgccaatacatacaggcagaggctacccgcctttactatgctgggtaggccccgggctccaaggcctctggaggagacccctggccccggtgctcattgtcctgaacaagtcacagtcaataaggcgagggcccctgcattctcaatgggtatccgccactcgaaacgagcctccacgatggcagcgacaaccccctccaggccggctggacacaggcttcccgggagatgctgctag

SEQ ID NO: 49312 - DNA, 3405 bp, Artificial Sequence
  Description of Artificial Sequence: Synthetic coding sequence
atgggcctgctggccagcgccggcctgctgctgctgctggtgatcggccatccgaggtctcttggcctcaaatgcggcatcaggatggtcaacatgaaatctaaggaacccgctgtcggtagcagattcttctccagaatctcttcgtggcgcaactccacggtgactgggcatccttggcaggtgtcgctcaagtccgacgagcatcacttttgtggcggaagcctaatccaggaagaccgggttgtgacagcagcgcactgcttagactccctgagcgagaagcagctcaagaacatcaccgtgaccagcggcgagtacagcctctttcagaaggacaaacaggaacagaacatccccgtgagcaagatcataactcaccccgagtacaactcaagagaatacatgtccccggacattgccctgctataccttaaacacaaagtaaagtttggcaatgctgttcagcctatttgcctacctgacagtgacgacaaagtggagcccggtattctgtgtttgtcaagcggatggggcaaaattagtaaaacaagtgagtacagcaatgtcttacaggagatggaattgccgattatggacgatcgggcgtgtaataccgtcttaaagagcatgaatctgccacctctggggaggactatgctgtgtgccgggttccctgattgggggatggatgcctgtcaaggagatagtgggggccccctggtctgccgccggggaggcggtatttggatcttggctggcataacctcctgggtggcaggttgtgccggcgggagcgtgccagtgcgaaacaaccatgtgaaagcttccctcggcatctttagcaaggtgagcgagctgatggattttattacgcagaacctgttcacaggcctggaccgtgggcagcccctatcgaaggtcgggagtcgttacattaccaaagccttgtcctccgttcaggaagttaacggaagtcaaagggggaaaggaatcctagacatggaaaaacaggtgggctgcgatcatgactacgtgtcgctgaggtctagctccggcgtactgttcaatcaaagatctcttatggaggatgacggaaagcagaataagagagtttgtgggaagatcttaccttcacccctgctagcagagaccagtgaagcaatggtgccatttgtttccgatacagaagattcgggttccggtttcgagctcacggtcacagcggtccagaagagtgaagcaggatcggggtgcggctccctcgccatcttggtggaagagggtacaaatcactctgcaaaatacccagacctgtatccttccaacaccagatgccattggtttatctgcgcacctgaaaaacacattattaagctcaccttcgaggatttcgcagttaaattcagccccaactgcatttatgatgccgtcgtcatctatggagattccgaagagaagcacaagcttgccaagctttgcgggatgcttaccataacatccatatttagcagtagcaacatgactgttatttactttaagtccgacggaaaaaacagattgcagggcttcaaggcacgctttacaattctcccctcagagagtctgaacaagtttgagccgaaactcccacctcaaaataaccccgttagcaccgtgaaagcaattctgcatgatgtgtgtggaattccacccttttccccgcaatggctcagtagacgcattgctggcggtgaggaggcctgtccacattgctggccttggcaggtcggcctgcgattcctaggagactatcagtgcggaggcgcaatcattaacccggtgtggatcctcacagcagcccactgtgttcagctgaaaaataatcctcttagctggacaattattgctggcgaccatgatcggaatctgaaggagagcacagaacaggtccgcagagcgaagcacatcattgttcacgaggacttcaacaccctgagctatgattctgatattgcactgatccagttgtctagtcctttggagtacaactctgttgtgaggcccgtctgcctcccacacagcgcggagcctctgttcagttctgagatatgcgctgtgacaggatggggatctatttctgcagatggaggcctggcctcaaggttgcagcagatacaggtgcacgtgttggaaagggaggtttgcgagcacacctactactccgctcatccggggggaattactgaaaaaatgatctgtgccgggttcgcagcctccggcgaaaaggatttttgccaaggggactctggaggccctctggtttgccggcacgaaaatgggcccttcgtgctgtacgggatagtgagttggggagccggatgtgtgcagccatggaaacctggagtgttcgccagagtcatgatcttcctggattggatccagagtaaaattaacggacccgcatccttgcaaacaaacaacaagtgtaagaccctcaagcagcagctcccacccccaaccccttcccccgacagtgcttcttggccgggctgttgcagcgaggcggagctggagaagcccagagggtttttccctacccctagatatctgctggattacaggggcaggctagaatgttcatgggtactccgtgtaagcgccagcagtatggccaagttcacaatcgagtacctgtctttgcttggatctcctgtgtgccaggacagcgtactcatcatctacgaagagcgccactcaaaacgcaaaaccgctggcggcctccatggtcggcgactgtactctatgacctttatgtcgccagggcctttagtcagagtgacttttcacgccctggtccgcggcgcctttggaattagctacatcgttcttaaagttctgggcccaaaggacagtaagattaccagactcagccagagcagtaaccgggaacacctggtgccctgcgaagacgtccttctgaccaagcccgaaggtattatgcagattccccgcaactcacaccgcacaaccatgggctgtcagtggagactcgttgcccccctgaatcacatcatacagctcaacataatcaactttcctatgaagcctacgacatttgtctgtcacggccatctcagagtctacgagggttttggaccggggaagaaactgatcgccagctttgccggcacattggcgatgatcctaaccaaggacatccttaaacgtgaaaaactaaattttattaatacttatataatgcacatctgggaaaactctgtctacgacaatgtgcgttccgtgggtaagcggaagcagaaaaagttcgccagcaatttgtcttactccatggaggccgagaagtctaggatccaggtaccagccgacctggttcccgcaaaaggtagcctttcaggatcatag

SEQ ID NO: 49313 - DNA, 1695 bp, Artificial Sequence
  Description of Artificial Sequence: Synthetic coding sequence
atgctgatcagccggaacaagctgatcctgctgctgggcatcgtgttcttcgaaagggggaaatccgctactctctccctcccaaaggccccgagctgtggtcagagtctcgtgaaagtgcagccatggaattatttcaatatcttctccaggattctgggggggtctcaggtagagaaagggtcatatccttggcaggttagtctcaagcagaggcagaaacacatttgtgggggcagcatagtaagcccccagtgggtgattactgcggcacattgtatagccaatcggaatattgtgtcaactctgaacgttacagccggagagtacgacctctctcagaccgaccccggggagcagaccttgacaattgaaacggtcattatccacccgcacttttctactaaaaaacctatggattacgatattgctctgttaaagatggccggtgcctttcagtttggccattttgtggggcccatttgtctgccagaactccgcgagcagttcgaagccgggttcatatgcactacagccggatggggtcggttgaccgagggaggggtactttcacaggttctgcaagaagttaatctacccatactgacatgggaggaatgcgtggctgccctactgaccttaaaaagaccgatttcaggcaagacttttttatgcaccgggttccccgatggaggcagagatgcctgtcagggcgattccggagggtcactcatgtgccggaataagaagggagcttggactctggctggagtcacgagttggggactgggctgcgggaggggttggcggaataatgtgaggaaaagcgatcaaggcagccctggaatatttactgacatttcaaaggtgctcccatggattcacgagcatatccagacagggaaccggcgcaaatcctcacgtgcctggtgcagcgagcaggatgtgatcgtgtctggggcagaaggaaaactgcatttcccagagtcattacatctttattacgagtccaagcaaaggtgtgtttggacattattggttccagaagagatgcatgtcctcttgagctttagccacctcgatgttgagtcttgtcaccatagttacctcagtatgtactccctcgaagaccggcctatcggcaagttttgtggcgaaagtttgccaagctctattttaattggatccaatagcctgcggctaaaattcgtttctgatgccacagataatgccgccggctttaatttgacctataaagccttaaagcctaattacatccccgactctggatgcagttacttgactgtgttgtttgaggagggcctgattcagagcctgaattatccagagaactactctgataaggcaaattgtgattggatctttcaagcctctaaacatcacctgatcaagcttagcttccagtccttggaaatcgaggagtccggcgattgcacgtccgattacgtcactgtgcattcagatgtggaacgaaaaaaggaaattgctaggctttgcggatatgatgttcccacccctgttctcagtccaagcagcatcatgctcatatctttccaatcagatgagaatggcacatgtcgtggttttcaggccacagtgtccttcattccaaaggccggaaagaaaatagagttgcctaccctctggtttccagtgttgatccttgtcatgtag

SEQ ID NO: 49314 - DNA, 756 bp, Artificial Sequence
  Description of Artificial Sequence: Synthetic coding sequence
atgccccgggccttcctggtgcggagccggcggccccagccccccaattggggccacctgccagatcaactgaggggcgacgcctacataccagactgtagttctctcggaggacctcccgcacagcaaagctcaagtgtccgcgacccatggacagccgtctcagttttgggtacttgtcccccccttctgctctgcgtgggcaacgcctcacctttcctcgtggctccaggccccgccgcaacaggcatctccagcagtggggctcaggactcttctccacacgtcgacgacccgttgtatctgtgtatgcattggagaaaggaatccgccagccgtaaccagcccacacagggtaatttgacgtctgccccacgtgggcccggaactttggggtgtccactatgtcccaaagcctttcccctacagcgtatgctgactcgtcatctcaagtgccactccccagtgcggaggcacctttgccgttgctgtggtaaggggttccacgatgcttttgatctgaagagacacatgcgtacccatacaggcatccgtccattccggtgtagcgcctgcgggaaggctttcacgcaaagatgtagcctcgaggcccacctggccaaggtgcacgggcagccagcatcctacgcttatagggaacgcagagagaagctgcatgtctgtgaggattgcgggtttacatcttcccgccctgacacctatgctcaacaccgggccttgcatagggctgcatag

SEQ ID NO: 49315 - DNA, 1683 bp, Artificial Sequence
  Description of Artificial Sequence: Synthetic coding sequence
atgggcaagtggcggccccggggctgctgccggggcaacatgcagtgtcggcaggaggtgcccgctaccctcacctcatcagaactgttcagcacaagaaaccaaccccagccccagccgcagccccttctggcggatgcccctgtaccttgggccgttgcgtcacggatgtgtttgacccctggccagggttgcgggcatcaaggccaggatgagggccccctccctgccccctccccgcctccagccatgtcgtcctcaagaaaagatcatctgggcgctagttcgtcggaacccctccccgtcatcattgttggaaacggccctagcggcatctgtctgtcctatctcctgagcgggtacacgccatatacaaaaccggacgcaattcatccacatccactgctccagcgtaagctgacagaggctccaggcgtctcaattcttgaccaagacctagattacctgtccgagggactggagggcaggagccagtcaccagtcgctctgctcttcgatgctctgctgcgacccgacaccgacttcggcgggaatatgaagagcgtgctgacctggaagcataggaaagagcacgccattccacatgtggtgctcggacgaaacctacccggcggagcttggcactcaattgaaggctccatggtgatcttatctcagggccaatggatgggcctacctgacctcgaagtaaaggactggatgcaaaagaagaggcgtggcctgaggaattcacgtgccacagccggggatatcgcacattattatcgagactacgtggtgaagaagggacttggacataattttgtctcgggagcagtggtgaccgcagtggaatgggggacccctgatccctcatcatgcggcgcacaggattcatcacctttattccaggtttccggttttttgacacggaaccaggctcagcaaccgttcagcctgtgggctcgaaatgtagtgcttgcgacaggtacatttgattccccagcccgcctgggaataccaggagaagccctgccattcattcaccatgagctgtctgctctggaggctgccacccgggtgggtgcagtcaccccagccagcgaccctgttctgatcattggggcaggcctctcagcagcagatgccgtgctctatgctcgtcattataacataccagtaattcatgccttcagacgagcagttgacgaccccggactagttttcaatcagctgcctaagatgctgtatcccgagtaccacaaggtccatcagatgatgcgtgaacagtcaatacttagtcccagcccttatgagggctatcggtccttgccccgtcaccagttgctgtgttttaaagaggattgtcaagccgtttttcaagatcttgagggagttgaaaaggtgtttggtgttagcttggttctggtacttatcggtagtcaccctgacctctctttcttgcccggagctggcgccgacttcgccgtcgatccagatcagcccttaagtgccaagcgcaatccaatagacgtcgatccctttacttaccagagcacacggcaagaaggtctgtacgcaatgggccccctggctggcgacaatttcgttcgatttgtgcaaggcggcgcactggcagttgccagcagtctgcttcgcaaagagactcggaagcctccttag

SEQ ID NO: 49316 - DNA, 1434 bp, Artificial Sequence
  Description of Artificial Sequence: Synthetic coding sequence
atgagcagcagccggaaggaccacctgggcgccagcagcagcgagccactgcccgtgattatcgtgggaaacggaccttcgggaatctgtctgtcttatctgctaagtgggtacactccttacaccaagccagacgccatccacccccacccactcttgcagaggaagctgacagaagccccaggtgtctcgatcctggaccaggatctggactacctatcagaagggcttgaggggcgcagccaaagcccagtggcactcctgttcgatgcacttctgcggcccgacacggactttggcggcaatatgaaaagcgtgctgacctggaagcatcggaaggagcacgccatacctcatgtggtgttaggtcggaacttacccgggggagcttggcacagcattgagggatctatggtgatcctgagccagggccaatggatgggcctaccggatctcgaggtcaaagattggatgcaaaagaagaggcgggggttgcggaactctcgcgccaccgccggggatattgcacactattacagagactacgtggtaaaaaagggcctcgggcataacttcgtcagtggcgcagttgtcaccgccgtggagtggggtacccctgacccctcttcctgcggggcccaggatagctctccccttttccaggtcagtgggtttcttactagaaaccaggcccagcagccatttagcttatgggccaggaacgtcgtccttgccacgggcacctttgactcgcccgcacgcctcggcatacccggagaagccctgccattcatccatcatgagcttagcgccctcgaagcagctacaagagtgggtgctgtcacacctgcatccgatcccgtgttaattattggtgccgggctgtctgcagccgatgctgtcctctacgctcgtcactacaacatccccgtgatccacgccttccggcgagccgtcgatgatccaggtctcgttttcaaccaattgcccaaaatgttgtatcctgaatatcataaggtgcaccaaatgatgagggaacaaagtatccttagcccatccccatacgaaggttataggtcacttccaagacatcagctgttgtgttttaaggaagattgtcaagccgtatttcaggatctggagggagtggaaaaggtgtttggagtctcattggtgctcgtgttgatcggatcccaccccgacctttcattcctgccaggagcgggggccgattttgccgttgaccctgatcagcccctgagcgctaagaggaatccaatcgacgttgatccattcacctatcagtccactaggcaagagggactgtacgccatgggaccacttgcaggtgataatttcgtgcgattcgtccaagggggagctctcgctgtggctagctctctgctgcgtaaggaaactcgcaagccaccctag

SEQ ID NO: 49317 - DNA, 1434 bp, Artificial Sequence
  Description of Artificial Sequence: Synthetic coding sequence
atgagcagcagccggaaggaccacctgggcgccagcagcagcgagccacttccggtcattatcgtcggcaacggtccctctgggatatgtctaagttatctgttgtcgggttataccccgtatactaagccggatgcgatccatccacacccgcttttgcagcggaagctgacagaggcacctggagtgagtatcttagaccaggacctcgactacctgtcagagggactggagggaaggtcccagtcaccggtggccctgcttttcgatgcactcctcagacccgacacggactttggcggcaacatgaagtcagtcctgacatggaagcaccgcaaggagcatgcgatcccccatgtggtgttgggtagaaacctaccaggtggcgcctggcacagcatcgagggctctatggtaatattgagccaggggcagtggatgggcctgcctgatttggaggtgaaggactggatgcagaagaaacggagaggactaaggaatagtcgggcgaccgcaggggatattgctcactactatagagattacgtggtgaaaaaaggcctgggccacaatttcgtgtccggagctgtggttaccgctgtggagtggggcacccctgaccccagttcatgcggcgctcaagacagctccccgctgttccaggtgagcggctttctcacgagaaaccaggcccagcagccctttagtctgtgggctcggaacgtggtgctcgcgaccgggacattcgatagccctgctaggcttggtattcctggtgaggctctcccctttatccaccatgagctctcagcgctcgaggcagccacccgggtaggagctgtaacaccggcctccgatcccgttctgataataggcgccggtctcagcgcggcggacgcagtcttgtacgccaggcactacaacatccctgtaatccatgcattccgtagggccgtggacgaccccggccttgtgtttaatcaactgccgaaaatgttgtacccggagtatcataaggtgcatcagatgatgcgagaacagagcattttgtccccatcaccatatgagggctacagatcgctgccgaggcaccagcttctgtgtttcaaagaggactgccaagcagtcttccaggatcttgagggcgtggagaaggtattcggcgtgtccctcgtgttggtcttgataggttcacaccctgacctatccttcctgcctggagcaggcgcagacttcgccgtagatcctgatcagccacttagcgccaagaggaatcccatagatgtggatccctttacttatcagtctacccgccaggagggcctgtacgctatggggccattggcgggggataacttcgtgaggtttgtgcaggggggagcactcgcagttgcaagctctctactgagaaaagagactcgcaaaccaccctag

SEQ ID NO: 49318 - DNA, 1518 bp, Artificial Sequence
  Description of Artificial Sequence: Synthetic coding sequence
atgcccctggtggaggagaccagcctgctggaggacagcagcgtgacgtttcctgtggtaattattggcaatgggccatcaggcatctgcctgagctatatgttaagtgggtaccggccatacctgtcttctgaggccattcaccccaacaccatcctgaactcaaaactagaagaggcaaggcacctttcaatcgttgaccaagatctggaatatctgtcagagggtttggagggtaggagttctaatcccgtggccgtgctcttcgatacactgttgcatcccgacgcagactttgggtacgactaccccagcgtactccactggaagctggaacagcatcattatatccctcatgtggtgcttggaaaaggccctcccggcggcgcttggcataacatggaggggtcaatgctcacaatcagctttggctcctggatggagctgcctggtttaaagtttaaagactgggtctcaagcaaacgccgctcactgaaaggcgaccgggtaatgcccgaggagatcgctcgctattacaagcactacgtcaaagtgatgggactgcagaaaaattttcgcgagaacacttatattactagtgtgtcgagactctacagggatcaggatgatgatgacatccaagatcgtgacatctcaaccaagcatctgcagatagagaagtcaaattttatcaagagaaattgggaaattaggggctaccaaagaattgctgatgggtctcatgttccgttttgcctgttcgccgagaatgtagccctggccacaggaaccctggattctcccgcgcatctggagatcgaaggcgaagattttccatttgtgttccattcaatgccggaattcggcgctgccatcaataaaggaaagctcaggggcaaagtggaccctgtcctgatagttggatctggactgactgccgccgacgctgtattgtgcgcctacaactctaacatccccgtgattcacgttttcagaaggagggtgaccgatccctcactgatatttaagcagctccctaaaaaactgtatcctgaatatcacaaagtataccacatgatgtgcactcagagttattctgtagacagcaatctgctgagcgactatacaagtttcccagaacatcgggtgttgtcatttaagagtgatatgaagtgcgttctgcagtcagtcagtggcctgaagaaaatcttcaagctgtccgctgccgttgttttgattggctcacatcctaacctctccttccttaaagatcagggatgctacctgggtcataaaagttctcagccaatcacatgtaaggggaaccccgtcgaaattgatacctatacgtacgagtgtatcaaggaggcgaatcttttcgctctggggcccctggtcggcgacaattttgtgcgattcttgaaaggaggagctctgggtgtgactcgatgcttggctactaggcaaaaaaagaagcatttatttgtcgaacggggtggtggcgatggtatcgcatag

SEQ ID NO: 49319 - DNA, 1650 bp, Artificial Sequence
  Description of Artificial Sequence: Synthetic coding sequence
atgcccgtgtggtgctgccggtgcagcctggccggccacttccggaactactccgatacagagaccgaaggagagatattcaacagtctggtccagtattttggagacaacctaggccggaaagtgaaagccatgccgctggtcgaagagacctccctcttggaagacagcagcgttacattcccagtcgtcatcataggaaacggaccatctggcatttgcctatcatatatgctaagcggttatcggccgtatctgagttcagaggctatccacccaaataccatcctgaattccaagctggaggaagcacgccatctaagcattgtagatcaggacctcgaatatctatccgaaggactggaaggccggagctcaaaccctgtggctgtcttatttgacaccctgttgcacccagatgccgatttcggttacgattatcccagcgtgctgcactggaaactggaacaacatcattacatccctcacgtcgtgctgggcaaggggccacctgggggcgcttggcataatatggaggggtctatgctcactattagttttgggtcctggatggagctgcccggccttaagtttaaggattgggtgtcatcaaagagaagatctctgaagggggaccgggtaatgcccgaagagattgccagatactataagcactacgttaaagtgatgggccttcagaaaaactttagagaaaacacgtacatcacaagcgtgtcccgactctaccgcgaccaggatgatgatgacatccaagacagagacatctccactaaacacttgcagatagagaagagcaacttcatcaaacggaattgggagattcggggataccaaaggatagccgatggctcccatgtgcccttctgtttattcgctgagaatgtggctctcgctactggtaccctggattctccagcccatttagaaatcgaaggcgaggactttccattcgtttttcactcaatgcctgaattcggcgcagccataaacaagggaaaactccgaggaaaggtggatccggttctgattgtcggctcgggtctgaccgctgcagacgccgtactgtgtgcatataattcgaatatccccgtgattcacgtgtttagacggagagtgacagacccctccctgatctttaagcagctgcccaagaaactgtaccccgagtaccacaaggtctatcacatgatgtgcacgcagagctatagtgtggactctaatctgctgtctgactacacttcctttccagagcacagggtgctctcattcaaatccgacatgaaatgcgtcctccagagtgtgagcggactgaaaaagatctttaagctgagtgcagctgttgtgctgatcggctcacacccgaatttaagctttcttaaagaccaaggatgctaccttggacacaaatcttcacaacctattacttgcaaagggaaccccgtagagattgatacctatacctacgagtgcattaaggaggcaaacttatttgcattgggcccactcgtaggcgataactttgtgcgctttttgaaaggcggagcattgggcgtgactagatgcctggccacacggcagaagaaaaaacatctgtttgtcgagagaggcggcggggacggtatagcatag

SEQ ID NO: 49320 - DNA, 1584 bp, Artificial Sequence
  Description of Artificial Sequence: Synthetic coding sequence
atgagcgaggacagcagcgccctgccctggagcatcaaccgggacgactacgagttgcaggaggtcatcggtagcggtgctaccgcggtggtacaggctgcatactgtgcacctaaaaaagagaaggtggccataaaaagaattaacctggagaagtgtcagacctccatggacgaacttttaaaagaaattcaggctatgagccagtgccaccaccctaacatagtgtcctattacacaagttttgtggtaaaagacgagttgtggcttgttatgaagctgttgagtggaggttcggtgctagatatcattaaacacatcgtcgcaaagggcgaacacaagagcggcgtgcttgatgagtctaccattgccacgatcctgcgtgaagtgctagagggcctggagtatctgcataagaacggtcagattcaccgcgatgtgaaagcagggaacattttacttggcgaggatggcagcgttcagatcgccgacttcggcgtgagtgcctttttagccaccgggggagacatcactcggaacaaagtacggaaaacgttcgtgggcactccatgttggatggctccagaagtgatggagcaggtgcggggatacgatttcaaggctgatatctggtctttcgggatcacagccattgagcttgcgacaggagccgcaccctaccacaaatatcctccaatgaaggtgttgatgctgacgcttcagaatgaccctcctagcctcgagacaggcgttcaggacaaggagatgctaaaaaagtatggcaagagtttcaggaaaatgatcagcttatgtctgcagaaggacccagaaaagcggccaactgccgcagagctgctgaggcacaagttttttcagaaagccaaaaacaaggagtttctacaggaaaagacattgcagcgagctccaacaatctccgagcgcgccaaaaaggtgcgtagggtccctggcagttcaggtaggctgcataagacggaagacggagggtgggaatggtcggacgatgagtttgacgaagagtccgaggagggcaaagcggcgatttctcagctcaggagcccacgcgtcaaagagtcgataagcaattcggagctgtttccaacaacggatccggttggaaccctactgcaagtgcctgagcagatctctgcgcatttaccgcaacccgcggggcagatcgccacacaaccgacgcaggtatcattgcctccaaccgctgaacccgctaagacagcccaagcgttatctagtggctctggcagccaggaaaccaaaatccccatttctctggtccttcggctacgaaacagtaaaaaagagctcaacgacatccgttttgagttcacaccagggcgggatactgcagagggagtgagccaggagctcatctccgcagggctagtggatggaagggacctggtgatcgtcgcagctaacttacagaagatcgttgaagagcctcagtctaatcgctcagttacctttaagctggctagcggagtggagggctcagacatcccagatgacggcaagctgataggcttcgcgcagctgtcaataagctag

SEQ ID NO: 49321 - DNA, 309 bp, Artificial Sequence
  Description of Artificial Sequence: Synthetic coding sequence
atgagcgcccgggtgcggagccggagccggggccggggcgacggccaagaggctccggacgttgtcgcctttgtagctcccggggagtcccagcaggaggaaccccctacagacaaccaggatatcgaacctggccaggagcgggagggaacaccgccaattgaagaacggaaggtcgaaggcgattgccaggagatggatcttgagaagacccgctccgagcgcggtgacgggtcagatgttaaggaaaaaacccctccaaaccccaagcacgccaagaccaaggaggctggcgacggccaaccttag

SEQ ID NO: 49322 - DNA, 336 bp, Artificial Sequence
  Description of Artificial Sequence: Synthetic coding sequence
atgagcgagcacgtgcggacccggagccagagcagcgagcggggcaatgaccaggaatcttcccagcccgtggggtcggtcatcgtgcaggagcctactgaagaaaagaggcaagaagaggagcctcctaccgataaccagggaattgctccgagcggggagatcgagaacgagggggctccggctgttcaagggccagacatggaagcctttcaacaagaactggcactccttaaaattgaggacgagcccggagatggtccggatgttcgtgagggcatcatgccaaccttcgatctcaccaaagttctggaggccggcgacgcccagccctag

SEQ ID NO: 49323 - DNA, 285 bp, Artificial Sequence
  Description of Artificial Sequence: Synthetic coding sequence
atgagcgagcacgtgcggacccggagccagagcagcgagcggggcaacgatcaggagagcagccagccagtgggcagtgtgatcgttcaggaaccaacagaagagaaaaggcaggaggaagagccgccaaccgacaaccagggtccagatatggaggctttccagcaagaactggcgctgttaaagatcgaagacgagccgggtgacggcccagacgtccgcgaaggaattatgcctacattcgacctgaccaaggttctcgaggccggtgacgctcagccatag

SEQ ID NO: 49324 - DNA, 393 bp, Artificial Sequence
  Description of Artificial Sequence: Synthetic coding sequence
atgcaggccccctgggccggcaaccggggctgggccggcacccgggaagaggtgagagacatgtctgagcacgtcactaggagtcagagtagtgagcggggaaatgaccaggagtcttcacagccggtcgggccagtgatcgtgcagcaaccaactgaggaaaaacggcaggaggaggaacctccgacggataatcaagggatcgcccctagcggcgaaattaaaaatgaaggagctcccgctgtacagggaacagatgtggaggcgttccagcaagaactggccctcctcaaaatcgaagatgcccctggcgatggaccagatgttagagagggaaccctgccgacattcgacccaaccaaggtcttagaggccggcgaagggcagctgtag

SEQ ID NO: 49325 - DNA, 282 bp, Artificial Sequence
  Description of Artificial Sequence: Synthetic coding sequence
atgagcgagcacgtgacccggagccagagcagcgagcggggcaacgatcaagaatcttctcagccagtcggaccagtgatcgtgcagcagccaactgaggagaagcggcaggaagaagagcctccaaccgataatcagggaacagatgtcgaggcctttcagcaggaactagccctgctgaagatcgaagacgcaccaggagatggccccgacgttagagaaggaacactcccaactttcgacccaacaaaggtgctggaagccggggaaggacagctttag

SEQ ID NO: 49326 - DNA, 333 bp, Artificial Sequence
  Description of Artificial Sequence: Synthetic coding sequence
atgagcgagcacgtgacccggagccagagcagcgagcggggcaacgatcaagaatcatcacaaccagtcgggccggttatcgtgcagcagcccacagaggagaagcgccaagaggaggagccccctaccgataaccaagggattgcacctagcggggaaatcaaaaatgagggggcaccagccgttcagggaaccgacgtggaagccttccagcaggaattagccctgcttaagatagaggatgctcctggcgatgggcctgacgtacgcgaaggcactctgccgacgtttgaccccacgaaagttctggaggcgggggagggacagctgtag

SEQ ID NO: 49327 - DNA, 3273 bp, Artificial Sequence
  Description of Artificial Sequence: Synthetic coding sequence
atggccgaggccgagctgcacaaggagcggctgcaggccatcgccgagaaacgaaaaaggcagactgagatcgaaggaaaacggcagcagcttgacgaacagatactattgctgcagcacagcaagtcaaaagtgttacgggaaaaatggcttctgcaaggaattcctgcagggacagcagaggaggaagaggctaggcgacggcagagcgaagaggacgagttccgcgtcaagcaattagaggacaacatccagagactggaacaggagatccagacactagagtccgaagaatcacaaatttcagcaaaagaacagatcatactcgaaaaacttaaggagacagaaaagtcttttaaagatttccaaaaagggttctcatccactgacggcgatgctgtaaattacatatccagtcagctacctgacctccctatcttgtgttcacgtaccgctgagccatcccctgggcaggatgggacaagccgtgccgccggagtgggttgggaaaacgtgctgttaaaagagggcgagagcgccagtaacgctactgagacttcaggcccagacatgactattaaaaagcccccccagctgtctgaagacgatatctggcttaagagcgagggggataactatagtgctaccctcttagagccagcagcttcatccctctcccctgatcacaaaaacatggaaatagaggtgagcgttgcagaatgcaagtccgtcccggggattacttcgaccccacacccgatggaccacccaagcgcgttttactcccccccacataatgggttacttaccgaccatcacgagagcctagacaacgatgtcgctagagagataaggtacctcgatgaggttcttgaagccaactgctgtgacagtgctgtggacggaacttataacggcactagcagtcctgagccgggagctgttgtgctggtgggaggcctatcccctccagttcacgaagccacgcagccagaaccaactgaaagaaccgcctcccgtcaggctcctcctcatatcgagctttctaactcaagtcctgatcctatggccgaggccgaacgcaccaacgggcacagcccctcccagccaagggatgccctgggcgactcattgcaggtccctgtgtcaccttcctctactacttcatccagatgcagctctcgagacggcgagttcactctcaccaccctgaaaaaagaggccaaattcgaactcagggccttccatgaagataaaaagccctccaaacttttcgaggacgacgagcatgagaaggaacagtattgcatacgaaaggtcagaccttccgaggaaatgctcgagctggagaaggagagacgggaactgattagaagccaggctgtgaagaaaaatccaggcattgctgccaaatggtggaatcctccacaggagaagaccattgaagagcagctagacgaagagcatttggagagtcacaaaaagtataaggaacgcaaagagagacgagctcaacaggagcagctgctcctgcagaaacagttacagcagcagcagcagcagcccccatcacagctttgtactgctccagcttcttctcacgaaagagcctccatgatcgataaggcaaaagaggacatcgttaccgaacagatagatttttctgcggccagaaagcagttccagctcatggaaaactccaggcaggccgtggccaaggggcagtcaactccaaggctctttagtattaaaccattctaccgcccgctgggctccgtcaattctgataagccattaacgaatccacgcccccccagcgtcggcggaccacccgaggacagcggggcatctgccgcaaagggccaaaagtcacccggcgctctggagaccccctctgccgccggtagccagggtaacaccgcctcccagggaaaggaggggccgtactctgagccatctaagcggggtcctctctccaagctgtgggccgaggatggcgagttcaccagcgctagagctgtgcttactgtcgtcaaagatgacgatcacggtatactggatcagttctccaggagcgtaaatgtgtcccttacacaggaagaacttgatagtggcctagacgagttgtcagtccgctctcaagatacaacagtcctggagactctcagcaacgactttagcatggacaacatatcagacagcggagcatcaaacgagaccacaaatgccctacaggagaacagcctggccgattttagcctccctcaaactccccagactgacaatcccagtgagggtaggggagaaggggtgtccaagagcttttctgatcatggcttttacagcccgagtagcacactcggggactcaccactggtggacgatcccctggaatatcaggctggactattagtgcagaacgcgatacagcaggcgatcgctgagcaagtggataaagccgtgtccaagacttccagggatggggctgaacagcaagggccagaggccaccgtagaagaggcagaagcagcagcctttggatcagaaaagccccagtccatgttcgagccacctcaggttagctctcctgttcaagaaaagagggatgtcctgcccaaaattttacctgcagaagaccgggcactgagagagagaggccccccccagcccctgcccgcagtccaacccagtggacctatcaatatggaagagacgcgacccgagggctcatatttctccaaatattcagaagctgccgaattgcgctctacggccagtctgttggcgacccaggagagcgacgtcatggtaggccctttcaaactgaggtcccgaaagcaacgaactctgtccatgatcgaggaggagataagagccgcgcaagagcgcgaggaggagttgaaacgacagcgccaagtgctgcagagcactcagtctcctcggacaaaaaacgcgccctctttaccctcccgaacatgctataagactgcccccgggaaaatcgagaaggtaaagcccccaccctcgccgacaacggaaggcccctctctccagcccgatctagcccctgaagaagccgctggcacacaacgccctaaaaacctgatgcagacgctgatggaggactacgagacccataagagcaagagacgggagagaatggacgattcttccgtacttgaggccactcgcgtcaacagaagaaaaagcgcactggcactgagatgggaagccggaatctatgccaaccaagaagaggaggacaacgagtag

SEQ ID NO: 49328 - DNA, 3312 bp, Artificial Sequence
  Description of Artificial Sequence: Synthetic coding sequence
atggccgaggccgagctgcacaaggagcggctgcaggccatcgccgagaagaggaaacgccagactgagatagagggcaagcgccagcagctggatgagcaaatcctgctgctgcagcattcgaagtcaaaggtgctacgggaaaaatggctactgcaggggatccccgccgggaccgccgaggaggaagaagcccggagaagacagtctgaggaggacgagtttagagttaaacaattggaagataatatccagagactggaacaagaaattcagacactggaaagcgaggagtctcaaatctccgcaaaggagcagattattcttgaaaagctgaaggagactgaaaaatctttcaaagacttccagaagggcttctctagcaccgatggagacgctgtgaactatatctcatcacagctgcccgacttgcccatactctgttctagaacagctgagccctcccccggacaagacggcacatcgcgggccgcaggggtcgggtgggaaaatgtgctgctgaaagaaggtgagtcagcctccaacgcgactgaaacttccggaccggacatgacgatcaaaaaacctcctcagctgtccgaggacgacatctggctgaaatccgagggagacaattactccgccacactgctggaacctgccgcaagcagcttgagccctgatcataagaatatggagatcgaagtttccgtcgccgagtgcaagtcagttcccggaataactagcacgccccatccaatggaccatccttcagccttctacagtccaccccataacgggcttctgacggatcatcatgagtcacttgataacgacgtcgcacgagagataaggtatctggacgaggtgcttgaggctaactgctgtgattcggccgtggacggaacatacaatgggacctcatcaccagagcctggggccgtggtgctggtgggcggtttgtctccgcctgtccatgaagccacccaaccagagcccacagagaggaccgcaagccgccaagctcctccccacatagaattaagtaacagttctcccgaccccatggcggaggcagaacggacaaacggtcatagtccgagccagcctagggacgcactcggcgattccttgcaggtaccggtgagcccttcatctactaccagctcgcgatgctcttcacgcgacggcgagttcaccttaacaaccctaaagaaagaagctaaattcgaactgcgagcatttcacgaggataagaagccatcaaagctgtttgaggacgacgagcatgaaaaggagcagtattgcatccgaaaggtcaggccatcagaagagatgctcgagctggaaaaagagcggcgcgagttgatccggtcccaggccgttaaaaaaaatcctgggatcgcagctaagtggtggaacccccctcaggagaaaaccattgaagagcagctggatgaggagcatcttgaatcccacaaaaagtataaggagagaaaagagagacgggcacaacaggagcagctcttgctgcagaagcagctccaacaacaacagcagcaaccaccctcccagctctgtacagcacctgcctcttcgcatgaacgcgcctcaatgatcgacaaggccaaggaggatatcgtgaccgagcagatcgatttcagtgcagcccgcaaacagttccagttaatggagaactccagacaggctgtcgcaaagggtcagtctaccccgcgcctgttctctattaaacccttctatcgcccactcgggtctgtgaactctgacaagccactgacaaaccctaggccccccagtgtgggcggaccaccagaagacagcggagcatcggccgctaaaggccagaaatctcctggggcactggaaaccccatcagccgccgggtctcagggcaatacagccagccagggcaaagagggaccctacagcgaaccgtctaaacgaggacccctaagcaagctctgggccgaagatggggagtttacctccgctcgcgcagtgcttaccgtggtcaaggatgacgaccacggcatactggaccagttctcccggagtgtcaatgtctcacttacccaggaggagctggattccggcctggatgagctgtccgttagatctcaggacacaactgtattggagaccctcagcaacgacttttcgatggataatatctccgatagtggggctagcaatgaaacaactaatgctcttcaggaaaacagtctggccgatttttccttaccgcagacgccccagactgataacccctccgaggggcgtggggagggggtgagcaaaagcttctcagaccacgggttctactccccctcatctaccctgggggattccccactggtggacgaccccctcgaataccaagccgggttactggtgcagaacgctatacagcaggccatcgctgagcaagtggacaaagccgtctctaaaacaagtagagatggggcagagcagcagggccccgaggcgacagtcgaggaggctgaggcagccgcttttggttctgaaaagccgcagtccatgtttgagccccctcaagtgagtagtccagttcaggaaaagcgggacgtgcttcccaaaatcctgcctgcagaagatcgtgccttacgagagagggggccacctcagccccttcctgccgttcagccaagcggcccaattaacatggaggagacacggcctgagggcagctacttctccaaatacagcgaggccgcagagctccggagcactgccagcttactggctacccaggagtctgatgtgatggtgggcccctttaagttgagatcgcggaagcagcggaccttgtcaatgattgaggaagaaatacgtgcagcccaagaacgtgaggaagaactgaagagacaaaggcaggtgctgcagtcaacacaaagtccacgtaccaaaaatgccccatccctgcctagcagaacctgctacaaaaccgctccaggcaagatagagaaagtaaaacctcctccttcaccaactaccgagggacccagtcttcaacccgacctagcgcctgaagaggctgcagggactcagaggcctaagaacctcatgcaaactcttatggaggattacgagacccacaagtctaagaggcgcgaacgcatggatgattcttcttatacatccaagcttctcagttgcaaggtcacgtccgaggtgttggaggcaacccgagtgaatcgacggaagtccgccctggccttgcgctgggaggctggaatttatgccaatcaggaggaggaggataacgaatag

SEQ ID NO: 49329 - DNA, 1302 bp, Artificial Sequence
  Description of Artificial Sequence: Synthetic coding sequence
atggccgaggccgagctgcacaaggagcggctgcaggccatcgccgagaaacgcaaaaggcagaccgaaatcgaagggaagcgacagcagctggacgaacaaatcttactgcttcagcattcaaagtcaaaagttctgagagagaaatggttgttgcagggaatacctgcgggcactgccgaagaagaggaggccagacgtcgccagtctgaggaagatgagttccgcgtgaagcaactggaggataacatccagaggttggagcaggagatacagacccttgagtcagaagagtcccagatcagcgccaaagagcagattattctggaaaagctaaaagaaacggagaagtccttcaaagatttccagaaaggatttagctcgacagatggggatgctgttaattatatctcctctcagcttcccgacctcccaatcttgtgcagccgcaccgctgagccaagccccggccaggatggcacctcaagagccgcagccgtctacgccatggaaattaacgtggagaaagacaaacagaccggggagactaagatcctgtcaacttctaccatcggccctgaaggcgtgcaccagaagggggtgaaagtttacgacgatgggacaaaagtcgtctatgaggtgaggtccggcggaacagtcgtagagaatggcgtgcataaactctcaaccaaggatgtcgaggaattgatccagaaagcagggcaaagctctctcgggggaggacacgtgtctgagagaactgtgattgcagacggaagccttagtcacccgaaagagcatatgctgtgtaaggaagccaagctcgagatggtacacaagagcagaaaggaccatagctctggaaacccgggacagcaggcgcaggccccatctgctgccggtccggaagcaaatctcgaccagcccgtaactatgatctttatgggctatcaaaacatcgaggatgaagaggaaactaagaaagtgcttggctacgatgagaccatcaaggcggagttggtactgatagacgaagatgatgagaagtctcttcgcgagaaaactgttaccgatgtctccactattgacggaaatgccgcagagctggtgagcggtcgtccagtgtccgacacaactgagcctagctctcccgaaggaaaagaagagtcactggctacagaacctgctccaggagtcggctgggaaaatgttttgttgaaggaaggggagagcgcaagcaatgcgacagaaacatctggcccagatatgacaataaagaaacctccacagctgtctgaatag

SEQ ID NO: 49330 - DNA, 1404 bp, Artificial Sequence
  Description of Artificial Sequence: Synthetic coding sequence
atgctgatcttctggaccatcaccctgttcctgctgggcgccgccaaaggcaaggaggtttgttacgaagatttgggctgcttttcagacacggaaccctggggcggcaccgcaattaggcctttaaagattcttccttggagtcccgagaagataggcactcgtttcctgctgtacacaaacgaaaaccctaacaactttcaaatcttgcttctctcagatccctccacgattgaggcctccaattttcagatggataggaagactcgcttcatcatccatggctttatcgataagggggatgagtcttgggtaacagacatgtgtaagaaactttttgaagttgaagaggtcaattgtatttgtgtggattggaaaaaggggtctcaagctacgtacacgcaggcggcaaacaacgtcagggtggtgggagcacaggttgcccaaatgctcgacatcctccttactgagtattcttaccctccaagcaaagtgcatctcatcggtcattctttgggcgcccacgtagccggggaggcggggtcgaagacaccaggactgtcacgcatcacaggtctagaccctgttgaggcctctttcgaatcaacccctgaagaggtacggttggacccatctgacgccgatttcgtcgacgtgatacacacagacgctgcccccctgatccctttcctgggtttcgggaccaatcagcaaatgggtcacctggacttctttcccaatggcggagaatcgatgccaggatgcaaaaaaaacgctttaagccaaatcgtggatttggacggtatatgggcgggcacaagagacttcgttgcctgcaaccacctcaggtcctacaagtactatttggaatccattctgaatccagatggcttcgctgcttacccatgcacatcttataaatccttcgagagcgacaaatgttttccatgccctgatcagggctgtccccagatggggcactacgcagacaagtttgccggcagaacaagcgaggaacagcaaaaattctttctgaatacaggggaggcctcaaattttgcccggtggcgctatggagtgtccatcacactgtctggacggaccgctacaggccagatcaaggtcgctttgtttggcaataagggcaacacccaccagtacagcatttttagggggattcttaagcctggtagcacccactcatatgaattcgatgcaaagctggacgtggggaccattgagaaggtgaaattcttgtggaacaataacgtgattaacccaactctgcctaaggttggagccacaaagataaccgtgcagaagggcgaagagaaaactgtttataacttctgtagtgaagacaccgtgcgggaggatacgctcttgactctgacaccttgctag

SEQ ID NO: 49331 - DNA, 1407 bp, Artificial Sequence
  Description of Artificial Sequence: Synthetic coding sequence
atgctgcccccctggaccctgggcctgctgctgctggccaccgtgcggggcaggaaagtctgctatggccaactcgggtgcttcagcgatgaaaagccctgggccggcacactacaacgccccgtgaaacttctgccatggtcgcctgaagatatagacacaaggttcctactgtacaccaatgagaaccctaacaactttcagttaattactgggactgaaccagatacaatagaggcttccaacttccagctggatcgcaagactcgattcatcatccatggattcctcgataaagctgaagatagttggccttcagatatgtgtaagaaaatgtttgaggtggagaaagtcaattgtatttgcgtggactggcggcacggttcccgggctatgtacacacaagcagtccaaaatatcagggtggtgggggctgaaactgcctttctcatccaagccctaagcacccagctgggatacagcctagaagacgtacacgtgattggtcatagtttgggagcccacaccgcagccgaggctgggaggagactagggggtcgagtgggccgtattactggcctcgatccagctggtccatgctttcaggatgaacctgaagaggtccgccttgatccgagtgacgccgtgtttgtggatgtcatccatactgatagctcccctatcgtgccttcacttggtttcggtatgtctcagaaggtgggccacctggacttcttcccaaacggcggcaaggaaatgccaggctgtaaaaagaatgtgctgagcacaattactgatatcgacgggatatgggaggggatcggaggattcgtctcctgtaaccatttaaggtcgtttgagtattattcaagctctgtgctgaaccctgacggcttcctcggctacccatgtgcatcctacgacgaatttcaagagagtaagtgctttccatgcccagcagaaggttgccctaagatgggacactatgctgatcaattcaagggcaaaacttccgccgtagagcaaaccttcttcctcaacactggcgagtcagggaacttcacaagcaaatataaaatctccgtaacactctctgggaaggaaaaggtgaatggatacatccgcattgccctctacgggtcaaacgaaaacagtaaacaatatgagatctttaaaggctcactgaagccagacgcctcacacacatgtgccattgacgtggacttcaatgtagggaagatccagaaggtgaagtttctctggaataagcgcgggattaacctgagcgaacccaaactgggcgcttcacagataacggtgcaaagtggggaagacggaacggagtacaatttctgcagtagtgatacagtggaagagaatgtccttcagagcctgtacccatgctag

SEQ ID NO: 49332 - DNA, 423 bp, Artificial Sequence
  Description of Artificial Sequence: Synthetic coding sequence
atggccgccatccccagcagcggcagcctggtggccacccacgactactatcgaaggcgcctggggtctacaagctccaatagcagctgttcatcaactgagtgtcctggagaagccataccacaccccccaggcgaatgtcgtattgccccattttccccaaggtcgagccgatcttggcagcatcaagaccctacgtctctgctgtccggtctgcccaaggcagatcccggccactggtgggcctccttttttttcggcaaatccaccctgcctttcatggccaccgtcctggagagcgctgagcacagcgagccacctcaggcatccagcagcatgaccgcctgcggtctggctcgcgacgcacctcgaaagcagcctggcggccagtccagcacggctagcgcggggcctccttcctag

SEQ ID NO: 49333 - DNA, 213 bp, Artificial Sequence
  Description of Artificial Sequence: Synthetic coding sequence
atggccgccatccccagcagcggcagcctggtggccacccacgactactacagacgaaggttgggatcaacttcgagtaattcgtcatgcagctcaacagaatgtccaggggaggccattccccacccacccggactcccaaaggccgacccaggccactggtgggcatcttttttctttgggaagagcaccctgccaccccccacactatag

SEQ ID NO: 49334 - DNA, 345 bp, Artificial Sequence
  Description of Artificial Sequence: Synthetic coding sequence
atggccgccatccccagcagcggcagcctggtggccacccacgactactacaggcgtagactcggctcaaccagttccaactcctcatgctcaagtacagaatgtccaggcgaggccataccacaccctccggggctgccgaaagctgacccgggtcactggtgggccagctttttcttcgggaagtccaccctgccttttatggccactgtgctggagtctgcagagcatagtgaacctcctcaggcttcatcatccatgacagcgtgtggtctcgctcgagatgcaccccgaaagcagccaggaggacagtcaagcaccgccagcgcgggccctccatcttag

SEQ ID NO: 49335 - DNA, 1860 bp, Artificial Sequence
  Description of Artificial Sequence: Synthetic coding sequence
atgtaccggagcggcgagcggctgctgggcagccacgccctgcccgctgagcaacgggactttctccccctggagaccactaataataacaataatcaccatcagcctggcgcttgggcaaggcgagcgggctccagcgcaagctcgccaccaagcgccagttcgagcccacacccttccgctgctgtgccagccgcggaccctgccgattcggctagcggatcatctaataagcgcaaacgggacaataaaccttctggtgggagagccgcgggaggaggtagggcggatggcggcggcgtagtttactcgggaactccttggaagagacgtaactacaatcagggcgtggttggtctccatgaagagatctcagatttctatgaatacatgtcaccacgtccagaagaagagaagatgaggatggaagtggtcaatcggatcgagtctgtcattaaggaactctggccttccgcagacgtccagatattcgggtcttttaaaactgggctgtacttgccaacgagtgacatcgacctcgtagtgttcggtaaatgggagaacctgccactctggacactggaagaagcactgcgaaaacacaaggtcgcagatgaggatagcgttaaagtcttagacaaagcaacagtcccaatcataaaactgaccgattcgttcaccgaagtgaaggtggacatctctttcaatgtgcagaatggtgttcgggctgcagatctgataaaggattttaccaaaaaatatcccgtactgccatatctcgtgctagtgttgaagcagttcctccttcagagggatctgaatgaggtgtttaccggaggtatcgggagttattccttgtttctcatggcagtttctttccttcagctccaccctcgcgaggacgcctgtattcccaataccaattacggagtgctcctgatcgaatttttcgaactgtacgggcgacactttaactacttgaagacaggaatccggataaaggatggaggcagttatgtggcaaaagatgaagttcaaaagaacatgctggatgggtatcggcctagcatgctctatattgaggaccctctgcaacctggaaatgacgtcggtcgatccagctacggggctatgcaagtgaagcaggcattcgattatgcttatgtggtgctgtctcatgccgtcagcccaattgccaaatactacccaaacaacgaaacagaatctatcttaggtagaattataagagtcaccgacgaagttgccacttatcgggattggattagcaaacagtggggtctcaagaacaggcctgagcccagctgtaatgggaacggagtcaccctgatagttgacacccagcagctggataaatgtaataataatctttctgaggagaatgaggcgttgggtaagtgtcggtccaagacatcggagtccctgtcaaagcactcatcgaattcgtcttctggccccgtctcaagctcttccgccacacagagctcgtccagcgatgtggatagcgatgctacaccttgcaaaacaccgaaacagttactttgtcgtccctccacaggaaacagagtagggtcccaggatgtgagcctcgagtcatcacaagcggtagggaagatgcagagtacccaaaccactaacacctctaatagtaccaacaaaagccaacacggttcagctcgcttgtttaggtcttcctccaaaggatttcaaggtacaactcagaccagtcacggaagcctcatgacaaataaacagcaccagggcaagagcaataatcagtattatcacggcaagaagcgcaagcacaaaagagacgcaccgctttcggacttgtgtaggtag

SEQ ID NO: 49336 - DNA, 2097 bp, Artificial Sequence
  Description of Artificial Sequence: Synthetic coding sequence
atgcggccccggccccggagcgcccccggcaagccccggcggcggtcccgggccaggctgcggagttcaagaaccccgagcggaggggcatcgggaggaggcggatcctccagctcgagcagcaccgcgaccggggggagcggatcttccactggtagcccaggtggagcagcatccgctccagccccagccccagcggggatgtatagatctggggaacgacttctcggttctcatgcgctgcctgctgaacagagggattttcttcccctggagacaacaaacaacaataacaatcaccaccagccgggcgcttgggctcggcgggctgggagttccgcctcttctcctccatcggcttccagctcacctcatccgtccgccgccgtgcctgcagcagaccctgcagattctgcctccgggagttctaacaaaagaaagagagataataaagcttcaacttacggcctcaattactctctgctccagccatccgggggtagggccgccggaggcggaagagccgatggaggaggggtggtgtacagtggcaccccatggaagcgcagaaactataaccaaggggtggtggggctgcatgaagagattagcgacttctacgaatacatgagccccaggccagaggaggagaaaatgcgcatggaagtcgtgaacaggattgagagtgtgatcaaggaactgtggccatccgcagacgtgcagatcttcggctcttttaagacaggcctgtacctacctacctctgacatagacctcgtcgtgttcggtaaatgggagaatctgccactctggacactcgaagaagcccttaggaaacacaaggtagccgatgaagacagcgtaaaggtcctcgataaggccaccgtccctattatcaaactgaccgattctttcacggaggtgaaggtggacatcagttttaatgtccaaaacggggtccgggcagccgacctcattaaggatttcacgaaaaagtatccagtactgccttaccttgtcttagtcttgaaacaattcttgctgcaaagagacttaaacgaggtgtttacagggggaattggttcctactctcttttcttgatggcggtttcattcctgcagctccacccccgtgaggatgcctgcattccaaacactaactacggtgttttgttgatcgagttttttgaactctacggacgtcacttcaactatctcaagaccggcattaggatcaaggatggtggaagctatgtggcgaaagacgaggtccagaagaatatgcttgacggataccgcccatcaatgttatatatcgaagatccactacagcccggaaacgacgtaggccgcagctcgtacggtgcgatgcaggtgaagcaagcctttgattacgcctatgtggtgctctcccacgccgtatctcctattgcaaaatactacccaaataatgaaaccgaaagtatactgggacgcattatccgtgtgacagacgaagtggcgacctacagggactggatctccaagcaatggggactaaagaatcgtcctgaaccatcttgtaacggaaacggcgtcacactaattgtcgacacccagcagctcgataaatgcaataacaatctttcagaagagaacgaagccctgggaaaatgccggtctaagacgagtgagtccctgagtaagcactcatctaactcaagttctggacccgtgagctctagtagtgcaacccagtcgagcagctccgatgttgattccgacgccaccccatgtaaaactcctaagcagttgctatgtcggccatccacaggaaatagagtgggttcacaggacgtctctttggagagctcccaggcggtgggtaagatgcagagtacacagacaaccaacacgtcgaacagcacaaacaagtcacaacatggatccgctcgcctgttccgaagctcatccaagggtttccagggcaccacacagacatcacatggatcactaatgacaaataagcagcaccagggaaaatctaataatcagtactatcatggcaaaaagcggaaacataagcgggacgcgccccttagtgacttgtgtcgctag

SEQ ID NO: 49337 - DNA, 522 bp, Artificial Sequence
  Description of Artificial Sequence: Synthetic coding sequence
atggacatcgagaaggtgaacagcatggacctgggcgagttcgtggacgtgtttgggaacgctacagaacgttgcccactgatcgcagctgcagtgtggagtcaacgacccttttccgacctggaggatttggagaagcacttttttgcctttatagacgcacttgctcaatcaggacaggaagggattctacggtgccacccagacctcgcggggagcgaactccaaagagggaccctgaccgccgaatcccagcgcgaacagtccggggcaggcctcaggtctcttggggcagacgagaggctccgcctcgccgaacttaatgcccaatacagggcgagatttgggttcccattcgttctggccgcgcgattttctgacaggaccgccgttcccagggaactcgcaagaagactgctctgtccctcagcccaggagcttaggactgctctcggcgaggttaaaaaaatcggatctctccggcttgctgacctactccgcgctgatcctgctaagctgtag

SEQ ID NO: 49338 - DNA, 2022 bp, Artificial Sequence
  Description of Artificial Sequence: Synthetic coding sequence
atggccgagagcagcctgtaccggcagcggctggaggtgatcgccgaaaaacggaggcttcaggaggagatcagggcagctcgcagggaagtggaggaggagaagctaagggtagagcgcctgaagcgcaaatctctgagagaacgatggttaatggatggcgcagccgcggtgcccgaaccgagcgaagatccaacttccaaagacccacagagtccagaggggcaggcccaggcacggattaggaatctggaagattctctgtttactctgcagtctcagttgcagctgctgcagagcgccagcactggagcccagcacaagccctctggcaggccctcctggaggcgacagggccacagaccgctcagccagagtatcgttgaggcaggctcagtaggtcagacagatctcaataagcgggccagtctccccgctgggctggtcgggactccccctgaatcgcccagcgaaccgagggaggacgtactcggcttccttccagggcctaggcaggtgcccggggcggccggggattcgtcagaggcaaatgggccctgtccatcgcccatccctacccccgaacagggcctctcacagcgggccgtgcctagcgagggaagggtgggcgaagccaagggggggggtgttgttagcgtggtttgggagggcctccgcgccacggaggattgcgctaccggggccactggccctgagcttgaggctaaggtggaggaggtggtgcttgaggcgatcggggacagaaagggggcagggtcacttgaattgccagcttgggtcaaagaggatagggggatagtggaggtggtatgggaaggagtggggggaagcgacgccgaggctatgggcgagatcggccgggtgccggaagtagtgcagacctcatcaccacgattacaggagaggctggaggccgcggccagtatcgagggcgaggacgtcccacaggggagccctgagggcgatggtcagggaggctctggaggggaggaaggcagtttcatttgggtggagcgggtgacactgtctgaagagtgggaagagctcctggtcgaggggctggagggacccgaagttgcagggagggagaggggggacgagtcaccgcttggtgctgaaggtgctaagacaggggggggtgaagagacctgggaagctgagaagcgaaaggccgaggagtccatggggatcgggagtgaggagaaacctggcaccggccgtgatgaggccgaaatgtcccccgtggtagagagaaagggtggggagaaaaagctcgaacttgagagtcgcggttcagctgaaaagctgggcaccgagagagaaggtggggaggagcctctcggcattgaaaggaaggttgagggccacctgagggccgagaaggaaggggatgaggaaaagaggggcgccgaagaggaggaggtggaggagcctctaggcgtcgaaaaaaagggaggggaggaagaaccagaagccacaaaagagccactggaggcggagaggaaaggaggcgaggagacgcttgaagcggagaagcggggcggcgaggaaagcctggaaacagagaagactcagggcactgagggcgatctgaacctggaacagggcagtagagaaggatccgagagccaagccgaagagatgaacgaggctgggcccccgctggaagccaacactgaaaccagacctgagaaagagggccctcagccacaagagaagcccgtgggagctctggaggaagaaggagtgaaacctcagaccgcagctgaaggccaggggcccctcggcgacgcaacccccctactggctgaaaccccagccccagagcagccagctgagtgccagccattactccagggcgaggggccttccgcaaatccgtctgcccaccctgtgccaacatacgccccagcacgccagccagaacctagcgctcctacagagggagaggaggcctcaggccctaagcagaagacctgccagtgctgcgcagttatgtag

SEQ ID NO: 49339 - DNA, 1347 bp, Artificial Sequence
  Description of Artificial Sequence: Synthetic coding sequence
atggccctgaccctgctggaggactggtgcaagggcatggacatggacccacgaaaggccctcctaattgtgggcatccccatggaatgtagcgaagtcgaaatccaggacacagttaaagctgggctgcagcctctatgcgcatacagagttctgggcaggatgttccgtcgcgaagataatgctaaggccgtgttcattgagctcgccgacacagtcaattacaccactctcccctctcatatccccggtaaaggcggctcctgggaagtcgtggttaaaccaaggaatcccgacgacgagttcctgtccagattaaactacttcttaaaagatgagggccgatccatgaccgatgtggccagggccctgggttgctgtagcttgcccgccgagtcactggacgcggaggtcatgccgcaggtgcggagtcctcccctggagccccctaaagagtctatgtggtatcgtaagctcaaagtgtttagcggcacagcgtcaccctcacccggcgaagagaccttcgaggactggttagagcaggtgactgaaatcatgccgatctggcaggtttcggaagtcgaaaaacgtcggcgattgctggaaagtttacgaggtcctgcactctcaatcatgcgagtgctgcaggcaaataatgactccatcactgtggaacagtgcctggatgccctgaaacagattttcggtgacaaagaggatttccgggcctcccagttcagatttctgcagacgtctccgaagataggggagaaagtgtctaccttcctgctgcgcctggagccccttttgcagaaggcagtacataaatctccgctgagcgtgcggagcactgacatgattcggttgaagcacttgttggccagagtagctatgaccccagccctaaggggaaaattggagctacttgaccaacggggttgtcctccaaactttctcgagttaatgaagctgatacgtgacgaggaagaatgggagaacacggaggctgtgatgaaaaataaggagaaaccaagcggacgggggcggggcgctagcggcaggcaggcccgcgccgaggccagtgtgagcgcaccgcaggctactgtgcaagcgcgcagctttagcgactccagcccacagacgatccaaggaggactgccacctctcgttaaacgccgacgactgttgggatccgaaagtacccggggcgaggaccatggtcaggcaacataccccaaagccgagaaccagactcctggcagggaagggccacaggcagcaggcgaggaacttggaaacgaagcgggcgccggagccatgagtcaccctaaaccatgggagacgtag

SEQ ID NO: 49340 - DNA, 423 bp, Artificial Sequence
  Description of Artificial Sequence: Synthetic coding sequence
atggccctgaccctgctggaggactggtgcaagggcatggacatggaccctaggaaggccctgctgattgtggggatccccatggaatgttccgaggtcgagattcaggataccgtgaaggcaggcctccagcccctctgcgcctatcgagtcctggggcggatgttccgcagagaggataatgccaaggccgtgtttattgaactcgcagatactgtgaactacaccaccctgccctcgcacatcccaggtaaaggcgggagctgggaggttgttgtgaagcctaggaaccccgatgatgaatttctgtccagactgaattatttcttaaaagatgagggacggtctatgactgatgtcgccagggcacttgggtgttgctcactcccagccgagtcactggatgcagaagtaatgccatag

SEQ ID NO: 49341 - DNA, 1347 bp, Artificial Sequence
  Description of Artificial Sequence: Synthetic coding sequence
atggccctgaccctgctggaggactggtgcaagggcatggacatggatccccgcaaagccttactaattgtgggaattccaatggagtgcagtgaagttgagatacaggatactgtgaaggcaggcctgcaaccgctgtgcgcatacagagtgctgggccgcatgttccgaagagaggacaatgcaaaggctgttttcatagagctggccgacaccgtcaactataccacgttaccttcacatatccccggcaagggcggtagttgggaggtcgtggtgaaacccagaaacccagacgacgagttcctgagccgtctgaattattttctcaaagacgagggacgcagtatgaccgatgtggccagggccttgggctgctgctcgctacctgcggaatcactggatgccgaagttatgccacaggtcaggagcccccctcttgagccccctaaagagagtatgtggtatagaaaactcaaggtgtttagtggaacagctagtccaagccccggggaagagacattcgaagactggctggagcaggtgacggagatcatgccaatttggcaggtcagcgaggtagagaaacgtcgtagactgctcgagtccctccggggaccggccctgtctatcatgcgcgtcctccaggccaataatgacagtatcacagtggagcaatgcctggacgccctcaagcagatttttggcgataaggaagatttcagagcaagtcaatttagattccttcagacctctccaaaaataggcgaaaaagtatcaacgtttcttctcaggttagaaccactgctccagaaagccgtgcataaaagtcctttgtccgttagaagcactgacatgatccgtctgaagcacctgcttgctagagtggccatgactcccgcgctgcggggcaaattggagctgctagatcagcgcggctgtccacccaatttccttgaattaatgaagctcatccgcgatgaggaagagtgggagaataccgaagccgtgatgaaaaacaaggaaaaacccagcggccgaggccggggtgcttctggccgccaggctagagccgaggcctccgtttctgcgccccaggctacagtgcaggcacggtccttcagtgactcctctccacaaactatccagggtgggcttccgcctcttgtcaagcgtaggagattactgggaagcgagtcaactcggggcgaggaccacggacaagcaacataccccaaggcagaaaaccaaactcctggtcgcgaaggcccacaggccgccggagaagagcttggaaacgaagctggtgctggtgctatgagccatcctaagccttgggagacttag

SEQ ID NO: 49342 - DNA, 1347 bp, Artificial Sequence
  Description of Artificial Sequence: Synthetic coding sequence
atggccctgaccctgctggaggactggtgcaagggcatggacatggatcccaggaaagctctcctgattgtagggatacccatggaatgcagtgaagtggaaattcaggatactgtcaaggccggactccagccactgtgtgcgtaccgcgtgctcgggagaatgttcagaagagaagacaacgcaaaggcagtgttcatcgagctggccgatacggttaactacacgaccctccctagccatatacccggcaagggcgggtcctgggaagtggtcgtgaagccaagaaaccccgacgatgagtttctgagccggctgaactattttctgaaggacgagggtcgcagcatgacagatgttgccagagctttggggtgctgcagtcttcccgcagaatcattggacgcagaagtgatgccacaagtacgatctccacccctcgaacctccgaaggagtctatgtggtaccgcaaattaaaggttttttcggggacagccagccccagccccggggaggaaacattcgaggactggttagagcaggtcaccgaaattatgccaatctggcaagttagcgaagtggaaaaaagaagacgtcttctagagtcattaaggggtcccgccttgagcatcatgcgtgtcctgcaggccaacaacgattcgatcaccgtggagcagtgcctggatgctctcaagcaaatattcggagacaaggaggactttcgtgcctcacagttcaggtttctgcagactagtcctaaaattggtgaaaaggttagcacctttctcctcaggctcgagcctctgctgcagaaggccgtgcacaagtcccccttatccgtccgttcgacagacatgatacggctcaaacatttgctggcacgggtcgcaatgacccccgcactgcgagggaagctcgaactactagatcaacgggggtgccctcccaactttctcgagctgatgaagctcatccgggatgaggaggagtgggaaaatacagaggccgtcatgaagaacaaggagaaaccgagcggccgcggacgcggcgcctctggccggcaagcccgcgccgaggctagtgtgtcagcacctcaagcgacagtgcaagcccgtagcttcagcgactccagccctcaaaccatccagggcggactgccgcctttggtgaagcggagaaggctgttgggatccgagagcacacgcggcgaggaccacgggcaggcaacatacccgaaagcagagaatcagacccccggccgggaggggccccaggcggccggagaggagctgggcaacgaagcaggagccggtgcgatgagtcacccaaagccatgggagacttag

SEQ ID NO: 49343 - DNA, 1347 bp, Artificial Sequence
  Description of Artificial Sequence: Synthetic coding sequence
atggccctgaccctgctggaggactggtgcaagggcatggacatggatccgcggaaggctctcctcatcgtgggaatccctatggaatgttctgaagttgagatccaggatacggttaaggcaggactccagcctctgtgcgcctatcgggtgctcggtcgcatgttccgaagggaagataatgcgaaggcagtattcatcgagctggccgatacagtgaattacacgaccctgcctagtcacatcccaggtaagggaggtagttgggaggtagttgtcaagccacggaatcctgacgacgagtttctgagtcgcctcaattatttcctcaaggacgagggccgatcaatgaccgatgtagcccgagctctgggttgctgcagccttccagcggaatcgctggatgccgaagttatgccccaggtaaggtcaccaccccttgagcctccaaaggagtccatgtggtaccggaagctgaaagtgttttctggaactgcctccccaagccctggagaggagacttttgaggattggctggagcaggtaaccgaaatcatgccaatttggcaggtcagcgaggtcgagaagcgaagacgcctcctggaatcactcaggggcccggcactgagcataatgcgtgttttgcaggctaacaacgactccatcacagtggagcaatgcctggacgcattgaagcagatattcggcgataaagaagactttcgtgcttctcagttcaggttccttcagacctcacctaagatcggcgaaaaagttagcaccttcctgttgcgtctagaacctctgttgcagaaggcagttcacaagtcccctctgtcggtacgatcaactgacatgattaggctaaagcatctgcttgcaagggttgcaatgacccccgccctgcggggcaagctcgaacttcttgatcagcgcggctgcccgcccaacttcctcgagctcatgaaattgatccgcgacgaagaggagtgggagaacaccgaggccgtgatgaagaacaaggagaagcctagtggcagagggcgcggcgcgtccggcaggcaagccagagctgaagcttccgtgtccgcacctcaggccaccgtgcaagctagatctttttccgattctagtcctcagactattcaaggcggattgcctccccttgttaagcgtaggagactgttggggagtgaatccacccgaggcgaagaccatgggcaagcaacctatccgaaggcagaaaaccagactcctggccgagagggcccacaggccgccggcgaggagctgggcaatgaagctggggcaggcgccatgagtcacccaaagccttgggaaacatag

SEQ ID NO: 49344 - DNA, 1200 bp, Artificial Sequence
  Description of Artificial Sequence: Synthetic coding sequence
atggccgtgaccatgctgcaggactggtgccggtggatgggcgtgaacgctagacgcggccttttgattctgggcattcccgaagattgcgacgacgctgagtttcaagagagccttgaggccgctctgagaccaatgggccactttactgtgctggggaaggtattcagggaggaagacaatgccacagctgccttggtcgagctggaccgcgaggtcaattacgctctggtgccacgggagattccaggcaccggcggcccttggaacgtcgtcttcgttccccgctgtagcggagaagaatttctgggtctgggccgtgtgttccatttccccgagcaagagggccagatggtggagtctgtagctggcgccctgggcgtgggcctcagacgagtttgctggctcaggtctatcggccaggcagtgcagccttgggtggaggctgtgcgctaccagagcttgggtgtcttcagcgggagggaccagcctgcccccggtgaggagtccttcgaggtttggttggaccacacaacggagatgttgcacgtttggcaaggcgttagtgagagagagcgcagaagacgccttttggagggcctccgcgggacagccctccagttagtgcacgcccttctggctgagaaccccgctcgaacagcccaggattgcctcgcggccttggctcaggtctttggggataacgagagccaggcaaccatccgcgtgaaatgccttactgcccagcagcagtctggcgagagattgagcgcgttcgtgctccgtctagaagttctgctgcagaaagccatggagaaagaagccctggctcgagccagcgccgatcgagtgcgcttaaggcagatgctgaccagagctcacctgaccgaaccgctggacgaagctctgcgcaaacttcggatggctggacgcagcccaagctttctcgagatgctggggctcgtgcgggaaagtgaggcttgggaggctagcctggctcggtccgtgcgcgcccaaacccaggagggtgccggggcccgggccggagctcaggctgtggccagggcatcaaccaaagtggaggcagtaccaggcggtcctggtcgcgaacccgagggtctccgtcaggccggcgggcaggaggccgaggagttacttcaggagggcctgaagccggtcttggaggaatgtgacaattag

SEQ ID NO: 49345 - DNA, 1200 bp, Artificial Sequence
  Description of Artificial Sequence: Synthetic coding sequence
atggccgtgaccatgctgcaggactggtgccggtggatgggcgtgaacgctcgccgcggcctgttgatattgggcattcccgaagattgcgacgatgcagagtttcaggagtccctggaggccgcacttcgcccaatgggccatttcacagtgctagggaaggtgttcagagaggaggacaatgccacagccgcactcgttgaactggatcgtgaagttaactacgctctcgtccctagggagatccccggaaccggcggcccctggaacgtggtattcgtgccgcggtgcagcggtgaagaatttctgggactcggcagggtcttccattttccagaacaggagggccaaatggtggaatcagtggctggcgcattgggggtgggccttcgccgtgtttgttggctgcggtccatcggacaggcggttcaaccctgggtcgaggccgtgcgataccagagtctgggcgtgtttagcggaagggaccagcccgcacccggggaggagtccttcgaggtatggctcgaccacactacagagatgttacatgtttggcaaggggtcagcgagagagaacgtagaagacgccttctcgaaggtctgcgtggaactgccctccagctggttcatgctttgctggccgaaaatccagcgcggacagctcaagactgcctggccgcattggctcaagtgttcggagataacgaatcacaggctaccattagggtgaagtgcctgaccgctcagcaacagagcggtgagagattaagtgcttttgtactgagactggaagtgttgctccaaaaagccatggagaaagaggctttggcccgcgcatcggcggaccgggtgagactacgccagatgctgactcgggcccatctcaccgagcctctggatgaagccctgcgcaagttgaggatggccggaagaagtccttccttcttggaaatgcttggactcgtaagggagtctgaagcctgggaagcatctcttgctcgcagcgtgagggcacagacgcaggaaggggcaggagcgagggccggtgcccaggccgtggcgagggcatccacaaaagtggaggccgtgcccggcgggcccggcagagagccagagggtctgcgacaagccggcggtcaggaggccgaggaacttctccaggaggggttaaaacctgtcttagaagagtgcgataactag

SEQ ID NO: 49346 - DNA, 1200 bp, Artificial Sequence
  Description of Artificial Sequence: Synthetic coding sequence
atggccgtgaccatgctgcaggactggtgccggtggatgggcgtgaatgctaggcgtgggctgttgattctgggcattccagaggattgtgatgacgccgagttccaggagtcgctcgaggccgccctccgaccaatgggccatttcactgtgttgggaaaagtttttcgcgaagaggacaacgccacagccgcactcgtggaactagatagagaagtcaattatgcgcttgtgcccagagaaataccaggaactgggggcccatggaacgtagttttcgtgccaaggtgttcaggcgaagagtttctcggactaggccgggtgttccattttcccgagcaggagggccagatggtggaaagtgtggctggtgccctgggggtcgggctgagaagagtgtgctggctgaggagcatcgggcaggctgtacaaccatgggtggaagccgtacggtatcagagtctgggcgtcttttccggaagagatcaacctgcaccaggagaagaaagctttgaagtttggcttgaccataccacggagatgctgcatgtgtggcaaggcgtgtccgagcgcgaacggcggaggcgactcttggagggattaagaggcactgccctgcagctcgtgcacgcgctgctcgctgaaaaccctgcccgaacagcccaggactgcttggctgcattagctcaagtgtttggagacaacgagtctcaggcgaccattcgggtgaaatgcttgaccgcgcagcagcagagtggtgagcggctgtccgcattcgtactaaggctggaggtcttgctccagaaagcgatggaaaaagaagctctggctagagccagtgcagaccgagttcgcctgcggcaaatgctaacacgggcacacctgaccgagcccttggacgaagctctccgaaaacttaggatggcgggtaggtctccgagcttcttggaaatgctcggtctcgtgagagagagtgaagcttgggaagcgtcacttgcaagatccgtcagagcgcagactcaggaaggcgcgggcgctagagctggagcccaggcagtcgctcgggcgtctaccaaggtcgaggctgtgccaggcggacccggccgggagccagaaggcctccgacaggccggaggccaggaggctgaagaactactccaggagggcctgaaacccgtgctcgaagagtgtgacaattag

SEQ ID NO: 49347 - DNA, 1200 bp, Artificial Sequence
  Description of Artificial Sequence: Synthetic coding sequence
atggccgtgaccatgctgcaggactggtgccggtggatgggcgtgaacgcaagacgaggcttattgatcttaggaattcccgaggactgcgatgatgccgaattccaggagtctctagaggcggccctgcgacccatgggccacttcactgtattaggcaaggccttcagagaggaagacaacgctactgcggctttggtcgagctggaccgagaggttaactacgcccttgtgccacgagagattccaggcacagggggaccatggaacgtggtgttcgtccctcgttgttccggggaggaatttctggggttaggccgtgttttccatttcccagaacaggaggggcagatggttgagtccgtagctggggctctcggcgtggggcttagacgtgtgtgttggttaagatccataggccaggcagtccagccatgggttgaggcagtccgatgccagagcctgggcgtgttctccggtcgggaccagcccgcccccggggaggagagctttgaggtgtggctcgatcacactactgaaatgctgcacgtttggcaaggcgtgtccgagcgggagagacggcgtagattactggaggggctccgtggtacggctctccagttggtgcatgcgctgctggcggaaaacccggcacggacagctcaagactgtctggctgcactggctcaggtgttcggcgacaatgaatcacaggctaccataagggtgaagtgtctcacagctcagcagcagagcggggaacgactgagtgcttttgtcttgagactggaggtgctcctgcaaaaagcgatggagaaggaagccctggctcgagcgtccgcagaccgagtaaggctaaggcaaatgctaacaagagcacatctaacagaaccgctagacgaagctctacggaagcttcgtatggccggtcggtcaccaagtttcctagaaatgttgggtctggtccgcgaaagcgaagcctgggaagcctctctcgcgcggagcgtacgcgcccaaactcaggagggcgcaggtgctcgagcaggggcccaagccgtcgcacgggcctccactaaagtggaagcagtgcccggcggtcccggacgggaaccggagggactgctgcaggctggcggacaggaggcggaggagctgctgcaagaggggttgaaaccagttcttgaggagtgtgacaattag

SEQ ID NO: 49348 - DNA, 1200 bp, Artificial Sequence
  Description of Artificial Sequence: Synthetic coding sequence
atggccgtgaccatgctgcaggactggtgccggtggatgggcgtgaacgcacggaggggtctgttgattctggggattcccgaagactgcgacgatgctgagttccaggagtcgctggaggctgccctgcgccctatgggccattttacagtgctgggcaaagccttccgggaagaggacaatgcaacagccgcgctggtggagttggaccgagaggttaattatgcgctggtgcctagagaaattcccggcacaggcggcccttggaatgtcgtgttcgtaccacgctgttctggcgaagaatttctgggattgggccgagtgttccatttccctgagcaggagggacagatggtggaatctgtggcgggggctctcggagtgggacttcgtcgcgtgtgctggttgaggtcgataggccaggcagtgcagccctgggtagaggccgtgcgctgccaatcccttggggttttttccgggcgggatcaaccagcccccggagaagaatcttttgaagtttggctggaccatacaactgaaatgctccatgtgtggcagggcgtctctgagcgagagcgtcggagacgactcttagaaggcttgcgtggcaccgcactccaactcgtgcatgcactactggcagaaaatccagccaggacagctcaggactgtctggcagccctggctcaagtgttcggagataatgaaagtcaggccaccatccgggtcaaatgcctgaccgcccagcagcagtccggtgagagactgagtgcatttgtccttcgcctggaagttctgttgcagaaagccatggagaaggaggccttggccagggccagcgccgatagagtgaggcttagacagatgttgacacgggctcatcttaccgagccactagatgaggcgttgaggaaacttcgcatggcaggccgcagcccttcttttctggaaatgttgggactggttcgtgaatccgaagcttgggaggcctcattggctcgatccgtccgagcccagactcaagagggagcaggcgcacgggccggagcccaggccgttgctagggcctcgaccaaagtcgaagctgtgcccggcggacccgggagggaacccgaggggttattacaggccggcgggcaagaagccgaggagcttttgcaggaagggctcaagccagtcctcgaagagtgtgataactag

SEQ ID NO: 49349 - DNA, 1347 bp, Artificial Sequence
  Description of Artificial Sequence: Synthetic coding sequence
atggccctgaccctgctggaggactggtgcaagggcatggacatggatccaagaaaagccctactgatcgttggcatccccatggagtgcagcgaagtagaaatccaggataccgtcaaagctggcctgcagccgctgtgtgcctaccgggtgcttggtcgcatgttcaggcgcgaggacaacgctaaggctgttttcatcgagctggccgatacagttaactacactacactgcccagccatatccccgggaagggggggagctgggaagtagtcgtcaaaccgagaaatccagacgatgaattccttagtcggctcaattactttctcaaagacgagggccgctctatgacagacgtcgctcgggcactgggttgttgctctctgcccgcggagagcctggatgctgaggtgatgccacaggttagaagcccaccactcgagcccccaaaagagtccatgtggtatcggaaactgaaggtgttcagtggaaccgcttccccttctccgggcgaggagactttcgaggattggttggaacaggtgacagaaattatgcctatatggcaggtgtctgaagtcgagaagcgcagacgcctcctcgagagcctgagggggccggcgttaagcattatgagagtgctgcaggctaacaatgacagtatcactgttgaacagtgcctcgacgccctaaaacagatattcggcgataaggaagacttccgcgctagtcagttccgtttccttcagacctctcccaagatcggagaaaaggtttctacctttctgctccggctggaacctctgcttcaaaaggctgtgcacaagtctcccttgtctgtgaggtctacggatatgatacggctcaaacatctgctggcacgcgtcgccatgactcccgcccttcgcggcaagttggagctgcttgaccaaagaggctgtccgccgaacttcttagagttgatgaagctgatccgagatgaagaggaatgggagaacacggaggcagttatgaagaacaaggaaaaaccttctgggaggggacggggggcaagtggaaggcaagctagagcagaagcgtcagtttcagctccacaggcaacagttcaagcaaggtctttctccgattcttctccgcagaccatccaggggggactgcccccactcgttaagcggaggcgactcttgggttcggagagcacaagaggggaagaccacggccaggcaacctatcccaaggccgagaatcaaacacctggacgagaggggccccaagccgcaggcgaggagttaggcaacgaggcaggggccggagcaatgtcccaccctaagccctgggagacatag

SEQ ID NO: 49350 - DNA, 1347 bp, Artificial Sequence
  Description of Artificial Sequence: Synthetic coding sequence
atggccctgaccctgctggaggactggtgcaagggcatggacatggatccgcgtaaggctctgctcatcgtcgggattcccatggagtgtagtgaggtagaaatacaggacaccgtgaaggcaggccttcaacctctttgtgcttatagggtgcttggccggatgtttcgacgggaagataatgctaaggccgtgttcatagagctggccgatactgtcaactatacaaccctacctagtcacatacccggaaaaggagggtcttgggaggtagtggtgaagccgaggaacccagatgacgagtttctgtcacggctaaactatttcctaaaagacgaggggcgttctatgacagacgttgcgcgcgccttgggctgttgctccttgccagcggaatccctggacgcagaggtgatgccgcaggtgagaagtccgcctttagagcctccaaaggagtctatgtggtaccggaagcttaaggtcttctctggtactgcatccccttctccaggcgaggagacattcgaagactggctggaacaggtgacagagataatgccaatctggcaggtgtccgaagtcgagaagcggcggcgactcctggagtctttacgggggcccgccctcagcattatgcgggttttacaggcgaacaacgattctattaccgtcgaacagtgtctggacgctctcaaacagatcttcggggataaggaagacttccgcgcctctcagtttcgctttctgcagacctcccccaagattggcgaaaaggtgagcacctttctactaagactggagccactgcttcaaaaagcagtccacaaatccccactgtccgttaggtccacggatatgatcagactgaaacacctgctggccagggtcgcaatgacgcccgcacttcgcggaaaactggagctcctggatcagaggggctgtccgcctaatttcctggaactgatgaagttgattcgcgacgaggaggagtgggagaacactgaggccgtgatgaagaataaagagaaaccttcgggacgcggccgaggggcttctgggagacaagcacgggcagaagccagcgtttctgcgccacaggccaccgtgcaagccaggtcattctctgactccagccctcagacaatccaaggtggcctcccaccattggtcaagagacgtagacttttaggatctgagtcaaccagaggtgaagaccacggccaggcaacatacccaaaggccgagaaccagaccccggggcgtgagggaccacaggctgccggtgaggagcttggaaatgaggccggtgccggcgcaatgagtcatccaaaaccgtgggagacctag

SEQ ID NO: 49351 - DNA, 1347 bp, Artificial Sequence
  Description of Artificial Sequence: Synthetic coding sequence
atggccctgaccctgctggaggactggtgcaagggcatggacatggacccgcggaaagccctactcattgtggggatcccaatggagtgtagtgaagtggagattcaagataccgtgaaagctggtttgcagcctctttgcgcctatcgggttctgggcagaatgttcagacgcgaagataatgccaaggccgtgtttattgagcttgccgacaccgtgaattatacaaccctgccatctcacattccaggcaaaggaggctcgtgggaagtagtcgttaagcctagaaatccagacgacgaatttctgtctaggctgaattacttcctcaaggacgagggacgctccatgaccgacgtcgcacgggcactggggtgctgtagcttgccggcagaatccctagatgctgaggtcatgcctcaagtgcgctcacccccattagaaccaccaaaggaatcaatgtggtacaggaaactgaaggtgttttctggaaccgcctcaccctcacccggcgaggaaacctttgaagactggctggagcaggtgactgaaattatgcctatatggcaagtcagtgaggtggaaaagagaaggagactgttggaaagcctccgggggccggctctcagcatcatgcgtgttttgcaggccaacaatgacagcataactgtagaacagtgtctcgatgctctgaaacagatcttcggagacaaagaggattttagagcctcccagttccgctttctgcaaacaagccccaaaattggagaaaaagtgtcaaccttcttactgcgcctggagccactgctacaaaaagcagttcacaagagtccgctaagcgtgcgcagtaccgacatgattcgcctcaagcacctgcttgcccgtgtggccatgacaccggcattgcggggcaagttagaacttctcgaccaacggggatgccccccaaacttcttggagcttatgaagctgattcgggacgaggaagagtgggaaaacacagaagcagtgatgaaaaacaaagaaaagccctctggccgcgggcgtggcgcctctggacgccaagctcgcgccgaggcttcagttagtgctccccaagccacagtgcaagcacgtagctttagtgattcgtctccacagactatccaaggtggcctgcccccgcttgtaaagagacggcgactgctcgggtcagagtctactaggggagaagaccacggccaggccacctatccaaaggcagaaaatcagacccccgggcgcgagggccctcaagctgcgggcgaggaactcgggaatgaggccggcgccggcgctatgtcacaccctaagccttgggagacatag

SEQ ID NO: 49352 - DNA, 1347 bp, Artificial Sequence
  Description of Artificial Sequence: Synthetic coding sequence
atggccctgaccctgctggaggactggtgcaagggcatggacatggatcctcgcaaagctctgctgattgtgggaattccaatggagtgctctgaggtggagattcaagacactgtgaaagccggtttacagccactgtgtgcttaccgcgtgttgggtcgcatgtttcgcagagaagacaatgctaaggcagtgtttatcgaactggccgacacagtaaactacaccactttgccttcccacataccgggtaaaggggggtcttgggaggttgttgtcaagccacgcaatcctgatgatgagttcctctccaggctgaactacttcctgaaagacgagggacgctccatgaccgacgtggctcgggcactcggctgttgcagcttgcctgccgagagccttgatgccgaagtgatgccgcaggtccggagcccaccgctggaaccccccaaggaatcgatgtggtaccgaaagcttaaagtgttctctggaaccgcatccccgagtcctggcgaggaaactttcgaagactggctggaacaggtcacagaaatcatgcccatttggcaagtgtcggaggtcgaaaagcggcggaggctcctcgagtccctgagaggacccgctttgtctattatgagggtgctgcaggccaataatgactccatcaccgttgaacagtgcctggacgcacttaagcagatatttggagataaggaggatttccgtgctagccaattccggtttttacaaaccagccccaaaataggtgagaaggtctcaacgtttcttttgcgtctcgagccattactgcagaaggccgtgcataaaagcccactgtccgtcagatctacagacatgatccggctaaaacatttactggcacgcgtcgccatgacacctgcccttcgaggaaaactagagcttctggaccagcggggatgtcccccaaactttctagagctgatgaagttaatcagagatgaagaagaatgggaaaataccgaggccgtcatgaagaacaaagagaagcctagtggcagagggcggggagctagcggaagacaggctcgggccgaggctagcgtgtccgcgcctcaggcaaccgttcaggctcggtctttttcagatagttccccccagacaatccaaggcggactgccacccctcgttaagaggaggcgcctattggggtctgagagcactcgcggagaggaccacggacaggccacctatcctaaggccgaaaaccagacgccgggaagggaggggcctcaggctgccggggaggagcttggcaacgaggctggcgcgggcgctatgtcacaccccaaaccctgggagacatag

SEQ ID NO: 49353 - DNA, 1908 bp, Artificial Sequence
  Description of Artificial Sequence: Synthetic coding sequence
atggccatgagcctgctgcaggactggtgccggagcctggacgtggacgctcatagagcattgcttgtcactggcattcctgaagggctggaacaagccgacgttgaagccgtgctgcagcctaccttgttgcccctgggcacgttccgtttaaggcatatgaaagccttgatgaatgaaaaggctcaggccgctcttgtagaattcgtcgaggatgtgaatcacgccgctattcccagggaaatcccaggaaaggacggagtgtggagggtgttgtggaaagatcgagcccaagataccagggtcctacggcagatgaggcgactactccttgatgatgggccaactcaggccgcagaagccggaactcccggagaggcacccacaccccccgccagcgagactcaagcccaagattcgggagaagtcacaggccaggccgggagtctgcttggagccgcgcgaaaccccagacgtggaaggagaggcagaagaaatcgcacacgtaggaaccgtttaacacaaaaaggcaagaaaaggtctcgaggaggccggcctagcgcgcctgcaaggtcagaagccgaagacagcagcgatgaaagtcttgggattgtcatagaagaaattgatcagggcgatctgtctggggaggaagatcagtctgccctgtacgctactttacaggcagcagcaagagagctggtaagacaatgggccccttgtaatagtgagggggaagaagatggcccccgggaatttctggcactggtgactgtcactgacaagtcgaagaaggaggaggctgaaaaggaaccggccggcgcagaaagcattcgactgaatacaaaagaagataaaaacggagttcccgatctcgtagcgctgctcgccgtcagagacacacccgacgaggagccggtggacagcgacacttccgaatcagacagtcaggaatccggcgatcaggagacagaggaactggataacccggaatttgtggcaatcgtggcttatacagacccctctgacccttgggcccgggaagagatgttaaagatagcctctgtgatcgaatctctgggatggagcgatgagaaagacaagagggatcccctaagacaggtcctaagtgtgatgtccaaggacaccaatgggacccgtgtgaaggttgaagaagccgggagagaggtggacgcagtggtgttacggaaggccggcgatgatggagacttgcgggaatgcatctcgaccctggcgcagcccgacctaccccctcaggccaaaaaagcaggtagaggcctatttggcggttggagcgagcacagagaggacgagggcggtctgttggagctagtggccttgcttgcagctcaggacatggcagaagtgatgaaggaagaaaaggagaacgcctgggagggcggtaaatacaagtaccccaaggggaaacttggcgaggtgcttgcgctgctggccgctagagaaaacatggggagcaatgagggcagtgaggaggccagcgatgagcagagtgaggaagaaagcgaagacacagaaagcgaggcctcggaacctgaggatagagcctctagaaagccacgggcgaagcgagctcgcaccgctccccgcggcctgactcctgcaggggcaccacccaccgccagcggtgcccggaagacacgggctgggggcaggggccgggggcggggtgtgactcccgagaagaaggcaggatcacgcggcagcgctcaggatgatgccgccggaagccgcaagaaaaaagggtccgccggagctggcgcccacgcacgcgcaggggaggcgaagggccaagctccaaccgggtccaaagccgcacggggcaagaaagccaggcggggtagaaggctgccgcccaaatgtcgctag

SEQ ID NO: 49354 - DNA, 666 bp, Artificial Sequence
  Description of Artificial Sequence: Synthetic coding sequence
atgcagaagagcgagggcagcggcggcacccagctgaagaaccgggcaactggaaactacgatcagaggacaagtagtagcacccaactaaagcaccggaacgccgtccaggggagcaaatcttccctgtcaacctctagccctgaaagcgccagaaaactccacccgagaccctccgataagctgaatccgaaaaccatcaacccctttggcgagcagagccgcgtccccagcgctttcgctgctatttattccaaagggggtataccttgcagactcgttcatggttcagttaagcatagactgcagtgggaatgccctcccgagagcctgtccttcgatccactgttgatcaccctggcagaggggctgcgagaaaccaaacacccttataccttcgtttcaaaagagggatttcgggaactgcttttggttaagggcgcccccgaaaaggcaatccccctgttacctaggttgattcccgttctaaaagcagctttggttcattctgatgacgaggttttcgagcggggactcaacgcgctggtgcagctgagcgtagtggtgggcccatctctgaacgaccatctgaagcatcttctgacgagcggttccctgagtataattaaatcaaagattcctacatactgcagcatttgctgctag

SEQ ID NO: 49355 - DNA, 666 bp, Artificial Sequence
  Description of Artificial Sequence: Synthetic coding sequence
atgcagaagagcgagggcagcggcggcacccagctgaagaaccgggccaccggaaattacgatcaacgtacctcttctagcacacagctcaagcatcgcaacgccgtccaggggtccaagagttccttgagtacatcaagtcctgaaagcgccaggaagttacacccaaggccctccgacaaactgaaccccaaaactatcaacccattcggtgagcagtctagggtgccgtctgcgtttgccgctatctattcaaagggggggattccctgccggctggtccacggatcagttaagcaccggttgcagtgggagtgccctcctgagtccttgtcctttgacccccttctcataacgctggcggagggcctcagggagactaagcatccctataccttcgtgtctaaagaggggtttcgagagcttttgctggtcaagggcgccccagaaaaagccatcccccttctcccaagactgatacccgtgctgaaggccgctctggtccactcagatgacgaggtatttgagagaggattaaatgctttagtgcagctttccgtggtcgtcgggccatctctgaacgatcaccttaagcatctcctgacctctggaagcctgtccataattaaaagtaagataccgacctattgctcaatctgttgttag

SEQ ID NO: 49356 - DNA, 747 bp, Artificial Sequence
  Description of Artificial Sequence: Synthetic coding sequence
atgcagaagagcgagggcagcggcggcacccagctgaagaaccgggcaactggtaattatgatcagcggacatcttccagcactcaactcaagcatcgaaatgccgttcaaggctcaaagagctctctcagtacctcctctcctgagtcggcccggaaactgcatccaagacccagtgataagctcaatccaaaaaccatcaaccccttcggcgaacaatcgcgagtccctagcgcctttgctgccatctacagcaagggcgggattccctgcaggttggtacacggctcagtcaagcatcgcctgcagtgggagtgtccccccgagtctttatctttcgaccctctgctgatcaccttggccgaggggctgcgggagactaaacatccctacacattcgtctccaaggagggctttcgagagctcttgctggttaaaggggcacctgagaaggccattccgctgctgcctcgcctcatcccagtacttaaagccgccttggtgcactccgacgatgaagtatttgagcgggggctgaatgccctcgtccagctctccgttgtcgtcggaccctccttgaacgatcatctgaagcatctccttaccagtctgtccaagcgcttaatggacaagaagtttaaggagcccataacatctgccctccagaagttggaacagcacggcggatccgggagcctttctattattaagtctaaaattcccacctattgctccatttgttgctag

SEQ ID NO: 49357 - DNA, 276 bp, Artificial Sequence
  Description of Artificial Sequence: Synthetic coding sequence
atgcagaagagcgagggcagcggcggcacccagctgaagaaccgggctacagggaactatgaccagagaacatcaagcagcacacagctgaagcatcggaacgctgtccaagggagcaaatcaagcttgtctaccagtagcccagagtccgccagaaaactgcatccaaggccctctgataaacttaaccctaaaaccattaacccgttcggagagcagtctagagtgcccagcgcgtttgcagccatttacagcaaggggggcattccttgctag

SEQ ID NO: 49358 - DNA, 258 bp, Artificial Sequence
  Description of Artificial Sequence: Synthetic coding sequence
atgcagaagagcgagggcagcggcggcacccagctgaagaaccgggctactggcaattacgaccagaggacctctagctcaacgcagctcaaacacagaaacgccgtgcagggcagcaagtcaagcctgtccacctcctcacccgagagcgctcggaagctacatccccggccctccgataagttgaatcccaaaaccatcaacccgtttggagaacagagtcgcgtgccaagtgcctttgccgcaatctactcctag

SEQ ID NO: 49359 - DNA, 666 bp, Artificial Sequence
  Description of Artificial Sequence: Synthetic coding sequence
atgcagaagagcgagggcagcggcggcacccagctgaagaaccgggcaacgggtaactatgatcagagaacctcatctagcactcaactcaaacaccgaaacgccgtgcagggctctaagtcttctctttctaccagctcgccggagtcagccagaaagctacatccaagaccatcagataaactgaatccaaagactatcaacccatttggagagcaatcccgggtgcccagcgcttttgccgcaatttattcaaagggtggcattccgtgtagactggtgcacggttccgtgaagcatagactgcagtgggaatgcccccccgagtcccttagcttcgatcccctccttattaccctcgctgagggccttcgggagacaaagcacccatacacttttgtctccaaggagggcttccgggaacttttgctggtcaagggcgcacctgaaaaggccatccctctgctgccacgcctcatccctgtattgaaagccgcccttgtacattccgatgatgaggtctttgagagaggtttaaacgccctggtccagttgtccgtagtggtgggcccgtcactgaatgatcatctcaagcatttgctgacttcaggatcgctgtcaataatcaaatctaaaataccaacctattgcagcatttgttgttag

SEQ ID NO: 49360 - DNA, 411 bp, Artificial Sequence
  Description of Artificial Sequence: Synthetic coding sequence
atgcagaagagcgagggcagcggcggcacccagctgaagaaccgggccacaggaaactatgaccagcgcacttcctcctcaactcagctgaaacaccgtaacgccgtacaggggtccaaaagctcactgagcacttcttcgcctgaatctgcccgaaaacttcaccctagaccctccgacaagctcaacccaaaaacaatcaacccattcggagaacagtctagagtccctagtgccttcgcagccatctactctaagggcgggataccctgccgcctcgtacacggatccgtaaaacatcgactgcagtgggagtgccctcccgagtcgttatcctttgacccgctgcttatcaccctcgctgagggtttgagagagaccaagcacccttacacattcgtgagcaagtag

SEQ ID NO: 49361 - DNA, 612 bp, Artificial Sequence
  Description of Artificial Sequence: Synthetic coding sequence
atgcagaagagcgagggcagcggcggcacccagctgaagaaccgggcaaccggaaactacgatcagcggacatccagctctactcagctgaagcatagaaatgccgtccagggatctaagtctagcttatccacctctagtcctgagagcgcgcggaagctgcatccaagaccttcagacaagctcaatccaaaaactatcaatccctttggggagcagtctagggttccttctgcatttgcagcgatttacagcaaaggtggaattccttgtcgcctggtgcacggttccgtgaaacacagactgcagtgggaatgcccccccgaatccctttcatttgaccctcttctgatcacactggcagaggggctgagagagacaaagcatccttatacatttgtgtcaaaggaagggttcagagaactgcttcttgttaagggggctccggaaaaagctatccctctgctgccccgcctgatcccagttcttaaagctgccttagtgcatagcgatgatgaagtctttgagcgaggcctaaacgccctggtccagctgtctgtggtggtcggaccgtcgctcaacgaccatctcaagcacctgctaacctcttag

SEQ ID NO: 49362 - DNA, 369 bp, Artificial Sequence
  Description of Artificial Sequence: Synthetic coding sequence
atgcagaagagcgagggcagcggcggcacccagctgaagaaccgggccactggaaattacgaccagcgtacgtcttccagtacgcaactcaagcacaggaacgcagtgcaagggtctaaatccagcctgagtacctcgagccctgagagtgcccgtaaattacacccacgtccaagcgacaaattgaacccaaagacgatcaatcccttcggggagcagagccgagttccgtctgcatttgccgccatttacagcaagggcggcatcccctgcagactagtgcacggcagtgtgaaacatcgcttgcagtgggagtgccccccagaatctctaagttttgaccctcttctgattacgctggcagaatag

SEQ ID NO: 49363 - DNA, 309 bp, Artificial Sequence
  Description of Artificial Sequence: Synthetic coding sequence
atgcagaagagcgagggcagcggcggcacccagctgaagaaccgggccacaggcaattatgaccaaaggacctcatcatccacgcagctgaaacatagaaatgcagtgcagggtagcaaatcctctctgagtacctcgtcacctgaaagcgcccgaaaactgcaccctcgcccatctgacaagctgaaccctaagaccattaacccctttggcgagcagagcagggtcccttcagcctttgccgccatttatagcaaaggaggcattccttgccgcctagtgcatggatccgtcaagcatcggttgtag

SEQ ID NO: 49364 - DNA, 372 bp, Artificial Sequence
  Description of Artificial Sequence: Synthetic coding sequence
atgcagaagagcgagggcagcggcggcacccagctgaagaaccgggctactggaaactatgatcaacgaacgtcatcttccactcagctcaaacaccggaatgcggtgcagggctccaaatcctcactgagcacatccagtccagaatcggcacggaagctgcatccaagaccatccgataagctaaatcccaaaacaattaaccccgtacactcagacgacgaggtctttgaacgcgggttgaacgctttggtgcaactgtccgttgtggtggggccttctctcaacgatcatttaaaacatctgctcacatccggttcactctcaattataaaaagcaaaatccctacttattgctctatatgctgctag

SEQ ID NO: 49365 - DNA, 372 bp, Artificial Sequence
  Description of Artificial Sequence: Synthetic coding sequence
atgcagaagagcgagggcagcggcggcacccagctgaagaaccgggctacaggcaactatgatcagcggacaagcagctcaacacagctgaagcatcgcaatgccgtgcagggctctaaatcatccctgtccacatcaagccccgaatccgcaaggaagctccatccaaggccctctgacaagttaaaccccaagactatcaaccccgttcacagcgatgacgaagtttttgagcgggggctgaatgccctggtgcagttgtcagtggtagtcgggcctagcctaaacgaccatcttaaacatctccttacttcgggctccctcagtatcattaaaagtaagatccctacttactgctcaatttgctgctag

SEQ ID NO: 49366 - DNA, 762 bp, Artificial Sequence
  Description of Artificial Sequence: Synthetic coding sequence
atgaagcacatcaacctgagcttcgccgcctgcggcttcctgggcatttaccatttaggcgcagccagcgccctttgccgtcatggaaaaaagctagtcaaagacgttaaggctttcgctggcgcctctgcggggtctctcgtggcctccgtcttactcacagctcctgagaaaattgaagagtgtaatcagttcacatacaaattcgccgaagaaatcaggcgacagtcgttcggcgcggtgacccccggatacgacttcatggccagattgcgcagcggtatggaatccattctcccccctagcgctcatgagctggcccagaatcgcctccacgtttcaatcacaaatgctaaaaccagggagaatcacttggttagtaccttttcttcaagagaggacctgattaaggttctgctggcgtccagtttcgtgcctatatatgcaggattgaagttggtagagtataagggacagaaatgggtagacggcggactcacgaacgcccttcctatcctccccgtgggtcgcactgtgaccatctcccccttttcaggcagactggacatcagcccacaggataagggacagctcgatctttatgttaacatagctaaacaagacatcatgctgtcactagcaaatttggtgcgccttaaccaagcgctatttcctccctccaaacgcaaaatggaaagcttataccaatgcggctttgacgacactgtcaagtttctgctgaaggagaattggttcgaatag

SEQ ID NO: 49367 - DNA, 573 bp, Artificial Sequence
  Description of Artificial Sequence: Synthetic coding sequence
atgaagcacatcaacctgagcttcgccgcctgcggcttcctgggcatttaccacctaggggctgccagcgccctgtgcaggcacggcaaaaaactggtcaaggacgttaaggcatttgccggggcctccgcaggcagcctggtggcaagcgtgctgttaacagcccctgaaaaaatcgaggagtgtaaccaattcacctataagtttgctgaagagatccgtagacaatcctttggggccgtaacccccggttatgatttcatggcgaggttgcgcagtggcatggagtccattttgcccccttcagcccacgagttagcccagaacaggttgcacgtgtcaatcacgaacgccaagacaagagagaatcatttggtatctaccttttcttccagggaggacctgataaaagtgctgttagcctcttcgttcgtgcccatctatgcaggccttaaactagtggaatacaaaggccagaagtgggtcgacgggggcctaacaaatgctttaccaatactgccagtgggcagaaccgtcactatctctccattcagtggcaggctggacatctag

SEQ ID NO: 49368 - DNA, 762 bp, Artificial Sequence
  Description of Artificial Sequence: Synthetic coding sequence
atgaagcacatcaacctgagcttcgccgcctgcggcttcctgggcatttatcatctgggcgctgcctcagcactttgtagacacggcaagaagctagttaaagatgtgaaagcattcgccggggcgtccgctggcagcttagtggcatcagtcttacttacagcaccagaaaagatcgaggaatgcaatcaattcacctataagtttgctgaagagattcggcggcaatctttcggagcggtgaccccgggctacgattttatggctcgcctacgttcaggaatggaaagcatccttccgccctcggctcacgagctggcccagaatagacttcatgtctcaataactaatgccaaaacccgcgagaaccacctcgtcagcacctttagttcacgtgaagacctgattaaggtgctgttagctagtagctttgtccccatctatgctggcctcaagctcgtggagtataaaggtcagaaatgggttgatggaggacttaccaacgcactgccaattctaccagtcggccgcacagtcacaatatcccccttttctggccgcctggacatatctccacaggacaaggggcagctggacctgtatgttaacatcgccaagcaggatataatgttgtcactagcgaaccttgttcgcttgaatcaagctctgttccctcctagcaaaagaaagatggagtccttgtaccagtgtggattcgatgatacagtgaaatttctgctaaaagagaattggttcgaatag

SEQ ID NO: 49369 - DNA, 501 bp, Artificial Sequence
  Description of Artificial Sequence: Synthetic coding sequence
atggcccggctgcggagcggcatggagagcatcctgccccccagcgcccatgagctcgcgcagaatcgcctgcacgtttcaatcacgaatgcaaagacaagagagaatcacctggtgagcactttttcctctcgcgaagacctaatcaaggtgttgttggctagttccttcgtccctatttatgcaggcttgaaattggtggagtacaaaggtcagaagtgggtggacggcggcctcactaacgctctgcccatcctcccggtcggccggaccgtgactatctctccattctccgggcggctcgatattagtccccaggacaaaggccagttggatttgtacgtgaatattgctaagcaagacattatgctgtccctggcaaatctggtgcggttgaaccaggccctgttcccccccagtaaacgcaaaatggagtctctgtatcagtgcggtttcgatgacacagtcaagttcctgctcaaggagaactggttcgagtag

SEQ ID NO: 49370 - DNA, 969 bp, Artificial Sequence
  Description of Artificial Sequence: Synthetic coding sequence
atggagggcatcagcaacttcaagacccccagcaagctgagcgagaagaagaaatccgttctgtgctcaacacccaccataaacattcctgcctccccttttatgcagaagcttggcttcggaaccggggtaaacgtttacctgatgaagcgttcccctagaggactatcccacagcccgtgggccgtcaagaagatcaacccaatttgcaatgatcactacaggagcgtctatcagaaacgactgatggatgaggccaaaatactcaagtcactgcaccacccaaacatagtcggctacagggccttcactgaagccaacgacggatctctgtgtctggccatggagtatgggggcgagaagagcttgaatgatcttatcgaagagaggtataaggctagccaagaccccttcccagccgccatcatcctgaaagttgctcttaacatggcccgcggcctgaagtacttacatcaggaaaaaaagctcctgcacggggacataaagagttctaatgtcgtgatcaagggtgactttgagacgataaagatctgcgacgtcggcgtcagcctgccgctggatgaaaatatgactgtgacagatccagaggcgtgctacatagggaccgagccgtggaaacccaaagaggccgttgaagagaatggcgtcatcacagataaggccgatatatttgcattcggcctgacactgtgggagatgatgacactttcaatcccccacatcaacctgtccaacgatgacgacgatgaagataagacttttgacgagtcagactttgatgacgaagcatactacgctgctctcggcaccagaccccccatcaatatggaagagctcgacgagagctatcagaaggtgatcgagcttttctccgtctgcacgaacgaagatccaaaagaccgaccttcagcagcacacatcgtagaagctcttgaaacagacgtgtag

SEQ ID NO: 49371 - DNA, 1560 bp, Artificial Sequence
  Description of Artificial Sequence: Synthetic coding sequence
atgaccagcaccttcaacccccgggagtgcaagctgagcaagcaggaaggtcagaattatggtttcttcctgcgcattgaaaaggatactgagggacatcttgtccgcgtcgtggagaagtgttcccctgccgaaaaagccggtcttcaagatggagatcgtgtcctgcggatcaatggagtctttgttgacaaagaagagcatatgcaggtagtggacttagtgagaaagtcgggaaatagcgtaactctcctcgttctggatggcgattcatacgagaaggccgtgaagacccgtgtagacttgaaagagctgggacaatcccagaaagaacaaggcctatccgacaatattctcagtcctgtcatgaacggcggtgtgcagacctggactcagcccaggctttgctaccttgttaaggaaggcggcagttatggattcagtctgaagactgtgcagggaaagaaaggggtctacatgactgatatcacacctcaaggagtcgctatgcgtgcaggggtgctcgccgacgaccatctgatcgaggtcaacggagagaacgtggaagatgcaagtcatgaggaagttgtcgagaaggtgaagaagagcggatctagagtgatgtttcttcttgtggataaggagacagataaacggcacgttgaacagaaaatccagtttaagagggagaccgcgtcgctgaagctgctgccacaccagcccaggatagttgaaatgaagaaaggcagtaatggttacggtttctacttgcgggcgggctcggaacagaagggtcaaataatcaaggacatagatagcggaagcccagccgaggaggcgggactgaagaacaacgacctagtggtcgcagtgaacggggagagcgtggagacattagaccacgacagcgtggtggagatgatccggaagggaggagaccagacgagcctcctggtggtcgataaagaaactgataatatgtaccgcctagcccatttcagtccattcctgtactatcagagccaggaactccccaatggcagcgtgaaggaggcgccagcccctaccccaacctcacttgaggtctccagtcccccagacaccactgaggaagtcgatcataagcctaagttatgtaggctagctaagggagagaatggctatggctttcaccttaatgctattagaggactcccgggctctttcatcaaagaggtgcaaaaaggcgggccggcagatctggcaggcctggaagacgaggacgtcataatcgaggtcaacggtgtgaatgtgttagacgaaccctatgagaaagtggtggatcgaatacagtcatccggcaagaatgtcaccctcctggtttgtggcaaaaaggcatatgattattttcaggcgaaaaaaatcccaatagtctcttccttggctgacccacttgacacccctcctgattctaaagaaggtattgtggtggagagcaatcacgacagccatatggcaaaggaaagggcacacagcacagctagccacagttcaagcaattctgaagataccgaaatgtag

SEQ ID NO: 49372 - DNA, 1560 bp, Artificial Sequence
  Description of Artificial Sequence: Synthetic coding sequence
atgaccagcaccttcaacccccgggagtgcaagctgagcaagcaggaaggacagaactacgggtttttcttacgcatcgaaaaggacaccgagggccacctcgtgagagtggttgagaaatgctcacctgccgagaaagcagggctgcaggatggcgaccgagtgctccggatcaacggggtcttcgtggataaggaagagcacatgcaggttgtcgacctggtacgcaagtcaggaaactcggtgacactgttggtcctcgacggcgactcttatgagaaggcggtgaaaaccagagtggatctgaaggaactcgggcaatcccagaaagagcagggcctgagtgataatatcttgtccccagtaatgaacgggggtgtccagacttggacacagccccgattgtgttatctggtgaaagaaggcgggagctatgggttcagcttgaagacagtccagggaaagaagggggtgtacatgacagacataactcctcaaggtgttgccatgcgtgccggtgtgcttgcagatgaccacctgatcgaggttaacggcgaaaatgtggaagacgcgagccacgaggaagtggtagagaaagtcaagaaatcagggtcaagagtgatgttcctcctcgtagacaaagaaactgataagaggcacgtagagcagaaaatccagtttaaaagagaaacagcctctctgaagctgcttcctcatcagccccggatcgtggagatgaagaagggcagtaatggatatggtttttacttgagagctggatctgagcagaaaggccagattattaaggatatcgatagtggttcccctgccgaggaggctggactgaaaaacaatgatttggtagtggccgtgaacggggagagcgttgaaacgctggaccacgattcagtggtggagatgatcagaaaagggggcgaccagacatctctgctcgtcgtggataaggaaactgacaatatgtaccgcttagctcacttcagcccctttctttactaccaatcccaggagctgccaaatggctctgtgaaggaagcgcctgcacccacccccacctccctagaagtgagttcaccacccgatacaactgaagaggtggaccataagcccaaactgtgtcggctagcaaaaggcgagaacggatatggcttccatctgaacgcgataagagggttgccaggcagtttcatcaaggaagtccagaagggtggaccagcggaccttgccggccttgaagatgaagatgtaatcatagaggtgaacggcgttaacgtgctcgatgaaccttatgaaaaggttgtagatcggatacaaagcagtggcaaaaacgtcacgttgctggtctgtggaaaaaaagcctatgactatttccaggcaaaaaagattcctattgtaagcagtctagccgaccctcttgacactccccctgatagcaaagagggaatagtagtggagagtaatcatgattcccacatggccaaggagcgtgctcactcaacggcaagtcactcttcaagtaacagtgaggatacagagatgtag

SEQ ID NO: 49373 - DNA, 609 bp, Artificial Sequence
  Description of Artificial Sequence: Synthetic coding sequence
atggccgagggcgaggaggagggcggcgacgtgctgatcagcgtggggcacgctaatgtgctcggatatactctgcgggaatttctgcaactgttgcagcatatcacaatcggcaccgttctgcagataaaagtgtacagggactttatcaacatacccgaagaatggcaagagatatatgatctaatcccagaagccaagtttcctgttaccagtactccaaaaaagattgaattggctaaggacgagtcattcacgagtagcgatgacaatgagaatgtcgaccttgacaagcgtctgcagtactacaggtacccctggagtacagttcaccatcctgcccgacgacctatatctatctcccgcgattggcacgggtacaaaaaaaaaaaccataccattagcgtaggcaaggacatcaactgtgacgtgatgattcatcgagatgacaagaaggaggtgcgggccccaagtccatactggattatggtgaagcaggataatgaatcttcatcttcaagtacttcatctacgtccgatgccttctggctggaagactgcgcccaggtggaggagggtaaagcccagctggtgtcaaaagtgggatag

SEQ ID NO: 49374 - DNA, 795 bp, Artificial Sequence
  Description of Artificial Sequence: Synthetic coding sequence
atgcagaaggccagccacaagaacaagaaggagcggggcgtgagcaacaaagtgaaaacaagtgtccataacctgtcgaagacccagcaaactaaactaacggtaggtagcctcgggcttggcctgatcatcatccaacacggcccttacctgcagattacccacctgatccggaaaggtgctgcggccaacgacggcaagttacaaccaggggatgtactcatatcagttgggcatgcaaacgtgcttggttacaccctccgggagttcctccaattactgcagcatataaccatcggaactgtactccaaatcaaagtctacagggactttatcaacattcctgaggaatggcaggaaatctacgatttgatccctgaagccaagtttccggtcacaagtacccccaaaaaaattgagctggctaaagatgaatcattcacgagctcagatgataacgagaacgtggaccttgacaagcggcttcaatattatcggtacccatggtcaactgtacaccatcctgcacggcgcccaattagtatttcgagagattggcacggctataagaagaaaaatcacactatcagcgtaggaaaagacattaactgcgacgttatgattcacagggacgacaagaaggaggttcgggctccctccccctactggatcatggttaagcaggacaacgagtccagcagtagctcgacaagcagtacctctgatgcgttttggctggaagactgcgcccaggtggaagaaggcaaagcacagctggtgtccaaggtgggatag

SEQ ID NO: 49375 - DNA, 615 bp, Artificial Sequence
  Description of Artificial Sequence: Synthetic coding sequence
atgcagaaggccagccacaagaacaagaagggcgacgtgctgatctcagtggggcatgctaatgtactgggatataccctgcgagagttcctccaactgctccagcatattaccatcggcaccgtgcttcaaataaaggtctatagggacttcatcaacatccccgaggaatggcaggagatctacgatctaatccccgaagctaagtttcctgtgacctcaactccaaaaaagatcgagttagctaaagatgaatctttcacatcctccgacgacaacgaaaatgtcgacttggacaaaagactccagtactaccgatatccttggagtacggtgcaccatcctgcccggaggcctatctcaatttctagagactggcacggctacaagaaaaaaaaccacactatttcagtgggcaaggacattaattgcgatgtcatgattcaccgtgatgacaaaaaagaggtacgcgctccgtccccttactggatcatggtgaagcaggacaacgagagcagttcttcatcaacctcctctacctcagacgccttctggctggaagattgtgctcaggtggaggagggcaaggcacagctagtctctaaagtgggctag

SEQ ID NO: 49376 - DNA, 2103 bp, Artificial Sequence
  Description of Artificial Sequence: Synthetic coding sequence
atggacttcgtgcggctggcccggctgttcgcccgggcccggcccatgggcctgttcatcctccagcacctagatccttgccgagcaaggtgggccgggggacgagaggggctgatgcgcccgatgtgggcccctttttcatcctcatccagccaactgcctcttggccaggagcgccaagaaaacacgggatcgctcggatcggacccttctcatagcaatagtaccgccacccaggaagaagacgaggaagaagaagagtctttcggcacactgagtgacaagtattcttccaggcggttgttcaggaagtccgccgctcagttccacaatttgagatttggagagcgtagagatgagcagatggagcctgagccaaaactgtggaggggcagacgaaataccccatactggtacttcttgcagtgcaaacatttgattaaggagggtaagttagtggaggcactagatctgttcgagcgacagatgcttaaggaggagagactgcagcccatggagtctaattatacagtgttgatcggtggatgcggcagggtagggtacttgaagaaggctttcaatctgtataaccagatgaagaagcgcgatctggaacccagcgatgctacatacacagcactgttcaatgtttgtgcggaaagcccttggaaagatagcgcactccagagtgccctcaaattacggcagcaactgcaggctaagaacttcgagttaaacctcaaaacgtaccacgctctcctcaagatggctgctaagtgtgctgacctccgcatgtgcttggacgtcttcaaggagattatccacaaagggcacgtggtcactgaggaaacttttagctttctactgatgggctgcatccaggacaagaagacaggatttcgatatgccctgcaggtgtggcggctgatgctgtccctaggactccagccatcccgcgactcatacaatcttctactcgtggccgcccgagactgcgggcttggagacccccaagttgccagtgaactcctccttaagccgagggaggaggctaccgtcttgcagccccctgtgtctagacagcgccctcggcgcacggcccaggcgaaggcaggaaacttaatgtctgccatgctgcacgtggaggccctagaaaggcaattgtttttagagcctagccaggccctcggacctccggagccgcccgaagcccgggtccccggcaaggcccaacccgaggtggacacaaaggccgagccaagccacactgccgccttgacagctgtggctctcaagcctcctccggtggagctcgaggtgaatctcctaacccccggagccgtgccacctactgtcgtcagttttggcacagtgaccacacctgctgatcggttagctctaatcggcggactcgagggctttctatcaaagatggccgagcatcggcagcagccggacattcgcacactgactctgctggccgaggtggtcgaaagcggaagtcccgccgaaagccttttgctcgcactcctggatgaacaccaggtcgaggcggacctgacttttttcaatactctagttcgcaagaagtccaaactaggggacctggaaggagctaaagcacttctacccgtcctggcaaagagaggactcgtgcctaacttgcagaccttctgtaatcttgcgataggatgccacaggcccaaggatgggttacaactcctcacagatatgaagaaaagccaagtgaccccaaatacacacatttacagcgcattaatcaacgcagcgattagaaaattgaattacacgtatctgatctctattctgaaagatatgaagcagaacagggtccccgtcaatgaggtggtcatacgacaacttgagttcgctgcacagtacccccctacctttgaccgatatcaaggcaaaaatacatatctggagaaaattgatggcttccgagcttactataagcagtggcttacagtcatgcccgccgaagagactccgcatccctggcaaaagtttcgaactaaaccacagggtgaccaggatactgggaaagaagccgacgacggatgtgcactgggcggccgctag

SEQ ID NO: 49377 - DNA, 321 bp, Artificial Sequence
  Description of Artificial Sequence: Synthetic coding sequence
atggacttcgtgcggctggcccggctgttcgcccgggcccggcccatgggtttattcatattgcagcaccttgacccatgccgcgcacgatgggccggtgggcgcgagggacttatgcgccctatgtgggcacctttctcctcttcaagtagccaattacctctcggtcaggagaggcaggaaaacacagggagcctgggctctgatccttctcactccaactccaccgccactcaagaggaagatgaagaagaggaggaaagttttggtaccctatccgataagtatagctcaaggcgtttatttcgtaagagtgcttag

SEQ ID NO: 49378 - DNA, 435 bp, Artificial Sequence
  Description of Artificial Sequence: Synthetic coding sequence
atggacttcgtgcggctggcccggctgttcgcccgggcccggcccatggggttgtttatcctgcaacacctcgatccttgtcgcgcaaggtgggctggcggtagggagggattgatgcggcctatgtgggcaccattctccagcagttcttcccaactgcctttgggacaggaacgacaagagaacacaggtagtttgggcagcgatccttcccactctaactctaccgccacacaggaggaagacgaggaagaggaggagtccttcggaaccctgtcagataaatactccagccggcggctcttccgcaaatctgcagctcagtttcacaatttgagattcggagagcgccgcgacgaacagatggagccagagccgaagttatggcggggccgacggaataccccatactggtattttttgcaatgcaaatag

SEQ ID NO: 49379 - DNA, 495 bp, Artificial Sequence
  Description of Artificial Sequence: Synthetic coding sequence
atggacttcgtgcggctggcccggctgttcgcccgggcccggcccatggggctgttcattttgcagcacctggatccatgtcgcgctaggtgggccggagggcgagaaggcctcatgaggccgatgtgggcaccattctcatccagctccagccaactgcctctcggacaggagcgccaagaaaacaccggatcactggggagtgatcctagccattcaaatagtaccgcaacacaggaagaagatgaggaagaggaggaatctttcgggaccctgtctgacaaatacagtagtcggcgcctgttccgcaagagcgccgcacaatttcacaacctgcggttcggagagcggcgcgacgaacagatggagcctgagccaaagctgtggcgaggtaggcgtaatacgccatactggtactttttacagtgcaagcatctgatcaaggaggggaagctcgtcgaggctttggatctgtttgagcgccagatgttatag

SEQ ID NO: 49380 - DNA, 213 bp, Artificial Sequence
  Description of Artificial Sequence: Synthetic coding sequence
atggacttcgtgcggctggcccggctgttcgcccgggcccggcccatggggctttttatcctccagcaccttgatccttgcagagcacgctgggccggcggccgcgaggggctgatgaggccaatgtgggcccccttcagcagtagctcatcacagttgccattaggtcaggagcggcaggaaaacaccggatctttaggctctgatccatag

SEQ ID NO: 49381 - DNA, 1449 bp, Artificial Sequence
  Description of Artificial Sequence: Synthetic coding sequence
cggaagcggctggtgcggcggggcgaccgggccggcctgcccgtgggcgtccaccagttgcaggcaaagaactttgaactgaatctgaagacttaccacgctctgctcaaaatggccgctaaatgtgcagatttgcgcatgtgtttagatgtctttaaggagatcatacacaagggccacgtcgtcacagaggagacattctcttttcttttgatgggctgcatacaggacaaaaaaacgggtttccgctacgccctgcaagtctggcgactgatgctcagtctaggtcttcagccttccagggattcctataaccttctgctggtggctgccagagactgtggcttgggggatccccaggtggccagtgagcttttactcaaaccgcgtgaagaagctaccgtgctccagccgcccgtttcccggcagagaccacggaggaccgcccaggcaaaagctggtaatctgatgagcgccatgcttcacgtggaagcactcgaaagacagctgtttcttgagccatcccaggctctcggacccccagagcctccggaagcgcgggtcccggggaaggcacagccagaggttgatacaaaggccgaacccagccacacagctgccctgactgccgtggcactgaaacccccaccagtcgaactggaagtgaacttgctcactcccggcgcggtaccccccaccgtcgtgtcatttggcactgtaactaccccagctgatagactggccctgataggcggcttagaaggctttctcagcaagatggccgagcatagacagcagcccgatataagaaccctaactctcttagcagaagttgtggagtcaggctcccctgccgaatccttgcttctcgcactgctcgatgagcatcaagtggaagcagacctgacattcttcaacacacttgtcaggaagaagtccaaattgggcgatctcgagggcgcaaaggccctgctgccagtcctcgccaaacgtgggcttgtgcccaaccttcagactttttgtaacctcgctatcggatgtcacaggcctaaggacgggctccagctgttaacagacatgaagaagtctcaggtaacaccaaacacccatatctacagcgccctcattaatgctgccatcaggaagctaaattacacctatctcataagcatcctgaaggatatgaagcaaaacagggttcctgtgaacgaggtggttattcgtcaactggaatttgccgctcaataccccccaacatttgaccgctaccaaggtaaaaacacatacttggagaaaatcgacggattcagggcctactacaagcagtggctcaccgtgatgcctgccgaagagacaccacacccttggcagaagtttagaacaaagcctcagggagaccaagacacgggcaaagaggctgacgatggctgcgcattgggcggccggtag

SEQ ID NO: 49382 - DNA, 2250 bp, Artificial Sequence
  Description of Artificial Sequence: Synthetic coding sequence
atggccagcgtggtgcccgtgaaggacaagaagctgctggaggtgaaactaggcgagttgccctcttggatcctgatgagggacttctctccttctggcattttcggcgcatttcaaaggggtcccgggggtacgggcaagccagagatggattttgtgaggctcgctcgactgtttgcgagagctcgacccatggggctgtttatactccaacacttggatccatgcagagctcgctgggctgggggccgcgagggactcatgcgcccgatgtgggcccctttctctagctctagctcgcaattgccactgggccaagaacgtcaagagaataccggatccttgggctcagatccttcacatagcaattcaaccgccacccaggaagaggatgaggaagaagaggagagctttggcacactctctgataaatactccagccggcggttattccgaaaatcggcagcgcaatttcataatttgcggttcggcgagcgtcgcgacgagcagatggagcctgaaccaaaactgtggcgcggccggaggaacaccccctactggtactttttgcaatgcaagcatctcattaaggagggcaagttagttgaggccctggacttgttcgaacgacagatgctgaaggaagaacgcttgcagcctatggagtccaattacaccgtgctgattggtgggtgtggcagggtcggctacctgaagaaagcttttaatctgtacaaccagatgaagaagcgtgatctggagccttctgatgccacttataccgcactgttcaatgtctgcgccgagtctccctggaaggattccgctctccagtctgcgctcaagttgagacagcaactgcaggcaaagaatttcgagcttaatctgaaaacgtatcacgcactactcaaaatggctgctaagtgcgcggatctgagaatgtgcctggacgtcttcaaagaaatcatccacaagggacacgtcgtgaccgaggagacattctcgttccttcttatgggctgtatccaagacaagaagaccggcttcaggtacgcccttcaggtctggcgcctgatgctaagtctggggctgcaacctagccgagactcttacaatctgctactcgtcgctgcacgggactgcggattaggcgatccacaagtcgcttctgaactactcctgaaacctagagaagaggcaacagttttacagccccctgtcagccgccagagaccacggaggacagctcaggctaaggctggcaacctaatgtctgcgatgctacacgtggaagcactggaaagacagttgtttctggagccctcccaggccctcgggcctccagagccacctgaggccagagtgccaggaaaggcccagcctgaggtagacacaaaagccgaaccgtcccatactgcagcgttaactgccgtggctttaaagcccccccccgtggagcttgaggtcaaccttctgacacctggggcagttccgcctaccgttgtctcgtttgggacggtgacaactcctgccgacaggttagcactcatcgggggactggaaggtttcctttcaaagatggcagagcaccgacaacagcccgacattaggaccttgacacttctggccgaggttgtagagtcaggaagtccagctgaaagtctgctgctggctcttttggatgagcatcaggttgaagccgacttaacattttttaatacactcgtacgcaagaagtctaagctgggggatcttgagggagcgaaggcgctcctcccggttttggccaagagggggctggtgccgaacctgcaaaccttctgcaatcttgcaattggatgccaccggcctaaggatggcttgcagctgctgaccgatatgaagaagtcccaggtcactcccaatacccacatctactcggctctcattaacgctgcaattcgtaaactgaattatacgtacctgatttccatactcaaggatatgaaacagaacagagttcctgtgaatgaagtcgtgataagacaactggagtttgcagctcaataccccccgactttcgatagatatcaagggaaaaatacctacttagaaaaaattgacggcttcagggcatactacaaacagtggctgaccgtcatgccagcagaagaaacgccacacccttggcagaagtttaggacaaagccccagggcgaccaggatacaggaaaggaggctgatgacggatgcgccctagggggtaggtag

SEQ ID NO: 49383 - DNA, 1311 bp, Artificial Sequence
  Description of Artificial Sequence: Synthetic coding sequence
atgcggcccggcggcgagcggcccgtggagggcggcgcctgcaacggtcgatcagagctggagttgctcaagcttagaagcgccgaatgcattgatgaggcggctgaacgcctgggggctctttccagagcaatttggagccagcccgagctggcttacgaggagcatcatgcccacagagttctcacacatttttttgagagagagcctcctgccgcctcctgggctgtgcagcctcattatcagctgcctaccgccttcagagccgaatgggaacctccagaggcaagggccccttctgccacccccagacccctgcatctgggatttctctgtgagtatgacgcactccctggaataggccatgcttgtggtcacaaccttatagcggaagtaggagctgccgccgcactcggcgtgcggggggcccttgagggtctcccccggccccccccacctgttaaggtagtagtgctcggaactcccgccgaggaggacgggggagggaaaatcgatctgattgaagcaggcgcgttcactaacctggatgtcgtgttcatggctcacccaagccaagagaacgcggcctacctcccggatatggcagagcatgatgttacggtgaaatactacggtaaggcttcacacagcgctagttatccctgggagggacttaatgccttagatgccgcggttctggcatataacaatctgtccgtctttcgccagcagatgaaaccgacatggagagtgcacggtattatcaagaatggcggcgtcaaacctaacattatcccaagttatagtgagctgatatactattttcgggcccctagcatgaaagaactacaggttctaacaaagaaggcggaggactgctttagggcagccgcgctggcgagtggttgtacagtagagataaagggcggggcccacgactactataacgtgcttccaaataagtctctctggaaggcttacatggaaaatggcagaaagctaggaatcgagtttatttccgaggacaccatgctaaatggccccagcggaagcactgatttcggcaacgtaagctttgtggtgcccggcattcacccgtatttccacattggaagtaacgctcttaatcacaccgagcaatacactgaggcagccgggtcacaggaggcccagttttacacgctgcggacggcaaaggcactagcaatgactgcgctagatgttatcttcaagcctgaactgttggaagggattagggaagatttcaagctgaaactgcaggaggagcagtttgttaacgcagtggaatag

SEQ ID NO: 49384 - DNA, 840 bp, Artificial Sequence
  Description of Artificial Sequence: Synthetic coding sequence
atggcccggccccagccctgcggccccccccacgcccggtgcggctctcctagcctccccgaaaggcccctgcaagttaaggtggtgggactgtttagctgtcctaacttccagattgctaagtcagcagccgaagaactgaaaaacgagacatgggagtattccagctcggtaatctcgtttgttaacggccagttcctgggagacgctttagaccttcaaaaatgggcccatgaggtctgggacatcgtggacattaaacccagtgcgctttatgacgcgttgaccgaggattttagtgccaagtttctccgcgacaccaaacacgacttcgtgtttttagacatctgtatcgacagctcccctatcggccgtctcatattcgagctttattgcgatgtgtgcccaaagacatgcaagaactttcaggtgttgtgcacaggcaaggccggcttctcacagaggggcatccggttacactataagaactcgatctttcaccgcatcgtgcaaaacgggtggatccagggaggtgatatcgtttacggcaaaggagacaacggggagtctatctatgggcctacattcgaagatgagaatttcagcgtcccgcacaacaaaagaggcgttctgggtatggccaataaggggcgacactcaaatgggtctcagttctacataaccctgcaggccacgccctatctcgataggaaatttgttgctttcgggcagctgattgagggaacagaagttttgaaacagttggaactagtccctacccaaaacgagcgccctatccatatgtgcaggattaccgacagtggtgatccttatgcttag

SEQ ID NO: 49385 - DNA, 936 bp, Artificial Sequence
  Description of Artificial Sequence: Synthetic coding sequence
atggcccggccccagccctgcggccccccccacgcccggtgcggctcgccaagcctgcccgagcggccccttcaggttaaagtggtggggctgttctcttgcccaaatttccagattgctaaaagcgctgcagaaaacctgaaaaataaccacccgagcaagttcgaggacccgattctggtccctcttcaagaatttgcatggcatcaatatcttcaggagaaaaagagagagcttaaaaacgaaacctgggaatattccagctccgtcatcagctttgtgaatggccaattcctgggcgatgccctagacttgcaaaagtgggctcacgaggtgtgggatattgtggacattaaaccatctgcattgtacgatgccctgacagaagacttttctgctaagttccttcgagacacaaagcacgatttcgttttcttggatatttgcatagacagctctccaatcggaaggctcattttcgagctatactgcgacgtgtgccctaaaacatgcaaaaattttcaggtgttgtgcacaggaaaagcaggtttctcacagaggggaatcagactccactataaaaacagcattttccatcgaattgtgcagaacggatggatccagggaggcgacattgtgtacggcaaaggcgataacggagaaagcatctatggacccaccttcgaagatgaaaacttcagcgttccccataataagaggggtgttttggggatggctaataaaggtcgacattctaacgggtcccagttctatatcacccttcaggcaacgccctatctggaccggaagtttgtggcctttgggcagttgattgaaggcaccgaagtactgaagcaacttgaactcgttcctacccaaaacgagaggcctatccacatgtgtcgaattaccgattccggggatccatacgcttag

SEQ ID NO: 49386 - DNA, 1014 bp, Artificial Sequence
  Description of Artificial Sequence: Synthetic coding sequence
atggcccggccccagccctgcggccccccccacgcccggtgcggcagccctagtctgcccgaacgccctttacaggtgaaggtggtcggattgttcagttgtccgaactttcagatagcaaagtccgccgcagagaacctaaagaacaaccatccctccaagtttgaggaccccatactggtccccctgcaagagtttgcgtggcaccagtacctccaggaaaaaaagagggaactgaagaatgagacttgggaatattcgagctctgtcatctctttcgtgaacggccagtttctcggagatgcactagacctgcagaagtgggcacacgaggtgtgggacatcgtagatattaagcccagcgccctctacgatgcattaaccgaggatttcagcgccaaatttctcagggataccaagcacgattttgtcttcctcgatatctgtatcgatagctccccaatcgggaggctgatttttgaactgtattgtgacgtctgtcccaagacctgcaagaatttccaggttctatgtacgggcaaggccggattttctcaacgaggcatcagattacattacaagaattccatcttccatcgcatcgtgcagaacggatggatccagggaggtgatatcgtgtatgggaaaggggacaacggggaaagcatctatggtcccactttcgaggagttgtacggaagcttgaaacgttcagttaaaagacaaaaagagagccggggcgtcgggaagatcgagaaatatcgcgatgagaacttcagcgtgccccataataagagaggagtgctggggatggccaacaaggggaggcattctaacggtagccagttctacataactctgcaggccacaccctatctggataggaaattcgtcgcatttggtcaactgattgagggtaccgaggtgctaaagcagttggagctagtgcctacccagaatgagcggcccatccacatgtgccgaatcacagattccggtgatccctatgcctag

SEQ ID NO: 49387 - DNA, 495 bp, Artificial Sequence
  Description of Artificial Sequence: Synthetic coding sequence
atggtgaacagcgtggtgttcttcgagatcacccgggacggcaagccccttggccgcatttctatcaagttattcgccgacaagattcctaaaactgccgagaatttcagagctttgagcactggagagaaaggttttcggtacaaaggatcctgctttcacagaattatccctggttttatgtgccaagggggcgattttacccgacctaacggcaccggtgacaaatccatctatggggagaagtttgatgatgaaaacttgattcgcaagcacactggcagcgggatcctgtcaatggcaaacgccgggcctaatacgaacggtagccagttttttatatgtgcagctaagactgagtggttagacggaaagcacgtcgcattcggaaaggttaaggagcgcgtgaacatcgtagaagccacagaacacttcggatacaggaactctaagacatcaaagaaaatcaccatcgccgactgtgggcaattttag

SEQ ID NO: 49388 - DNA, 495 bp, Artificial Sequence
  Description of Artificial Sequence: Synthetic coding sequence
atggtgaacagcgtggtgttcttcgagatcacccgggacggcaagcctcttggccggatttccatcaagctattcgccgataagatccccaagacagcagagaattttagggctctgtccacaggggaaaagggcttccgctacaagggaagttgctttcaccgaattattcccggatttatgtgtcaagggggtgatttcacccgtcccaatggtaccggtgataaatccatctacggtgaaaagttcgatgatgagaatctcatcaggaaacataccgggtccggaatccttagcatggccaatgccggacctaataccaacggttcccagtttttcatatgtgccgcaaagacagagtggctggacggcaaacacgtggcattcggaaaggttaaggagcgggtgaacattgtggaggccactgagcactttggctataggaattctaagacaagcaaaaagatcacaattgctgactgcggacagttctag

SEQ ID NO: 49389 - DNA, 423 bp, Artificial Sequence
  Description of Artificial Sequence: Synthetic coding sequence
atgcaccggggcgtgggccccgccttccgggtggtgcggaagatggccgcatcaggcgccgaaccacaggtgctggtgcagtatctggtcttacgaaaggacctctcccaagccccgttttcatggcccgccggagcactggtggctcaggcctgccacgccgctacagcagcactacatacgcacagggaccacccgcatactgccgcctacctccaggagctcgggcgcatgcggaaggtggtgcttgaggctccagacgagaccacactaaaggagttagcagaaactctgcaacagaagaatattgatcatatgctttggttggagcagcctgagaacatcgcaacttgcatcgccctcaggccctatcctaaggaagaagtcgggcagtatctgaagaaatttcggctttttaagtag

SEQ ID NO: 49390 - DNA, 393 bp, Artificial Sequence
  Description of Artificial Sequence: Synthetic coding sequence
atggccgacggcaaggccggcgacgagaagcccgagaagagccagagagctggtgcggctgggggtccagaggaggaagcggagaagcctgtgaagactaagacagtgtcctcgagcaatgggggggaatcatccagccggtccgccgaaaaaagatcggctgaggaggaggcggctgacctgccaactaaacctactaagatctcgaaatttggattcgccattggaagtcagaccaccaaaaaagcatcagccatttctattaagctcggttcctccaagccaaaagaaaccgtccccactctggcgccgaaaaccctttccgtagccgccgcatttaatgaggatgaggacggctataccaatatctcctggaccaagctcctccagtag

SEQ ID NO: 49391 - DNA, 222 bp, Artificial Sequence
  Description of Artificial Sequence: Synthetic coding sequence
atgggcgtgaagctggagatcttccggatgatcatctacctgaccttcccagtggccatgttttgggtttccaaccaggcagagtggtttgaggacgacgttatacagagaaaacgggagctatggccaccagagaagctacaggaaatcgaggagtttaaagagagattgcgtaaacgtagggaggaaaagctgctacgcgacgctcagcagaacagttag

SEQ ID NO: 49392 - DNA, 2667 bp, Artificial Sequence
  Description of Artificial Sequence: Synthetic coding sequence
atggaccggagcagcaagcggcggcaggtgaagcccctggccgcctctctgctggaagccttagactacgatagctcagacgacagcgattttaaagtcggagacgccagcgatagcgagggatcaggaaacggcagtgaagatgcaagcaaggactctggggaaggctcttgttccgatagcgaggaaaacatactagaagaagagctgaacgaggacataaaagtgaaagaagagcagctgaaaaactccgccgaggaggaagtgctaagctctgaaaagcagctgatcaaaatggaaaagaaagaagaggaggagaacggcgaacggccaaggaagaagaaggaaaaggaaaaagagaaggagaaggaaaaagaaaaagagaaggagagagagaaggagaaagagaaggccaccgtgtcagaaaacgtagccgccagcgcggctgctacaacgcctgccacatctcctcccgctgtgaatacatcaccctcggtccctactactaccaccgctaccgaagaacaggtctcggaaccaaaaaagtggaatctgagacgcaatcgacctctgctggactttgtgtctatggaggaactgaatgatatggatgattacgattcagaagacgataatgactggcggccaacagtggtcaagcgcaaaggcaggtctgccagtcaaaaggaagggtcagatggagacaatgaggatgatgaggacgagggctccggcagtgacgaagacgaaaacgatgagggtaatgatgaggaccactcaagcccagcttctgagggcgggtgtaagaagaaaaagtctaaagtgctttctaggaactcagccgatgatgaagaattaacaaatgatagcctcaccctcagccagagtaagtctaacgaggactctctgatcctggaaaaatcacagaattggtcctcccagaagatggaccacatcttgatctgctgtgtgtgcctcggcgacaactctgaggatgccgacgagatcatccaatgcgacaattgtggcatcacagtccacgaggggtgctacggagttgatggggagtctgactccatcatgagtagtgcctcagaaaatagtacggaaccatggttctgcgacgcttgtaaatgtggcgtatccccttcctgcgaactgtgcccaaatcaagacggaatttttaaggagaccgacgccgggcgctgggtccatatcgtttgcgccctgtatgtccccggagtggctttcggcgacattgacaaattacggccggtaacactaaccgaaatgaattattccaagtacggcgctaaagagtgtagcttttgcgaggacccacggttcgccaggacaggagtatgtatcagctgcgatgccggaatgtgtcgggcgtacttccatgtgacctgcgcccagaaagaaggtctactgagtgaagctgccgccgaagaagacatcgccgatcccttctttgcgtactgtaagcagcacgccgaccgactcgaccggaagtggaagcgaaaaaactacttagcattacagtcatactgtaaaatgtccctgcaggagagggagaagcagctgagccctgaagcccaagctagaatcaatgcacggttacagcaataccgagcgaaggctgagttggcaagaagtaccagaccccaggcttgggtcccccgcgaaaagttaccgcggcccctaacctcatctgcatctgccatccgtaagctgatgagaaaagccgaacttatgggcataagtacggacatcttccctgtggacaatagcgacacatcatccagcgtggacggtaggcgcaagcacaagcagcccgccctgactgccgactttgtgaactactacttcgaacggaatatgcgaatgattcaaatccaagaaaatatggccgaacagaaaaatattaaggacaagctagaaaacgagcaggaaaagctgcatgtggaatataacaagctgtgcgagagcctcgaagagctgcagaacctcaatggtaagctccgttccgagggtcaggggatttgggcactacttggtcgcattactggccaaaagctaaacattcctgcaatccttagagcccctaaggaacgcaagcccagcaaaaaagagggggggacacaaaaaacctcaaccttgcccgccgtcctctactcctgtggaatatgtaaaaagaaccacgatcagcatcttctcctgctctgtgacacttgcaagctgcactatcacctcgggtgcctggacccccccctcacgcgaatgcccaggaagaccaagaactcgtattggcagtgctccgagtgcgatcaggcgggaagctccgacatggaggccgacatggcgatggagaccctgccagacggtaccaaaaggtctcggaggcagataaaagagccagtgaaattcgtccctcaagatgtgccgccagagcctaagaaaattcctatcagaaacacgcggacaagaggtagaaagcggtcattcgtccccgaagaggagaaacacgaggaacgagttccccgggagagacggcagagacagtccgtcctacagaagaagcccaaggccgaggatctcagaacagagtgtgcgacctgcaagggcaccggggataatgaaaacctggttcgatacccctcgtag

SEQ ID NO: 49393 - DNA, 1992 bp, Artificial Sequence
  Description of Artificial Sequence: Synthetic coding sequence
atgatcgtgcagatgaccgtgatcctgaagctggagatgccccaggattccctaatactggaaaaatcccagaattggagttcccagaaaatggaccacattctgatatgctgtgtgtgcttgggtgacaatagcgaagacgctgacgagataattcaatgtgacaattgtggtattacagttcacgagggttgctatggcgtggacggagaatccgattccatcatgagttcagccagtgaaaactctacggagccatggttttgcgatgcttgtaagtgtggagttagtccgagttgtgagctctgccccaatcaggacggcatattcaaagagacggacgcaggccgatgggtgcatatcgtctgcgctctctacgtacctggtgtggccttcggggatattgataaactgcgccctgtgacgttgacagagatgaactacagtaagtacggagcaaaagaatgtagtttttgcgaagaccccaggttcgctagaactggagtttgtatctcctgtgacgcaggcatgtgccgcgcctattttcacgtcacctgcgcccagaaagagggcttactatctgaagcagctgcagaagaggacattgcggatccgttcttcgcctactgcaagcagcatgctgacaggttggatagaaaatggaaaaggaaaaattatcttgctttgcagtcctactgtaagatgtctttacaggagcgagaaaagcagctctccccagaagcccaggcacgaatcaacgctaggttacaacagtaccgggcaaaagcagaactcgccaggtctacacgaccccaggcatgggtcccccgggagaaactgccccgtccactgacatcctcagcctcagccatcagaaagttaatgcggaaagccgagctaatgggcatatcaaccgacatcttccccgttgacaattctgatacatcgtcatctgtggacggaaggagaaagcataagcagcctgccctgacagccgatttcgtcaattactatttcgagaggaatatgcgtatgattcagatccaggagaatatggccgagcaaaagaatattaaagacaaactggaaaacgaacaggaaaaactgcacgttgaatacaacaaactgtgcgagagcctggaagagttgcagaatctcaatggaaagttgcggagcgagggccaaggaatctgggcactccttggacgtatcaccggccagaagctaaacatacccgctatactgcgggcaccaaaagaaagaaagccaagcaaaaaggaagggggtacacaaaagacctctacccttccagcggtcctgtattcctgcgggatttgcaaaaaaaaccacgatcagcatttattactgttgtgtgacacatgcaaactgcactaccatctagggtgtctggatcccccgctgacacgcatgcctcgaaagaccaagaatagttactggcagtgctcagaatgcgatcaggccggatcatctgatatggaggccgatatggccatggagaccctgcccgatggaacgaaacgcagtcgtcgccagattaaggaacctgtgaagtttgtcccacaggatgtgccgcccgagccaaaaaaaatcccaataaggaacacacgaacgcgcggccgcaaaaggtccttcgtcccagaggaggaaaagcacgaggagcgcgtaccccgagaaagacggcaacgacagagtgtgttacagaaaaaaccaaaagctgaagatctgcggactgagtgtgcgacctgcaagggcacgggggataatgaaaacctcgtgaggtgtgatgaatgcaggctgtgctaccattttggttgcctggaccccccgctgaaaaagagcccaaaacagaccggttacggatggatctgtcaggagtgtgacagctcaagctccaaggaggatgagaatgaagctgagcgcaaaaacatttcccaagaattgaatatggagcagaagaatcctaagaaatag

SEQ ID NO: 49394 - DNA, 1077 bp, Artificial Sequence
  Description of Artificial Sequence: Synthetic coding sequence
atggccgagcggcaggaggagcagcggggcagcccccccctgcgggccgagggaaaagctgatgccgaagttaaactgatcctttatcactggacacatagcttttctagtcagaaagttcgtctggtgatcgccgagaaagccctgaaatgtgaggagcatgatgtatcgctgcccctttccgaacataatgagccctggtttatgagactgaattcgacaggcgaagtgccagttctaattcatggtgagaacatcatctgcgaggcaacccagatcatcgactacctggagcagacttttctggacgagcgcactccacgccttatgcccgataaagaatccatgtactacccccgagttcagcactaccgggagctgttagattcactgcccatggatgcgtatacgcacggatgtatcttgcacccagaactgactgtggattctatgattccagcctacgccaccaccagaattaggtcgcaaatcggaaacacggaatctgagctgaaaaaactcgctgaggagaaccctgacctgcaggaagcttatatcgcaaagcaaaaaagactcaagtctaagttgctcgatcacgacaacgtgaaataccttaagaagatcctcgatgaactagagaaagttcttgaccaggtcgaaaccgaactacagcggcgcaacgaggaaactccagaagagggacaacagccctggttatgtggcgagagtttcactctcgctgatgttagcttagccgttacactgcatcgcttgaagtttctggggttcgctcgtagaaattggggcaatggcaaaagacccaatctcgaaacctattacgagcgagttctcaaaagaaaaacatttaataaggtcctcggacacgtgaacaatatcctgatctccgctgtgcttcccacggcctttcgggtagctaagaagagggcccccaaagtccttggaacaaccctcgttgtgggtctgctggccggcgtcgggtatttcgctttcatgctctttaggaaacggctcggttcaatgattctcgcattcaggcccagacccaattacttttag

SEQ ID NO: 49395 - DNA, 1722 bp, Artificial Sequence
  Description of Artificial Sequence: Synthetic coding sequence
atgagcaagaagccccccaaccggcccggcatcaccttcgagatcggtgcgaggcttgaagccctcgactacctgcagaaatggtatccctctagaatcgaaaaaattgattacgaggagggcaagatgctggtgcattttgaaagatggtcccatcgatacgacgagtggatctattgggactccaatcgcctgcgaccactggaacggcctgctttgcgaaaggagggattaaaggatgaggaggacttcttcgacttcaaggctggcgaggaggtgctcgcaagatggacagattgtaggtactacccagcaaaaattgaggccattaacaaagaaggtacctttaccgttcagttttatgacggggttatccgctgcttaaagcgcatgcacataaaggccatgccagaagacgcaaaaggacaggtaaaatcccaacacccgcttagctggtgttgcccaatcgatccagccggtagctgcaaccaaagcatgggctccgaagactggattgccctggtcaaagccgccgcggccgccgctgccaaaaataaaaccgggtctaagccccgaacaagtgctaacagtaacaaggacaaagacaaggacgagagaaagtggttcaaagtcccctccaaaaaggaagagacctccacctgtattgctactcctgacgtggaaaaaaaagaagatctgcctaccagctccgagacttttggacttcatgtcgagaatgtcccaaagatggtcttcccacagccagagtccaccctcagcaataagcggaaaaacaaccagggcaacagcttccaggctaagcgggcacgtctgaataaaattaccggcctgcttgctagcaaggcagtcggggtggatggagctgaaaaaaaagaggattataacgagactgcccctatgcttgagcaagccatatctccaaagcctcagtcgcagaagaaaaatgaggccgacattagtagttccgcaaatacgcagaagccagccctgctttcttcaactttgtcctccgggaaagccagatcaaagaaatgtaaacatgagtctggcgactcttccgggtgcataaagccaccgaagtctcctcttagccccgagttaatccaggtggaggacctgactctggtctcgcagctgtccagctccgtcataaataaaacatccccgcctcagcctgtcaaccctccacggccctttaagcactctgagagaaggaggcggtcccagagacttgccacactccccatgccagatgattctgtcgaaaaggtatcaagtccctctcccgctacggacggaaaggttttttccatcagttcccagaaccagcaggagtccagtgttcctgaagtcccagacgtggctcacctcccacttgaaaaattggggccctgcctgccacttgatctcagtcgggggtcagaggttacagcaccggtggcctccgacagtagttatcgcaacgagtgtccaagagccgagaaagaggatacacagatgcttcccaatccatccagcaaggctatagcggacggtcgcggcgcacctgcggccgccggaatcagcaaaactgagaaaaaggtaaagctggaggacaaatctagcacagcattcgggataagatcctgggacttctctgccctgctcatgaaaatcccttcttactctccaatttccctgtctggactgccagaaagttag

SEQ ID NO: 49396 - DNA, 1332 bp, Artificial Sequence
  Description of Artificial Sequence: Synthetic coding sequence
atgcacatcaaggccatgcccgaggacgccaagggccaggtgaagtcccaacatcctctctcgtggtgttgtccgattgaccccgccggttcatgtaatcaatccatgggaagcgaagactggatcgctttagtgaaggctgcagccgccgccgccgcaaagaacaaaactgggtctaaaccacgtactagcgcaaatagcaacaaagacaaagataaggacgaacgaaagtggttcaaagtgcctagcaagaaagaggagaccagcacctgtattgcgacccctgatgtggagaaaaaggaggaccttccaacaagctctgagacttttggactgcatgttgaaaacgtgccaaaaatggtgtttcctcagcctgaatccacactatccaataaaagaaaaaacaaccaggggaactcattccaagccaagcgggcgcgactgaataaaattaccggacttctcgcctcaaaggctgtaggggtagatggtgcagaaaaaaaggaggactacaacgagaccgcccccatgttggagcaggcaatcagtccaaagccacaatctcagaaaaaaaatgaggcagacatctccagctctgcgaatacacagaaaccggcgttgctgagtagtacactctcttccgggaaagcgagatcaaaaaagtgtaagcacgagtcaggtgacagcagtggttgtatcaaaccacccaagagtcccctttcaccagaactgatccaggtagaggatttaacgctggtctcacaacttagtagtagtgtcataaacaaaacgtcgcctcctcagcctgttaaccctcctcggccgtttaaacactcagagcggaggcgccgatcacagcggctcgccacgctgcccatgccggacgactccgtggagaaagtttcctccccatctcccgcaacagatggaaaagtcttttccatatcgtcccagaaccaacaggagagtagcgtgcctgaggttcccgatgtggcccacctgcccctcgaaaaacttggtccctgtctacccttggatctgtcgagagggtcagaagtcacggctccggttgcctcagacagcagttatcgcaacgaatgccctagggccgaaaaggaggatactcaaatgcttcccaatccctcaagcaaggctattgcagatggcaggggcgcccctgccgcggcgggaataagtaaaactgagaagaaggttaagcttgaggacaaatccagcactgcattcggaatcaggtcttgggacttttccgccctgctgatgaaaataccttcatactctccaattagcctgtcaggactgccggagagttag

SEQ ID NO: 49397 - DNA, 858 bp, Artificial Sequence
  Description of Artificial Sequence: Synthetic coding sequence
atgagcaagaagccccccaaccggcccggcatcaccttcgagatcggtgcgcggctggaagcattggactatttacagaagtggtatccctctcggatagagaagatcgattatgaggaaggtaaaatgctcgtccacttcgaaaggtggtctcaccgctatgacgagtggatttattgggattctaaccggctgcgcccgctggagcgtcctgctttgagaaaggagggtcttaaagatgaggaggattttttcgattttaaggcgggcgaggaggtgctggcaagatggacagactgtagatattacccggccaaaattgaggcaatcaataaggagggaacatttacagtacagttctatgatggggtgattcggtgtttaaagagaatgcacattaaggccatgcccgaggatgcaaagggacaggattggatcgcgctggtcaaagctgccgctgctgcagctgccaagaacaagaccggttccaaacccaggacgtccgcaaacagcaacaaggacaaggacaaggacgagagaaagtggtttaaggtcccctctaaaaaagaggagacttccacctgtatcgctaccccagacgtggagaagaaggaggatctgccgacatcttccgaaaccttcggtttacacgtggaaaacgtgccgaagatggtgttcccccagcccgagtccaccctcagcaacaaacggaaaaataatcagggcaatagcttccaggccaaaagagcacggttaaacaaaattactggactccttgcttcaaaggctgttggagtcgacggggcggaaaagaaggaggactataacgagacagccccaatgttggagcaggtgtag

SEQ ID NO: 49398 - DNA, 3054 bp, Artificial Sequence
  Description of Artificial Sequence: Synthetic coding sequence
atgagcaagaagccccccaaccggcccggcatcaccttcgagatcggcgctagactcgaggccttggactacctgcagaagtggtacccttctagaatcgaaaagatagactatgaagagggcaaaatgctggtgcatttcgagcgctggagccaccggtatgatgagtggatatactgggactccaatcggctgagaccgctcgagcggccagcccttagaaaggaaggtctgaaagatgaagaggatttcttcgactttaaagccggagaggaggtgctggcccgatggactgattgtcggtactatccagcgaagattgaagcgatcaacaaagaggggacattcaccgtccagttttacgacggggtgatcagatgccttaagcgcatgcatatcaaggctatgcccgaagatgccaaaggtcaggtgaagtcccagcaccccctgagctggtgctgtccgatcgacccagctggctcctgcaatcaaagcatgggctctgaagactggatcgcacttgtgaaagccgctgctgcagccgccgcaaagaacaaaactggatccaagccacggacttccgccaattccaacaaggacaaggacaaggacgagcggaaatggttcaaagtacctagtaagaaggaggagacctctacctgtattgccacccctgacgtggaaaagaaagaagatctgcctacgagttccgaaacgtttggtctccacgtcgaaaatgtgcccaaaatggtgtttccccagcccgagtctaccctgtcaaataaaaggaaaaacaatcagggcaattcatttcaagcgaaaagagcacgcctcaataagatcaccggcctgctcgcctcaaaagccgtcggggttgacggcgctgagaagaaagaggattacaacgagacagctccaatgcttgagcaggctatcagccctaagccccagagtcagaagaagaacgaggccgatataagcagcagcgctaacacacagaaaccagccttattgtcatcaaccctctccagtggaaaagcaagatcaaagaaatgcaagcacgaatctggcgattcatcaggatgcataaaacctcctaaaagcccgctcagtccagagttgatccaagttgaagatctaactctcgttagtcagttatcatcctcagtgataaacaagacctctcctccccaaccagtgaatcctccgcggcctttcaagcactccgagcgcagacgtcggagtcaaaggttggccactctgccaatgcccgacgacagcgtggagaaggtgagttccccctctccagcgacagatggaaaggttttctcgatttcatcacaaaaccagcaggagagcagcgtgccggaagtgcctgatgtggcccacctccctctggagaaactgggaccttgtctcccattggaccttagcaggggcagcgaggtaaccgcccccgttgcctcggactcctcatacagaaatgagtgcccacgcgctgaaaaggaggatacccagatgttaccaaacccctctagcaaggccattgctgacggccggggagcaccagctgctgccgggatctccaaaacagaaaaaaaagtaaagctagaggataagagttccacagcatttggaaaacgaaaggaaaaagacaaagagaggcgcgaaaaacgcgacaaggaccactacaggccaaaacaaaaaaagaagaagaagaagaagaaaaaaagtaagcagcacgactatagcgactatgaggatagttccctagagttccttgagcgatgctctagccccttaaccaggtcgtcggggagctcattagcttcccgctctatgttcacagaaaagactacaacatatcagtaccctcgcgcgattctatcggtagatctaagcggtgaaaatctatctgatgttgactttctggacgatagctcaaccgaatctctacttctgtccggcgatgaatacaatcaggatttcgactccacgaattttgaggagtctcaggatgaagatgatgccctgaacgaaattgtccgctgtatctgcgaaatggacgaagagaacgggttcatgattcaatgtgaggagtgcttgtgttggcaacattctgtgtgtatggggttgctggaggagtctatccctgagcagtatatttgttacatctgtagagatccgccgggacaacggtggtcagcaaaatacagatacgacaaagaatggctgaataacggacgaatgtgcggtctctcttttttcaaggagaattactcacatttgaacgccaagaaaatcgtctcgacccatcatcttctggctgatgtttacggggtgacagaagtactccatggactgcagctcaaaatcgggatcctgaagaacaagcatcaccccgatcttcacctgtgggcctgctccggaaaacgaaaagatcaggaccagatcattgcaggtgtcgaaaagaagattgctcaggacacagtgaatcgcgaggaaaaaaagtacgttcaaaatcacaaagagcctcccaggctacctttaaagatggaaggcacctatattaccagtgagcactcataccagaagccacaaagtttcggtcaagattgcaaaagccttgcagacccaggctcttccgatgacgacgacgtctcatcactggaagaggagcaggagttccatatgcgtagcaaaaactctttacaatactcagccaaggagcacggtatgcctgagaaaaacccagccgaaggcaatacggtcttcgtttacaatgacaaaaaaggtaccgaggaccccggagacagccacctgcaatggcagttgaatcttttgactcacatcgaaaacgttcaaaatgaggtaacatccaggatggacctgattgaaaaggaagtggatgtcctggaatcgtggttggactttaccggagagctcgaaccgcctgatccattggcgaggcttccccagctaaagcgacacatcaagcagctcctgattgacatgggaaaagtgcagcagattgccactttgtgcagcgtctag

SEQ ID NO: 49399 - DNA, 1596 bp, Artificial Sequence
  Description of Artificial Sequence: Synthetic coding sequence
atggagctgcagagccggcccgaggccctggccgtggagctggccaggcaccagaacggcgatctcaaaaagcagctacatgagaggcagcctcgcattgctgccctttccgacaagcaggccctggggacgatcaccgctgtgcccgtaaccggtccacaagtctccagcctgcagcggctagccggtcagggggccgctgtcctcccccaggtgcggcctaagacgttaatccccgactcccttcctgtggctccaggcagagataggcctccaaaacagccgcctacctttcagaaggctacagttgtttctgttaagaatccctcaccagcgttacccaccgcaaataacacagtaagtcatgttccagcacccgggtcccagccccaggccctagccgaacccgctgccttggcctctccactctccagcgctggtgtggcatatgcaataattagcaccagtccgagtaatgccgcggccatggccccgagtacagcagtgagtgtggtgagtgactcaattaaggtgcagccactcctcatctccgcagataataagcctcccccaaggctcctgagctcccctcatccagcaacgcaccactgtcccctgcatccatcatccttgcccctcaccccacctagcccgagcctttccccatctccactgcatgggatcttccaagtgatcataatccagcctcaggttcaaactcagcccgagtccactgcagagagccgccctcccacggaagagccgtcccagggcgcacaggcaaccaagaagaagaaggaggacagaccacccacccaggaaaatcccgagaagatcgcttttatggtggctttggggctggtcaccactgaacacctcgaggaaattcagtccaagagacaagaacggaagcggaggtccactgcaaaccctgcgtacagcggactgctggagacggaacggaaacggttagcaagcaattaccttaacaatcccctctttcttacggcacgggccaacgaggatccttgctggaaaaacgagatcacacatgacgagcactgtgctgcttgtaagcggggcgcaaacctgcagccctgtgggacttgtcctggtgcttatcatctgtcctgccttgagcctccccttaagacggcacctaagggcgtgtgggtctgtcctagatgtcagcagaaagcacttaaaaaagatgaaggggttccctggacaggcatgctggctatcgtgcattcatatgtgacccataagacggtaaaagaagaggagaagcagaagctcctacaaagaggatctgagctgcagaacgagcatcaacagcttgaggagagagaccgtcgcctcgcctccgccgtgcaaaaatgcctggaactgaagacatcgttgctggcccggcagcgggggacacagtctagcttggataggcttagggccctcctccgactgattcagggcgaacagcttctgcaggtgaccatgacaacaacgagccctgcacctctgcttgccggcccctggacaaaaccctccgttgccgccacccaccctacggttcagcatccccaggggcacaactag

SEQ ID NO: 49400 - DNA, 1470 bp, Artificial Sequence
  Description of Artificial Sequence: Synthetic coding sequence
atggagctgcagagccggcccgaggccctggccgtggagctggcccgccatcagaacggagacctgaagaagcagttacacgaacgacagccacgcattgccgccctcagcgacaaacaggcgttggggactatcactgcggtgcccgtcacaggccctcaagtgtcttctttgcagcggctggctggacaaggagctgctgtactgcctcaggtgagaccaaagaccttgattcccgattctctgcctgtggctcccggcagggaccgaccccctaaacagcctcctacctttcagaaggccacagtcgttagtgtcaagaacccaagccctgcactgccgaccgccaataatactgtgagtcacgtcccagcccccggcagccagccgcaagcacttgccgagccagctgccctagcatcgccgctgagcagcgccggcgtcgcttatgcaatcattagcacatccccttcaaatgccgcagctatggcccctagcactgcagttagcgtggtgagcgacagtattaaggtgcagcccctgcttatcagtgcagataataaagtaatcataattcagccacaagtgcagacccaaccagagtcaactgccgaatcaagacctcctacagaagaaccatcccaaggcgcccaggccaccaagaagaaaaaagaggaccgaccccccacgcaagagaatccggaaaagattgcttttatggtggccctcggactcgtgaccactgaacacctcgaagaaattcagagtaaaagacaggagcgcaaaaggagatcaaccgccaaccccgcttatagcggactgcttgagaccgagcggaagcggctagccagcaactatctgaataacccactgtttctaactgcgcgcgctaacgaggacccatgctggaagaatgaaatcacccacgatgagcattgcgccgcatgcaaacgcggagccaacctgcagccctgtggaacctgcccgggagcgtatcacttatcatgtctggaaccgcccctgaaaaccgcacctaagggtgtgtgggtatgccctaggtgtcagcagaaggccttgaagaaggacgaaggtgttccttggaccggaatgctcgccattgtacactcctacgttactcataaaacagtcaaggaggaggaaaaacagaaactgctgcagcgtggtagtgagctgcaaaatgagcatcagcagttggaggaacgggacaggcggctggcaagtgccgtccagaaatgcctggagttgaagacaagtctgctggcaagacaacgcggcacacagtcatcattggacagacttcgggccctgctgagactgattcagggcgagcagctacttcaggtaacaatgacgaccacaagccccgctcctctgctggccgggccctggaccaaaccctctgtcgccgcaacacatcctactgtgcagcaccctcagggacataattag

SEQ ID NO: 49401 - DNA, 1434 bp, Artificial Sequence
  Description of Artificial Sequence: Synthetic coding sequence
atgcggcggcagccccagaacggcgacctgaagaagcagctgcacgagaggcagccaagaatcgctgctctgagcgataaacaggcactcgggacgatcaccgccgtgcccgtcaccggtccgcaagtttcttctctgcagcgactcgccggacagggcgccgctgtgttgccacaggttaggccgaagaccttgatcccagattcccttccagttgctcccgggagagatcggcctcctaaacaaccaccaacattccagaaggcaacagtcgtatccgtcaagaacccaagtccagcactgccaactgcaaacaatacagtttctcatgtaccagctccggggagccagccacaggctttggccgagcccgccgctctcgcgtccccgcttagctcagccggggttgcctacgcaattatcagcaccagccccagtaatgctgcagccatggcacccagtactgcggtttccgttgtctctgattccatcaaagtgcagcccctgttgatttctgctgacaacaaggttatcataatccaaccccaagtgcagacacaacctgagagtacagccgagtcgcgcccacctactgaagaaccatcacagggcgctcaggcaaccaagaagaagaaagaagataggcctccaacgcaggagaacccagagaagattgcctttatggtcgccttgggtctggttaccactgagcacctcgaggagattcagtctaaacgccaggagcgtaagcggcgaagtaccgcaaatcccgcttactccggactccttgaaacagaacgcaagaggctcgccagcaactatctaaacaacccgttgtttctaactgccagagccaacgaggatccatgctggaagaacgaaatcacccacgatgagcactgtgcagcctgcaagcggggcgccaatctacagccctgtggcacttgtcctggtgcttatcatctgtcttgtctggagcctcccctcaaaaccgcccccaagggagtttgggtttgtccaagatgtcagcaaaaagccttgaaaaaagacgagggcgtaccgtggacaggcatgttggcaattgttcactcctacgtgactcataagaccgtaaaggaggaggagaaacagaagttgctgcagcgcggctccgagttgcaaaacgagcaccagcagctagaggaacgggaccgcaggcttgcttcagctgtgcagaagtgtttagagctgaagacctctctccttgcccgccagaggggcacccagtcctccctcgaccgtctgagggcgctactgaggctcatccagggtgaacagctgttacaggtgaccatgacaactacttcccccgctccgttactcgcaggcccgtggacaaagccatcggttgcggccactcacccaaccgtccagcacccccaagggcataattag

SEQ ID NO: 49402 - DNA, 873 bp, Artificial Sequence
  Description of Artificial Sequence: Synthetic coding sequence
atgcggcggcagccccagaacggcgacctgaagaagcagctgcacgagaggcagccaagaatcgcggccctgagcgacaaacaggctctcggcacaataacagcggtgcccgtaaccggaccacaggtttcctctctccagaggctggcaggacagggagcggccgtgctgccccaggttagacccaaaacacttattccggattctctgcctgtggcaccggggagagatcgcccccccaaacagccacctacctttcagaaggctacagtcgtgagcgtcaagaaccctagcccagccctccccacagccaacaatacagtgtctcatgtgccagcccctggatcacaaccccaagcgctggccgagcccgcagcgctggcctctcctctttcttccgcaggtgttgcatacgcaatcatcagcacctccccttcaaacgctgccgccatggccccatccacagccgtgtctgtagtcagtgactcgatcaaggttcagccgttgctaattagcgccgataataaagtgattataattcagccccaagttcagacacagcccgaatccacggctgagtcgcgaccacccacagaggaaccgtcgcagggggcacaggctactaagaagaagaaggaggacagaccacctacccaagagaatcccgagaagatcgccttcatggtcgccttgggattagtaaccactgagcatctcgaggaaattcagagcaagagacaagagaggaagcgcagatccacagctaatccagcttacagtggcctgctcgaaaccgaacgcaagagactggcatccaattatcttaataacccgctgtttcttaccgcacgcgagagagaccacccccggtag

SEQ ID NO: 49403 - DNA, 1743 bp, Artificial Sequence
  Description of Artificial Sequence: Synthetic coding sequence
atggactaccccaagatggactacttcctggacgtggagagcgcccatagattgctggatgtcgaaagcgctcagcgattcttctacagccaaggggcccaagcaagacgtgcaacattgcttctccccccaacccttatggctgcatctagcgaggatgatattgacagacgccccatcagaagagttcgcagcaagagtgacaccccgtacctggcagaggctcgcatatcatttaacctgggggcagctgaggaggtagagagactagccgctatgcgctctgactccctggtgcccggcactcatactccgccaattcgacgaagatctaaatttgccaatctcggcaggatctttaagccttggaaatggcgaaaaaagaaatcagaaaagtttaaacacacgagtgcagctctggaaaggaaaatctccatgcggcaaagccgcgaggagctgataaagcggggcgttctgaaagagatttatgataaagatggtgaactgtccatcagtaacgaggaggatagtctcgagaatggccagagcttaagctcgtcccagttgtctctcccagcgctgtccgaaatggaacccgtaccgatgcctagggacccttgcagctatgaggtattgcagccctccgacatcatggatggtcctgaccccggcgcccccgtcaaactcccctgcctgcctgtaaaactctcccctccgctgcccccaaagaaggtcatgatctgtatgcccgttgggggacctgatctctccttagtcagctacaccgcacagaagagcggccagcagggcgtcgctcaacaccaccacacagtactcccctctcagatacagcatcaactccagtacggatcacacggtcagcacctaccaagtactactggctctttgccgatgcaccccagcggctgccgtatgatcgacgagctaaacaagactttggctatgacaatgcagaggctggaatcttccgagcaacgcgtgccttgcagcacttcatatcactctagtggcctccactctggtgatggggtgaccaaggcgggtcccatgggactgccggaaatcagacaggtccctaccgtggtgatcgagtgcgacgacaacaaagaaaatgtgccccacgagtccgactatgaagatagcagttgtctatatacaagggaagaagaggaggaagaggaagatgaggacgacgacagctctctgtatacctcaagcctagctatgaaggtctgtaggaaggacagcctcgctattaagcttagcaatcgtccttcgaagcgagaactggaagagaaaaacatactgcctagacagaccgatgaagagcgcctcgagctaaggcagcagattggcacaaagctgactaggagactgtcccagcgacccaccgcagaggagctggagcagcggaacattttgaagcccagaaacgagcaagaagaacaggaggagaaaagggagatcaaaagacgtctgacccggaagctgtctcagagacccactgtggaagagcttagagaacgcaagatcctgattcgcttctcagattatgtcgaggtggctgacgctcaggattacgatagaagagcagacaagccctggacccgactgacggcagcagacaaagccgcaatccggaaagaactcaatgaattcaagtcaactgagatggaggttcacgaactgagtcggcatctcacatcattcagattcccctag

SEQ ID NO: 49404 - DNA, 423 bp, Artificial Sequence
  Description of Artificial Sequence: Synthetic coding sequence
atgtacctgcagggcccccggaagctgatgacccagggcggctacgatatggtccagaaactctttctggacttctttcggcgcagactatcccagcgcccaacagccgaggagctcgaacaaaggaatattctgaaaccgagaaacgagcaagaagaacaggaggaaaagcgcgagatcaagcgcaggctaaccaggaaactgtcccagagaccgactgtcgaagaactacgggagagaaagatactgattagattttccgattatgtagaggtagccgacgctcaggattacgacaggagggccgacaagccatggactcgtctgacagccgctgataaggtgagtcgaggagagtgctggcgggtcggaggaaggacggtctgttgggtatcactggggtctccgctagggagtgtatag

SEQ ID NO: 49405 - DNA, 435 bp, Artificial Sequence
  Description of Artificial Sequence: Synthetic coding sequence
atgtacctgcagggcccccggaagctgatgacccagggcggctacgatatggtccagaaacttttccttgacttttttaggaggagattgtcgcaacgtcccacagctgaagagttagagcagcggaatatcctgaaaccccgtaacgagcaggaagaacaggaggagaaaagagagattaagcgtcggctcaccagaaaattatcccaaagacctaccgtggaggaactgagagaacgaaagatcttgataaggttctccgactatgtggaggtagcagatgctcaggattatgaccggcgggccgacaagccttggacaaggctcactgctgctgataaagcggcaatccgcaaagagctgaacgagttcaaatcaacggagatggaggtgcacgagctctccagacacctgactcgcttccaccgcccctag

SEQ ID NO: 49406 - DNA, 600 bp, Artificial Sequence
  Description of Artificial Sequence: Synthetic coding sequence
atgcggcagagccgggaggagctgatcaagcggggcgtgctgaaggagatctacgacaaggacggagagcttagcatcagcaatgaagaggacagtctcgagaacgggcagagcctcagctcgtcccagttaagtcttccggctctcagtgaaatggaaccagtgcccatgccccgggacccatgctcttacgaggtgctccagccatccgacatcatggatgggcctgtaagtgaggagtctccatccgcatccgaatcaggggtgctgctgtctcaggacccatcagccaagcctgtactattgctgcctcctaagaaaccagccgcattcccaggcgatcacgaagaaacaccggttaaacagcttccactcctgaagcagcctcccgccctgcctcccaagccgacgactagaatcgcaaatcacttaacagactggcaccaggctcatcaggttggccagcgacacccgctgcctccctggcagtgggccttttctagccctggctcctcaaaacggattcaatctcggcccggggcagttgcctacgcctgtaatcccagtaccctcggaggcaggggccgctggataacgtag

SEQ ID NO: 49407 - DNA, 510 bp, Artificial Sequence
  Description of Artificial Sequence: Synthetic coding sequence
atggactaccccaagatggactacttcctggacgtggagagcgcccacaggcttctcgatgtggagtccgcacagcgatttttttatagtcagggtgcacaggcccgcagggccactctccttctgcctccaacgctgatggccgcctctagcgaggatgatattgatcgacgacccattcgcagagtcaggagcaaatccgatacaccgtacctggctgaggctaggatctcattcaatttgggggccggagtatccctcttcggggacatggatgaagccaggatgggtcccgccgtccctacccttggccgaccgcttggattagaactgtgtagcctggaaaaccacggattattaaagacagcaccaacctacaccacgagtgcccatatttgctcggggccttcaaccggtgggcaattctctacgcagggaatgagccccgttcagggcgccaagcgccggagggttgtctggctcccactggagggggaggagttcggatag

SEQ ID NO: 49408 - DNA, 1455 bp, Artificial Sequence
  Description of Artificial Sequence: Synthetic coding sequence
atggactaccccaagatggactacttcctggacgtggagagcgcccacaggctgctcgacgtggaaagtgcacagcgtttcttctacagccagggcgcgcaagcgcgccgtgcaacattacttctcccacctacactcatggccgcttcttccgaagacgatattgatagacgtccaattcgcagggtgagatccaagtctgacaccccctatctggctgaggccaggatcagcttcaatctgggagccgccgaggaagtggagcgcctggccgccatgcgctcagatagcctggtgccgggcacccatacacccccaatcaggcgtaggagcaagttcgctaacctcggtcgaatctttaaaccatggaaatggcgcaagaaaaagagcgagaagttcaagcatacaagcgccgccttggaacggaaaataagcatgaggcaaagcagggaggaattaataaagaggggggttttgaaggagatctacgataaggacggcgagctgtcaattagtaacgaagaggactctcttgagaacggacaaagcctgtcctcatcacaattgtcactgcccgcactgagtgagatggagccagtgcctatgcctagggatccctgttcatatgaggttcttcagccaagtgacatcatggacggccccgatccaggtgccccagtcaaacttccatgtctgcccgtgaagttgtcacctccattgcctcctaagaaggttatgatctgtatgcctgtcggaggtccagatctctcgcttgtgtcctacaccgcacagaagtcgggccagcaaggagttgcacaacaccaccacacagtgctcccctctcagatccagcatcaactgcaatacggaagccatggccagcacctgccaagtaccacgggcagtctgcctatgcaccctagtggatgccgcatgatcgatgaattgaataagacccttgcaatgacaatgcaaagattagagagctccgagcagcgtgttccctgcagcactagttatcacagtagtgggctacacagcggagatggggttactaaggccggacccatgggcttgcccgaaattcggcaggtaccaacagttgtgattgaatgtgatgacaataaagagaacgtccctcacgagtcagactatgaagatagttcgtgtctgtataccagagaggaggaggaagaagaggaggatgaggacgacgatagttctctgtacacaagttcactggccatgaaggtgtgccggaaggacagcttggctattaaactgagcaataggccatctaaaagggaacttgaggaaaaaaacatcttgccacgtcagaccgacgaagaacgactggagttgcggcagcaaatcgggacaaaactgactcgacggctcagccagcgacccactgccgaagaactggagcagaggaacatccttaagagaaaatag

SEQ ID NO: 49409 - DNA, 798 bp, Artificial Sequence
  Description of Artificial Sequence: Synthetic coding sequence
tgaagccccttcacccccttcagccccctgctgagcttcttcctgagtcccttctttttcctgttcccctctctgtcccacagtttacccacacctagcctgcctcttccctcaccgttcccaagtccttctcccgtacgcgagcccttgccgctaccctcctcccccttccgtttgtctcccagcccttctgtgtctttcagcctgtcagccaggcgcgcaaccctcctgttgcctcccacgctgatggccgcaagctcagaagacgacattgaccggcggcctattaggagggtaagatctaagtccgacactccctacctagcagaggccaggataagcttcaatctgggagctgccgaagaggtggaaaggctggccgctatgaggtccgattccttagtacccgggactcacactcctcccattcgccgaagatctaagtttgccaatctgggccggatttttaaaccatggaagtggcggaaaaagaaatcagaaaaatttaagcacacctctgctgctctggaaaggaagattagcatgaggcaaagcagggaggagctgattaagagaggcgtattgaaggagatttacgataaagatggggagctgagcataagcaacgaggaggacagtctggagaacgggcagtcattgtctagtagtcagctctccctgccagctcttagtgagatggaaccagtgccaatgcctcgtgatccatgttcctatgaggtactgcagccttccgacatcatggatgggccagtttcagaagagagccctagcgcctag

SEQ ID NO: 49410 - DNA, 1248 bp, Artificial Sequence
  Description of Artificial Sequence: Synthetic coding sequence
tgaggcgagctgagcatcagcaacgaggaggacagcctggagaacggccagagcctgagctcatctcagctcagcctacccgctctcagcgaaatggaaccggtaccaatgccgagggacccttgcagctacgaggtgctccagccgtctgatattatggacgggcccgacccgggtgccccagttaagctgccgtgcctgcccgttaaacttagcccccccctccccccaaaaaaggtcatgatttgtatgccagtgggcggtcctgacctttccctggtgtcatacacggcgcagaaatcaggccagcagggcgtggctcagcaccaccatacagtgctcccttcgcagatccagcatcaattgcagtatggttcacacggccagcatttaccaagtaccacaggttcgctcccgatgcatccatccggatgcagaatgatcgacgagctaaataagacattggcaatgaccatgcagcgcctggagagttctgagcagcgggtgccttgcagcacctcttatcattcgtcgggtttgcattccggcgatggggtgacaaaagccggacccatgggtttgcctgaaattcgtcaggtcccaactgtcgttattgagtgcgatgacaacaaagaaaacgtacctcacgagtcggactacgaagacagcagctgcttgtacacacgtgaagaggaagaagaagaggaagacgaggacgatgactcatctctttacacaagctcgctcgcgatgaaggtgtgtaggaaggacagcctggctattaagctgtccaatcgtccttccaagagagagctcgaggagaagaacatcctgcctagacaaacagacgaagaaaggctcgagcttaggcagcagatcggaacaaagctgacacggagattgtcccagaggcccaccgctgaagagctggagcagagaaacatcctgaagccacgcaatgaacaagaggagcaggaagaaaagagggaaatcaagaggagactaactcggaagctgtcccagaggccaactgtcgaagagctcagagagagaaaaattcttatccgtttttccgactacgtggaggtggctgatgcccaggattacgaccgccgtgcggacaagccctggactagactgactgccgccgacaaagcagcaatccggaaggagcttaacgagtttaagtccaccgagatggaagtacacgagctcagccgtcatctgacacgtttccatcgcccatag

SEQ ID NO: 49411 - DNA, 1644 bp, Artificial Sequence
  Description of Artificial Sequence: Synthetic coding sequence
atggactaccccaagatggactacttcctggacgtggagagcgcccatcgcctactggacgttgagtcagctcagcggttcttttacagccagggagcccaggctaggcgggccacgctcctactcccccccacacttatggccgcttccagtgaggatgatattgatagacggccaatcagacgcgtgcggtccaaatccgacaccccctatttagccgaggcacgaattagcttcaacctcggcgcagctgaggaggtggagagattagcagcaatgcgctccgatagcctagtgcccggcacccacacaccgcctatccgccggagatctaaattcgcaaatttagggcgtatcttcaagccttggaaatggagaaaaaagaaaagcgagaagttcaaacatacttccgcggctctggagcgtaagatatctatgcgtcagagcagagaggagttaattaaaagaggagtgctgaaagagatctatgataaggatggagaattgtccattagcaatgaggaggattccctggagaacggacaatcattaagctccagccagttatctcttcccgcactgtcagaaatggagccagttcctatgccccgggacccttgtagttacgaggtgctccagcccagtgatatcatggacggccctgtgtctgaggaatccccttcggccagtgagagcggcgtgctgcttagccaagatcctagcgcgaaacccgtgctgcttttacctcctaaaaaacccgcagcattcccaggggaccacgaagaaacccccgtaaagcagctgcccctgctgaaacaaccacccgccctccctccaaagcctactaccaggatcgcaaatcacctcaccgaccccggggctcccgttaagttgccctgcttgcctgtgaagctatctcccccactcccaccaaaaaaagtgatgatatgtatgcctgtgggtggaccggatctctcactggtcagttacaccgcacaaaaaagtggacaacaaggtgtggcccagcaccaccacactgttctgccctcccagatccagcaccagctgcaatatggttcgcacggtcagcacttacctagcactacgggctcgttgccaatgcatccatctgggtgcaggatgattgacgagctcaacaaaacgctcgcaatgaccatgcagaggctggagtccagcgaacagagagttccatgctccacgagctatcactctagcggcctgcacagcggagacggtgttaccaaagcaggccctatgggactcccagagatccggcaagtgccaacagtcgtgatagagtgcgacgacaataaggagaatgtgccccatgagtctgactacgaagattccagctgcctgtatactagggaggaggaagaagaggaagaggacgaagacgatgatagctctttatacaccagttcacttgcaatgaaagtctgcagaaaagactccctggccataaagttgtccaacaggcccagcaaaagagagctcgaggaaaagaacattctaccccgacagaccgatgaagaacggctcgaacttaggcagcagatcggaaccaagctgacgagaaacaagttccgtcgagatttcggcagacagttggaggggaaatag

SEQ ID NO: 49412 - DNA, 693 bp, Artificial Sequence
  Description of Artificial Sequence: Synthetic coding sequence
aacctgggccggatcttcaagccctggaagtggcggaagaagaagagcgagaaattcaaacatacaagtgccgcccttgagcggaagataagcatgagacagagccgcgaagagctgatcaagcgaggagtgctcaaggaaatctacgacaaagatggtgaattgagcatctccaatgaggaggacagcctggaaaacggccagagtttatcgtcctctcaattgtctctccccgcattgtccgaaatggaaccagttccaatgcccagagatccctgttcatatgaagtgctccagccaagcgatatcatggatggccccgttagcgaagaaagcccatcagcatctgaatctggcgtcctcttgtctcaggatccctccgcaaagccagtgctgttactgcctcccaagaaacctgcggcctttccaggcgaccatgaggaaacacccgtgaaacaactacccctgcttaaacagcctcccgctttgcccccaaagcccactacgaggatagcaaatcacctcacagactggcatcaggcccatcaggttgggcagcgtcatccactccctccttggcaatgggccttctcaagtcccgggtctagtaagagaatccaaagccggcctggagccgtcgcatatgcctgcaatccatccacactggggggtagaggtcggtggatcacttag

SEQ ID NO: 49413 - DNA, 1308 bp, Artificial Sequence
  Description of Artificial Sequence: Synthetic coding sequence
atgcggcagagccgggaggagctgatcaagcggggcgtgctgaaggaaatttacgacaaagatggcgagctctccatcagcaacgaggaggattcgttggaaaacggtcagtctttgtcctcttctcagctgtctctgcccgcactctctgagatggagccagtgcctatgcccagagacccctgttcctatgaagtcctgcaaccaagcgacatcatggacgggcctgatccaggcgcaccagttaaactgccttgcctgcctgttaaattatccccccccctaccaccaaaaaaagtaatgatttgcatgcctgtcggcggccctgacctgagtctcgttagctataccgcgcagaaaagcgggcaacagggggtggcccaacaccatcataccgtacttccatcccagatacagcaccagctgcagtacggctcccatgggcaacatctcccatcgaccacgggttccctgcccatgcaccccagcggctgtcgaatgattgatgaactgaacaagaccctcgcaatgacaatgcaaagactggagtcctccgagcagagagtaccttgttcgacatcgtaccattcatccggtcttcattccggggacggagttacaaaggccggcccgatgggattgccagaaatccgacaagtgcctaccgtggtgattgaatgtgatgataacaaggaaaacgtgcctcacgaaagcgactatgaagatagctcttgcctgtatactagggaagaggaggaagaggaagaggacgaggatgatgactcatctctttacacgagcagtctagccatgaaggtgtgcagaaaggatagcttggcgatcaagctctcgaatcgccccagcaagagggaactggaggaaaaaaacatcctgcctaggcagacagatgaggaaaggctggagttgcggcagcagatcggcacaaagctgacgcggaggctgtcacagcgccccacagctgaggagctggaacagagaaacatcctcaaaccccgtaacgagcaggaggaacaggaagagaaacgggaaattaaaagacggctgacaaggaagctctcccagagacctactgtggaggagcttagagaaagaaagatcttaattcggttttccgattatgtcgaagtcgcggacgcacaagattacgaccggcgcgctgacaaaccgtggacacgccttactgcagcggataaagctgccatccggaaagaattgaacgagtttaagagtaccgagatggaggtgcacgaattgtcccgacacttgaccagctttaggtttccgtag

SEQ ID NO: 49414 - DNA, 1665 bp, Artificial Sequence
  Description of Artificial Sequence: Synthetic coding sequence
atggacaacgccgtggacggcctggacaaggccagcatcgccaacagcgatggtcctacagcagggtctcagacacctccattcaaacgaaaaggaaagctgtctaccataggcaagatattcaagccctggaagtggcgcaagaagaaaacctctgacaaatttcgggaaacgagtgccgtgctggagcgcaaaatttcgacacgccaatccagggaggaactcatccgtagaggggtgttgaaggagctcccggaccaggacggcgacgtcaccgtcaattttgaaaattcaaatggacatatgatacccatcggggaggaatctactcgtgaggaaaacgtagtgaagagtgaggaggggaatgggtcagtgtccgagaaaacccccccattagaggagcaggcagaggataaaaaggccggctcgtctcattctaagaaaactactggctcgaaagcctcggcctcgccttccactagtagcacgagtagtcgcccaaaagcaagcaaggagacagtgtcatctaaagcggggactgtagggacaactaagggaaaaagaaagacagacaagcagcccattacaagccacttgtcttccgatacaactactagtggaacatcagatctcaagggggagcctgcggagaccagggtggagagttttaagctcgaacaaaccgtcccgggagccgaggaacagaacacaggtaaattcaagagcatggtccctcctcctcctgtggcccccgcccccagtccattagcaccgccattgccacttgaggatcagtgtataaccgcatctgatacccctgtggtgctcgtgagcgtaggtgccgatctgccagtcagtgcccttgaccccagccaattactgtgggctgaagagcccaccaacagaacaaccctgtacagcgggaccggcctcagtgtgaatagagaaaacgctaagtgttttacaaccaaggaagagctcggcaagactgtccctcagctgcttacccctggactgatgggagaatccagtgagtcattctcagcctctgaggacgagggtcaccgcgagtaccaggcaaatgattccgattctgacggtcctatactgtacacagatgatgaggatgaagatgaagatgaagacgggagcggtgaaagcgcgctagcgtctaagattcgtcggcgcgacactctggcaattaaactgggaaatcggccaagcaagaaggaactggaggacaaaaatatcctccaacggacttcagaggaggagcgacaggaaatccgacaacagattggcaccaagttggtgcgtcggctgagccagcgcccaactactgaagaacttgaacagcggaacatcttgaagcagaagaacgaggaggaggaacaggaggccaaaatggagctcaagagaagactgtcacgcaaactgagcctgagacctactgtcgccgagctccaggctcgccgcatcctgaggtttaacgaatatgtggaggtgacagattcccccgactacgatcgtcgggcggataagccgtgggctcgcctgacacctgcggataaggcagcgatacgtaaggagctgaacgagtttaagagtaccgagatggaggtccatgaagaaagcaggcagttcaccagatttcacaggccctag

SEQ ID NO: 49415 - DNA, 1698 bp, Artificial Sequence
  Description of Artificial Sequence: Synthetic coding sequence
atgggccagaccagcgtgagcaccctgagcccccagcccggcagcgtagatggcctggataaagccagcatcgctaactcagacggtcctaccgccggctcccagactcctcctttcaagagaaagggtaagctatctactatcggcaagatattcaagccgtggaaatggcgcaagaagaagactagcgacaaattcagagagacaagtgccgtgttagagcggaagatctctacacgccagagtagggaggaactgatccggcgtggagttctgaaggagctgcccgatcaggacggagatgtcacggtgaatttcgagaattccaatggccacatgatccccatcggagaggagagcaccagagaagagaacgttgttaagtcggaggagggtaacggctctgtctctgagaagacacctcccttagaagagcaagccgaggacaaaaaggccgggtcctcacactctaaaaaaactaccggatctaaggcaagtgcttctccatctacgtcctccacttcctccaggccaaaagccagtaaagagacagtcagcagcaaggcagggacggtcggtaccaccaagggcaaaaggaagactgataagcaacccattacgagccacctttcatctgacacaacgacatccggtacctccgacctgaagggggaacctgctgagacacgtgtcgagtcatttaagctcgagcaaaccgttcccggtgctgaagagcaaaacactggtaagtttaaaagtatggtgccccccccacccgtggcccctgcgccaagccccctcgcccctcccctgccactcgaagaccaatgcatcaccgcctccgatacccccgtagtcttagtatccgtgggtgccgatctgccagtgtcagccctggacccaagccagcttctctgggccgaagaaccaactaatagaactaccctttacagtggtactggactgtctgtgaatagagagaacgcaaagtgcttcactaccaaggaggagcttggcaagactgtgccccaattacttactcccggactgatgggtgaatcttccgaatccttctccgccagtgaagatgaaggtcatcgtgagtatcaggcgaacgactcagactctgacggaccaatactctacactgacgacgaagatgaggatgaggatgaggatggctctggcgaatcagcgttggcctccaaaatcagaaggagagacacactggctattaagctcgggaaccgccccagtaagaaggagctggaagacaagaacatactacagcggacctcagaagaagagcgccaagagattcgacagcaaattggaaccaagctcgtgagacgcctgtctcaacgccctactacagaagagctggagcagcgtaacatccttaaacagaagaacgaggaggaagagcaggaggccaagatggagctgaaacggcggctcagccgcaagctatccctgcgcccaacagtggcagaactgcaagcgaggagaattcttaggtttaacgagtatgttgaggtaactgatagtcccgattacgaccggcgagccgataagccttgggcccgcctcaccccagctgataaggctgccatccgcaaagaactgaatgaatttaaaagcacagagatggaggtgcacgaggaaagtaggcaattcaccagatttcataggccctag

SEQ ID NO: 49416 - DNA, 537 bp, Artificial Sequence
  Description of Artificial Sequence: Synthetic coding sequence
atgggccagaccagcgtgagcaccctgagcccccagcccggcagcgttgacgggcttgacaaggcctctattgccaattcagacgggcctactgctggatcccaaacaccacctttcaagagaaaaggtaagctgtccactattggcaagatctttaagccttggaaatggagaaaaaagaaaacatccgacaaatttagagagacaagcgccgttttggaacggaagatttccactcgacaatcaagggaggagctcatcaggaggggagtgttgaaggagttgcccgaccaggccggatcatcgcacagcaagaagacaaccggatccaaagcctctgcttcccctagtacaagctcaacctccagtagacctaaagcttctaaggagaccgttagctccaaggccgggactgtcggcaccactaaagggaagaggaagacagacaagcagccaataacctcccatctcagctctgatacgacaactagtggcacctctgacttgaaaggagagccagccgaaacaagagtgtag

SEQ ID NO: 49417 - DNA, 1905 bp, Artificial Sequence
  Description of Artificial Sequence: Synthetic coding sequence
atggacaacgccgtggacggcctggacaaggccagcatcgccaacagcgatggtcccaccgcaggctcgcagaccccaccatttaaacgaaaagggaagcttagcactattggaaagatatttaagccatggaagtggcggaagaaaaaaacgtcagacaaattccgcgaaaccagcgccgtgttagaaagaaagataagcacccgtcaaagccgcgaagaactcatacggcggggagtgttaaaagagctccccgatcaagacggtgatgttaccgtgaattttgagaacagtaacgggcacatgatacccatcggtgaggaaagcactcgagaagaaaacgtagtaaaatcggaggaagggaatggttccgtctctgaaaaaactcctcccctggaggaacaagcagaagacaagaaagaaaacaccgaaaaccattcggagacccctgccgcgcccgccttgccaccttccgcaccaccaaagccaagacctaaaccaaaaccgaagaagagccccgttcctcccaaaggagcgacagcaggcgccagtcataaaggagacgaagtcccaccaatcaaaaaaaatacgaaggctcctgggaaacaggcccccgttcctccgccaaagcctgcatctaggaacactacacgggaagcagccggtagctcccacagcaaaaaaacgacaggatcgaaggcttcagcgagtccatcaactagttccacttcctcgagaccaaaggcctcaaaggagaccgtttccagcaaagcgggaacggtggggacaacgaagggcaagagaaaaactgataaacagcccatcacgtcccacctgtccagcgatacaactacctccggcacgagtgacctgaaaggcgagcccgctgagactagagtggagtcatttaagcttgaacagaccgttccaggggcggaggagcaaaacacaggtaagtttaagtctatggtccctccaccccccgtggcccctgctccatctcctttggcaccccccctgcctctggaagatcaatgtattaccgcctccgatactcccgtggtgcttgtaagcgtgggcgccgacctgcctgtttccgcactagatccctcgcaactattgtgggcggaagagccaaccaataggaccacactttactctggcacaggcttgagtgtgaatcgcgagaacgctaagtgtttcacaaccaaggaagaattaggaaagactgtaccgcaactcctcacccccggtctgatgggcgagagctcagagagcttcagcgcaagcgaagatgaggggcacagggagtaccaagctaacgactcagactctgacgggccaatcttgtacaccgatgatgaagacgaggacgaggacgaagacgggagtggagagagtgcgctggccagcaaaattcgccggagagacactcttgcaatcaaattagggaatcgcccgagtaagaaggagttggaagacaagaatattctccagcggacgtctgaggaagagcgacaggaaattcggcagcagattgggactaagcttgtgaggaggttgtcacagcggcccacaactgaggaacttgaacagagaaatattcttaagcagaagaacgaggaagaggagcaagaggctaaaatggagctgaagaggcggctgtccaggaaactcagtttaagaccaacagtggccgagttgcaggccagaagaattctgagattcaacgaatatgtagaagtgacagattctcctgactacgacaggcgggccgataaaccctgggctagactgaccccggccgacaaagctgcgattaggaaagaacttaacgagttcaagagcaccgaaatggaggtgcacgaggaatctcgtcaattcacgcgcttccaccgaccatag

SEQ ID NO: 49418 - DNA, 1938 bp, Artificial Sequence
  Description of Artificial Sequence: Synthetic coding sequence
atgggccagaccagcgtgagcaccctgagcccccagcccggcagcgtcgacggcctcgataaggcgtcaatcgccaacagcgacggcccaacggcaggaagccaaacccccccattcaagcgcaaagggaagctgtctaccattggaaaaattttcaagccatggaaatggcgcaagaagaaaacaagcgacaaattcagggagacgtctgccgtcttggagaggaagatttcgacgcgccaatcaagagaagaacttattcgaaggggtgtgctaaaggaactacccgatcaggatggagacgttactgtgaatttcgagaattcaaatggacacatgattcctatcggcgaggagagtaccagggaagagaatgtcgtgaaatccgaggagggtaacggaagtgtatcagaaaagacgcccccgttagaagagcaggccgaagataagaaggaaaacacggagaaccacagtgaaacccccgcagcccctgcactacccccttctgcaccgccaaagccccgacccaaacccaaaccaaagaagtcccctgtaccccctaagggcgccactgccggggccagccacaagggggacgaggtgccacccatcaaaaagaacactaaagcgccgggcaagcaggctcctgtccctcctcccaagcctgcttcacgaaacaccacccgggaagccgccggttcctcccacagcaaaaagactactgggtcgaaggcctccgcctctccttcaaccagtagcacgtcctctagaccaaaggcgtccaaagaaaccgtgtcgagcaaagccggcacagtcggaactaccaaagggaagaggaagactgacaagcagcctattactagccacctgtccagtgatactacaacttcaggcacgtcagacctgaagggggagccagcagaaactagggttgagtcttttaaacttgaacaaacagtgcctggtgcagaagagcaaaacacaggaaaattcaagagcatggtaccaccccctcctgtggcgccagcaccctcacctttggccccccctctcccccttgaggatcagtgtattactgcaagcgacaccccagtcgtcctcgtgagcgtgggcgctgatctgcctgtgtctgctcttgatccatcccaactgctgtgggcagaggagcctaccaatcgcacaacactatatagtggcacgggtctcagtgtgaatagggaaaacgctaagtgctttacaacgaaagaagaactcggcaagacggtaccccagcttctaacccccggactgatgggtgaatcaagcgaatcattctccgccagcgaggacgaagggcatcgggaatatcaggccaatgacagtgatagcgacggacccatcctatataccgatgacgaggatgaagacgaagatgaggacggttcgggtgaaagcgctctcgcctctaaaatacgccgaagggacaccttggctatcaagctgggcaaccgcccatctaagaaggagttagaggacaaaaatattcttcaacggacatcggaggaagaacgccaggaaatcagacagcagatcggaactaagctagtgcgtcgcctgtcacaacggccaacaacggaggagctagagcagcgtaacatcctgaaacagaaaaatgaggaggaagaacaggaagccaaaatggaactgaaacggcgcctaagtaggaaactgagccttagacctacggtcgcagaactgcaggcacgcagaatcctgcggtttaatgagtacgtggaggttacagactctccagactacgatcgccgggccgacaagccttgggcacgactgacacccgcggacaaagccgcgatacgtaaggaactgaacgagtttaagtccaccgaaatggaagtccacgaggagtcgagacagttcactaggtttcacaggccttag

SEQ ID NO: 49419 - DNA, 2139 bp, Artificial Sequence
  Description of Artificial Sequence: Synthetic coding sequence
atgggccaggccgacgtgagccggcccgtgaaccccgacgccgtggaagaggccgatcaacccaccacggagcccgggatggtcctcgattcagtggaggctggagacacaaccccccccaccaagcgcaaaagtaagttctctggatttgggaagatctttaagccatggaaatggagaaagaagaaatcctccgacaagtttaaagagacatccgaggtcttggagcgcaaaatctcgatgagaaagcccagggaagagctcgtgaagagaggagtcctgttagaagatcccgaacagggtggggaggatcccggcaagccctccgacgcaatgctcaagaacgggcatactacacccattgggaatgctaggtcctcttctcctgtgcaggtagaggaggagcccgtacggttggcgagtctgagaaaggctataccagaagaagacttgaaaaagcgactcggatccaccggatctcaacctaatagtgaggccgaatccgttcccgagaatgttccaaaaccccccttactccctcccaagcggcccctgtcaagctcccacgaagccagcgaggggcaggccaaggatgcaacttcttccggtggtaccgccaggttcatcatttcaacctcaatcacaactgcccctgctgcgaccacagccgccacgtctctcgctaagactgtaaaccttagcgtgactcccagtccagcaccgcggacgctgcctgccgcacctgcttccaccaataccaccgcgacccctagcctgacccacatggtgcccgccaagcagccgcctatccctcccccgaagccagcccatcggaattccaaccccgtaatcgctgagctgagccaggctattaactccgggactctactgtctaagcccagtccccctctgcctccaaagcgcggcatccccagtaccagcgtgccaacactagaaagcgctgccgcaattaccacaaaaacaccgtctgacgaacgcgagaagtcaacttgcagcatgggcagtgaattgctccctatgatcagcccacgctccccatcaccgccgttaccaacccacatacctcccgagccccctcgcacccccccgtttccagccaaaacattccaggtggtgcccgagatcgagtttcctccatcactggatctccatcaagagattccgcagcaagaggatcagaagaaagaagtcccgaaacgcatcctggatcagaatttcggggaacctcacataccttctcggttacctccgctgcctctgcatattcggatccagcaggcgctgacatcacctttgcccatgaccccaattctggagggtagccatagggcccattcccttctattcgagaattccgatagcttttccgaggactcctccaccctagggaggacgcgatccctgcccatcacaatcgagatgctaaaagtgcccgatgatgaggaagaagaggaacaaacctgcccatcgacctttagcgaggaaatgacacccacctccgtgatccctaagctcccacagtgtctgcgtgaggaggaagagaaggagtcggactctgactcggagggccctatccagtatcgggacgaggaggacgaggacgagtcttatcaatctgccctcgccaataaagtaaaaaggaaggataccctggcaatgaagctgaatcatcgcccatccgagccagagttaaatttgaacagctggccatgcaaatccaaggaggaatggaacgagatccgccatcagattgggaacacactcattagaaggctaagccaacgacccacacctgaagagctggagcaacgcaatattctccaacccaagaacgaggccgaccgccaggccgagaaacgtgagatcaagaggcgcctgaccagaaaactgtcacagagacccactgtggcagagttactggccagaaagatcctcagatttaatgaatatgtagaagtcactgacgcccaggactacgatcgacgggcggataagccatggactaagctgacacctgccgataaggctgcgatccgcaaggagcttaacgagttcaaaagcagcgagatggaggtgcacgaggagtccaaacactttacgcggtaccacaggccctag

SEQ ID NO: 49420 - DNA, 1938 bp, Artificial Sequence
  Description of Artificial Sequence: Synthetic coding sequence
gagcggcccgccgaggaggccgaccagcccaccaccgagcccggcatggtgctggatagtgtcgaggccggagacacgactcctcccaccaaacggaaatcgaaattttcgggatttggaaagatcttcaagccatggaagtggagaaagaagaaatcctccgacaagttcaaagaaacctccgaagtgttggagaggaagatctccatgcgcaagcctcgggaggagctggtaaagcgcggtgtgctgctggaagaccccgaacagggcggggaagatccggggaaaccctctgatgcaatgcttaagaacggacacacaacccccattggtaatgctcggagctctagccctgttcaggtggaagaagaacccgtgagactggcaagcctgcggaaggcaatcccagaagaagatctgaagaagcggctgggctccaccggctcgcaacccaattccgaagccgagtcagttccggagaatgtgcccaagccaccactgctcccaccaaagcgacctttatcctcttcgcacgaggcaagcgaagggcaggccaaggacgctacctcatccgggggaacagcccgctttattatatcaacctccattaccactgcaccagccgctactaccgcggcaacatcactggccaagacagtaaacctgtcggtgacgccgtccccagctccacgtacgcttccagctgcacccgcatcaacaaacaccaccgctacaccttctctgacccacatggttccagcgaaacaacccccaatccccccacccaagcccgctcaccggaacagcaaccccgtcattgccgaattgagccaggccattaattcaggaaccctgctcagcaaaccaagcccccccctgccaccaaagaggggcattccatctacctcagtacctaccctcgagtccgcggcggccattactacaaaaacccccagcgacgagagagagaaatccacttgttcgatgggatctgaactcctgccaatgatctcgccgagaagtcctagtccccccctgcccacgcacattccgcccgagccacctcgcacaccaccattccctgccaagaccttccaggtagttccggaaatcgaattccctccctctttggatctacaccaggagatccctcagcaagaggaccaaaagaaggaagtcccgaaacggatattagatcagaactttggggaaccccacatcccgagcaggcttccgcctcttccactgcacatcagaatccagcaggccttgacatcccccctccctatgacgcccatcctggaagggagccacagggcccacagcctattgtttgagaacagcgacagctttagcgaggacagcagcaccttgggcaggacacgctcactgcccataacaattgaaatgctcaaggtaccagatgacgaagaggaagaggagcagacctgcccatcaacgttctcagaagagatgactcctacctccgtcatccctaagttaccgcagtgcctgagggaagaggaggaaaaagaaagcgattcagattctgaaggtcctatccagtatcgggacgaagaggatgaagatgagagctatcagtctgctctcgcaaataaggtgaaacgcaaggacaccctagccatgaagctaaaccatcgcccctctgaacccgaactgaacctgaactcttggccatgtaagtcaaaggaagagtggaacgaaatccgccaccagattggcaacacattgatacgcaggctctcacaacgcccaacaccagaggaactggagcagaggaacattctgcaacagtatagagtgaagtttggcctgaaaagtctgcttactgaaaaggtgtgggcttctctaggactgtttgtcagcatgttttcgttgaccaatccatctcccgtgttaagtgcccttctgggttag

SEQ ID NO: 49421 - DNA, 2109 bp, Artificial Sequence
  Description of Artificial Sequence: Synthetic coding sequence
atggaggaccccttcgaggaggccgaccagcccaccaccgagcccgggatggtgctcgactcagttgaggccggggatacgacaccaccaacaaagagaaagtcgaagttttccggatttgggaagatctttaaaccctggaagtggagaaagaaaaaaagcagtgacaagttcaaggaaacctccgaggtgctcgagcgcaaaatatcaatgaggaaaccccgcgaggagcttgttaagcgtggggtcttactagaggacccggagcaggggggtgaagaccccggaaaacccagcgacgcaatgctcaaaaatggccacacaacccctattggcaacgcacgttctagcagcccggtgcaggtggaggaagagccggtgcgcctggcaagtttaaggaaagccattcccgaggaggacttaaaaaagcggctaggcagtacaggtagccagccgaattccgaggctgagtccgtgcctgagaatgtacccaaaccccctctcctgccacccaaaaggccgcttagctccagtcatgaggcttcagaaggccaggccaaggacgccacatcatctggcggaacagctcgttttattatcagtacaagcatcactaccgccccagctgctactaccgcagcaacgagcttagccaagacagtcaacctgtcagtgactccgagccccgcgcctcgcacactgccagctgcccctgcttctactaacactaccgccacaccgagcttgacccacatggtaccagccaaacaacctcccatcccgccccccaaacccgcgcataggaattctaacccagttatcgcagaattgtcgcaagccatcaatagcgggacattgctgagtaagccttccccccccctgccgccgaagaggggaattccatccacatcagtgccaacactggagtctgccgccgcgataacaaccaagacgccctctgacgagagagagaaatcaacgtgctccatgggctcagaactattaccaatgatctccccacgctccccttcccctccccttcccacccacatacctccagagcccccccggacccctccgttccctgcgaaaacattccaagtggtgcctgagattgagttcccaccatctctggatctacaccaggaaatcccacagcaagaggatcagaaaaaagaagtgccaaaacgcatcctcgaccagaattttggggaacctcacatacccagccgattgccacctctcccactgcacatcaggatccagcaagctcttacaagcccccttccaatgacacccatcttagaaggatcacatcgcgcccacagtctcctgttcgaaaattcagacagctttagtgaggactcgtcgaccctgggaagaacaaggagcctgccaattaccatcgagatgttaaaagtgccagatgacgaagaggaggaagaacagacctgccctagcacatttagcgaagagatgaccccaactagcgtaatacccaaactcccgcagtgccttcgagaggaagaggagaaggaatctgactccgactcagagggtcctatccagtatagagatgaagaagatgaggatgaatcctaccaatccgccttagccaataaagtgaaaagaaaggacactttggccatgaagctgaatcaccgaccctcagaaccagaactgaatctgaacagctggccctgcaaatccaaagaggaatggaacgagatcagacatcaaatcggaaacaccctgatcagacgcctatcgcagcgtcccactcccgaggaacttgagcagcgcaatatcctacaaccaaaaaacgaggccgaccgacaggccgaaaagcgagaaattaaacgccgactgacaagaaagctgagccagcgccctacggttgcggaattattggcgcgcaaaattctgcgttttaacgaatacgtcgaagtgactgacgctcaggactacgatcggagggccgacaagccctggactaaattaacacccgccgataaggctgctattaggaaggagctgaacgagtttaagtcgagtgaaatggaggttcacgaagagtctaagcacttcacccgctaccaccgcccatag

SEQ ID NO: 49422 - DNA, 804 bp, Artificial Sequence
  Description of Artificial Sequence: Synthetic coding sequence
atgagcggctgcttccccgtgagcggcctgcggtgcctgagccgggatggcaggatggcagcccagggtgcacctcgatttctgctaactttcgactttgacgagactatcgtggatgaaaatagcgacgattccattgtgagggccgcgccagggcagcgcctgccagaatccctgagggccacttatagagaaggcttttacaacgagtacatgcaaagggttttcaaatacttaggcgagcagggggtgcgcccacgagatctgagcgccatatatgaggccataccactgagtcctggaatgagtgacctactgcaatttgtcgccaaacagggcgcgtgttttgaggtcattctgatcagtgatgcaaataccttcggtgtggagagcagtctgagagctgccggacaccactcgctgtttaggaggatcctttctaacccaagcggtccagacgctcgagggctgcttgctctgagaccctttcatactcactcctgtgctcgctgcccagccaacatgtgtaagcacaaggtgttatctgactacctaagagagagagctcacgatggtgttcacttcgagaggctcttctatgtgggcgatggcgccaatgatttctgccctatgggactgctggcgggcggtgatgtggctttcccacgccggggatacccaatgcacagactgattcaggaagctcagaaggccgaaccttccagctttagagcttccgtcgtgccatgggaaacagccgccgatgtcagattgcatctgcagcaggttttgaaatcatgctag

SEQ ID NO: 49423 - DNA, 879 bp, Artificial Sequence
  Description of Artificial Sequence: Synthetic coding sequence
atgtgccagcggctgtggccctggcccgccaaccagcccctgcccggtggccttctgccacgcccactgtctctggcgccttccagctcttcttcctgttgctcgcctccgtgtagccaggacggcaggatggccgcacaaggcgctccccggttcctgttaacgttcgatttcgacgaaaccatcgtcgacgaaaattccgatgacagcatagtccgagccgcaccaggccaacgcctgccagagtccctgcgggctacctatagagagggattctataacgagtatatgcagagagttttcaaatacttgggcgaacagggcgtgcggccaagagatctgtctgcaatctatgaggccataccgctctctcctggaatgtctgacctgctgcagtttgtagcaaagcagggcgcatgtttcgaggtcatactgatatccgatgcgaacaccttcggtgtggagtcctctcttagagcagcaggacaccattctctgttccgccgtatcctgtccaaccccagcggtccggacgctagagggcttctagctctaaggccgttccacacacacagctgtgccagatgccccgccaacatgtgtaaacataaagttctatccgattatctccgggaacgtgcccatgatggcgttcacttcgaacgactgttctacgtcggtgatggtgccaacgatttctgccccatgggcttactggccggtggcgacgtggcttttccgcgtagaggttaccccatgcaccgcctcatccaggaggcacaaaaagcagagccttcctcctttcgtgcgagtgtggtcccctgggaaaccgccgcggacgtccggctccaccttcagcaggtcctgaaatcttgttag

SEQ ID NO: 49424 - DNA, 615 bp, Artificial Sequence
  Description of Artificial Sequence: Synthetic coding sequence
atgagcggctgcttccccgtgagcggcctgcggtgcctgagccgggacggtcggatggccgcccaaggggcgcccagattcctgctcacttttgactttgacgagacaatcgttgatgagaacagtgatgactcaatcgtgcgcgcagcgcccggccagcgcttacccgagtccctgagagcaacttatcgtgaagggttttataacgaatacatgcagcgggttttcaaatatcttggagagcagggtgtgcggccacgcgatctgagcgccatttacgaggctatcccacttagccctggaatgagtgatctgctgcaattcgtggccaaacaaggtgcatgcttcgaagtaatcctcatctcagatgcaaacacgttcggtgtggagtcaagcctgcgcgctgcgggccaccattcgctcttcaggaggatcctgagtaaccccagcggccccgacgcgcgcgggttgcttgcacttcgaccatttcacactcattcatgcgcccgttgcccagcaaatatgtgcaaacacaaggtgttgagcgattatctccgagaaagggctcacgatggcgtgcacttcgaaaggttattctatgttggggatggatag

SEQ ID NO: 49425 - DNA, 336 bp, Artificial Sequence
  Description of Artificial Sequence: Synthetic coding sequence
atgtgccagcggctgtggccctggcccgccaaccagcccctgcccggaggattgctcccccgacctctgtccctcgcaccatccagctcgagcagctgctgttcccctccctgctcccaggatggaaggatggccgcgcagggcgccccaaggttcttgctcaccttcgactttgacgagaccattgtggacgagaactcagatgattcaatcgtgcgtgctgctccgggacagcgcctcccggaatcgctcagagctacttaccgcgaaggcttctacaatgaatatatgcagcgggtgttcaaatacttgggcgagcagggtgtgaggccctag

SEQ ID NO: 49426 - DNA, 879 bp, Artificial Sequence
  Description of Artificial Sequence: Synthetic coding sequence
atgtgccagcggctgtggccctggcccgccaaccagcccctgcccggaggcctgcttccgcggcctctgagcctcgcgccttcttcatccagttcatgctgcagccccccatgcagccaggacggcagaatggccgcccagggcgccccccgctttctgctcacttttgatttcgatgagaccatagtggatgaaaactctgatgactccatagttagggctgccccaggccagagactcccagagagcctcagggccacttatcgggaggggttctataatgaatatatgcagagagtgtttaaatacctgggggaacagggcgtgagaccccgcgatttgtctgcaatttacgaggcaattcctcttagccccggcatgtcagatctgctgcagtttgttgctaagcagggagcatgcttcgaggttattctgatcagcgacgccaacacattcggggtggagtcatcactcagagctgccgggcatcactctctttttcggcgcatcctgtcaaatcccagcggtcccgacgcacgcggactgctggcgctgcgaccttttcacacccatagctgcgcccggtgcccagccaatatgtgtaaacataaggtgttgtctgattatctccgggagcgggcccacgacggggtccattttgaaagactgttctacgtgggggacggtgccaatgacttctgcccaatgggcctgttagctgggggagacgtggcgtttccaaggaggggctatcccatgcacagactgatacaggaagcgcaaaaggctgagccttctagtttccgggcctccgttgttccctgggagactgccgcggacgttagacttcatttgcagcaggtcttaaagagctgctag

SEQ ID NO: 49427 - DNA, 726 bp, Artificial Sequence
  Description of Artificial Sequence: Synthetic coding sequence
atgaagatcctgctggtgttcgacttcgacaacaccatcatcgacgacaatagcgatacctggatagtgcaatgcgcccctaacaagaagctaccgatagaactgagagattcctacaggaagggtttctggactgaattcatgggtcgtgtattcaagtatctgggcgacaaaggtgtccgtgagcacgagatgaaacgcgcagtgaccagtcttccgtttaccccaggtatggtggagctattcaacttcatcagaaagaataaggacaaattcgattgtattatcataagcgacagtaattcagtcttcatcgattgggtgctggaggctgcctcatttcacgatatatttgacaaagtttttaccaatcccgccgcattcaacagtaacggtcatcttaccgttgaaaactaccacactcacagctgtaacagatgcccgaaaaacctgtgcaaaaaggttgtgctgattgagtttgtggataaacagctgcaacaaggcgttaactacacccagatagtgtatataggggatggcggtaatgacgtgtgtcctgtgacgtttctcaagaatgatgatgtggctatgccacgaaagggttatacacttcagaaaactctttcaaggatgtctcagaatcttgagcccatggaatattctgtagtcgtgtggagtagcggggtggatataataagccacctccagtttctcatcaaagactag

SEQ ID NO: 49428 - DNA, 411 bp, Artificial Sequence
  Description of Artificial Sequence: Synthetic coding sequence
atgaagatcctgctggtgttcgacttcgacaacaccatcatcgacgacaatagcgatacctggattgtgcagtgtgccccaaacaaaaaattacccattgagctgcgggacagctataggaagggcttttggactgaattcatgggcagggtttttaagtacttaggcgacaagggcgtaagggagcacgagatgaaaagagctgtcacgtcactgccttttacacctggaatggtcgagctcttcaactttatccgaaaaaataaggacaaatttgactgcataatcattagcgactctaacagtgtgtttatcgactgggtgctggaagctgcctcttttcacgatattttcgacaaggtcttcactaaccctgccgccttcaattccaatggccatctgacggtgtag

SEQ ID NO: 49429 - DNA, 171 bp, Artificial Sequence
  Description of Artificial Sequence: Synthetic coding sequence
atgaagatcctgctggtgttcgacttcgacaacaccatcatcgacgacaacagtgatacgtggatagtgcagtgtgctccgaataagaagctcccgatcgaacttcgcgacagctaccgcaagggtttttggacagagttcatgggcagagtctttaaatatcttggttag

SEQ ID NO: 49430 - DNA, 150 bp, Artificial Sequence
  Description of Artificial Sequence: Synthetic coding sequence
atgaagatcctgctggtgttcgacttcgacaacaccatcatcgacgataactccgacacctggattgtgcagtgcgccccaaataagaagttgcccatagaattgcgtgactcctatagaaaagggttttggaccgaattcatgggttag

SEQ ID NO: 49431 - DNA, 936 bp, Artificial Sequence
  Description of Artificial Sequence: Synthetic coding sequence
atggtgcaggccatcaagtgggtggacgaggtggtgcccgccgccccttatgttaccaccctggaaaccttggataagtataattgtgatttctgcgtgcacggaaatgatatcactcttactgtggatggtagagatacctatgaagaagttaaacaagctgggcggtatcgcgagtgcaagcgaacacagggcgtgtcaacaacagatctggtgggccgcatgcttctggttactaaggcccatcacagctcccaggaaatgagttccgagtatcgcgaatatgccgactccttcgggaagtgtcctggggggagaaacccttggacaggcgtgagtcagttcctgcagacaagtcagaagattattcagttcgcaagcggaaaggaaccacagcccggtgagaccgttatctatgtggccggagcctttgacctgtttcacatcggacatgtggacttcctggaaaaggttcatagattggctgagagaccttacatcatcgcaggactccatttcgaccaggaagttaatcactacaaaggaaaaaactaccctatcatgaatttacatgaacggaccttaagcgtcctggcctgccgctacgttagtgaggtggtaatcggagccccctatgctgttaccgctgaactactctcacacttcaaagtagacctggtgtgtcatggtaagaccgagataatccccgaccgggacggcagtgacccctaccaggagccgaagaggcgcggcatcttccgccaaatagactccggtagcaacttgacaaccgacctcattgtgcagcgtatcatcaccaacaggctcgaatacgaggccagaaaccaaaagaaggaggctaaggagctggctttccttgaggccgccaggcagcaggccgcacaacccttaggtgaacgggacggcgatttctag

SEQ ID NO: 49432 - DNA, 1224 bp, Artificial Sequence
  Description of Artificial Sequence: Synthetic coding sequence
atgatccggaacggccggggcgccgccggcggcgccgagcagcccgggcctgggggcagacgagccgtgcgtgtatggtgcgacggctgttacgacatggtgcactacggacactctaatcagctgcgacaagcgcgagcgatgggagattacctaattgtgggggtccacacagatgaagagattgccaagcacaaaggtccaccagtttttacccaggaagagcgatacaaaatggttcaggcaatcaagtgggtggatgaagtggtgcctgctgccccatacgtgacaactcttgaaactctcgataaatataactgcgacttctgcgtgcacggcaacgacatcacactaaccgtggatggcagagacacctatgaagaggtgaagcaggctggcagatacagggagtgcaaaaggacccagggtgtgtccaccacagacttagtcggaagaatgctgctcgtcacaaaagcgcaccactcgtcccaagaaatgtcttcggagtaccgcgaatatgctgatagctttgggaagcccccacatcccattccagcaggagacattctgagctctgagggatgttcacagtgccccggaggtcgaaatccatggacaggtgtgtcccagttcctgcagactagtcagaaaattattcagttcgcctccggaaaggagccccaacccggggagactgttatttatgtggcaggcgcttttgatctcttccatatcgggcacgttgacttcctagagaaggttcacaggttggctgagcgcccttacattatcgctgggctccattttgaccaagaagtgaatcattacaaggggaaaaactatccgattatgaacttacacgagagaacactaagtgtgctcgcctgtcgctacgtgtcagaagtcgtgattggcgcaccatacgcagtgaccgctgagttgctgtcgcactttaaagtcgacttggtttgccacggcaagaccgagatcatacctgaccgagacggtagcgacccctaccaggaaccaaagcggcgcggcatcttccgtcagatcgactccggttctaatctaactacagatctcattgttcagcgcattataaccaatcggcttgagtatgaagcgcgaaatcaaaagaaagaagctaaagaacttgccttcctggaggcagctcgccagcaggcggctcaaccgctcggggaacgagatggtgatttttag

SEQ ID NO: 49433 - DNA, 1170 bp, Artificial Sequence
  Description of Artificial Sequence: Synthetic coding sequence
atgatccggaacggccggggcgccgccggcggcgccgagcagcccggtccaggaggtcgacgagccgttagagtttggtgcgatggatgctacgacatggtgcattatggccatagtaaccagttacggcaggctagggctatgggagactacttgatcgtgggcgtgcatacagacgaggaaatcgctaaacacaaggggcccccagtatttacccaggaagagcggtacaaaatggtgcaagcgatcaagtgggtggatgaggtggtgcccgccgcgccatacgtgactacactggagacactggataagtataattgtgacttttgtgtacacggcaatgatattacactcactgttgacgggcgggacacatacgaggaggtgaagcaggctggccgctatagggagtgcaaacgtactcagggcgtcagcacaactgacctggttgggcggatgctgttggtgaccaaggcgcatcacagctctcaggagatgtcctccgagtatcgggagtacgcagattcttttggtaagtgtccgggaggtcgaaacccctggaccggggtgtcacagtttttacagacgtcgcagaaaattattcagttcgcctcagggaaagaaccccagccaggtgagactgtaatttatgtcgcgggcgcttttgatctcttccatataggtcatgtcgacttcctggaaaaagtccatcggttggcagaacgaccttatatcattgccggacttcatttcgaccaagaggtgaaccactataagggaaagaattaccctataatgaacctgcatgaaaggaccctcagcgtgttagcttgtcgatatgtctccgaggtagtcatcggagccccttacgccgtcaccgctgaactgctctcacatttcaaggtcgacctggtgtgccacgggaagaccgaaatcattcccgacagagacggctcagatccctatcaagagcctaagcgccgcggtatctttcgacaaatcgacagcgggtctaacctgacaacagatctaatcgtgcagagaatcattaccaaccggttagaatacgaagcccgcaaccaaaagaaagaagctaaagagctggcattcttagaagcagcccggcagcaggccgctcaaccactgggtgaaagagatggagatttctag

SEQ ID NO: 49434 - DNA, 1515 bp, Artificial Sequence
  Description of Artificial Sequence: Synthetic coding sequence
atgagcgagaagcagatgaaggaggccttcgtgagcaacctgaacggcaccaccgtactggaaatcactcaggggctgtgctttcctgccttctgcatcctatgccgtggctttttaattattttctcccagtatctgtgctccttctctccaacttggaaaacaaggtttcttacagacttcgttgtactgatcgtgccaatggtcgccactttgaccatctgggcgtctttcatcctgctggaattgctgggagttatcattttcggggccggcctgctctaccaaatttacaggagaaggacatgctatgccaggctgccttttctgaagattctggaaaaatttctgaacattagcctggaaagcgaatacaatccagcgattagttgtttccgcgtgatcacatcagcatttaccgcaattgcaatactggccgtggacttccccctgttcccacgaaggttcgcaaagacagaactgtatggcaccggagccatggacttcggagtgggcggcttcgtctttgggtctgctatggtgtgtttggaggtccgccgtcggaaatacatggaggggagtaagcttcactattttaccaatagcttgtactctgtctggcccttggttttcttgggaattgggcggctggcgataattaagtcaatcggatatcaggaacacttgacagagtatggcgtacattggaacttctttttcaccatcatcgtggtgaaactcatcaccccgttgctgctgatcattttcccccttaataaaagttggattatcgctctgggcatcacagtcctataccaacttgccttagacttcacctctctaaagcgtctcattctctacggaacagacggctctggcactagggtcggactcctgaacgcgaatcgcgagggtatcatcagcactcttggatatgtcgccatccatatggctggcgtacagaccgggctgtatatgcacaaaaaccgcagtcatatcaaggacctgatcaaggtcgcttgcttcctgcttcttgcagccatttcgttattcatcagtttgtacgtggttcaagtcaacgtcgaagccgtaagccgtcgcatggccaacctcgcattctgcatatggattgtggccagcagtctgatcttgctttcaagcctattacttggagatattattctcagctttgctaaattcctcattaaaggagcactcgttccttgcagctggaagttaattcaaagccccgtgacgaataagaagcatagtgaatctctcgttcctgaagcagaaaggatggaacccagtctatgtctaatcaccgccctgaatcggaaacagctgatttttttcctgctcagcaatattacgactggacttatcaacctgatggtggatactctccatagtagcactctctgggccctgtttgtcgtgaatctgtatatgttctccaactgtctgattgtgtacgttttataccttcaggacaagactgtgcagttttggtag

SEQ ID NO: 49435 - DNA, 807 bp, Artificial Sequence
  Description of Artificial Sequence: Synthetic coding sequence
atgctgctgaaggagtaccggatctgcatgcccctgaccgtggacgagtataagatagggcaactttacatgatctccaaacactcccacgaacagagtgacaggggcgaaggcgtcgaagtggtccagaatgagccgttcgaagatccgcaccacggaaacgggcagtttactgaaaagcgcgtgtatctcaatagcaaactgccaagctgggctagagcggttgttcctaagattttctatgtgaccgagaaagcatggaactactacccctataccatcactgagtatacgtgtagttttttgcccaaattcagtattcatatcgagacaaaatacgaagataataagggatccaacgatacaatatttgacaacgaagccaaggacgttgaacgagaggtctgttttatcgacatagcctgcgacgagattcccgaaagatactataaagagagtgaggacccaaaacattttaagtctgagaagaccggtagaggacagctcagggaaggctggagggattctcatcaaccaatcatgtgctcttacaagcttgtaaccgtgaagttcgaagtgtgggggttgcagaccagagtggagcagttcgtgcacaaggttgttcgagacattttgctaatcggtcatcggcaggcatttgcttgggttgatgagtggtacgacatgactatggatgacgtgagggagtatgagaaaaatatgcatgagcagacaaacatcaaagtctgcaaccagcattcttcaccagtagacgatattgagagccacgcacagaccagtacctag

SEQ ID NO: 49436 - DNA, 807 bp, Artificial Sequence
  Description of Artificial Sequence: Synthetic coding sequence
atgctgctgaaggagtaccggatctgcatgcccctgaccgtggacgagtataaaattggacaactttacatgatctcaaaacactcacacgaacaatctgatcgcggtgaaggcgtggaagtggtccagaatgagcctttcgaagatccccatcatggaaatggacaattcacagagaaacgggtgtaccttaacagcaaactcccaagttgggcgcgcgctgtggttccaaagattttttatgtgactgagaaggcatggaactattacccatacacaatcaccgaatataaatgctcctttttgcccaagttcagcatacatatagaaactaaatatgaggataataagggtagcaatgacacaatctttgacaacgaagctaaagatgtggagagagaggtctgcttcattgacatagcatgcgacgagattccggaaagatattacaaggagtccgaggaccccaaacactttaaaagcgaaaagacaggcagaggccagctgcgcgagggctggagagactcccatcagccgattatgtgcagctacaaacttgtaacagtgaagtttgaggtgtggggtcttcagacgagagtggagcagttcgtacacaaggtggtacgggatattcttctcataggccacaggcaggcattcgcctgggtagatgagtggtacgatatgacaatggacgacgtgagggagtacgagaagaatatgcatgagcaaaccaatatcaaagtgtgtaatcagcactccagccctgtggatgacattgagtcacatgctcagacctctacatag

SEQ ID NO: 49437 - DNA, 999 bp, Artificial Sequence
  Description of Artificial Sequence: Synthetic coding sequence
atgctgctgaaggagtaccggatctgcatgcccctgaccgtggacgagtataagattggacagttatacatgataagcaaacactcacacgagcagagcgatcgcggagagggcgtggaagtggtgcagaatgagcccttcgaggacccacaccacggtaatggccagtttaccgaaaagcgagtttacttgaacagcaagttgccatcttgggctcgggcagtggtaccaaaaatcttctatgtgactgagaaggcctggaattactatccctacaccataacagaatataagtgtagctttcttcccaagttcagtatccacatcgaaacgaaatatgaggataataagggaagcaacgatacgatcttcgataacgaagctaaagacgtcgaaagggaggtgtgctttatcgacattgcctgcgatgagatccccgagcgttactataaggaatcagaggatcctaagcatttcaagagcgagaaaactggacgtggccagctgagggagggctggcgtgactctcaccagcctattatgtgtagctacaaattagttacagtgaaatttgaggtctggggccttcagacccgggtcgagcagtttgtgcacaaagtcgtccgggatatcctgcttattggacaccgacaggcttttgcatgggtggatgagtggtatgatatgacaatggacgaagtccgtgagtttgaaagagcaacccaggaagcaactaacaagaaaatcgggatcttcccaccggccatatcaatttcttctatccctttgcttccgtcaagcgtgagatccgctcccagtagcgcgcctagcacacctctgtcaactgacgctccggagttcctgagtgttccaaaggaccggccccgaaagaagtccgcccccgaaaccctaactctgccagatcccgagaagaaagctaccttgaacctacctggaatgcattcatcagataagccatgtcgccccaagtccgagtag

SEQ ID NO: 49438 - DNA, 801 bp, Artificial Sequence
  Description of Artificial Sequence: Synthetic coding sequence
atgcacaacatcctgaagaagtaccaccagtacatcgtggagtgccacggaattacactgctgcctcaatttctcggaatgtatcgactgaatgttgatggtgtcgaaatctatgtgattgtgacccgcaatgtgttttcacaccgcttgagcgtgtaccgcaaatacgatttaaaaatggccaacttgaaggccacgttcactttcccgaagccaacagggtctactgtggctcgggaggcctccgacaaagagaaggcaaaggagctgccaacactgaaagataacgattttatcaacgaggggcaaaaaatctacatcgatgacaacaacaagaaagtattcctcgagaagctcaagaaagatgtagaattcctagcgcagctaaagctaatggattattcactgttggtgggaatccacgacgtcgagcgcgctgaacaggaagaggtagagtgtgaagaaaatgatggtgaagaagaaggggagagcgacggaactcacccagtgggtactccacctgatagtcccggcaatactctgaacagctcaccgccgctggctcccggggagttcgatcccaacatagacgtctacggcatcaaatgccatgagaactcccctcgtaaggaggtttattttatggcaatcattgacattctcacccattacgatgccaagaaaaaagcagcccatgccgccaaaacagtcaaacacggggcgggagccgaaatctcgaccgtgaatcccgaacagtattctaaaaggttcttagacttcattggccatattctgacctag

SEQ ID NO: 49439 - DNA, 669 bp, Artificial Sequence
  Description of Artificial Sequence: Synthetic coding sequence
atgtggggcgtgaaccacagcatcaacgagctgagccacgtgcagattccagtcatgctgatgccagacgactttaaggcctattccaagatcaaggttgataatcatctgttcaacaaggagaacatgccatctcacttcaaatttaaggaatactgcccaatggtctttcggaatctgagagaacgatttggcattgacgaccaggacttccagaattccttaactcggtctgccccactgcctaatgactcgcaggcacggagcggggctagattccacacctcatatgataagaggtatatcataaaaacgattacatctgaagatgttgcagaaatgcacaacattttaaaaaaatatcaccagtacatagtcgagtgtcatggaattacgttactgccccagttcctcggcatgtaccgattgaacgtggacggtgtggagatctacgtaattgtgactagaaacgtttttagtcaccggttgtcagtatatcgtaaatacgatcttaagggatcaacagtggcccgggaggctagcgacaaagaaaaaagtcccacccccgcgatcgtggtattgccagtccctcatagtgctgcaaccagcgagaaacattgcatcgacccaatgagggtcttgttacacttcagctccagtaattgctag

SEQ ID NO: 49440 - DNA, 1221 bp, Artificial Sequence
  Description of Artificial Sequence: Synthetic coding sequence
atggccacccccggcaacctgggcagcagcgtgctggccagcaagaccaaaaccaaaaaaaagcactttgtagctcagaaggtcaagctgtttcgggcaagtgaccctctcctgtcagttcttatgtggggggtcaaccattccattaatgaactgagtcacgtgcaaataccagtcatgctcatgcctgacgacttcaaggcatactccaaaattaaggtcgacaaccacctcttcaacaaagaaaacatgcccagccatttcaaatttaaagagtattgtcccatggtctttcgcaatctgcgagagaggtttggaatcgacgaccaggacttccaaaattcgctcactcgctcggctccgctgcctaacgatagtcaggccaggagtggggctcgctttcacacgtcttacgataagagatacatcattaagactatcacgtccgaagacgtagctgagatgcataatattctaaagaagtaccaccagtatattgtagagtgccacggcattactctgctgccacaatttctgggcatgtatcgcctaaacgtggatggagtcgagatatatgtcatcgtcacccggaacgtgtttagccaccgactctcagtctaccgcaaatacgacctgaaaggatccaccgtcgcccgcgaggcctcggacaaggagaaagcgaaggaactgcccactctgaaagataatgactttatcaatgagggtcagaagatatacattgatgataacaataagaaggtcttcttagagaagctgaagaaagacgtagaattcctggctcagttgaaactaatggattacagcctgctggtagggatccacgatgtggaaagagccgagcaggaagaggtggagtgcgaggagaatgatggggaggaagagggtgaaagcgatggcactcacccagtgggaacccccccagacagtcctggcaacaccctgaacagcagccccccgctagcccctggggagtttgatcctaacattgacgtttatggcatcaaatgtcacgagaactctccccgtaaggaggtatatttcatggccattatcgacatcctgacccactatgacgccaaaaagaaggccgctcacgccgctaaaactgttaaacatggcgccggtgcggaaattagtacagtgaaccccgaacaatactccaagagatttttagacttcattggacacattctcacatag

SEQ ID NO: 49441 - DNA, 648 bp, Artificial Sequence
  Description of Artificial Sequence: Synthetic coding sequence
atcaacgagctgagccacgtgcagatccccgtgatgctgatgcccgatgattttaaagcctattccaagatcaaagtcgataatcatctgtttaacaaggagaatatgccctcccactttaaattcaaggaatactgcccaatggtgtttcgcaacttgagggaaagatttgggatcgacgatcaggattttcaaaactccctcactcgatcagcacctctgccgaacgattcccaggctcgatccggggcccgctttcatacatcctatgacaagcggtatattattaagaccatcacatctgaggacgttgcggaaatgcacaatatcttaaagaagtatcatcagtatattgtggagtgccatggcatcaccttactccctcagttcctcgggatgtaccgcctaaatgtggacggcgtggaaatctatgttatcgtaacaagaaacgtgtttagccaccgactgtccgtatatcgtaagtacgacttaaaaggatcgactgtcgcgcgcgaggcctccgataaggagaaatccccaacacccgcgatcgtggtacttcctgtcccccactcggcagctacaagtgaaaagcattgcattgatccaatgcgcgtccttctgcacttttctagcagcaactgttag

SEQ ID NO: 49442 - DNA, 228 bp, Artificial Sequence
  Description of Artificial Sequence: Synthetic coding sequence
atcaacgagctgagccacgtgcagatccccgtgatgctgatgcccgatgattttaaagcctactcgaagataaaagtggacaatcatctgtttaataaggaaaatatgcccagtcacttcaagttcaaagagtactgtccgatggtctttagaaatttacgagagcgctttggaattgatgatcaggacttccaggtaagctgtgtctgcaacatatgctttcagtag

SEQ ID NO: 49443 - DNA, 1044 bp, Artificial Sequence
  Description of Artificial Sequence: Synthetic coding sequence
atgctgatgcccgacgacttcaaggcctacagcaagatcaaggtggacaatcatctgttcaacaaagaaaacatgccaagccactttaagttcaaagagtattgccctatggtgttcagaaaccttcgtgagcgctttggaatcgacgatcaggatttccagaattctttgaccagatccgcgcccctgccaaacgacagtcaggcaaggagcggcgcgcggttccatacgagctacgataagagatatatcatcaaaacaatcacctccgaagatgtggcggagatgcacaacattttgaaaaaataccaccaatatatcgtggaatgccacggtatcacactgctgcctcaatttctgggcatgtatcgcctaaatgtggacggcgtcgaaatctacgttatcgtgactaggaatgttttttctcatcgcttaagcgtatacaggaagtacgatcttaaggggagtaccgtggcgcgggaagcttcggataaagaaaaggccaaagagctgccgaccttaaaggacaacgatttcattaatgagggccagaaaatctacatagacgacaataacaaaaaagtatttcttgaaaaacttaaaaaggacgttgaattcctcgctcagctgaagttgatggattactcattgctcgtaggtattcacgacgtggaacgcgctgaacaagaggaggtggagtgcgaagaaaacgacggggaggaagagggtgagtccgatggtactcatcctgtggggacacctcctgatagccccggcaacactttgaattcatctccaccactcgctcctggagagttcgaccccaatattgacgtgtacgggataaagtgccatgagaacagcccccgaaaggaagtttactttatggctatcatcgatatcctgactcactacgatgccaagaagaaagcggcgcacgcggcgaaaaccgttaagcatggggcaggagccgaaatctcaacagtgaatccagaacaatactcaaaacgcttcctcgactttatcggacacatccttacctag

SEQ ID NO: 49444 - DNA, 972 bp, Artificial Sequence
  Description of Artificial Sequence: Synthetic coding sequence
atgggcggccaggtgagcgccagcaacagcttcagccggctgcactgcaggaatgccaacgaggattggatgagcgctttgtgtccaagactctgggatgttcctctgcaccatctgtctattccaggcagccacgacacaatgacatattgcctgaataagaagtcgccaatttctcacgaggagtccaggctgctgcaactcctcaataaagccttgccttgcattacgcgcccagtcgtgctgaaatggagcgtcacacaggccctggacgtgactgaacaactggacgccggtgtcaggtacttggatctgcgcatcgctcatatgctggagggaagcgagaagaacctgcacttcgtgcacatggtctatactacggccctcgtcgaggacaccctcaccgagatcagtgagtggctcgaaaggcaccctagagaagtggttatactggcttgtaggaacttcgagggactgtctgaggacttgcacgagtaccttgtggcgtgcattaaaaacatctttggcgacatgctctgtcccaggggggaagtgccaacactgaggcagctttggtcaagaggtcaacaggtgatcgtgtcttacgaggatgaaagcagcttacgcagacatcacgaactgtggcctggcgtgccttactggtggggaaaccgggtgaagacggaagccttgatcaggtacttggagacaatgaagagctgtggccggcctggcgggcttttcgttgccgggatcaacctgaccgagaatctacaatacgtcctcgcacatccctctgaatctctggagaaaatgactctgccaaatctgcccaggcttagcgcgtgggtgcgggaacagtgtcccggtccagggtccagatgtaccaatattatagcgggagactttatcggagctgacggcttcgtttctgatgtaatcgccttgaatcaaaaactcctgtggtgctag

SEQ ID NO: 49445 - DNA, 972 bp, Artificial Sequence
  Description of Artificial Sequence: Synthetic coding sequence
atgggcggccaggtgagcgccagcaacagcttcagccggctgcactgccgcaacgcaaatgaggactggatgtctgccttatgcccacggctgtgggacgtgccactgcatcatttatctatccctggcagtcacgatacgatgacatattgtcttaacaagaagtcccccatctcccacgaagaatctcgattgttacaactgttgaacaaggcactgccctgtatcacaagaccagtcgtcctgaaatggagcgtgacccaggcgctcgatgtgaccgaacaacttgatgccggagttcgctacttggatctaagaatagcccacatgcttgaagggagcgaaaagaatctgcacttcgtgcacatggtctatacaaccgccctggtggaggacactcttaccgagatatcagaatggctcgagagacacccccgcgaggtggttatcttggcctgtcgcaacttcgaagggctgagcgaggatctgcacgaatatttagtggcatgcattaagaacatattcggagatatgctgtgtccccgaggcgaggtgccaactttacgacagctgtggtcccggggacaacaggttatcgtatcctatgaggacgaatcaagcctccggagacaccacgagctgtggccgggagtaccatattggtggggcaaccgagttaagacagaagccctcatacggtacctggaaaccatgaaaagctgcggccgtcccggcggactcttcgtagcgggcataaatctaaccgagaatctacagtatgtgttggcccatccctccgagtccctcgaaaagatgactttgcccaacctgcctcgcctttcagcttgggtcagggaacagtgccccgggcctggctcaagatgtaccaacattatcgcgggcgacttcattggggctgacgggttcgtatctgacgtgattgccctgaaccagaagctgctctggtgttag

SEQ ID NO: 49446 - DNA, 972 bp, Artificial Sequence
  Description of Artificial Sequence: Synthetic coding sequence
atgggcggccaggtgagcgccagcaacagcttcagccggctgcactgtcgtaatgctaatgaggattggatgtccgctttgtgtccccggctgtgggatgttcctcttcatcacctttctatccccggctcccatgatacaatgacttattgcttgaacaaaaagagtcccatcagtcacgaagagtcaaggctactccagctgctgaacaaagcattaccctgtataactcggccagtggtcctgaaatggtccgtgacccaggctctggatgtaactgaacagttagatgcaggtgtgcgttacttggatctccgaatcgcgcacatgctggaaggctccgagaaaaatctgcatttcgtacacatggtgtatactaccgctctagtcgaggatacattaactgagatctcagagtggcttgagcggcacccacgtgaagtcgtcattctcgcttgtcgaaatttcgaaggactgtccgaggacttgcacgaatatctggtggcttgcattaagaatatctttggagatatgctgtgccctcgcggcgaggtaccaaccttgaggcagctgtggtctagggggcagcaggtaattgtcagttatgaagatgaatccagcctcaggcggcaccacgagctctggcccggggtgccctactggtggggaaatcgtgtcaaaactgaggcccttattaggtacctggagacaatgaagtcctgtgggcggccaggcgggctttttgtggcggggattaacttaaccgagaacctgcagtacgttctggctcaccctagcgagtccctagaaaagatgaccctcccaaatctgcctcgcctttccgcttgggtccgagaacagtgccccgggccaggctcgaggtgtaccaacataatcgctggcgattttataggagctgacggattcgtgtctgatgtcatcgccctaaatcaaaagctgttgtggtgttag

SEQ ID NO: 49447 - DNA, 537 bp, Artificial Sequence
  Description of Artificial Sequence: Synthetic coding sequence
atgggcggccaggtgagcgccagcaacagcttcagccggctgcactgccgcaatgcaaacgaggactggatgagcgctctttgtcccagattatgggacgtgcccctccatcatctctctattcccggttctcatgacacaatgacgtactgcctgaataagaaaagtcctatctctcatgaggagagcagattgttacagctactaaacaaggcactcccatgtataacccggccggttgtactaaagtggtccgtgacacaagcactggatgtgacggaacagctggacgcaggagttaggtacctggatttacgcatcgcccacatgttggagggatcagagaaaaacctgcatttcgtgcacatggtgtatacaacagctcttgtcgaggacaccttgacggaaatttccgagtggcttgaaagacatcctagagaggtcgtcatccttgcgtgtaggaacttcgagggtctatctgaagatctccatgagtacctcgtggcctgcatcaaaaatatattcggagacatgtag

SEQ ID NO: 49448 - DNA, 183 bp, Artificial Sequence
  Description of Artificial Sequence: Synthetic coding sequence
atgggcggccaggtgagcgccagcaacagcttcagccggctgcactgtcgaaacgcaaacgaggactggatgtctgctctgtgccccaggctgtgggacgtccccctccaccacttgtccatacctggatcccacgataccatgacctactgtttgaacaagaagtccccaataagccactag

SEQ ID NO: 49449 - DNA, 525 bp, Artificial Sequence
  Description of Artificial Sequence: Synthetic coding sequence
atgggcggccaggtgagcgccagcaacagcttcagccggctgcactgtagaaatgctaacgaggattggatgtctgctctctgtcctcgcctttgggacgttccactgcatcacctgtccatccccggcagccacgatactatgacatactgtttaaataagaaatcccccatttcccatgaagagtctcggcttctgcagttactgaataaagcccttccttgtattacgaggccggtggtgctgaagtggtccgttactcaggcccttgacgttaccgaacagttggatgccggcgtgcgatatctggatctgcgtatcgcacacatgttggagggttctgagaaaaacttgcacttcgtccatatggtttataccaccgccctcgtggaagacactcttacggagatctcagaatggctggagcgccacccccgtgaagttgtgattcttgcctgtaggaatttcgaaggcctctcggaggacttgcacgagtatctggtcgcctgtataaagaacatctag

SEQ ID NO: 49450 - DNA, 225 bp, Artificial Sequence
  Description of Artificial Sequence: Synthetic coding sequence
atgggcggccaggtgagcgccagcaacagcttcagccggctgcactgccgcaatgctaatgaggactggatgagcgctctgtgtccacgcctctgggacgtccccctgcaccacctgtctatcccaggatcacatgatacaatgacatactgcctgaataagaaatctccgatttctcatgaagagagcaggctgctccaactcctcaacaaggctctgccttag

SEQ ID NO: 49451 - DNA, 267 bp, Artificial Sequence
  Description of Artificial Sequence: Synthetic coding sequence
atgggcggccaggtgagcgccagcaacagcttcagccggctgcactgccggaacgccaatgaggactggatgagcgcactatgcccgagactttgggacgtaccactgcaccacttgagtatccccggctcacacgataccatgacttattgtttgaacaaaaagtcccctatctcccacgaggaaagccgccttctccagttgctgaacaaagcccttccctgcataacacgtccggtggtgcttaagtggtcggtcacccagtag

SEQ ID NO: 49452 - DNA, 525 bp, Artificial Sequence
  Description of Artificial Sequence: Synthetic coding sequence
atgggcggccaggtgagcgccagcaacagcttcagccggctgcactgcaggaacgccaacgaagactggatgagtgcactgtgcccaagactctgggatgtcccactgcatcacctctccataccaggcagccacgacacaatgacctactgtctgaacaagaagagcccgattagtcatgaggaatcacgacttctccaattacttaacaaagctcttccctgtatcacacgcccggtggttttgaagtggagcgtgactcaggccctcgatgtaacagaacagctagacgcaggagtccgatacttggacctgcgcatcgcacatatgcttgagggctcagaaaagaacctgcacttcgtgcatatggtgtacacaaccgctctcgtggaagacacactgacagagatcagtgagtggctggaaaggcatccgagagaggttgtgatcctggcttgtcgtaacttcgaggggttgtcagaggacctacacgaataccttgtcgcatgcattaagaatatctag

SEQ ID NO: 49453 - DNA, 375 bp, Artificial Sequence
  Description of Artificial Sequence: Synthetic coding sequence
atgggcggccaggtgagcgccagcaacagcttcagccggctgcactgccggaatgcaaatgaggattggatgtccgcactctgtccgaggctttgggatgtgcctctccatcacttatcaatcccagggtcacacgatacaatgacctattgcctgaacaagaaatctcctatttctcacgaagagagcagactcctgcagctgctgaacaaggcattgccatgcatcacccgtcccgtggtcttgaagtggagcgttacgcaggctttagacgtcacggagcagttagatgctggtgttcggtacctggacctccgaatcgctcacatgcttgaaggttccgaaaaaaatctgcacttcgtgcatatggtgtag

SEQ ID NO: 49454 - DNA, 915 bp, Artificial Sequence
  Description of Artificial Sequence: Synthetic coding sequence
atgctggccgtgcggaaggcccggcggaagctgcggatgggcaccatatgttcccctaatcccagcggtacgaaaaccagtagtgaagtctgcaatgcggactggatggcttctttgcccccgcacctccacaatcttccgctgtctaacctcgccatccctgggtctcacgactcatttagctactgggttgacgaaaagtctccagttgggccagaccagacccaggccatcaaacgactggccaggatttcactggtaaagaaactgatgaagaaatggtcagtcactcagaatctgacctttagggagcagctcgaagcaggcatcaggtattttgatctgagggtgtcatccaaacctggcgacgccgaccaggaaatctacttcatccacgggttgtttggcatcaaagtctgggacggactgatggagatcgactcatttttgacacagcatccacaagagatcatttttctggattttaaccatttctacgcaatggacgagacccaccacaagtgcctggtactgcgaattcaggaggctttcggcaataagctctgccccgcctgtagtgttgagagtcttaccctccgcacactctgggagaaaaactgccaggtcctcatcttctaccactgccctttttataaacagtacccgtttctgtggcccggcaaaaagatcccggctccctgggctaacaccacctctgtcaggaaacttattcttttcctcgaaaccacgcttagcgagagagcttccaggggctcgttccacgtgagccaggctattctcacgccccgagttaagaccattgcccgtggtctggttggtgggctcaagaacacactggtgcaccgtctcgcactgatacctgtctaccccctacgcttctccagacggtcttag

SEQ ID NO: 49455 - DNA, 918 bp, Artificial Sequence
  Description of Artificial Sequence: Synthetic coding sequence
atgctggccgtgcggaaggcccggcggaagctgcggatgggcaccatctgcagccccaacccttctggaaccaagaccagtagcgaggtttgtaacgccgattggatggcttcgttaccgccgcacctgcataacctgccgctgtcaaatctggcaatcccaggaagccatgattccttcagctattgggtagacgaaaagtcacccgtcggaccggatcagactcaggcgatcaagcgactggcccggattagcctagtgaagaagctgatgaaaaaatggagcgtgacccagaatcttaccttcagagagcagctcgaggccggcattcgttattttgatcttcgcgtgtcctcaaaacctggggacgcagatcaagagatctattttattcatggtctgttcggaatcaaggtgtgggatggtcttatggagatcgacagcttcttgacacagcatcctcaggagataatattcctggattttaatcatttctacgcgatggatgaaactcaccataagtgcctggttcttagaatccaagaggcgttcggaaataaattgtgccccgcgtgctccgtcgagtcgctgacattgaggaccttatgggaaaaaaactgccaggtgttgatcttttaccactgccctttttacaagcagtaccccttcctgtggcctggtaaaaagattcctgcaccctgggccaacactacctcagttcgaaagctcatccttttccttgagacaaccttatctgagcgggctagccgtggctcatttcatgtttcacaggcaatcctgacaccgcgcgtgaaaactatcgccagaggtttggtgggagggttaaagaatacattagtccatagcaatcggtggaatagccacggacctagtttactgagccaggagaggtcatag

SEQ ID NO: 49456 - DNA, 966 bp, Artificial Sequence
  Description of Artificial Sequence: Synthetic coding sequence
atggccagcagccagggcaagaacgagctgaagctggccgactggatggcaacattgccagagagcatgcactcgattcctctcacaaacctggccatcccgggctcacatgattccttcagcttctatatagacgaggcttctcccgtcggaccggagcagcctgaaacggtgcagaacttcgtgagcgtgtttggcaccgttgccaagaagctgatgcgaaagtggctggcgacccaaacgatgaatttcaccggccagcttggagcggggattcggtacttcgacctgcggatttctacaaagcctcgggatccagacaacgagctgtacttcgctcatggtttattttccgcaaaagtgaacgagggcctagaggagataaatgcttttctgacggaccaccacaaggaggttgtgtttctggacttcaaccacttttatgggatgcaaaagtatcatcatgaaaaactcgttcagatgttgaaagacatctatggcaacaagatgtgccctgccatctttgcccaggaagtgtccctaaaatatctctgggagaaggactaccaggtcctcgtgttctatcattcgcctgtagcgctggaggtaccctttttgtggccgggacagatgatgcccgctccttgggctaacaccactgaccctgagaagctgatccaattcttgcaagcctccatcactgaacgccgtaaaaagggatcctttttcatcagccaggttgtcctgacccctaaggcgtctaccgtggtaaagggagtggctagcggcctgagggaaactatcactgaaagggccttgccggccatgatgcaatgggtccggacccagaaacctggagagtcagggatcaatatcgttactgccgacttcgttgagctaggagacttcatatcgactgtgataaagctaaattatgtttttgatgagggagaggctaacacctag

SEQ ID NO: 49457 - DNA, 966 bp, Artificial Sequence
  Description of Artificial Sequence: Synthetic coding sequence
atggccagcagccagggcaagaacgagctgaagctggccgactggatggccaccctgccagaaagcatgcattccatcccactgactaacctggccatcccgggctcccatgattcatttagtttttacatagacgaagcctcacctgtgggtccagaacagcccgagacggttcaaaatttcgttagcgtgtttggtacagttgctaaaaagcttatgcggaaatggctggctactcaaacaatgaattttactggtcagttgggagcaggcatccgatacttcgatttgaggatcagcaccaagcctcgcgatcctgataatgagctgtatttcgcacacgggcttttcagtgctaaggtaaatgaagggctggaagagatcaacgccttcttaaccgaccaccataaagaggttgtcttcttagatttcaatcatttttacggcatgcagaaataccatcatgaaaagctggtacagatgctgaaggacatctacggaaataaaatgtgccctgccatctttgcacaggaagtaagtttaaaatatctgtgggaaaaggactatcaggttcttgtcttttaccactctcccgttgctcttgaggtgccgtttctctggccaggtcaaatgatgcccgcaccctgggccaataccacagaccctgagaagcttattcagtttctgcaggcctcaattacggagcgtcggaagaagggcagtttctttatcagccaggttgtcctgacacccaaagcctcaacggtcgtcaagggcgtcgcctcagggcttcgggaaaccatcactgagcgcgcattgcccgccatgatgcagtgggtgcgaacccagaaaccaggcgaatccggaatcaatattgtgacagctgacttcgtggaattaggggactttataagtaccgtaatcaagttgaattacgtcttcgacgagggggaagcaaacacctag

SEQ ID NO: 49458 - DNA, 351 bp, Artificial Sequence
  Description of Artificial Sequence: Synthetic coding sequence
atgggccccaaggaccacatggtgaccagcagcttctgctgccagtctgatggatgcaacagtgcgttcctgagtgtccctcttacaaatctgaccgaaaacggactaatgtgtcccgcgtgcaccgcgtcctttcgcgataaatgcatgggtccgatgacccactgcacaggcaaagaaaaccactgcgtgagcctaagtggacacgtccaggcaggtatctttaaaccgcgattcgcgatgcgggggtgtgctactgaaagcatgtgtttcactaaaccgggtgccgaagtccctacagggacaaatgtcctctttctgcaccacatcgaatgtacgcactctccatag

SEQ ID NO: 49459 - DNA, 615 bp, Artificial Sequence
  Description of Artificial Sequence: Synthetic coding sequence
atgcggctgagccggcggcccgagaccttcctgctggccttcgtgctcctgtgcactctgttaggcctggggtgcccactgcattgtgagatctgtacagcagcggggtcgagatgccacggtcaaatgaagacctgctccagcgataaagatacctgcgtgttgctggtgggcaaggctacttccaagggtaaagagctggtccatacttacaagggatgcatacggtcacaggattgttattccggagtaatcagcaccactatggggcccaaagatcacatggtcacctcttctttttgttgtcagtcagatgggtgtaacagtgctttcttaagcgttccgctcaccaacctcaccgagaatggactgatgtgcccagcatgcaccgcctcctttagagacaagtgcatgggacctatgactcactgtactggcaaagagaaccactgtgtctctctgtcagggcacgttcaggccgggatctttaagccccgatttgctatgagaggctgtgcgacagaaagcatgtgctttactaaaccaggagccgaggtgcctaccgggactaacgtgttattcctccatcacatcgagtgtacccacagtccttag

SEQ ID NO: 49460 - DNA, 2520 bp, Artificial Sequence
  Description of Artificial Sequence: Synthetic coding sequence
atgcgggccaagtgcatcaccgagcccgtgggcatcgagctggccccctgtttgcaggcgccaagcgtgccggaaacagatctgaagggagttgtgcaagctcgaggtggtggggcttcagtattggaaaaacccagggaaggctttaaacgggctgaacaggtacctgtgtcccaaactgactgctttgtgtctctttggttacccactgcaagtcagaagaaactgcgtacacgcaccatttctaactgccccaaccctgagtggaatgagtcgtttaatttccagattcaaagccgcgtgaagaacgttttggagctgtcggtatgcgacgaggacacagtgactcccgacgatcatctgttgacggttctctacgatctgacgaaactgtgtttccggaaaaagacacacgtgaaattccctctgaatccacaagggatggaagaactggaggttgaatttctgctcgaagaatctccctcaccacccgagacactggtgacaaacggagtcctcgtaagcaggcaggtctcttgtttggaggttcacgcacagtcacgccggcgacgcaaacgcgaaaagatgaaggacttactggttatggtgaacgagtctttcgagaatacacagcgggtgcggccatgcctggagccgtgctgtcccaccagtgcatgttttcagactgccgcttgcttccattatcctaagtacttccagtctcaggtccacgtggaggtcccaaagtcccactggagttgcggtctctgttgtcggtcaaggaagaaaggacccatcagtcagccactggactgtttgtccgacggacaagtcatgacgctcccggtcggggaatcttacgaactgcatatgaaatctacgccctgccctgagactctcgacgtgagacttggcttttccctctgcccggccgaattggaatttctgcagaagcgcaaagtggtggtggccaaagcactgaaacaagttttacaactagaggaagatctccaggaagacgaggtgcctctcattgcgatcatggctaccgggggggggactcgcagcatgaccagcatgtatgggcacctgctcggactgcagaaattgaatctgctcgactgcgcgtcctatatcacaggcctgagtggggcaacgtggacaatggcaaccctttatagagacccagactggagctctaaaaacctggagcccgctattttcgaggcacgcagacacgtggtgaaagacaaattgccttccttgtttcctgaccagttaagaaaattccaggaagagctgagacaaaggagtcaggaggggtaccgagttaccttcaccgatttctgggggctgctgattgagacctgtttaggcgacgagaggaacgaatgtaaattaagcgaccagagagccgccctctcctgtggacaaaatccgttgcctatctatcttactataaacgtgaaagatgatgttagcaatcaggattttcgcgaatggtttgagttctccccctatgaggtcggcttgcagaaatacggagcatttattccctctgagctgttcggatcagagttcttcatgggccgcttggttaaacgaattcccgaaagccggatttgctacatgctaggtctgtggagctctatctttagtctcaatttgcttgacgcatggaacttgagccacacctccgaggaattctttcataggtggacacgggaaaaagtccaggatatagaggatgagcccatcttaccggaaatcccaaaatgcgacgccaatattcttgagacaacagtggtgatccctggatcctggctaagtaacagctttcgcgagattctcacccaccgcagctttgtgtcggagttccacaatttcctgagcgggcttcaactgcacaccaactacttgcagaacggccagttttccaggtggaaggacacggtccttgacggctttccgaatcaacttaccgagagcgctaatcacctttgcctgctcgatactgcgttcttcgtcaactcctcgtatcctcccctgctccggcccgagcgtaaagcggatcttattatccatcttaactactgtgctgggagccagaccaagccacttaaacaaacttgcgaatattgcacagtgcagaacattccctttcctaaatacgagctccctgacgagaacgagaacctgaaagagtgctatctcatggaaaacccacaggagccagacgccccaattgtgacctttttccccctcatcaacgacacattcaggaaatataaagcacccggcgtcgaacgatcacctgaagagctggagcaggggcaggtggatatctacggcccgaaaacaccgtacgccactaaagagctgacgtacacagaagctaccttcgataagttggttaaactgtccgagtataatattttaaacaataaagacaccctacttcaggcgctacggctggccgtggaaaagaagaagaggctgaaaggacagtgtcctagttag

SEQ ID NO: 49461 - DNA, 2388 bp, Artificial Sequence
  Description of Artificial Sequence: Synthetic coding sequence
atgaccagcggcgccacccggtaccggctgagctgcagcctgcggggccacgaactcgatgtgcgggggctggtgtgctgcgcttatccccccggtgctttcgtgtcggtgtccagggacaggaccacccggctctgggcgcccgattcacctaatagatcctttaccgagatgcactgcatgagcggtcactcgaatttcgtgtcttgcgtttgtataattccttcttctgacatttatccgcacggactgatcgctaccggtggaaacgaccacaatatatgtattttcagcctagactcccctatgcctctgtacattctgaaggggcacaagaataccgtctgttctctgtcgtctggcaagttcggcactctgctgtccggtagttgggatactaccgctaaggtttggctcaacgacaaatgtatgatgacactgcagggccacactgccgctgtttgggccgtgaagatcctgcccgaacagggtctaatgctgaccgggtctgcagataaaaccgtgaagctttggaaagcaggcagatgtgagaggaccttctcgggtcacgaagattgtgtgcgcgggttagccattctgagtgaaaccgaattcctgagctgtgccaatgatgcatccatccggcgttggcagatcacaggggaatgtctcgaggtttactacggccatactaactacatttattctatttcagtgtttcccaactgccgtgatttcgtgaccacagcagaagatcggtcactccgaatctggaagcatggagaatgtgcccagactatccggcttccagcccagtccatatggtgctgttgcgtgctcgataacggagatattgtcgtgggggcaagtgacggaattattagagttttcaccgagagtgaggaccggaccgcaagcgctgaagaaatcaaagcattcgagaaagagctgagccacgccactattgatagtaagacaggagatctgggcgacataaatgccgagcagcttccgggccgggaacacctgaatgaaccaggaacccgtgaaggacagactcggctcatccgggatggcgaaaaagtggaggcatatcagtggtctgtgtccgagggcagatggatcaagattggagatgttgtgggctcgagcggcgccaaccagcagactagtggaaaggtgctctacgagggcaaggagtttgattatgtgttctctattgacgtcaacgaagggggcccttcttataaactcccctacaatacaagcgacgatccttggctgacggcctacaattttttacagaaaaatgatcttaacccaatgtttctcgaccaagtggccaagtttataatcgacaacacaaaggggcaaatgcttggcctaggcaacccatctttctccgacccctttaccggcggcggacggtacgtccctggctcatcgggcagcagtaacacgctccccaccgcagatccctttactggcgccgggcgctacgtgcctggcagtgccagcatgggtactactatggctggtgttgatccgtttaccgggaactccgcataccgaagcgcagccagtaagaccatgaatatttactttcccaagaaagaagctgtaacctttgaccaggctaatccgacacaaatcctgggcaagctgaaggaactaaatgggacagcgccagaggagaagaagctaaccgaagatgacttaatccttttagagaaaattctgtctctcatttgcaactcctctagcgagaagcctacagttcagcagctacagatcctgtggaaagcaattaattgtcctgaagatatcgtttttccagcacttgacattctacgactgagtataaagcacccaagtgtgaacgagaacttttgcaacgagaaggagggggctcagtttagcagccatctaatcaatctcctcaatcctaaagggaagccagccaatcagctgctcgcactgcggaccttctgcaattgcttcgtaggtcaggctgggcaaaagcttatgatgtcgcagcgggaatcactaatgtctcacgcaatcgagctgaaaagtgggtctaacaagaacatccatatcgcgctggcaactttggccttaaactatagtgtatgtttccataaagatcataacatcgaagggaaggcccagtgtctgtctctcatctccaccatactcgaagtagtccaggacttggaagcaacctttcgccttcttgtcgccctggggacattgattagcgatgacagcaacgcagtacaactggccaaatccctgggggtggattctcaaattaaaaaatattcctcagtgtccgagcctgccaaggtgtcagagtgctgtagatttattctgaatctgttgtag

SEQ ID NO: 49462 - DNA, 2367 bp, Artificial Sequence
  Description of Artificial Sequence: Synthetic coding sequence
atgctgtgcggccggtggcggcggtgccggcggccccccgaggagccccccgtggccgcacaggtggctgctcaggtggcagcccccgtggccttaccaagtccccctactcccagcgatggaggtacaaagagaccaggtttacgggcactaaagaagatgggcctgacagaggacgaggatgtgcgtgccatgcttaggggatctcggctccgaaaaatccgatctagaacatggcataaagagaggctctacaggctgcaagaagatggcctgtctgtgtggttccagcggaggattccacgggcaccgtctcaacacattttcttcgtgcagcacatcgaggccgtgagagaaggccaccagtcagagggcctcaggaggtttgggggtgcctttgctcctgccaggtgcttgacaatcgctttcaagggcagacgcaaaaatcttgatctagcggcgccaacggctgaggaggctcaaagatgggtccgcggccttactaagctgagggctaggctagacgcaatgtcacaaagagagagattagatccgtggatccatagttacttgcaccgcgctgacagtaatcaggactccaagatgtctttcaaagaaattaaaagtttactgcggatggtgaatgtggatatgaatgatatgtatgcatatctgctgttcaaagaatgcgaccacagtaataacgaccggctggaaggcgctgaaattgaagagttcctgcgccgcctgctgaagcggcctgaactagaggagatttttcaccagtatagcggcgaagatcgcgtgcttagcgccccagaactgttggagtttcttgaggatcagggggaagaaggggccacactggccagggctcagcaacttattcaaacatatgagctcaatgagacagccaagcagcatgaattaatgaccctcgacggttttatgatgtacctcttatcccccgaaggagcagcactggataatacccatacctgcgtgtttcaggacatgaatcagccccttgcacactatttcatcagctcctcccacaacacttatcttactgactcacagatcggtggcccatcttccacggaggcctatgacagggctttcgcgcagggatgtagatgcgtggaactggactgctgggagggacctggcggggagcccgtcatttatcacggtcacaccctgacttctaagattctgttcagagacgtggtgcaagcagtgcgagatcatgccttcaccctgtccccatacccagtcattttgtcccttgaaaatcactgtggtttggagcaacaggccgccatggctagacacttgtgcacaattcttggagacatgctggtgacccaggccctggactcccccaatcccgaagagctgccatcacccgagcagctgaaagggagggtcctagtaaaggggaagaagttaccggcagctagatccgaggatggccgggctctctcagacagagaggaggaggaagaggatgatgaggaagaagaggaggaagttgaggccgcagctcagaggcgcctagccaagcagatctcacctgaactcagcgctctggccgtctattgtcatgcaactagactacggttgcaccctgctccaaatgctcctcagccctgtcaggtgtcatccttgagcgagcgtaaagccaagaaattaatcagagaagccggtaattcctttgtgcgtcataacgcaaggcagttaactagagtgtatcccttaggcctgcggatgaacagtgccaattattcaccccaggagatgtggaactctggttgccagctggtggcactgaatttccagacacctggctatgagatggatctgaacgccggtagattcttggttaacggacagtgtgggtacgtgctaaagcccgcctgtctgcgacagccagacagcactttcgatccggagtatcctggccctcccaggacaacactaagtatccaggttcttacagctcaacagctgcccaagctaaacgcggagaagccgcatagtatcgtggaccccctggtaagaatcgaaattcacggcgtacctgccgactgcgcccgacaggaaacagactatgtgttgaacaatggtttcaacccacgctggggccagactctgcagtttcagctgagagcccccgaattagcccttgttcgcttcgttgttgaggattacgacgcaacttcacctaacgacttcgttgggcagtttacactccctctgagctccctcaaacagggatataggcatatccacctccttagtaaagatggcgcctcgctgtcgccagctactctctttattcagatccgcatccagagatcgtag

SEQ ID NO: 49463 - DNA, 144 bp, Artificial Sequence
  Description of Artificial Sequence: Synthetic coding sequence
atgagccagcagaagtgcatcgtgatcttcgccctggtgtgctgcttcgccattctggtggccctaatattctccgccgttgatattatgggcgaagatgaggatgggttgagtgagaaaaactgtcaaaacaagtgtaggtag

SEQ ID NO: 49464 - DNA, 816 bp, Artificial Sequence
  Description of Artificial Sequence: Synthetic coding sequence
atggccagcaaggacgcccagaaccagcggcggggcctgcccggcttcttgcccggagctcctgatcccgaccaaagtcttccggcatcctccaatcccggcaaccaggcatggcagctgagcctgccactccctagcagcttcctgccgaccgttagcctcccacccgggcttgagtacctttcacaactggacctgattatcatccaccaacaggtcgagctgttagggatgattcttggcacagagacatccaacaaatatgagattaagaactcccttgggcagcggatatatttcgcagtggaggagagcatctgctttaaccgtactttctgcagtaccctcaggagctgtaccctgaggataactgataatagcggacgggaagtgatcaccgttaaccgacctttaagatgcaactcttgctggtgcccctgctacttgcaggagttagagattcaagcgcctcccggcaccattgtaggatacgtaacccaaaagtgggacccattccttcccaagttcacgattcagaatgcaaataaggaagatattttaaaaattgttggcccctgcgtgacgtgcggatgttttggggacgtggatttcgaagtgaaaactataaacgagaagctgactatcggcaagatcagcaaatactggagcggattcgtaaatgacgtgtttactaatgccgataacttcggaatccatgtcccagccgatctggatgtgacagtcaaagccgccatgattggtgcttgttttctgtttgatttcatgttctttgaacactccttagcagggttgtag

SEQ ID NO: 49465 - DNA, 816 bp, Artificial Sequence
  Description of Artificial Sequence: Synthetic coding sequence
atggccagcaaggacgcccagaaccagcggcggggcctgcccggcttcttgccaggcgcccctgatccagaccagtccctccccgccagctctaatcccggcaaccaagcctggcagctgtcgttgccactgcctagcagtttcttgccaactgtgtccctgccaccaggcctggaatacctttctcaacttgatcttatcattattcatcagcaggttgaactactcggtatgattctgggtactgagactagcaacaagtatgagattaaaaatagtctggggcagagaatctactttgctgttgaggaatccatatgcttcaacaggaccttctgctccactctcaggtcgtgcacgctgcgaatcaccgataatagtggccgggaggtcattaccgtgaataggcctctgagatgtaatagctgctggtgtccatgctacttgcaggaattagaaatccaggccccacccgggaccattgtgggctacgtcactcagaagtgggaccccttcctgcctaaatttaccatacagaacgctaataaagaggatatcttgaagatcgtgggtccgtgcgtcacttgcggatgcttcggcgatgttgatttcgaggtgaagacaataaatgaaaagttgaccattggcaaaattagtaaatactggagcggcttcgttaatgacgtttttacaaacgccgataacttcgggatccacgtacctgcggacttggatgtgaccgtcaaggcagccatgattggggcatgcttcctcttcgattttatgttctttgagcactccctggccggtctgtag

SEQ ID NO: 49466 - DNA, 3033 bp, Artificial Sequence
  Description of Artificial Sequence: Synthetic coding sequence
atggccgcccgggtgctgatcatcggcagcggcggccgggagcacacactggcatggaagttggcgcagtcccatcacgtgaagcaagtcttggtagcgcccggcaatgctggaactgcgtgttcagaaaaaatctcgaatacagcaatctccatttcagaccacacggccctggcccaattctgtaaagagaaaaagatcgaatttgtcgtcgtcggacccgaggctcctttagctgcaggcattgtgggaaatctgcggtctgctggagttcagtgtttcggaccaactgccgaggcagcccagttagagagcagcaaacggtttgctaaagaattcatggacagacatggaatccctaccgcccagtggaaagcattcactaaacccgaagaggcttgcagtttcatcctctccgccgacttcccagcactagtggtcaaggcctcaggcctggccgctggaaaaggcgtgatcgtggccaagtctaaggaagaagcatgcaaggcagttcaggagattatgcaggaaaaagccttcggcgcagctggggaaactatcgtaatcgaggagctactcgacggcgaggaagtatcttgtctttgttttaccgacggaaagaccgttgctccaatgccgcccgctcaagaccacaagcgcctgcttgagggcgacgggggccctaatacaggaggaatgggagcctattgtccagcacctcaggttagcaacgacctgctgctcaaaatcaaagacacagtactccaacgcactgtggacggaatgcagcaggaggggactccctacacagggatcctgtacgccgggatcatgttgacaaagaatggtcccaaagtattggagttcaattgtcgatttggggacccggagtgtcaggtgattctgcccttactcaaatcagacctgtacgaagtgattcaaagcactctggatgggctcctgtgcactagcctgcccgtgtggctagaaaaccacaccgccctcacggtcgtgatggcttcgaagggatatcctggggactatactaagggcgtggagatcaccgggttccctgaagcccaggcactgggtctagaggtattccatgcaggaacagccctgaagaacggaaaggtggttacacatggaggacgcgtcctggccgtcaccgcaatccgggagaacctcataagtgctctggaagaggctaaaaagggcctggccgcgattaagttcgaaggggcaatttaccgcaaagatgtgggcttccgggcaattgcctttctgcaacagcctcggtccctgacttacaaggagtctggagtggatattgccgcagggaatatgttggttaagaagattcaacctttagctaaggccacttcacgctctggctgtaaggttgatctcgggggctttgctggcctctttgacctgaaggctgcgggtttcaaggacccgctgctggctagcggtacagacggtgtcggaacaaaattgaagatcgctcagctgtgtaacaagcacgacacaattggtcaggacctggtggcaatgtgcgtgaacgatatcctcgcacagggtgcagaacccctgttctttctcgattacttctcatgtggtaaattggacctgagcgtgacagaagctgtcgttgcaggaatagcaaaggcctgtgggaaagcaggatgtgcgctcctgggcggtgagaccgccgagatgcctgatatgtacccacccggcgaatatgatttggcgggattcgcagtgggtgcaatggagcgcgaccagaagttgcctcacttagaaaggatcacagagggtgacgtcgtcgttgggattgccagttccggtctgcattccaacggtttctcgttagtgagaaagatcgtggccaagagcagtctccagtattcatcaccggcacctgatggctgcggcgaccagacactgggcgatctcctcttaaccccaacccgtatctattcacatagtctgttgcctgtactaagatccggccatgtgaaggcgttcgctcatataacggggggagggcttttagagaacattccgcgagttctgccggaaaagctcggagtggacctggacgctcagacatggcgcattccaagggtattctcttggcttcagcaggagggccacttgtcggaagaggaaatggccaggacatttaattgcggagtcggagccgtcctcgtggtgagcaaggagcaaaccgagcaaatcctgcgggacatccagcagcacaaggaagaagcatgggtcataggctcggtggttgctagagctgagggttcccctcgtgtcaaagtcaagaacctaatcgaatctatgcagataaacggatcagtgctgaagaacggctcgcttacaaaccacttcagcttcgagaaaaaaaaggcccgggtcgctgtcctgatctcagggaccggatccaacctgcaagcactcattgattcaacacgagagcccaattcttccgcccagatcgatattgtaattagtaataaagcagctgttgccggcctggacaaggcagagcgcgcaggaatcccaacccgcgttattaatcacaaactgtataagaatagagtggaatttgacagcgccatcgacctggtgctggaggagttcagcatagatattgtctgtctcgcggggttcatgaggatcctgagcggtccattcgtgcagaaatggaacggcaaaatgttgaacatccaccctagcttactcccatcttttaaaggctcgaatgcccatgagcaggctctcgaaacgggagtgacagtgaccggctgtaccgtacacttcgttgctgaagatgtggatgccggacagattatcctccaggaggccgtgcccgttaagagaggggataccgtggcaactctgtctgagagagtgaaactggccgaacacaagatatttccagccgctctgcagctggtcgcctcaggaacagtgcagctgggggaaaacggcaagatatgttgggtgaaggaagaatag

SEQ ID NO: 49467 - DNA, 3033 bp, Artificial Sequence
  Description of Artificial Sequence: Synthetic coding sequence
atggccgcccgggtgctgatcatcggcagcggcggccgggagcacaccctcgcttggaagcttgcccaatctcaccacgtgaaacaggtacttgtggctcctgggaacgctggtaccgcctgcagtgagaagatctccaacaccgcgatcagcataagtgaccatacagcactggctcagttctgcaaggaaaaaaaaatagaatttgtggtggtcgggcccgaagccccactagctgctggaatcgtgggaaatctccggagtgccggggtacagtgtttcggtccaaccgccgaagcagcccagctggagtctagcaagaggttcgcaaaagagttcatggacagacacggcatccctacggcacaatggaaggcttttacgaaaccagaggaagcatgcagcttcatcctttctgccgattttcccgctctcgttgtcaaggcgagcggcctggccgcaggaaagggggtgatcgtggcaaaatccaaagaagaagcgtgcaaggccgtgcaggagattatgcaggaaaaggccttcggagctgcgggggagacgattgtcatagaggagctcctggatggtgaagaggtgtcttgtctgtgtttcacagatggtaaaacagtggcaccaatgccgcccgcccaggaccataaaaggctgcttgaaggcgatggaggtcccaacactggcggcatgggagcatattgtcctgctccacaggtctctaatgatcttctgctcaaaataaaagacactgtattgcaaaggactgtggatggaatgcagcaagaagggacaccttacaccggaatcttgtatgctggcataatgctgaccaagaatggccctaaggtgctggagttcaactgcagattcggcgatcccgagtgccaagtgatccttcctctgctgaagagcgacctctatgaggttatacagtctaccttggacggcctgctctgcacaagcctacccgtgtggctcgagaaccataccgcccttaccgtggttatggctagtaaaggctatcccggcgactacactaagggtgtagagattacaggcttccccgaagcccaagccctggggcttgaagtgtttcatgctggcactgccttgaaaaacgggaaagtggtcacacacgggggccgtgtgttggccgtcacagccattcgtgagaacttgatttctgccctggaggaggccaagaagggcctggctgcgataaagtttgagggtgctatctacaggaaagatgtcggctttcgcgccatcgccttcctgcagcagccacgttctctcacatataaagagagcggagttgatatagcagccggcaacatgcttgtcaagaaaatacagccccttgctaaagccacctctcgatccgggtgtaaagtggacctcggcggtttcgctggactctttgacctgaaggccgccggttttaaggaccctctgctggcttccggtacagatggtgttggcaccaagttaaaaatagcacagttgtgtaacaaacatgacactattggccaggatctggtggcaatgtgtgtgaacgacattcttgcacagggggcagaaccactattcttcctggattacttcagctgcggcaaactggacttgagcgtgactgaggccgtggttgcaggcatagcaaaggcatgcgggaaggccggatgtgcgctcctcggcggagagacagcagagatgcctgatatgtaccctccgggggaatacgatctggcaggcttcgccgtaggggccatggagcgggaccagaagctgcctcatctggaaaggattactgaaggggatgtagttgtgggtatcgcttctagcgggctgcactctaacggattttcattggtgaggaagatagtcgcgaaaagttctctccaatacagtagccccgcccccgatggctgtggtgaccagacattaggcgatttgttgctgacccctacgcgtatctacagtcactcactgcttccagtgctgcgatccgggcacgttaaagcgtttgcacacattacgggcgggggccttctggagaacatcccacgggtcctgccggagaagttgggtgtcgacctagatgctcagacctggaggattccaagggtcttttcttggttgcagcaagaagggcatctcagcgaggaagagatggccaggaccttcaattgcggtgtgggggcagtcctcgtggtgtctaaagagcagactgagcagatcctaagagacattcaacagcataaagaggaagcttgggtgatcggaagcgtcgtagctcgagctgaggggtcacctagggttaaggtgaaaaaccttatcgagtccatgcagattaatggcagcgtgcttaaaaatggatccctcaccaatcatttttcttttgaaaaaaagaaggccagagtcgccgtccttatcagtggaacgggcagcaacctacaagccctgattgattctacaagggagcccaactcttcagctcagattgatatagtgataagtaacaaagcggctgttgctggtttggacaaagcagagcgcgctggtatccctacccgcgtgattaatcacaaactttacaagaatagagtcgaatttgactcagcaatcgatctcgttctcgaggaattttccattgacatcgtgtgcctcgccggatttatgcgtatcctttcaggtccgttcgttcagaagtggaacggcaaaatgctcaatattcatccctctctcctcccctccttcaagggcagcaacgctcacgaacaagcacttgagaccggcgtgaccgtcacggggtgcacggttcacttcgtcgcagaggatgtggatgctggtcagataattctccaggaagccgtacccgtcaagcggggcgataccgttgcgactctttccgagcgagtgaagttggcagagcacaaaatttttcctgccgccctacagttggtcgctagcggtactgttcagctgggggaaaatggtaagatctgctgggtgaaagaagagtag

SEQ ID NO: 49468 - DNA, 3033 bp, Artificial Sequence
  Description of Artificial Sequence: Synthetic coding sequence
atggccgcccgggtgctgatcatcggcagcggcggccgggagcacaccctggcgtggaaactcgctcagtcccatcacgtcaagcaggtcttagtggcccctggcaatgccgggaccgcttgttctgaaaaaatcagtaatactgccataagcatttctgatcacactgctctggcccaattttgcaaagagaaaaaaatcgagtttgtggtcgtgggaccggaagccccattggctgccggtattgttggcaacctccgctctgccggcgtgcagtgtttcggacctaccgccgaggccgcgcaactggagtcctcaaagagattcgccaaggagttcatggacagacacggaatcccaaccgctcagtggaaggccttcactaagcctgaggaagcctgttctttcattctcagtgccgacttccccgccctcgtagttaaagcctccggactcgcggctggcaaaggagtgattgttgccaaatccaaggaagaggcctgtaaggctgtgcaggagataatgcaagagaaggcctttggtgccgctggggagaccattgtgatcgaagaattgctggacggggaggaggttagttgcctctgctttacagacgggaaaaccgtggcacccatgccccccgctcaggaccataaacggttgctggagggcgatgggggacctaatactggcggaatgggggcttactgcccagctccccaagtctccaacgatcttctccttaaaattaaggacactgtcctccagcggactgtagacggcatgcagcaggagggtaccccttacactggcattctgtacgccggaattatgctgacgaaaaacggacccaaggtcctcgagttcaactgtaggttcggtgatccagagtgccaggtcatcttaccgctgctgaaatctgatttgtacgaagttattcaatcaaccctggacggcctgctgtgtactagtcttccagtgtggctcgaaaatcacaccgcgttaacagtcgtcatggcctctaagggttatcctggagactacactaaaggagtcgagataactggattccccgaggctcaggctctcggacttgaggtgttccacgcaggaacagctctgaaaaacggaaaagtcgtgacccacggcggacgagtcctggctgtgactgcgattcgggaaaatctcatcagcgcactggaggaggccaaaaaaggcctcgctgcgattaaattcgagggggcaatttacagaaaagacgtgggattccgcgccatcgcctttttgcagcagcctagatcactgacatacaaggagtccggcgtagacatcgccgcaggcaacatgctggttaaaaaaattcaacccctggccaaggccacatctaggagcgggtgcaaggttgaccttggtgggttcgccggcctcttcgacctgaaagcagctgggttcaaagaccctctcttggctagcggcactgacggggtcgggactaagcttaagatcgcccagctgtgtaataaacacgatacgatcggacaggacctagtagccatgtgtgtaaatgatattcttgctcagggcgcagagccattgttcttcctggattacttttcttgtggaaagctggacttatccgtcaccgaagccgtagtcgctggtatagccaaagcgtgcggcaaggctggttgcgcattgctgggtggcgaaaccgctgaaatgccagatatgtaccctccaggggagtacgatcttgcaggtttcgcggtcggagctatggaacgagaccagaaactgccacacctggaaagaatcactgagggagatgtagttgttggaatagcgagctccggactccattccaatggattttcgctcgtgagaaagatagtcgcaaagtccagcctccagtactcttcccctgcccccgatggatgtggggatcagaccctgggcgatttgctgctgaccccaacgaggatctatagtcacagcctgttacctgttctgaggtccgggcacgttaaggcttttgctcacattaccggtggcggcctcctggagaacatcccccgggtcttgccagagaagcttggggtcgacctggacgcacagacatggcgcatacctagagtcttctcttggctacaacaggagggacacctcagcgaggaggaaatggcacgcacatttaattgcggcgttggagcggtcctggtcgtgtccaaggagcagacagaacaaattctccgggatatccagcaacataaggaagaagcgtgggttatcggaagcgtggtggcccgggccgaaggaagccctcgggttaaggttaagaatctgatcgagagcatgcagatcaacggatcagtgctgaagaacggaagcctcacaaaccacttctccttcgaaaaaaagaaggctcgtgtggcagtgctgataagcggcaccggttctaacttgcaggccctaattgattctacgcgtgaacccaattcgagtgcccagatagatattgtaatcagcaataaggccgccgtcgctggcctggacaaggccgagcgggccggcatccccacacgcgtcatcaaccataagttatacaagaatcgggttgagttcgatagcgcgatcgacctggttctggaggagttctctatcgacattgtctgtttggccgggttcatgcgcatcctgagcgggccattcgtacagaagtggaacggtaagatgttgaatatacaccccagccttttgcctagcttcaaaggctccaatgcccacgagcaggcacttgaaaccggagtgacagtcaccgggtgcaccgttcactttgttgctgaagacgtggacgccgggcagatcattctgcaggaggctgtgccagtcaagagaggcgacactgtggctacactgtccgaacgtgtcaagctcgcggagcataagatctttcccgcagcattacagctcgtggcctccggtacggtgcagcttggcgagaatgggaaaatctgttgggtgaaagaagagtag

SEQ ID NO: 49469 - DNA, 993 bp, Artificial Sequence
  Description of Artificial Sequence: Synthetic coding sequence
atggagctgctgagcaccccccacagcatcgagatcaacaacatcacgtgtgattctttcagaattagctgggccatggaggattccgacctcgaaagggtgacccattacttcatcgacttaaacaaaaaagagaacaaaaattccaataagttcaaacatcgcgatgtgcccacaaaactcgtggctaaagcagtgcctctacctatgaccgtccggggccactggttcctgtcaccaaggacagaatactctgtagccgtgcagactgccgtaaagcagagtgacggtgaatacctggtgtccgggtggagtgagacagttgaattttgtacaggcgactatgctaaagagcatctggctcagctccaagagaaggccgagcaaatcgcaggaagaatgttgagattctctgtattctatcgaaatcaccacaaagagtacttccaacatgcccggacacattgcgggaacatgctgcaaccctacctgaaggacaacagtggcagccatggatccccaaccagcggcatgcttcacggagtattcttttcttgcaacacagagtttaacaccgggcagccaccccaggatagcccgtacggccggtggcgtttccagattccagctcagagacttttcaatcccagtaccaatctctacttcgctgatttctattgtatgtatacagcatatcattacgcaatcctggtgcttgcacctaaggggagcctaggagacaggttttgcagggacagactcccattgctggacatagcctgcaataagttcttgacttgctctgtagaagatggggagctggtctttcgtcatgctcaagacctcatcctggagattatctatactgagccagttgacctatctctgggaactctaggggagatctccggacaccagctaatgtctttgtccactgcggacgccaaaaaggatccaagttgcaaaacttgtaacatctctgtaggccggtag

SEQ ID NO: 49470 - DNA, 714 bp, Artificial Sequence
  Description of Artificial Sequence: Synthetic coding sequence
atggagctgctgagcaccccccacagcatcgagatcaacaacatcacctgcgattccttcaggattagctgggcaatggaagatagtgacctggagcgcgtgacccactactttatcgacttaaataagaaggagaataaaaatagcaaccaccataaggaatacttccaacacgcacgcacacactgtggaaacatgctgcagccatacctaaaagacaactccgggtcacacgggtcgcctacctcaggcatgctgcatggagtcttcttctcctgtaacactgagttcaatacggggcaaccccctcaagactccccttacgggcggtggaggttccagattcctgcacagaggctgttcaacccgagcacaaatctgtatttcgccgatttttactgtatgtacacagcctatcactatgcaatcctcgtactcgccccaaaagggagccttggcgaccgcttctgtcgggacagactacctctcctggacatagcctgtaataaatttttaacctgtagcgtcgaagatggggaactggtgttcaggcatgctcaggatctcatcctcgaaattatctatactgagcccgtcgacctctcactcgggacactgggggaaatctcggggcatcagttaatgagtcttagcacggctgatgctaagaaggacccatcttgtaagacgtgcaacatatccgtcgggagatag

SEQ ID NO: 49471 - DNA, 993 bp, Artificial Sequence
  Description of Artificial Sequence: Synthetic coding sequence
atggagctgctgagcaccccccacagcatcgagatcaacaacatcacctgcgactctttccggattagctgggcgatggaggattctgacctggaaagggttacacattacttcatcgacctgaataagaaggagaacaaaaattcaaataagtttaagcatcgggacgttccaacaaaactagttgccaaggcagtgccactccctatgacggtaagaggccactggttcctgtcaccccgcacagaatactcggtggccgtgcagaccgccgtgaaacagagcgatggagagtaccttgtgtccggttggtcggaaaccgttgagttctgtactggtgactatgctaaggagcacttagcgcaattgcaggagaaagcggaacagattgcgggcagaatgctgcgtttctccgttttttatcggaatcaccataaggagtactttcagcatgcccgcactcattgtggtaacatgcttcagccttatctgaaagataactctgggagccatggttcgcccacttctgggatgctgcatggagtcttttttagctgcaacacagaatttaacaccggccaaccaccccaggactccccatatgggagatggcgatttcagattcccgcccagcggctgtttaacccctcaacgaacctatattttgcagacttctattgcatgtacactgcgtaccactacgcaatcctggtcttggccccgaagggatccctgggagatcggttctgtagggataggctgcccctgctcgacattgcttgcaacaagttcttgacatgcagtgtggaagatggagaactagtgtttcgccatgcacaggatttaatcctagagatcatctacaccgaacctgtggatcttagtttgggcaccctaggcgagatttctggccaccaacttatgtctttgtccacagccgacgccaaaaaagatccttcctgcaagacttgtaatatcagtgtcgggcgttag

SEQ ID NO: 49472 - DNA, 894 bp, Artificial Sequence
  Description of Artificial Sequence: Synthetic coding sequence
atggcctgcctgagccccagccagctgcagaagttccagcaggacggctttctcgtcctggaaggatttctgagcgccgaggagtgtgtcgcaatgcagcaacgaatcggcgaaattgtggcagagatggacgtgcccctgcattgcaggaccgagtttagcacccaggaggaggagcagctcagggctcagggcagcaccgactatttcctgagctcaggggacaaaatccgcttttttttcgagaagggtgtgtttgatgaaaaagggaactttctagtccctcctgaaaaatcaatcaacaagattggtcacgccttgcacgcccacgatcccgttttcaaatctattacccacagcttcaaagtgcaaactctagcccgctcactcggcctgcagatgcctgtagtggtccagagcatgtatatttttaaatcccccctgatcagaacgccccccagctgcactcggtccccctgggcgggatgctgggcgtgcggctcacagtggagaatgcccagatggaggactgctgtctctgggagttctctggcccccacaccagttgtgtgccaggaggggtggagcgggcctctcttggcccagcgcctggtcccggcgagtcttggacagtcccagccaggaattaccgcctccctctgtcctccgcagtgtcgcgaaggcccttggagcagctccatggaaaaatggtacacccgagcttcaagaacatcgttgaccgctagagcgaggcccactttgtcaacctcttggcgtccgctcgctcctcccggcgccaggaggactggatcgtcacagcagctcaattgcccttttccgaattgcacaccaaagggcagccggcgggccggcgctcttgctccacctggctag

SEQ ID NO: 49473 - DNA, 813 bp, Artificial Sequence
  Description of Artificial Sequence: Synthetic coding sequence
atggcctgcctgagccccagccagctgcagaagttccagcaggacggctttctggtcctggagggttttctgtcagctgaggaatgtgtggctatgcaacagcgcattggcgaaatcgtcgctgaaatggatgtgcctttgcactgcagaactgagttctctacacaggaagaggagcagcttagagcccagggctcaacagactatttcctctccagcggggacaagatcaggttttttttcgagaagggagtatttgacgaaaagggtaactttttggttcctcccgaaaaaagcatcaacaagatcggccacgctctgcacgcgcacgacccagtttttaaatctatcacccatagctttaaggttcagcagccccacttcggaggcgaggtctcccctcatcaggatgcttcctttctttacacagagccccttgggagagtcctgggcgtgtggattgcagtcgaagatgctactttggaaaacggctgtctgtggttcatcccggggtcgcacactagcggcgtctcccgccggatggtgcgcgccccagtcggtagcgctccaggtacgtcgtttctcggatctgagcctgcccgggataattccctgttcgtccccactcccgttcaacggggagcgctggttctgattcatggcgaggtggtacacaagagtaagcagaacctgagcgaccgctctagacaggcctatacatttcatctgatggaggcgtccgggactacctggagccccgagaactggctgcaacctacagccgagctgccttttccccagctgtacacatag

SEQ ID NO: 49474 - DNA, 876 bp, Artificial Sequence
  Description of Artificial Sequence: Synthetic coding sequence
atggcctgcctgagccccagccagctgcagaagttccagcaggacggcttcctcgttctggaaggtttcctgagtgccgaagagtgtgtcgcaatgcagcaacggatcggcgagattgtggcagaaatggatgttccccttcattgcagaactgagttcagtacccaggaggaggagcagcttagagctcagggatctacggattactttctgtcttccggcgataaaataaggttctttttcgagaaaggggtgtttgacgaaaagggcaacttcttagtgccaccagaaaagtcaatcaataagataggacacgcgctacatgcacacgaccccgtgttcaagtccataacccactctttcaaagttcagactctggcccgcagcttgggcctccagatgcccgttgttgtgcagagtatgtatatctttaaacaaccacacttcggaggggaggtatctcctcatcaagacgcctcttttctgtacacagagcctttaggccgggtgttgggtgtctggatcgccgtcgaggatgcaaccctggagaatggctgcctgtggttcatccctggaagccataccagcggcgttagccggcgaatggtcagagcacctgtggggagcgcaccgggaacttcattcttggggtcagagcccgccagagacaactctcttttcgtgcccacgccagtgcagagaggtgccctggtgctaatccacggcgaggtggtacataagtccaagcagaatttgtctgatcggagtagacaggcttacacgtttcaccttatggaggcatcagggactacttggtccccggagaactggcttcagccaacagctgagttgccatttccacagttgtacacttag

SEQ ID NO: 49475 - DNA, 201 bp, Artificial Sequence
  Description of Artificial Sequence: Synthetic coding sequence
atggcctgcctgagccccagccagctgcagaagttccagcaggacggctttctagtactggagggcttcctctctgcagaagagtgtgttgccatgcagcaacgtatcggcgagatcgttgccgaaatggatgtgcctttacactgccgcacagagttctcgactcaagaggaggaacagctgagagctcaagggtcttag

SEQ ID NO: 49476 - DNA, 813 bp, Artificial Sequence
  Description of Artificial Sequence: Synthetic coding sequence
atggcctgcctgagccccagccagctgcagaagttccagcaggacggtttcttagtactggaggggttcctttcagccgaagagtgtgttgctatgcagcagcgcatcggcgagattgtggccgagatggatgtccctttgcactgtaggactgaattcagcacacaggaggaggagcaactacgtgcccaggggtcaactgactattttctgtcctcgggtgataagattagattctttttcgagaagggcgtgttcgatgaaaaagggaactttctggtgccgcccgagaaatcaatcaacaaaataggccacgcacttcatgctcacgaccctgtgttcaaatccatcacccactcctttaaagtacagcaaccccattttggaggcgaggtctcaccacatcaagacgcttcatttctgtacacggagcccctcggccgcgtcctgggcgtgtggatagctgtggaagacgccaccttagaaaatggctgtctgtggttcatcccaggctcacacacttcaggggtgagcaggagaatggttagggccccagtcggctccgccccaggtacgtcattccttggctcggagcccgccagagataacagcctctttgtgccaaccccagtacagagaggggctctggtattgatccacggcgaggtcgtgcacaaaagtaagcagaatctgtccgacagatccaggcaggcgtacacatttcacttgatggaggcatcaggcacaacctggtcacccgagaattggctccagcccaccgctgaactgcccttcccccagttatacacttag

SEQ ID NO: 49477 - DNA, 534 bp, Artificial Sequence
  Description of Artificial Sequence: Synthetic coding sequence
atggcctgcctgagccccagccagctgcagaagttccagcaggacggatttttggtcctggagggattcttatccgctgaggagtgtgttgccatgcaacagaggattggagaaatcgtggccgaaatggacgtgcctttacactgtcgaacggaattctcgacacaggaggaagagcagctgagagcccagggctctacagattatttcttgagttccggcgacaagatccggttcttcttcgagaagggggtattcgacgagaaggggaattttctcgttccgcccgagaagtctatcaacaagatcggtcatgctttgcacgcgcacgatccagtgtttaaatctatcacccactcatttaaggttcagacgttggcccgctcactggggctgcaaatgccagtcgtggtgcagagtatgtatatattcaagcagcctcacttcggtggagaagtttccccgcaccaagatgcatctttcctctataccgagccactgggccgggtgttgggggtctggattgctgtctag

SEQ ID NO: 49478 - DNA, 195 bp, Artificial Sequence
  Description of Artificial Sequence: Synthetic coding sequence
atggcctgcctgagccccagccagctgcagaagttccagcaggacggtttcctggtgttagaagggttcctgtcagctgaagaatgcgtcgccatgcagcaacgcatcggggaaattgtggctgagatggacgtcccgttgcattgccgcacagaattctcgacacaggaagaggaacagctgagggcccagtag

SEQ ID NO: 49479 - DNA, 1779 bp, Artificial Sequence
  Description of Artificial Sequence: Synthetic coding sequence
atggccagcaccagccgggacgtgatcgccggccggggcatccactccaaggtaaaaagtgcgaaacttctcgaggttcttaatgccatggaagaggaagaatctaataacaatcgggaggagatatttatcgctcctccagataatgctgctggagagttcaccgatgaggattcgggcgacgaggattcacagcggggggcacacctgcctggatccgttctgcatgcctccgttctgtgcgaggacagcggaacaggcgaggacaatgacgacttagagctacagcctgcaaaaaaacggcagaaggccgtcgtgaaaccgcagaggatttggactaaacgagatattagacctgattttggcagctggaccgcctccgacccacatatagaagatcttaagtcccaggaactcagtcctgtggggctgtttgagctattcttcgacgaaggaaccatcaacttcatagtcaatgagacgaatcgatacgcgtggcaaaagaatgtgaatctgagcctgacagcccaggagctgaagtgcgttctaggtatccttattttgagcgggtacatctcctaccctaggagacgcatgttttgggaaacttcccccgactctcaccaccacctggtggccgatgctatacgaagagaccgttttgaactcatattctcctatctgcacttcgcagacaataatgaactagatgccagtgaccgatttgccaaggtacgtcccttgattattcgtatgaactgcaactttcagaagcatgctccccttgaagaattttatagctttggcgaaagcatgtgcgagtattttggtcatcggggctctaagcagcttcatcggggcaagccggttaggctaggctacaagatttggtgcggcacaacatccaggggatacctggtctggttcgagccgtcgcaaggaactctgttcactaaacctgatcgttctctcgacctaggggggtcaatggtaattaaatttgtcgatgccttgcaggagcggggtttccttccctaccacatcttcttcgacaaggtgtttacatctgtgaagctcatgtctatcttacgaaagaagggagtgaaagccacagggacagtgcgcgagtatcggaccgagaggtgccccctgaaggatccaaaggagctgaaaaagatgaagaggggcagttttgattacaaggttgatgaaagtgaggaaatcatcgtgtgccgttggcacgactcctccgtcgttaacatctgtagtaacgcagtcggaatcgaaccagtgaggttgactagtagacatagcggcgccgcgaaaacgcgcactcaggtgcatcaacctagcctcgtgaagctctaccaggaaaaggtaggtggagtaggacgcatggaccagaatatcgctaagtataaagtgaagatcagagggatgaagtggtactcctctttcattggttacgtcattgatgccgcgctcaataatgcatggcagcttcaccggatatgttgccaagatgcccaggtggatctcctggctttccggagatacatcgcctgcgtgtacctggagtccaatgctgatactacctctcaggggcgcaggtcgaggcgccttgaaacggagagccggtttgatatgatcgggcactggataatccatcaggacaagcgcacccgttgtgcactctgccacagtcagaccaacactcgctgcgagaaatgccagaagggggtgcatgcaaagtgcttcagagaatatcacatcagatag

SEQ ID NO: 49480 - DNA, 1026 bp, Artificial Sequence
  Description of Artificial Sequence: Synthetic coding sequence
atgaactgcaacttccagaagcacgcccccctggaggagttctactccttcggcgaaagcatgtgtgaatacttcggacaccgggggtccaagcagctccacagaggcaagccagtgaggcttgggtacaaaatttggtgcggtactacgtcaaggggttatctcgtttggttcgaacccagccagggcaccttatttacaaagccagaccggtctctcgatctgggcggcagcatggtgatcaagttcgttgatgctctgcaggagcgagggtttctgccctaccatatttttttcgataaggtgtttacctctgtgaaactcatgagcattctacggaagaaaggcgtaaaagctactggtaccgttcgcgaatatcgcaccgaaagatgccccctgaaagaccccaaagaattaaagaaaatgaaacggggtagctttgactacaaggtcgatgagagcgaagagatcatcgtttgccggtggcacgactcaagcgtggtgaatatttgttccaacgctgtcggcattgaaccggttcgattgacctcccggcattcgggggctgctaagacacgaacccaagtccaccagccttcactggtcaaactgtatcaggagaaagtcggaggagttggcagaatggatcagaacattgccaaatataaggtgaaaatccgaggcatgaagtggtattcttcttttatcgggtacgtcattgacgcagcgctgaacaatgcttggcagctgcacaggatatgctgccaggacgcccaggtagacttgctggcattccgtaggtatatcgcttgcgtctatctcgagtcgaatgccgacacaacaagccagggccgccgatcaaggaggttagaaacggagagcaggttcgatatgattggacactggatcatccatcaagacaagcgcactaggtgcgctttatgccactcacagacgaatacacgatgtgaaaagtgccaaaaaggagtgcatgctaagtgttttcgtgagtaccacatcagatag

SEQ ID NO: 49481 - DNA, 1770 bp, Artificial Sequence
  Description of Artificial Sequence: Synthetic coding sequence
atgggccgggacgtgatcgccggccggggcatccacagcaaggtgaaatccgccaagttgctggaggttcttaatgcaatggaggaggaggaatctaacaataacagagaagagatcttcatcgctccaccggacaacgcagccggtgaattcactgatgaggactcaggggatgaggattcacagcgaggcgcacatctgcctggaagcgtgcttcacgctagtgtactttgtgaggactctggcacaggcgaggacaacgatgacctcgaactgcaacctgccaagaagcggcagaaggctgtcgtgaaaccccagagaatctggactaagcgcgacatcaggccagacttcggctcatggacagcctctgatccgcatattgaggatttgaagtctcaagaactgtcacccgtcggattgtttgagttattcttcgacgagggtaccatcaatttcatagttaatgagacgaatcgttacgcttggcagaaaaatgtgaacctgtctttgaccgcacaggagctcaagtgtgtgctcggaatactgatcctgtctgggtacattagttacccaaggaggagaatgttctgggagacctctccagatagtcatcaccacctggtggccgacgccattagaagagatagattcgaactcatttttagttacctacattttgccgacaataatgagctcgacgcgtcagaccggtttgccaaggtgcggccattgatcatccgtatgaattgtaattttcagaagcatgctccccttgaagagttttactcttttggggagtccatgtgcgagtattttggccatagagggtcaaagcagcttcacagggggaaaccagtgcgcttaggttacaaaatctggtgtggaacaacctcccggggctacctggtatggttcgaaccttcccagggaactctgtttaccaagccggacagatctttggacctgggagggagcatggtgatcaagttcgtggacgcactccaagagcgcgggttcctgccgtatcacattttcttcgataaggtctttactagcgtcaagctgatgtctattctgcggaaaaaaggagttaaggccacaggcacagtgcgggaatacagaaccgagcggtgtcctctgaaagatcccaaggagctgaaaaagatgaaaagggggtccttcgactataaggtggatgagtcggaggaaatcatcgtgtgccggtggcacgattcctccgtggttaatatctgttccaacgccgtggggattgagcctgtgaggcttacctctagacacagcggggcagctaagacccggactcaagtacaccagccttcacttgtgaaattgtaccaggaaaaggtggggggagtaggcagaatggatcagaacatcgctaagtataaagtgaagatcagaggcatgaagtggtatagctccttcattgggtacgtcatcgacgcagccctcaataacgcttggcaattacacagaatctgttgccaggatgcccaggtggacctgctggcttttcgacgctatattgcatgtgtatacctggagagcaacgccgacacaacttctcaaggccgccggtctcggaggctggagacagaatcacgcttcgacatgatcggacattggataatacatcaggataagcgaacacgctgtgcactgtgccattcccaaacaaatacacgttgtgagaaatgccagaaaggagtccacgccaaatgctttagggaatatcacatacggtag

SEQ ID NO: 49482 - DNA, 1782 bp, Artificial Sequence
  Description of Artificial Sequence: Synthetic coding sequence
atgccccggaccctgagcctgcacgagatcaccgacctgctggagaccgatgactctatagaggcctctgctatagttattcagccaccagagaacgccaccgcgccagtgagcgacgaggaatcgggcgatgaggagggtggtacaatcaataaccttcctgggtctctgttgcatacagcagcttatctgatccaggatggtagcgatgccgagtcggactcagatgacccctcatatgcgcccaaggacgactcgcctgacgaagtaccctcaacatttacagtccagcagcctccacccagtagaaggcgaaagatgacaaagatattatgtaagtggaaaaaggctgacctgaccgtgcagcctgtggctggccgagtgaccgcccctccaaatgatttttttaccgtcatgcgcactcctaccgagatactggaattgttcctcgatgatgaggtgatagagctcatcgtgaagtattccaatctgtatgcctgttcaaaaggggttcatctgggactgacttccagtgaattcaagtgctttctgggcatcatatttctctcaggctacgttagtgtccctcggaggaggatgttctgggaacagcgcaccgacgtgcacaatgtgctggttagcgctgctatgcgtcgagatcgcttcgagactatcttttcgaacctgcatgtcgctgacaacgcaaatcttgatccagtagacaagtttagcaagctgcggccattaattagcaagctaaatgagaggtgcatgaaattcgtccctaatgaaacatacttctcctttgacgagttcatggttccttacttcggccggcatggctgcaaacaatttatcagaggtaaacctatacggttcggctataaattctggtgtggcgcaacgtgcttgggatacatctgctggttccagccctaccaggggaagaatccaaataccaagcacgaggagtacggcgtgggggcttccctggtgctgcagttcagcgaggctttgaccgaggcgcacccaggtcagtatcattttgtcttcaataatttttttacaagcattgctcttctggataaactctcaagcatgggccaccaggccacaggcacagtccggaaggatcacattgacagggtgccattggagagtgacgtggccttgaaaaagaaggagcggggtacgtttgattatcggatcgatggaaaggggaacatagtatgcagatggaatgacaacagtgtggtcaccgtagcatcgagcggggccggaattcaccccctatgcttggtgtcgagatattctcagaaactgaaaaagaaaatccaagtacagcagcccaatatgatcaaggtctacaaccagtttatgggcggggtggatcgagctgacgaaaatatcgataagtacagggccagtatccggggcaagaagtggtactccagcccactgctgttttgtttcgaactggtcctccagaacgcctggcagctgcataagacctacgatgagaagcctgtcgacttcctggagttcaggaggcgggttgtctgccactacctggagacccatggacatccccccgaaccaggccaaaagggtaggccccagaaaagaaacatcgatagccgctacgacggaataaaccacgttatcgtaaagcagggcaaacagacgcgctgtgctgagtgccacaagaatactactttccggtgcgaaaagtgtgacgtggccctgcacgtcaagtgttctgtggagtaccacacagagtag

SEQ ID NO: 49483 - DNA, 1782 bp, Artificial Sequence
  Description of Artificial Sequence: Synthetic coding sequence
atgccccggaccctgagcctgcacgagatcaccgacctgctggagactgatgattccatcgaggcctccgcgatcgtgatccaacctccagagaatgctaccgctcccgtgagtgacgaggaaagtggggacgaggagggagggacgatcaataaccttcccgggagtcttctccataccgccgcgtacctgattcaggacggatcagatgccgaatccgactctgatgatccctcatatgcccctaaagacgactctccggacgaagtgcctagcacctttaccgtccagcagcccccaccttcacgccgccgtaaaatgacgaagattttatgtaaatggaaaaaagctgatctgacagttcaacccgtagcgggtagggtgacagctcctcctaacgatttttttactgtgatgagaacccccacagagatcctggagcttttcctggatgacgaagtgatcgagctcatagtgaagtattctaacctctacgcttgctccaaaggagtgcacctgggcctgacctcttccgagttcaaatgctttttagggataatattcctatctggctacgtaagcgtgccccggagaaggatgttttgggagcaacggacggatgtgcataatgttttggttagcgcggctatgcgaagggatcggtttgagaccatcttcagcaatctgcacgtcgctgataacgcaaacctggatcctgtcgataagttttcaaagctcagacctctcattagtaagttgaatgaaagatgtatgaagtttgttcccaatgaaacgtacttctctttcgacgagttcatggttccgtattttggaaggcacggctgtaagcaattcatccgcggcaaacccattaggttcggttacaaattctggtgcggggcaacatgtctgggctatatctgttggtttcagccatatcagggcaagaaccccaataccaagcacgaggagtacggagtcggggcttcactggtgctgcagttttcagaagctttaaccgaggcccaccccgggcagtaccacttcgtttttaacaacttcttcacttcaatcgcactcctggataaactctccagcatgggacatcaggccaccggaacagtgcgcaaggatcacatagaccgcgtgcccttagagtccgatgtagctttgaaaaaaaaagaacggggcacgtttgactaccggatcgatggcaaaggcaatattgtctgccgatggaacgataattccgtcgttaccgttgcttcatccggggctggaattcatcccctgtgcctggtaagccgctatagccagaaactgaagaagaaaattcaggttcagcagccaaatatgattaaggtttataatcagtttatgggcggtgtggatagagctgatgaaaatatcgacaaataccgggcctccattaggggaaaaaagtggtattcatctccattgctgttttgttttgaactggtcctgcagaatgcctggcagctgcacaagacatatgatgagaagcctgtcgatttcctagagtttcgaagacgcgtcgtgtgtcattaccttgagacccatgggcatccccccgagcctggtcaaaaaggccgcccgcagaaacgaaacatcgactccagatatgatggaatcaaccacgtgatcgttaagcaaggcaaacagacgaggtgcgccgagtgtcacaagaatacaactttcaggtgcgagaagtgcgatgtggctctccacgttaaatgtagcgtggagtaccacactgagtag

SEQ ID NO: 49484 - DNA, 1758 bp, Artificial Sequence
  Description of Artificial Sequence: Synthetic coding sequence
atgagcaacccccggaagcggagcatccccatgcgggacagcaacacagggctagagcagttactcgcggaagactcgttcgatgaatcagactttagcgaaatcgacgactcagataacttcagtgatagtgctctggaggctgacaagatcagaccgctctcccatcttgagtcagatggcaagagcagcactagcagcgactcagggaggagcatgaaatggagtgcgcgggccatgatcccccgccagcggtatgactttactggaacgccaggtagaaaggtggatgtgagcgatatcactgacccgttacagtattttgaactgttcttcaccgaggaactagtgtctaagattacaagggaaactaacgcacaggctgccctgttggcttccaagcctccagggcccaagggattctcccgcatggacaaatggaaggatacagataatgacgaactgaaggtcttcttcgccgtaatgcttttgcaaggcattgtgcagaaacccgagctggagatgttctggtctacaagacctctgctggacacaccatatctgagacagatcatgaccggggaacgattcctgctcctttttaggtgtctccactttgtgaacaattcttccatttcagccggacaatcaaaagcccagatcagtctccagaagatcaagccagtgtttgattttctggtcaataagtttagtaccgtgtatacccccaacagaaacatagccgtcgacgagagcctaatgctctttaagggccctctcgcaatgaagcagtatctacctaccaagcgcgttcgcttcgggctgaaattatacgtgctgtgtgagtcccaatctggctacgtctggaatgctttagtccacaccggccccggtatgaatcttaaagattcagccgacggtcttaagtcctcgcgcattgttttgaccttagtgaatgacctcctcggccagggctattgtgtgttcctagataacttcaatatcagtcccatgctttttcgcgagctccaccagaataggacagacgccgtcgggaccgcacgactcaacagaaagcagattccaaacgacctgaaaaagagaatcgccaaaggtaccactgtggcacgtttctgtggggaactcatggctctgaaatggtgtgatggcaaagaggtgactatgctgagcacgtttcataatgacaccgttatcgaagtgaataatcggaacggaaagaagactaaacgcccccgtgtcatagttgattataatgaaaatatgggtgctgtggactcagcggaccagatgctcaccagctatccatccgagcgaaaaagacataaggtatggtacaagaagttcttccatcatctcctacacatcacagtgcttaattcttatatcctcttcaagaaagacaatcccgagcacaccatgagccatatcaattttagactcgccctgatagaacggatgttagagaagcaccataaacctgggcaacaacacctgcgtgggcgcccctgctcagacgacgtgaccccactgagattaagtggccggcactttcctaagtccatacctgccacgagtggaaaacaaaatccaactggtagatgcaaaatatgctgttcccaatacgataaagacgggaaaaagatcaggaaggagacgcgttacttctgcgcagagtgcgacgttccattgtgcgtggtcccttgttttgaaatataccatacaaagaagaattactag

SEQ ID NO: 49485 - DNA, 948 bp, Artificial Sequence
  Description of Artificial Sequence: Synthetic coding sequence
atggagaccagcagcaagggcctgctgacccaggtgacccagttctggaacttactggatgatcttgcccagtccgaccccgagggatacgaaaagttcattcagcagcaactcaaagaaggcaaacagctatgcgccgcccctgaacctcaattgtgcttacagacccgaatcttgaagccaaaagaaaagatcctgtttatcaacttgtgccagtggacaagaattcccgctccacagtcaactacacatcctgtacctcttacagtaggaaagccagaggacacaaccgagatatcggacgcatatacggtgattgacgtggcatacaatcctgacgtgttgcatgctgcggagaaagatcaggtcaagaagaaccagttgatccagatggcaatgaagtgcatcgaagagaagtttcagtttactctcagtcacagttaccatataacaaaatttcggatcaagggtagcatccaaagaatgaagcagaacctgatgggtattcagaccgatagcatagatttgcgcgagaaaatgaggagggaactgaccctagggcagattcgctctagcacaatgtctaaccccgaccactttcctcagcttctgctccccaaagaccaggtttccggaaaggcagtgtgcttaatcgaggagatcagcagcacagagattcaggtcgagatgaaaatgcccgcctacgagcttaagatagtccacgatcattccgaaaaacctcttaagattgaactcaaggtcgaactcccgggtattaactctgttagtctgtgtgatttgtcggtgtccgaggacgatctgctgattgaggtgtcagagaaataccggctgcaccttaatttacccaaactaatcgatacggagatgacaaccgccaagtttatcaaggagaagagtaccttgatcatcactatgccgctggtctag

SEQ ID NO: 49486 - DNA, 867 bp, Artificial Sequence
  Description of Artificial Sequence: Synthetic coding sequence
atggagaccagcagcaagggcctgctgacccaggtgacccagttctggaaccttctggatgatctcgcacagtctgatcctgaaggttacgagaagttcattcagcagcagctgaaagaggggaaacaactgtgcgcggctccagaacctcagctctgcctccaaaccaggatcctaaaaccgaaggagaaaatcctcttcatcaatctgtgccagtggactcgcatcccggctccgcaatctacaacacatcctgtaccactcaccgtgggtaagccggaagacacgactgaaataagtgatgcttatacagtgattgacgtggcatacaaccccgatgtgctccacgccgctgagaaggaccaagtaaaaaagaatcagctcatacagatggctatgaaatgtatcgaggagaaatttcagttcacattgagtcatagctatcacattaccaagttcaggattaagggtagtattcagcggatgaagcaaaaccttatgggaatacagactgattcaatcgatctccgggagaaaatgcggagggaattgacacttggccagatccgcagctctaccatgagcaaccccgatcacttcccacaattgctccttccaaaggaccaagtcagcggaaaggctgtgtgtctgatcgaagagatctctagcacagaaatccaggtagagatgaaaatgccggcgtacgaactgaagatcgtgcatgaccactccgaaaaaccactcaagatcgagttaaaggtggagctgcctggaattaacagcgtgtccttgtgcgacctaagtgtatctgaagggacaactgaaccccaggctttggcaaaagacgagctgagtctgaaattttag

SEQ ID NO: 49487 - DNA, 867 bp, Artificial Sequence
  Description of Artificial Sequence: Synthetic coding sequence
atggagaccagcagcaagggcctgctgacccaggtgacccagttctggaatctcctcgatgacctcgcacagtcggacccagagggttatgaaaagtttatccagcaacaactgaaagaagggaaacaactttgcgccgcccccgagccacaactatgcttacagaccaggatccttaagcctaaggaaaaaattctgtttattaacctctgtcaatggacccgaatccccgccccacagagtaccacccaccccgtcccactgacggtggggaaacctgaggataccactgagatctccgatgcctacactgtcattgatgtcgcctacaacccagatgtcctgcacgccgctgagaaggaccaggtcaagaaaaaccaacttattcagatggctatgaaatgcatagaagagaagttccaattcaccctatcacatagttatcatatcacgaagttcagaatcaaagggtctatccaaaggatgaaacagaatcttatgggcatccaaaccgattcaatcgacctacgggagaagatgcgccgcgaactgaccctaggacagattaggagcagtacgatgtcaaatccagaccactttccgcagttgttgctacctaaagatcaagtgtcaggcaaggccgtttgcctcatcgaggagatctcgagtaccgaaattcaggtggaaatgaagatgccggcctacgaactgaagatcgtacacgaccattcggagaaacccttgaagattgagcttaaagttgaactgcctggaatcaacagcgtcagcttatgtgatctatctgtctccgaggggactactgagccgcaggcactggctaaagatgaactgtctttaaagttctag

SEQ ID NO: 49488 - DNA, 948 bp, Artificial Sequence
  Description of Artificial Sequence: Synthetic coding sequence
atggagaccagcagcaagggcctgctgacccaggtgacccagttctggaacctgctggacgacctggcccaatcagacccggaaggttatgaaaaatttatccagcaacagttgaaagagggcaaacaactctgtgctgctccggaaccacaactctgtctccagacaagaattctaaagcctaaagaaaagattctgtttattaatctttgccaatggactagaattcccgctccacagtctaccacgcacccagtcccactgaccgtggggaagcccgaggacacgacggagatctctgatgcctacactgtgatcgatgtcgcttacaaccctgacgttctccatgcagccgaaaaagaccaggtcaaaaagaatcaacttatccagatggccatgaagtgcattgaggagaagtttcagtttacgctttcccactcgtaccacatcacaaagtttagaattaagggctccatccagaggatgaagcagaacctgatgggcattcaaactgactccatcgatctgagagaaaagatgcgcagggaacttacactggggcagatcagatcgtctacaatgagcaacccagaccatttcccacagctacttttgccaaaggatcaggttagtggtaaggctgtgtgcctgatcgaagagatatcttccacagagattcaggtggaaatgaaaatgccagcatatgagctgaaaattgttcatgaccacagtgagaaaccactgaaaattgaactgaaggttgagcttcccggcattaacagcgtgagcttgtgtgacctttccgtgagtgaagatgatttgttgatagaagtgagcgagaagtacagactgcatcttaatctgccaaagctgatcgacactgaaatgaccacagccaaattcataaaagagaagagtaccctcattatcacaatgcccctggtgtag

SEQ ID NO: 49489 - DNA, 636 bp, Artificial Sequence
  Description of Artificial Sequence: Synthetic coding sequence
atgagccacggccacagccacggcggcggcggctgccggtgcgccgctgaaagggaagagccgccggaacagcgaggtctggcttacggcttgtatttgaggatagatctggaaagactccagtgcctgaacgagtcccgtgagggcagtggccgaggcgtttttaaaccttgggaggaacgtaccgatagatccaaattcgtcgagtcagacgctgacgaggaacttcttttcaacattccgtttactgggaacgtcaagctcaaagggattatcatcatgggcgaggacgacgactctcatccgagcgaaatgcgcttgtataagaatataccccaaatgtccttcgacgataccgagagggagcccgaccagacttttagcttgaaccgagacctcacaggggagctagagtacgctaccaagatcagtaggtttagcaatgtataccatttgagcattcacatttcaaagaatttcggggccgacaccactaaggtgttttacattgggttgcgaggagagtggacggagctccgccgtcacgaggtaacaatctgcaactacgaggctagtgcgaacccagctgatcatagggtacaccaagtaacaccgcagacccactttatttcatag

SEQ ID NO: 49490 - DNA, 297 bp, Artificial Sequence
  Description of Artificial Sequence: Synthetic coding sequence
atgagcttcgacgacaccgagcgggagcccgaccagaccttcagcttaaaccgcgacctcaccggcgagctcgagtatgcaaccaaaatctctcgcttcagtaatgtgtaccacctcagtatccacatcagtaaaaacttcggcgccgacaccaccaaggtgttttatatcggactgcgtggggaatggactgaattacgcagacatgaggtgactatttgcaattatgaagctagcgctaacccggccgatcaccgtgtccaccaggttactcctcagacccactttattagttag

SEQ ID NO: 49491 - DNA, 213 bp, Artificial Sequence
  Description of Artificial Sequence: Synthetic coding sequence
atgggcgaggacgacgacagccaccccagcgagatgcggctgtacaaaaatatcccccagatgtctttcgacgacactgagagagagcccgaccagaccttctctctgaatcgggacctaaccggggaactggagtatgcaactaaaatcagtaggttctctaacgtgtaccatctgagtatccacatatcgaaaaacttcggagccgactag

SEQ ID NO: 49492 - DNA, 903 bp, Artificial Sequence
  Description of Artificial Sequence: Synthetic coding sequence
atggagccccccatggagcccagcggcggcgagcaggagcccggcgccgttcgtttcctggacctcccctgggaggacgtgctcctaccgcatgtcttgaatcgggtgccgttgcgccagcttcttaggctccaacgcgtctcaagggcttttaggagcctagtccagctgcatctggcaggcctgagaaggtttgatgcagcccaggtaggtccccagattcctcgcgctgcgctggcccggctgctgagggacgccgagggactacaagaactcgccctcgcaccctgtcacgagtggctaagcgacgaagacctggtgcctgtgttagcccgtaatccccaactcaggtcagttgccctcggaggctgcggacaactaagtaggagagccttaggtgcactggcagaagggtgtcctcgcctgcagcggctgagtctcgctcattgtgactgggtggatgggcttgctcttagaggccttgctgacaggtgccctgctctagaggagctggacctaaccgcctgcagacagctaaaagatgaggcaatagtgtacctggcccagcggagaggcgccggcttgagaagcctttctctcgccgtcaatgccaatgtcggggacgccgcagtacaagagctggcccgaaactgtcctgagcttcaccatctggacctgacaggctgtcttagagtgggctctgatggagtcaggacattggctgagtattgccctgttttacgctccctgcgagttcgtcactgccatcacgtagccgagagttccctgtcaagactgcgtaaacgaggagtggacattgatgttgagcctccattgcaccaggccctggtgcttttgcaagacatggctggcttcgctccctttgtcaacttacaggtgtag

SEQ ID NO: 49493 - DNA, 3093 bp, Artificial Sequence
  Description of Artificial Sequence: Synthetic coding sequence
atgcggaacgtggccctgcggcgggccgccggccccgtgtgcgccgaggccgcagagcggcggacctgtacaccacaatccgttgctatggaacaatacaagctgggcgacaaaattcacggctttacagtgaatcaggtgacttccgtgccagaactcttcctgacagcagtaaaacttacgcacgatgacacaggtgccagatatcttcacctggcaagggaagacaccaacaacctgttcagtgtgcagttcaggactaccccaatggattccacaggagtaccacacatcctggagcacaccgtattgtgcggcagccaaaaatacccatgccgcgacccctttttcaagatgctgaaccgtagcctgagcactttcatgaacgcctttacagcctctgactataccctttacccattttctacccagaatccaaaagattttcagaacctgctcagcgtgtacctggacgcaactttctttccatgtctgcgtgaactggatttttggcaggagggttggagactggaacacgagaatcccagtgacccccaaacccctttggtgttcaagggagtggtattcaacgaaatgaagggagccttcacggacaacgagaggattttctctcagcatcttcagaataggctgctacctgaccacacttacagtgtagtgtccggaggggatcccttgtgtataccagagctcacatgggaacaactgaaacagttccatgccacacactatcatccatccaatgcgcgattcttcacctacggcaattttccgttggagcagcacctaaagcagattcacgaagaggcattgtctaagtttcagaaaattgagccatccacagtggtcccagctcagacaccctgggataagccgcgggaatttcagatcacttgcggaccggactccttcgctaccgacccaagtaaacagacgacaatttcagtgtctttcctattgccggatatcactgataccttcgaggccttcaccctgtcgttactgtcaagtcttctgacctccgggcccaacagtcctttctacaaggctctgattgaatccgggctcggaaccgacttcagtcccgatgtgggatataacgggtacaccagagaagcgtatttttctgtaggtctacaagggatcgctgagaaagacatcgagacagtgcgcagcttgatcgatcgcaccattgacgaagtcgtcgaaaaaggcttcgaagacgatcgaattgaggcacttcttcacaaaattgagattcagatgaagcaccagtcaacctccttcggtctcatgctgacctcctacatagcatcctgctggaatcacgatggcgacccagtggagctcctgaagctgggaaaccagctcgccaagtttcgccaatgtctccaggagaatcctaaatttttgcaagagaaggttaaacaatacttcaaaaacaatcagcacaagctgaccctaagtatgagacccgacgacaagtaccatgagaaacaggctcaagtggaggctacaaaactgaaacagaaggtggaagcgctatcccccggtgaccggcagcagatatacgagaaaggattggagctgcgctcccagcagagtaaaccgcaggatgcatcctgtctgcccgcgctgaaggtatcggacattgaaccaaccatcccagtcacagagctggatgtggtgctcaccgctggcgatatccccgtgcagtactgtgcgcagcctactaatggcatggtttatttccgtgccttttcaagcctcaataccctgcctgaggagctgaggccttacgttccactcttttgcagcgtcctcaccaagcttggctgcggccttctggactatcgcgaacaagcacaacagatcgaactgaagactggggggatgtctgccagtcctcacgtcctgccagacgactcccacatggacacgtacgaacagggcgtgctgtttagctccctttgtctggacagaaacctgcccgatatgatgcagctatggtcggaaatcttcaataatccgtgctttgaggaggaggagcattttaaagtgttggtgaaaatgacagcccaggaactagccaatgggatccccgactcagggcatctttacgccagcatccgcgccggcaggactctgactcccgccggcgacctgcaggagaccttctccggcatggaccaagtgcgactgatgaagcgcatcgccgagatgactgatataaagcctatcctgcgcaagctgcctagaattaagaagcacctgctgaacggcgataacatgcgctgcagtgtcaatgctaccccccaacagatgcctcagaccgaaaaagccgtggaggactttttaagaagtatcgggcgatcaaaaaaggaacgcagaccggtgaggcctcacaccgtcgaaaaacctgtaccaagtagttctggcggagatgcccacgttccacacgggtcgcaggtgatccgcaaactggtcatggaaccaacattcaagccatggcagatgaagacccacttcttgatgccattccctgtcaactacgtcggagagtgcatccggacagtgccctacactgatcctgatcacgcttcccttaaaatcctcgcaaggctcatgaccgcaaagtttctgcacaccgaaataagagagaagggaggcgcttatgggggtggggcgaaactttcccataacggaatttttacgctttacagctaccgggatccaaacacaatcgaaaccttacagtcatttggtaaagcagtagactgggcaaagtcaggaaagttcactcaacaggatatcgacgaggccaaattaagtgtattctcaacagtggatgcccctgtggctcccagtgataagggtatggaccatttcctttatggactgtccgatgagatgaagcaggctcatcgggagcaacttttcgcggtgtcacacgataagctgttggctgtgtccgacagatacctggggacagggaagagtacccatggcctggcaatactggggccagagaaccctaagatcgccaaagacccctcttggatcatccagtag

SEQ ID NO: 49494 - DNA, 3117 bp, Artificial Sequence
  Description of Artificial Sequence: Synthetic coding sequence
atgtggcggtgcggcggccggcagggcctgtgcgtgctgcggcggttaagcggaggacacgcgcaccaccgagcctggaggtggaactccaatcgggcatgcgagcgtgcgctgcaatataaactgggtgataagatccatggctttacagttaatcaagttacatctgtccccgaactctttctcaccgccgtgaagctgacgcacgacgacacaggcgcccggtacctccatttggctcgcgaagacaccaataatttgttttctgtgcagttcagaacaacccctatggatagcacaggagtcccacatatactggaacacacagtgctgtgtgggtcacagaagtacccatgcagagatcctttcttcaagatgctgaatagaagtctgagcacgtttatgaatgctttcacagcgtccgactatacgctgtacccattttccactcagaacccaaaggatttccagaatctgctgtccgtctacctggacgctacattctttccatgcctgcgcgaactggatttttggcaggagggatggcgcctggagcatgagaatccctcggatcctcagacacctttggtattcaagggggtggtgtttaacgaaatgaagggagcctttacagacaatgaaagaatttttagccagcaccttcagaatcggttgcttccagaccatacatattctgtagtgtctggcggggatcccctctgtatccctgaactgacctgggaacaattgaaacagtttcatgctactcattaccacccaagtaacgctcgtttttttacctatggaaactttcctcttgagcagcacttgaaacaaatccacgaggaggcgcttagtaaattccaaaaaatcgagccctccactgttgtccccgctcagacaccctgggataagccaagggagtttcagatcacatgcggcccagattctttcgctactgatcctagcaaacagaccacgatctcagttagcttcctgcttccggacatcacggatacctttgaggcctttacattgtctctgttgtctagccttctcacttctggtcctaattctcctttttataaggctcttattgagtccggactgggaaccgacttttcacctgacgtgggctacaacggctacacaagggaggcttacttcagcgtgggtctgcaggggattgccgaaaaagatatagagaccgtaaggtccctgatcgaccggaccatcgatgaagtcgtagagaaaggatttgaagacgataggattgaagccctcctgcataagattgagatccagatgaaacaccagtcaacatcctttggactgatgcttacttcttatatcgccagttgctggaatcacgacggggatcccgtggaattattgaaattaggcaaccagctggcaaagtttagacaatgtcttcaggagaatcctaagttcctccaggagaaagtcaagcagtatttcaagaacaatcagcacaagttaactctttctatgcgacccgatgataaataccatgaaaagcaggctcaagtggaggccaccaaacttaagcagaaagtagaagccctcagcccaggcgataggcagcagatctatgagaaggggctggagctccgctcccaacagtccaagccacaggacgcctcttgtctgcctgcactaaaggtgagcgatattgaaccgacaatcccagtcactgagctggacgtcgtactgacggctggcgatatacccgtacagtactgtgctcagcccaccaacgggatggtctacttcagagctttctcctcactgaacaccctcccggaagaactgcgcccgtatgtgccacttttctgtagcgtattaactaaactgggatgcggactcctggactaccgggaacaggctcagcaaattgagctcaaaacaggcggcatgtccgccagcccacatgtgttacctgatgattctcacatggacacatatgagcaggtgggtgttctttttagttcgctgtgtctggacaggaacttacccgacatgatgcagctctggtcagagatattcaacaatccatgtttcgaggaggaggagcacttcaaggtcctggttaagatgactgctcaggagttagcgaatggaatccccgacagcggccatctatacgccagtatccgggccggacggactttgacccccgcaggagatcttcaggagaccttttccggcatggaccaggtgagactcatgaaacgcatcgccgagatgaccgacattaagccaatcctgcggaagctgcctagaatcaagaagcatctgttgaatggagacaacatgagatgtagcgtgaacgccacccctcagcaaatgcctcaaactgagaaagccgtcgaagattttctacgcagcatcggcagatccaaaaaggagcgccgccctgttaggccccacacagtcgagaagccagtcccaagcagctctggaggtgacgctcacgtgccccacgggagccaggttattcgtaagttggtaatggaacccaccttcaaaccctggcagatgaaaacccattttctgatgcccttcccagtcaattacgtgggggagtgcatcagaacagtgccttatacagatccagaccacgcatccctcaaaatcctcgcccgtctgatgacagcaaagttcctgcatacagaaattcgggagaaggggggtgcctacggcggcggcgcgaagctgagtcataacggaatcttcaccctctattcctacagggatccgaatactatcgagacactccagtcctttggcaaggctgtcgattgggcgaaaagcggaaaatttacacagcaggatattgacgaggccaaattaagtgtcttttccaccgtcgatgcccccgtggctccctcagacaaagggatggatcattttctctacggcctgtccgacgagatgaagcaggcacaccgggagcagttatttgccgtgtcccacgataagctgctcgcagtttccgatcgatatctgggcactggcaagtcgacccatggcttggctatactggggcccgaaaaccccaagatcgcaaaggaccctagttggataatccagtag

SEQ ID NO: 49495 - DNA, 1788 bp, Artificial Sequence
  Description of Artificial Sequence: Synthetic coding sequence
atgtggaagagcagcttccagtacatcgccagctgctggaaccacgacggcgaccccgtggaacttctgaagttgggcaatcagctggccaagtttagacagtgtctccaggagaacccaaagttcctgcaagagaaagtgaaacaatactttaagaataatcagcataaacttacactgtctatgagaccagatgataagtaccatgagaagcaggcacaggtagaggctacaaaacttaagcagaaggttgaggccctctcccctggagatagacagcagatctacgagaaaggcctggaattgaggagccagcagagtaagccccaggacgcctcttgcctgcccgctctgaaagtaagtgacatcgagccaacaatacctgtaaccgaactggatgtggttctgacagcaggcgatattcctgtgcagtattgtgctcagccaacgaacgggatggtctattttcgtgccttttcaagtctgaatactctgccagaggagttacggccgtacgtacccctgttctgctccgtcttaactaagctgggctgcggcctgttggactatcgcgaacaggctcaacagatcgagctgaagaccgggggaatgtctgcctctcctcatgtcctgccggatgactctcacatggatacctatgagcaaggagttctcttctcttccctgtgtttagacagaaacctgcccgacatgatgcagctctggagcgagatttttaataatccttgcttcgaggaagaggagcactttaaggttttggttaagatgaccgctcaggaactcgccaatggaatccccgatagcgggcatctgtatgcgagtatcagagccggcaggacgctaacacccgcaggcgatcttcaagaaacattttccggaatggatcaggtgcgccttatgaagaggatcgctgagatgactgacatcaagcccattcttagaaagctgcctcgcattaaaaagcacctactaaacggagataacatgcgttgttccgttaatgcaacacctcaacaaatgccccaaaccgagaaagcagtagaggatttcttgcgctctatcggacgcagtaaaaaagagcggcgtcctgttcgaccacacacagtagagaagcccgtcccaagctcctcaggaggcgatgctcatgtaccccacgggtctcaggtcatacgaaaactagtgatggagcctactttcaagccctggcagatgaagacacatttcctaatgcctttcccagtaaactacgtaggagagtgtatccgcactgtaccatatacagaccctgaccatgccagcctcaagattctcgcccgacttatgaccgcgaagttcctgcataccgagattcgagaaaagggtggcgcctatggaggaggtgctaagctttctcacaacgggatatttacactatattcctatcgagatcctaatacgattgaaaccctgcagtctttcgggaaggcggttgactgggctaaaagtgggaagttcacccagcaagatattgacgaagcaaaactcagtgttttttccaccgttgacgccccagttgccccatcagacaaaggcatggaccatttcctttacggactgtcagatgaaatgaaacaggcacacagggagcagctctttgctgtgtcccatgacaagctgctggctgtttccgatcgctacctggggaccgggaagagcactcacgggcttgccattctgggccccgaaaatccaaaaattgctaaggatccaagctggatcatacagtag

SEQ ID NO: 49496 - DNA, 261 bp, Artificial Sequence
  Description of Artificial Sequence: Synthetic coding sequence
gtgaacgccaccccccagcagatgccccagaccgagaaggccgtggaggattttctgagaagcatcggacgttccaaaaaggagcgccggccagtgagacctcacacggtggagaagcccgtgccctcctcttctggtggtgacgctcacgtgccacacggcagccaggtaattagaaagctcgtaatgtatacactacgccaccacgtaaaaattggcggtctccacgtgtcttttacagtgcggaactgcgtcgagtag

SEQ ID NO: 49497 - DNA, 702 bp, Artificial Sequence
  Description of Artificial Sequence: Synthetic coding sequence
tgactgatcgagagcggcctgggcaccgacttcagccccgacgtggggtacaacggatacacgagagaggcctattttagtgtgggactccaaggtatagctgagaaggatatcgagaccgtaagatctcttattgatagaaccatcgatgaggtggttgaaaaaggcttcgaggatgatcgcatcgaggccctgctccataaaatcgaaatccagatgaagcaccagagtactagttttggacttatgcttacctcatacatcgctagctgctggaaccatgatggcgacccagtggagctgcttaagctgggcaaccagttggctaagtttagacagtgtcttcaggaaaaccccaaatttttacaggaaaaagtcaaacaatacttcaagaacaatcaacataagctgaccctgagtatgagacccgatgacaagtatcatgagaaacaggcccaggtggaggctaccaaacttaaacagaaagtggaggcgttatcgcctggagatcggcagcagatctatgagaagggacttgagctgagaagccagcaatctaaaccccaggatgcatcctgcctgccggctctgaaagtttctgatattgaaccaactatacccgtgacggaactggacgttgtgcttacggggcactgtgaacgatacgcgttccccgggagtcgggtgccttgggggaactag

SEQ ID NO: 49498 - DNA, 2820 bp, Artificial Sequence
  Description of Artificial Sequence: Synthetic coding sequence
atgcggaacgtggccctgcggcgggccgccggccccgtgtgcgccgaggccgctgaacgacgggtgaccagtgtccccgaattgtttttgacggcagtaaaactcactcacgacgacactggagcccggtacttacatttagcgagagaagacaccaataacttattctccgtccaatttcgcacaacacccatggacagtacgggagtgccccacatcctcgaacacacagtcctctgcgggtcccagaaatatccttgccgcgaccccttttttaaaatgctgaaccggtcactcagcacatttatgaacgccttcacagctagcgattacaccctgtatcctttcagtacacaaaatcctaaggatttccagaaccttctgtctgtgtatctggatgccaccttcttcccttgtttgagggagctcgatttctggcaggagggttggcgcttggaacacgaaaacccttctgatccccaaacacccctggtctttaaaggagtcgttttcaacgaaatgaaaggcgcatttacggacaacgaaagaattttttcccagcatctgcagaaccgcttgctgccagaccatacttacagtgttgtgtccggtggcgatcccctgtgcattcctgagttgacctgggagcaactgaaacaatttcatgcaacacattatcatccctcaaacgctaggttcttcacctacggaaacttccccttagaacagcatctgaagcagatacacgaagaggctttgtcaaagttccagaagattgagcctagtacagtcgtgccggctcaaaccccttgggacaagccaagggaattccaaattacctgcgggcccgattccttcgccacagacccctcaaagcaaacaactatttcagtaagttttttgctacccgatattaccgacacgtttgaggccttcacattatcactcttatcttcactcctgactagcggccctaactcccctttttacaaggctctaattgagtcagggctggggacggatttctcccctgatgtggggtataacggctacacaagagaggcttacttctcagtgggattacagggcattgcagagaaagacatcgagaccgtgcgatcactcattgacagaaccattgacgaggtggtggaaaagggatttgaggacgacagaatcgaagcgctcctgcataaaattgaaatacagatgaagcatcagtccaccagctttgggttgatgttgacatcgtatatagcatcttgctggaaccacgatggcgaccccgtagaactcctcaagctgggaaaccagctggctaagttcagacagtgcctacaggaaaaccctaagttcctgcaggagaaagtcaagcagtatttcaagaataatcagcacaaactgaccctgtctatgaggcctgacgataaataccatgagaaacaggctcaggtggaagctactaagctgaaacagaaagtggaggcgctgagtccaggcgatagacagcaaatctatgagaagggacttgaactgcgctcacagcagagtaaacctcaagacgcttcgtgtcttccagctttaaaagtgtcagatatagagccgacgatacccgtcacggaattggatgtcgtcctgacagctggcgatatcccagtccaatattgtgctcagccaaccaacggaatggtttacttcagagcatttagtagcctcaatacacttccagaggaacttagaccctacgtaccactgttttgcagcgtcctgacaaatccatgcttcgaagaagaggaacactttaaagtcctggtgaaaatgacagctcaagaattggcaaatgggatcccggactccgggcatctctacgcttccataagagcagggcggacgcttacgcccgccggtgatcttcaggagacgttttctgggatggaccaggtaagattaatgaaaagaatcgcagagatgacagatatcaaacccatcctccgaaaattgccgcgcatcaaaaaacaccttttgaatggtgataatatgaggtgtagcgtgaatgctaccccacagcagatgccccagactgagaaggcagtagaagacttcctgcgatctattgggcgatccaagaaagagaggcgacccgttaggccacatactgtcgagaaacctgttccaagtagtagtggaggggatgcacacgtaccccatggaagtcaggtaattcgaaagctggtgatggaacctacctttaaaccttggcagatgaagactcacttcctcatgcccttccccgtgaactatgtgggcgagtgcatccggactgtaccttacactgatccagatcacgcttcgttgaaaatactggcccggctgatgaccgctaagttcctgcatacagaaattcgggaaaagggtggtgcttacggcgggggagccaagctgtcccataatggcatttttaccttgtatagttacagagatccaaataccatcgaaacactgcagagcttcggaaaggcagtggattgggctaagagtggaaagttcacacaacaggacatagatgaggccaagctgtcagtgttcagcactgtagacgctcctgtggccccatcagacaaaggaatggaccatttcctgtacggcttaagtgatgaaatgaaacaggcccaccgcgaacagctctttgcagtgtcccatgataaactcttggcagtgtcagaccggtaccttggaacgggaaaaagcacacatggcttagcaatcctgggccctgaaaatcctaaaatcgccaaggaccccagctggattatccaatag

SEQ ID NO: 49499 - DNA, 780 bp, Artificial Sequence
  Description of Artificial Sequence: Synthetic coding sequence
tgattcagcagcctgtgcctggaccggaacctgcccgacatgatgcagctttggagtgaaatcttcaacaacccctgctttgaagaggaagagcactttaaagtgttggtgaagatgacagcccaagaactggcaaacggcatccccgactctggccatctctacgccagtattagagctgggcgaacacttaccccagctggggacttgcaggaaactttttccggtatggaccaggtgaggttgatgaagaggattgctgaaatgactgatatcaaaccaatcttgaggaaactcccgcggatcaagaagcacttgcttaatggtgataatatgaggtgcagcgttaatgccacgccccagcagatgccacaaactgagaaagccgttgaggattttttgagatccatcgggcgctctaaaaaagagaggcggccagtccggccacacaccgttgaaaaacccgttcccagcagttccggcggcgacgcccatgtcccccatgggtcccaggtcattaggaagttggtgatggaacctacattcaaaccatggcaaatgaagactcactttttaatgccgttcccagtcaattacgttggagaatgtatccggaccgtgccatacacagatccggatcacgctcgcaaacgcccggtctgcgggtcaggtgacttgggattgatctctccacgtgcttcttctcgttctctctgtctttgttgccgtccgagccatcattgtcttccacgcctcctgtcagaggttgatgtattctag

SEQ ID NO: 49500 - DNA, 555 bp, Artificial Sequence
  Description of Artificial Sequence: Synthetic coding sequence
aagcccgtgcccagcagcagcggcggcgacgcccacgtgccccacggctctcaggttatccgcaaactggtgatggaacctacatttaaaccgtggcagatgaagactcattttctgatgcccttccccgtgaactatgtgggcgaatgtattcgaaccgtaccctacaccgacccggaccacgcctcactgaagatactcgcccgcttgatgacagctaagttcttacacaccgagatcagagagaagggcggcgcctacgggggaggtgctaagctttcacataacggcatctttactctttatagttatcgggatcccaacactatagagactctccagtcattcggcaaggctgtcgactgggcaaagagtggaaaattcacccagcaggacatcgatgaagctaagttgtcagtcttcagcacggttgatgctccagttgcacctagcgacaaggggattctctccatcacagttagaatttcaacccattcgctcacggacgatgtagcagtgtttcaagtcccaggcatgcatggacaagaacactag

SEQ ID NO: 49501 - DNA, 534 bp, Artificial Sequence
  Description of Artificial Sequence: Synthetic coding sequence
atgaactggttcggcagcaacttcttccggtgccccgaggacctgagcctgctaaacatctattctcctttgttgtcccacatgagtagcgaggatgagcatttcatcagcaacttgcgcggccatgtgcctgcgagtgccgttgtgaaacagcccgtgagaggagcgtcaggaagaactacgatcacggctatagtgcagaccgggggtggatggagcactggattgtttagtgtctgtagagacagacgtatctgcttttgcgggttgttctgccctatgtgccttgaatgtgacatcgcaaggcattatggcgaatgcctgtgctggccactgcttccaggcagcacatttgcacttaggattggaacgagagagaggcataagatccagggcaccttgtgtgaggattggctcgcagtccattgctgctgggctttttcaatatgtcaagttgcgcgagagcttaaaatgagaaccagtcaggtgtacgagatttgtgccgtcccgatgaccaaggatacacttgtgtag

SEQ ID NO: 49502 - DNA, 348 bp, Artificial Sequence
  Description of Artificial Sequence: Synthetic coding sequence
atgcaggcccaggcccccgtggtggtggtgacccagcccggcgtgggcccaggccccgcaccccagaacagtaactggcagactggcatgtgcgactgtttctccgactgtggcgtatgcctctgcggtactttttgcttcccatgccttggctgtcaagttgcggccgatatgaatgagtgttgtctgtgcgggacctctgtagctatgcgaacgttgtacaggactcggtacgggattcctggcagtatttgtgatgactacatggccactttgtgttgtccccattgtaccttgtgccagatcaagcgcgatataaatcggcgcagggccatgaggacattctag

SEQ ID NO: 49503 - DNA, 348 bp, Artificial Sequence
  Description of Artificial Sequence: Synthetic coding sequence
atgcaggcccaggcccccgtggtggtggtgacccagcccggcgtgggcccgggaccagctccacaaaactcaaactggcaaaccggcatgtgcgattgcttctctgactgcggtgtctgtctgtgtggcaccttctgcttcccctgcctgggctgccaagtggcagctgacatgaatgagtgctgcctttgtgggacttccgtggccatgcggactctgtacaggacgcggtacggaatcccaggaagcatttgcgacgattacatggccaccctgtgttgccctcattgcactttgtgtcagattaagcgggatatcaaccggcgccgcgctatgaggactttttag

SEQ ID NO: 49504 - DNA, 348 bp, Artificial Sequence
  Description of Artificial Sequence: Synthetic coding sequence
atgcaggcccaggcccccgtggtggtggtgacccagcccggcgtgggtccagggccagcacctcaaaactccaactggcaaactgggatgtgcgactgtttttcagactgtggcgtgtgtttgtgcgggacattctgcttcccatgtttgggatgccaggtggcagcagacatgaacgagtgctgcctgtgcggaacctctgtggctatgcggacgctgtatcggaccaggtacgggataccaggctccatttgcgatgactacatggctacattatgttgtccacactgtacactgtgccagattaaacgggacatcaacagaaggcgagccatgcggacattttag

SEQ ID NO: 49505 - DNA, 348 bp, Artificial Sequence
  Description of Artificial Sequence: Synthetic coding sequence
atgcaggcccaggcccccgtggtggtggtgacccagcccggcgtgggccccggcccagcgccacagaactccaactggcagaccggcatgtgcgattgcttctccgattgtggtgtgtgcctctgcgggactttttgcttcccctgtctcggttgccaagtggctgcagatatgaacgagtgttgcctgtgtggcacatccgtagcgatgcgcacattgtacagaacgcgctacggaatacctggttccatatgtgacgattacatggctaccctatgctgccctcattgcaccctctgtcagatcaaacgcgacattaataggcggcgggctatgcgtacgttctag

SEQ ID NO: 49506 - DNA, 1893 bp, Artificial Sequence
  Description of Artificial Sequence: Synthetic coding sequence
atggacgagatggccaccacccagatcagcaaggacgagctggacgaacttaaggaggccttcgctaaggtggacctgaacagcaatggatttatttgtgattatgaacttcatgaactgttcaaagaggcgaacatgcctcttcccggatacaaggtcagagagattattcagaagctaatgctggacggcgatcgcaataaggatggcaagatatcattcgacgagtttgtttatatcttccaggaggtgaagagcagcgatatcgcaaaaacattccgtaaagcaattaatagaaaagaagggatatgtgctctgggaggaacttccgagttgagcagcgaaggcacacagcattcctattctgaggaggagaagtacgcctttgtgaactggattaataaggctctcgaaaacgaccccgactgcagacacgtgatccccatgaatcccaacactgacgatctcttcaaagcggtgggcgatggcatagtcctgtgcaagatgataaatttgagcgtgcctgacacaattgacgaaagggccattaacaaaaagaagttgacaccctttatcatccaggaaaacctgaacttggctctgaattccgcatctgcaattgggtgtcacgttgttaatataggcgccgaggatctgcgggcaggaaagcctcatctcgtcttagggttactgtggcagattatcaaaatcgggctgttcgccgatattgaactctcccgcaatgaggccctcgcagcacttctgagggacggagagacactggaagagttaatgaaattaagccctgaagagctactgttgcgctgggcaaactttcacctcgaaaactctggttggcaaaaaattaataatttcagtgccgacataaaagatagcaaggcatattttcaccttctgaatcagatcgctccgaaagggcagaaggagggtgagcccagaattgacatcaacatgagcggctttaatgaaactgatgacctcaagcgtgctgaatctatgctacagcaggccgataaactgggatgtagacagtttgtgactcccgctgatgtggtctccggcaatcccaaattgaatctggccttcgttgctaacttgtttaacaagtacccagcccttaccaaacctgaaaatcaggacatagactggacattattagagggagaaacccgtgaggagcggacatttcggaattggatgaactcgttaggggtcaaccctcacgtcaaccatctgtacgctgacttgcaagatgctctcgtgatcctgcagctgtatgagaggatcaaggtgccagtcgactggagcaaggttaacaagccaccttacccgaagctgggagctaacatgaaaaaactggagaactgtaactatgccgtcgaactgggaaagcaccctgccaagttttctctcgtcggcataggtggtcaagacctgaacgatgggaatcagactttgactcttgcattggtgtggcagctcatgagaaggtacaccctcaacgtcctggaggatttaggggacggccagaaggccaacgacgacatcatagtgaattgggtgaatcggactctatccgaggccggtaagagtacatctatccagtctttcaaggacaagactatctcttctagtctcgcagtggtggacctaattgatgcaatccaacccggctgtatcaattacgacctggtcaaaagtggcaacctaactgaagacgacaaacacaataatgcaaaatatgctgtgagtatggcaaggagaattggggctagagtttacgccctgccggaggatttggtggaggtgaagccgaaaatggtaatgacggtgttcgcgtgtttaatgggaaggggaatgaaacgggtctag

SEQ ID NO: 49507 - DNA, 3849 bp, Artificial Sequence
  Description of Artificial Sequence: Synthetic coding sequence
atggccgccgacctgaacctggagtggatcagcctgccccggagctggacctatgggataaccagggggggccgggttttttttataaacgaggaggcaaagtctacaacatggttgcacccggtgacaggagaggccgtggttacggggcatcggcgacagtccaccgatttacccactggctgggaggaggcttacaccttcgaaggcgcccgatattacataaaccacaatgagagaaaggtgacatgtaagcaccccgtcaccggccaaccttcccaggacaattgcatctttgttgtgaacgaacagacagtggccacaatgacctcagaggagaaaaaagaacgccccatttcaatgataaatgaagcatctaattacaacgtgaccagcgattacgcagttcatcccatgagtccagtaggtcggacttcccgcgcctcaaaaaaggttcacaattttgggaagagaagcaattcaatcaaacgcaaccctaacgcaccagtggtgcggagagggtggctctacaagcaggatagcaccggaatgaaactctggaagaaaaggtggttcgtactgtcggacctctgcttattttactaccgggacgaaaaggaagaagggatcctgggatctatccttctgccttccttccagattgctctgctcacctccgaggaccatatcaatcgcaagtatgcgttcaaagccgctcatcctaacatgcggacttactatttttgcacagacactgggaaagagatggagctctggatgaaggctatgcttgacgccgcattagtgcagaccgagcccgtcaagcggatcacatttaattttcgagtcgataaaatcacatccgagaacgcacccaccaaagagaccaacaatatccccaaccaccgcgtactcattaagcccgaaattcagaacaaccagaagaacaaggaaatgtccaagattgaagagaagaaggcactggaagctgagaagtacggcttccagaaggatggccaggataggcccctgactaagattaacagcgtcaaattaaactcactgccttcagagtacgaaagcggctcagcctgtcccgcccagactgtgcactataggcccattaatctaagcagctcagagaacaaaatcgtgaacgttagtctggccgacctgaggggggggaaccgccctaatacggggccactctatactgaagcggaccgagtcattcagcgtaccaattctatgcaacagctggaacagtggattaagattcaaaagggtcgagggcacgaggaagagacaagaggcgtgatcagctaccagaccctgccgcgcaatatgccgagtcaccgggcccagataatggcacgctatccagaggggtatcgcacgctccctaggaacagcaaaacccgaccagagagtatttgtagtgtgacaccatcaactcatgacaagaccctgggtcctggcgccgaggagaaacgacgatccatgcgtgacgatacaatgtggcagctctatgaatggcaacagcggcagttctataataaacagagcacactcccaaggcattccaccctcagctcccccaagacaatggttaatatctctgaccaaaccatgcattctattcccacatctccaagtcacggatccatcgccgcgtaccagggttattcgcctcagagaacctatagaagtgaggtctcttccccaatccagcgcggcgacgttacaatcgaccgcagacatcgcgcgcaccatccgaaacacgtctatgtacctgaccgcagaagtgtgcctgctgggctcacccttcaaagtgtatcccctcagtcactgcagggcaaaacaccagaggagttgactctgctcctgattaagttgcggaggcagcaagctgaactgtcctcgattagagaacatactctagcccaattgatgcagctgaagttggaagcacactccccaaagaatgagatcctgtctcatcacctccagagaaatactatctatttggatcaccagatgaaggaaaatgagccaataattacaatggtgcatactatgattgagaacagcgcgcttaggccccagctgtatcagcagttcctacggcagaaaagcaaaatatctctgtactgcctgagtcaagatgagggacgggggactctttataagtataggcccgaagaggtcgatattgacgccaaactgtcccgactgtgcgagcaggacaaggtcgttcacgccctggaagagaagctgcagcaattgcacaaggaaaagtatactctagaacaggccttactctctgcaagccaggagattgagatgcatgccgataatcccgccgctatacagactgtcgtgctgcagagagacgaccttcagaatggcctgctttccacctgtcgggagctttctagagccaccgccgaactcgagcgagcgtggagagaatatgacaaattggagtatgacgtgactgtgaccagaaatcagatgcaggaacagctagatcacctcggagaggtccagaccgagtcagccggcatccagcgggctcagatacagaaagagctgtggagaattcaggacgtgatggaggggctgtctaagcataaacaacagagaggaaccaccgagattggcatgattggttccaaacccttcagcaccgtgaaatataagaacgaggaggaggaggttgtccccccccgacccccgctgccgagatcttatgattttacagagcaacctcccatcattcctcccttgccatccgactcttcctctttactgtgctattcccgcggccctgtccatctccccgaagagaaaaaaatgtatcaggtccagggttaccctaggaatggaagccactgtggtccagattacaggctttacaaatctgaacccgagctgacaaccgttgccgaagtggatgaatcaaacggagaagaaaaatccgagcctgtgtcagaaattgagacaagtgtcgtgaagggcagccatttcccagtgggcgtggtgccccctcgcgccaagtcccctacacctgagtcttcaactatcgcaagttatgttaccctgcgaaagaccaagaaaatgatggaccttcgcactgaacggcctcgctcagccgtcgagcaactgtgtctggctgaatctacacgtccccggatgactgtggaggagcaaatggaacggatacggcgccaccaacaggcatgtctgcgggaaaagaaaaagggccttaatgtgattggagcctcagatcaaagtccactccaatcaccaagtaatctaagggataatccctttaggacaactcagactaggcggcgcgacgacaaggagctagacaccgccatcagggagaatgacgtgaagccagaccatgagaccccagctaccgagatcgtgcaactgaaggagacagagccacagaatgtggattttagcaaagagttgaagaagactgaaaacatcagttatgagatgctgttcgagccagagccgaacggagttaatagtgtggagatgatggataaagagagaaataaggataagatgcccgaggacgtgactttctcccctcaggatgagacacagactgccaatcacaaacctgaggaacatcctgaagagaatacaaagaattcagtggacgagcaagaggaaacagtgatcagttacgaatcaacaccagaggttagccgcggtaatcagactatggccgttaaaagtctgtccccctcacctgagtcatcagcatcacctgttccaagtacccagccacagctgaccgaggggagccattttatgtgtgtatag

SEQ ID NO: 49508 - DNA, 231 bp, Artificial Sequence
  Description of Artificial Sequence: Synthetic coding sequence
atggccgccgacctgaacctggagtggatcagcctgccccggagctggacatatggaatcacaaggggcggaagggtgttctttattaacgaggaggcaaagtccaccacatggctgcatccagttaccggtgaggccgtggtcacaggccaccggcgtcagagcacagatcttcccactggctgggaggaggcatacacttttgagggcgccagatattacatcaactag

SEQ ID NO: 49509 - DNA, 2382 bp, Artificial Sequence
  Description of Artificial Sequence: Synthetic coding sequence
atgcccctgcccggcggcctgtggtggctgctgtgctgccggcggggctttactctcctgcatagagattacggagacggcgagctctccggagatggtgatgaggacgaagatgaagaaaccttcgaacttcgcacgcccagtcctgccgggggtggccgaggcccgctcgaggtgacactgacccagccagtgagatccgggcctgtctccaatcgtcttcaatcttgggaagagacctggtccttgattcccgaaaagggcctgccagaagacgaccccgatattgtggtgaagggttggctgtaccgagagccccgggggggtggggcacgtccgtggctgcctccccggcgcgcctggtttgtactcactcgagacagtcttgaccagtttagctcttctggcaagggggcccggcggctcggcagccttgtgctgacgtcactttgttccgtgactggccccgagaggcggagaaaggagaccgggctatggtcggttactgtctccgggcgcaagcattcagttcgactctgttcccctcggcaggctgaggcggagcggtggggcgtggccctcagggaggtgatcgccagtaaggcacccctggagacaccgacccagttacttcttcgggatattcaggaaagctgtggcgacccagaggcagtagccctcatctatttacgcaaccctatcttgcgccacacatctggtgccttatacgctccattactgcctcttccttatggagtgtctgcgcccggcccaggatatgctcccctccgggaagaggccgtcaggctctttctggctcttcaggccttggaaggtgcccgaagacctggtcccctgatgcagggggtgctgcagacttgcagagatctgccggccctgagggacgagcttttcctccagctggcgaaacagacgagtggaccagcgggaccaccagggctgcccgcaactcaagatcctgccgcacttcgctactggcaattgcttacatgtatgtcctgcaccttcagaccaggcggtgccgtgcgtgggcacctcctcgggcatctagagcgcacggagcaggccctgccagacagtgaacttgccgaatacgcgcggtttatccgaaaggctcttgggcggacgcgaggccgtgagctggtgccttctttggccgagatcagtgcgctaagccagcgtcaggagttgctctgcacagtgcattgcccgggggcgggggcctgcgccgtcgcaatcgatagccataccacggccggggaggtggcgcgagagctggtcgggcgactaggtctggctaggtccaggaacgctttcgctctttacgaacaacgcggagcacaagaaagagcccttgctggtgggaccctcgtggccgatgtgctcacacggtttgaaaacctggcagctgaagaggctggtctcgaagactccccggactctggatggagattgtgtctgcggctgcacggcccactccatccagaggggctatcaccagatggacacgagctgccgttcttgttcgaacaagcgcacgcgctgctgctgcgcggccgccccccgccacccgacgacaccctgagggcactggcagccctgcgcctgcagtcccttcaacgtgacttctccccccgggttcctcttcctaggcttgatcgccttcttccgccaccggccccaccgcgggaggacccgcctcgtccgaccccacgcccacctccctccgccgccctgttggctggagctctctggagtcccggcctggccaaacggagagccgagagagctagaaggggtggagctggcaggaccgctgggagcatagctagggagggcggcgggggtgccggaactgcggcggccgtgttaggtggctggaagagactgagagggatgggacgagctgaggccatggctgcctatctggctctggcagctcagtgtcccgggttcggtgcggcacgatatgacgttttagagttgtcaaccgaacccggacgcggtgcgccccaaaagttgtgcctagggcttggtgccaaggcaatgagtctctcaagacccggtgagacggagccgatccacagcgttagctacggccacgtggctgcgtgccaactaatggggccacatacactagccttaagagtgggagagtctcagctgctcctccaatcccctcaagtcgaagagatcatgcagctggtgaacgcctatctggcgaatccaagtccagagaggccctgtagcagttcttcccctccctgtcaggatctcccagacacctctcctcccagccagaggccgggcctggacgagcctcagggacaaagcggctgtctggggcaattgcaggattag

SEQ ID NO: 49510 - DNA, 450 bp, Artificial Sequence
  Description of Artificial Sequence: Synthetic coding sequence
atgcggtacaacgagaaggagctgcaggccctgagccggcagcccgctgaaatggcagccgagttgggcatgcgaggtcctaagaagggctccgtgctgaagcggcggctagtcaaactggtggtgaacttcttattctacttcagaaccgatgaagcagagccggtgggggcgttgctgctcgaacgatgtagagtggtgcgagaagagccaggcactttttcaatcagtttcatcgaagatccggaaaggaaataccatttcgagtgttcctctgaggaacaatgccaggaatggatggaggccctgaggcgcgcctcctacgagttcatgaggagatccctgatcttttaccggaatgaaatcagaaaggtcactgggaaggatcctctcgagcagtttggcatctccgaagaggccaggttccagctgtcgggcttacaggcgtag

SEQ ID NO: 49511 - DNA, 3351 bp, Artificial Sequence
  Description of Artificial Sequence: Synthetic coding sequence
atggccgccgacctgaacctggagtggatcagcctgccccggagctggacctatgggatcactagggggggacgggtattcttcattaatgaggaggccaagagcactacttggctccaccctgttactggcgaggctgtcgttacgggccatcggcgacagagcaccgatctcccaacaggttgggaagaggcgtacacgtttgagggcgcacggtattatattaatcacaatgaaaggaaggtgacctgcaaacatcctgtgaccgggcagccatcccaggataactgcatttttgtggttaatgaacagacagtggctaccatgacatctgaggagaaaaaagagaggcctatctctatgattaacgaggccagcaattataatgtcaccagcgactacgcggtgcatcctatgtcgcctgtcgggcgcacgtctagggcatcgaagaaggtgcataatttcgggaagcgcagtaacagcatcaaacgcaacccaaacgcacctgtagttcgccggggttggctttacaagcaggacagcaccggcatgaaactctggaagaaaaggtggttcgtgctgtccgatctctgccttttctactaccgcgacgagaaggaggagggaattctcggaagcattctgctcccctcatttcagatcgcccttctgacgtcagaggatcatataaaccggaaatacgccttcaaggccgcccatccaaacatgcgcacgtattacttctgtactgatacagggaaagagatggagctgtggatgaaagctatgctcgatgcagccctggtacagaccgaaccggttaagagagtcgacaagataaccagcgaaaacgctcctacaaaggagacgaacaatatacctaaccacagggttttaatcaaacccgagattcagaacaaccagaaaaataaagaaatgtcaaaaatagaagaaaaaaaagccttagaagccgaaaaatatggtttccaaaaggacggtcaggacaggcccctcacaaaaataaacagcgtgaagctgaatagcctgccaagcgaatacgagtcgggttctgcttgccctgcacaaaccgtgcactataggcctatcaacctcagctcaagtgaaaataaaattgtgaacgtgagtctggcagatctcaggggtggtaatcgtccaaacactggccccctttatacggaagcagacagggttatccagagaactaacagtatgcaacagcttgagcagtggatcaagatccagaaggggcgcgggcatgaagaagagacgcgcggtgtcatatcttaccaaaccctgccccggaacatgccatcccacagggcacagattatggcccgttatcccgaaggttatcgtacgcttccacggaattcgaaaacacgtcccgaatctatctgctcggtaacgcctagcactcatgacaagacactcggacctggggccgaggaaaagagaagaagcatgagggacgatactatgtggcagctgtacgagtggcaacagcggcagttctataataaacaaagcaccctcccccggcactctaccctgtcctccccgaagaccatggtgaacatcagcgatcagactatgcactctatccctacctccccctctcacggaagcatcgctgcttatcagggttattccccccagaggacgtaccgctccgaggtgagcagccccatccaaaggggcgatgtcacaatcgaccgtaggcatagggcccaccacccaaagcatgtatatgtgccagatagaaggtctgtgcccgccgggctgactttacagagcgtttcacctcagagcttgcagggcaagacattatctcaggatgagggtaggggaacactttacaaatatagacctgaggaggtggacatagacgcaaagctgtcccgattatgcgagcaggacaaggttgttcacgccctggaggaaaaactgcagcaactgcacaaggagaagtataccttggaacaggcactcctgtctgcgtcccaggagatagaaatgcacgcggacaaccccgcggctattcaaaccgtagtgttacagcgcgacgacctacagaacggtctcctgagtacgtgccgcgagctgtctagggctaccgctgaactagagcgggcctggcgggaatacgataagctcgagtatgacgtaacagtgaccagaaaccagatgcaagagcagctcgatcatctgggagaagtgcagacggaatccgctgggattcagagagcccaaattcagaaggagctttggcggatacaggacgtgatggagggtttatctaaacacaagcagcagagaggcaccactgaaattggaatgatcggttccaagccgttttccactgtaaagtacaaaaacgaggggcccgactacaggctttataaatccgagcccgagctgacaacagtggcagaagtcgatgagagtaatggcgaggaaaagagtgaacccgtgagcgaaattgagacctctgttgtgaaaggatcccatttcccagtgggcgttgtacctccaagggccaaaagtcctacccctgagtcttccacaattgcttcctacgttaccttgaggaagactaagaagatgatggatctgaggacagaaaggccgcggtcagcagttgaacagctgtgcctggctgagtccaccagacctaggatgactgtggaagagcagatggaacgcattcgacgacaccagcaggcctgtctgcgtgaaaagaagaagggacttaacgtaattggcgccagcgaccaatcacctctccagtcccctagcaatttgagagacaacccatttagaacaacacagacaaggcgccgcgacgacaaggaactggacactgcaattcgtgagaacgatgttaagcctgaccacgaaacacctgctacggagattgtgcagctcaaagagactgagccacagaacgtggatttttctaaggagttgaagaaaacagagaacatcagctatgagatgctgttcgaaccagagcccaatggagtcaatagcgtcgagatgatggacaaggagcggaacaaggataaaatgccagaagatgtgaccttctctccgcaagacgaaacacaaaccgctaatcacaagccagaagagcacccagaggagaatactaaaaactctgtggacgagcaggaagagacagtgatctcatacgagtctactcctgaagtttctcgcggaaaccaaaccatggccgtcaagtccctctctccatcgccggagagtagcgcatcccctgtgccttcaacgcaaccccagcttaccgaagggtcccatttcatgtgtgtttag

SEQ ID NO: 49512 - DNA, 1953 bp, Artificial Sequence
  Description of Artificial Sequence: Synthetic coding sequence
atggccgccgacctgaacctggagtggatcagcctgccccggagctggacgtacggcatcactagaggcggtagggtttttttcattaacgaggaagccaaatctaccacatggttacatcctgtcacaggagaggcggtggtcactggccaccggagacagtccactgatttgccgacgggatgggaggaggcttatacctttgagggcgctcgctattacattaaccataacgagcggaaggtcacctgcaaacatcctgtgactgggcagccgagccaggacaattgcatttttgtggtgaatgaacagaccgtagcaacaatgacctctgaagagaaaaaggaacgacctatttcaatgatcaacgaagcctccaattacaatgtaacatcagattatgcagtgcatcccatgtcacccgtaggtcggacctcgcgcgcatcaaaaaaagtccacaatttcggcaagagatcaaatagcattaaacgcaatccaaatgcacctgtggtgcgccgaggctggttgtataaacaggactctacaggcatgaagctatggaagaagcggtggttcgtgctatccgacctttgcttattttactaccgagacgagaaggaagaaggaattcttggatccatcctgctgccctccttccaaattgcactcctgacaagtgaagaccacatcaatcgcaagtatgcatttaaggccgctcatcccaacatgagaacctactacttttgcaccgatacaggaaaggaaatggaactctggatgaaggccatgttagatgccgcgctcgtccagacggagcccgtgaagcgtgtggacaagattacaagcgagaacgctcccacgaaggaaaccaataacataccgaaccatcgcgtgctaatcaagccagaaattcagaacaatcaaaagaataaggaaatgtcaaaaatcgaagagaagaaggctctcgaggcagagaaatacgggttccagaaagatgggcaggatagacccctgaccaagatcaatagcgtgaaactgaacagcctgccctctgaatacgagagcgggtcagcatgtccagcgcagacagtgcattaccgccctatcaatcttagtagtagtgaaaacaagatagtaaacgtttccctggccgatctccgcggaggtaataggcccaacaccgggcccctgtataccgaagcagaccgggtaattcagcgcaccaattcaatgcagcagcttgagcagtggataaaaatccagaaagggcgcggccatgaggaggagaccagaggggtgatctcctatcagacccttccccggaacatgccgagtcaccgcgcccaaattatggccagatatcctgagggataccgaacgttaccccggaattccaagactcggcccgagtcaatctgctccgtgaccccaagtacccatgataagactctaggcccgggcgccgaggaaaaacgccggtccatgagggacgatacgatgtggcagctgtacgaatggcaacagcggcagttctataacaagcagtctacactcccccgtcactctacactgtcgagtcctaagaccatggtgaacatatctgatcagaccatgcactcgatacccacttcaccatcccacggatccatagcagcataccaggggtatagcccccagcgcacttaccgcagtgaagtgtcttcacctattcaaaggggggatgtcacaattgatcgccggcatagagcccaccatcccaagcacgtgtatgtgcccgaccgaagatcggttcccgccggccttactctgcagtcggtttctccccagagcctgcagggtaagacgtggggacgagaaaaagttgcaacagccaccggggccgctgaagcagtggcatccgatacccacctgcccagaactggatcgtcaagccccagtcttctgtgtgtctag

SEQ ID NO: 49513 - DNA, 3540 bp, Artificial Sequence
  Description of Artificial Sequence: Synthetic coding sequence
atggccgccgacctgaacctggagtggatcagcctgccccggagctggacctatggtataacacgaggcgggcgagtgttttttataaatgaggaggctaaatccactacctggttacatccagtgacaggagaggctgtagtcaccggacacagacgccagtctacggatctcccgacgggatgggaagaagcttacacctttgagggggcaaggtattatatcaatcacaacgaaagaaaagtgacatgtaagcatccagtcactggccagccgtctcaggacaactgtatatttgtggtgaacgagcagacggttgcaactatgacatccgaagaaaaaaaggagcgacccattagcatgatcaacgaggcatcaaactataatgttacctccgattatgccgtccatccaatgtcacccgtgggtcggacctctagggcttctaaaaaggttcacaatttcggaaagcgcagcaacagtatcaagcgcaatcccaatgcccctgttgtgcggcgaggatggctctacaaacaggattccaccggcatgaaattatggaagaagcgatggttcgtcctgtctgatctgtgcctgttctattatagagacgaaaaagaagaaggcatcctcgggagcatcctgctgccctccttccagatcgccttgctaacgtccgaagatcacatcaaccgcaagtacgctttcaaggccgctcaccctaacatgagaacctactacttctgcacggacaccggtaaggagatggaactgtggatgaaagccatgctggacgccgccctagttcaaacggaacctgtgaaaagagtcgacaagattaccagcgaaaatgcgccaaccaaggaaacaaataatattcctaaccaccgcgtgctgataaaacctgagatccagaataatcagaaaaacaaagaaatgtctaaaatcgaggaaaagaaggctctggaggccgagaaatacggtttccaaaaggatggccaggatagacccctgactaagatcaattcagtgaaactgaactcccttccttccgagtacgagagcggaagcgcttgcccggcccaaacagtgcactataggccaataaacctttccagcagcgaaaataagatagtgaacgtttctctcgccgaccttcgcggagggaacaggcccaataccggcccactgtacactgaggccgaccgagtgatccagcggaccaatagcatgcagcagttggaacaatggattaaaatccagaagggtaggggccacgaggaggaaacacgcggagtaatatcctatcagaccctgccgagaaatatgccctcccatcgcgctcagatcatggcaagatacccagaagggtatcgaacactgcctagaaacagtaaaaccaggcctgagtccatatgctcagtgactccaagtacacatgacaaaactcttggtcccggagccgaagaaaagcgtaggtcaatgagagatgatacaatgtggcagttgtacgagtggcaacagcggcagttttataataagcagtcaaccctgcccagacattccaccctctctagtcccaaaaccatggttaatatcagcgatcagacgatgcacagcattcccacatcaccctcccacggctctatcgccgcgtatcagggctactcaccacagagaacatataggtctgaagtgagctctccaattcagagaggcgatgtgactatcgaccgcaggcaccgggcacaccatcccaagcatgtgtacgtcccagacaggcggagtgtgccagccggccttacattgcagtccgtgtcaccacagtcgttgcaaggaaagaccctcagccaggacgagggacggggcacactgtacaaatacagacctgaggaagtggacatagacgccaagctgtcgcgactgtgtgagcaggacaaggtggtgcatgccctagaggagaagctgcagcagctgcataaagagaagtatactttagagcaggccttactgtcggcgtctcaggagattgagatgcacgcagataaccctgccgccattcagactgttgttctgcagagagacgatctgcagaacgggttgttaagcacctgtcgcgaactgtcaagggccacagcagagctggagagggcttggagggaatatgataaacttgaatacgacgttacggtgactagaaatcagatgcaagaacagcttgatcatctgggcgaggtgcagacagagtccgcaggtattcagcgggcccaaattcagaaagagttgtggagaatccaggatgtcatggaaggcctgagtaagcacaaacagcaacgcggtaccacagagatcggcatgatcggctcaaagccattttctacagtaaaatacaagaacgaggaagaggaagttgtaccacccaggccacctttgccgaggagctacgatttcactgaacagccacctattatccctccactgccctccgatagtagtagcttgctttgctacagccgcgggccagtgcatttgcccgaggagaaaaaaatgtatcaggtgcaagggtaccctcggaatgggtcccactgtggcccggactatcggctgtataaaagcgaacccgaattgactaccgtggccgaagtggacgaatccaacggtgaagaaaagtcagagcctgtgtcagagatcgagacttccgtcgtgaaaggatctcattttcccgttggagtagtcccccccagagccaaatccccaactcccgagagcagcacaattgcttcatatgttacactccggaagaccaaaaagatgatggatctgaggaccgaaagacctcggagtgcggtcgaacaactctgtctggctgagtccacacgaccacgaatgacagttgaagagcaaatggagcggataagacgccaccaacaggcatgtttgagggagaagaagaagggcctcaacgtaatcggcgcctctgaccagtctccccttcagtccccgtctaatctgcgcgataacccattcaggacgacacaaaccagacgtcgggacgataaggagctggatacagccataagagagaatgacgtaaagccagatcacgaaaccccagccaccgagattgttcagctgaaagaaacagaacctcagaatgttgacttttcaaaagaactgaaaaagaccgagaatatcagttatgaaatgctgttcgaaccagaacccaacggcgtaaactccgtggaaatgatggataaagagaggaacaaagataagatgcccgaggatgtcaccttcagtccccaggacgaaacgcagacggcaaaccacaagcccgaggaacatcccgaggagaataccaaaaattcagtcgacgagcaggaggaaaccgtgatttcctacgagagtacaccagaagtaagtcgcggaaatcagacaatggcggtgaagtctctgtcaccatcaccagagtcaagcgcttcaccagtccccagtacccagccccagctcacagagggctctcacttcatgtgtgtctag

SEQ ID NO: 49514 - DNA, 3525 bp, Artificial Sequence
  Description of Artificial Sequence: Synthetic coding sequence
atggccgccgacctgaacctggagtggatcagcctgccccggagctggacatacgggatcactaggggaggtcgagtgttctttatcaacgaagaagcgaagtctactacttggctgcacccagtcacaggagaggccgtcgtgactggccacaggagacaatccaccgatcttccaactggctgggaagaagcttacacatttgagggagcacgttactacatcaatcataacgaaaggaaggtgacatgcaaacaccccgtcacaggccagccatcacaagataactgcatttttgtggtgaatgaacagaccgtggccactatgaccagtgaggagaagaaagaaaggcccattagcatgataaacgaagcatccaactataacgtgacctctgactacgcggtgcatccaatgagtccagtcgggcggactagcagagcgtctaagaaggttcataacttcggcaaacgctctaatagcattaagcggaatccaaacgcccccgtggtccgccgcggatggctttacaagcaggattccaccgggatgaagctttggaaaaagcggtggtttgtactttcagatctgtgtctattctactaccgggacgaaaaggaagagggtattctggggtctatactcctcccctctttccaaatcgctctgttgaccagtgaagatcacataaaccggaagtacgctttcaaagccgctcatcccaacatgagaacttactacttctgtactgatacagggaaagagatggaattgtggatgaaggctatgctcgacgcggcgcttgtgcagactgaacctgtgaagagagtcgacaagataactagtgagaatgcgcccacaaaggagactaacaacattcctaatcacagagtactgatcaagcccgaaatccagaacaatcagaagaacaaggaaatgtcaaaaatcgaggagaaaaaggccctagaagccgagaaatacggctttcagaaggacgggcaggacagacctctgactaaaatcaacagtgttaagctgaactcgttgccttccgaatacgaatctggaagcgcctgcccagctcagacagtacattaccgacctatcaacctcagcagctctgagaataaaattgtcaatgtgtcattggccgatctgcgcggcggcaaccgtcccaatacaggtcccctttacactgaggccgaccgagtcatccagcgcaccaattcaatgcagcagctggaacaatggattaagatacagaagggaaggggccacgaagaggaaactaggggagtgataagttatcagacactaccccggaacatgccttcacatagagcacaaattatggcacgatacccagaaggctaccgaacgctgccacggaatagtaaaactagaccagagtcaatttgtagtgttacgccgagtactcatgataaaacactcggccctggggccgaggagaaacggcgaagtatgcgggacgacacaatgtggcagttgtatgagtggcaacagcgtcaattctacaacaagcaaagtacactgcctcgacacagtactttatcttccccgaagactatggttaacatcagtgatcagaccatgcacagtattccaaccagtccctcacacgggagcattgcggcttaccaaggttacagtccacagcgtacatatcgcagcgaggtcagttccccaatacagaggggtgacgtcacaatcgaccgcaggcatcgtgctcaccaccccaagcacgtgtacgtgccagaccgcaggtcggtaccagctggactgaccctgcaatctgtttctccgcaaagcctccagggcaaaacacccgaggaactgactctacttcttattaagctgagaagacagcaggccgaactgtccagcattagggaacataccctggcacaactcatgcagctcaagctcgaggctcacagccccaagaacgaaattttatctcatcaccttcagagaaatacgatctatctggatcaccagcttagccaagacgaaggcagaggcacactgtacaaataccggcctgaagaagtggacattgacgccaagctttcccgcctctgtgaacaagataaggtggttcatgcactggaagagaaactgcagcagctccacaaggagaaatataccctggaacaggctttgctttcagcctcgcaggaaatcgaaatgcacgccgacaacccagctgccatccagaccgtggtgctccaaagagatgatttacagaatggactgttgtcgacctgtagagaactgtcccgcgccacagctgaactcgagcgagcctggagagaatacgataagttggagtacgatgtgacagttacccgcaaccaaatgcaggagcaactcgatcacctcggcgaagtgcagaccgaatccgcaggcatacagcgcgctcaaatccaaaaggaactgtggcgcatacaggatgtaatggagggactcagtaagcataagcagcagcgaggcactacggaaatcggcatgataggctccaaacctttttctacagtgaagtataagaacgagggcccagactatcgactttataagtccgagccagaactcacaaccgtggccgaggtcgatgagtctaacggggaggagaaatctgagcccgtatcagagatagagacatccgtggtgaaggggtcccacttcccagtgggtgttgtgccaccccgagcaaagtcacccactcctgagtctagcaccatcgcaagttacgtgactctgagaaaaactaagaagatgatggatcttcgtacagagcggcccagaagtgccgtggagcagctgtgtctcgctgaatctacccgtccacggatgaccgtagaggagcaaatggagaggatccggaggcaccaacaggcgtgcctcagagagaagaagaaggggctaaatgtcattggcgccagcgatcagtcacccttgcaatccccttctaatttacgggacaaccccttccggaccactcagacacgccgccgggatgataaagagttggacaccgctattcgagagaacgacgtgaagccagatcatgaaaccccagcgaccgaaatagtccaactgaaagaaaccgagccccagaatgtcgacttcagtaaggagctcaaaaaaacagaaaatatttcttacgagatgttattcgaaccggagccaaacggcgtaaattcagtcgaaatgatggacaaggagcgtaataaggataagatgccagaggatgtgaccttctctccacaggatgagacccagacagccaaccacaagcccgaagagcacccagaagaaaataccaagaattcggttgatgagcaggaagagacggtaatatcttatgaatccaccccagaggtcagtcgcggaaaccaaacaatggctgtgaaaagtctgagtccatccccggagagtagcgccagccccgtcccctctacacagcctcaattaacagagggatcccattttatgtgcgtctag

SEQ ID NO: 49515 - DNA, 3183 bp, Artificial Sequence
  Description of Artificial Sequence: Synthetic coding sequence
atggccgccgacctgaacctggagtggatcagcctgccccggagctggacctacggaatcaccagggggggaagggtctttttcattaacgaagaggctaaatcaacaacatggctccatcctgtcactggcgaggcggtggtcactggacatcgcaggcagagcaccgacctgccaaccgggtgggaagaagcttacacttttgaaggcgccagatactatataaaccataacgagagaaaggtgacatgcaaacaccccgttacaggccagcccagccaggacaactgcatatttgtcgtgaatgaacagacagtagctaccatgacaagcgaggaaaagaaggagagacctatctctatgattaatgaagccagcaactataatgtcacgagcgattacgctgtgcacccaatgtcaccagtgggccggacgtcaagagcctcaaagaaagtacacaacttcggtaaacgatctaactcaatcaagaggaaccccaacgcccctgtagtccgacgaggatggctgtacaaacaggactcaacgggcatgaaactgtggaagaagcgctggttcgtgctttcggatctgtgtctgttttactaccgcgatgaaaaagaggaaggtatccttggctccattctcttgccgtctttccagatcgccttgttaacttcagaagaccacatcaaccgcaagtatgccttcaaagctgcacacccgaatatgagaacctactacttttgcactgatactggaaaggagatggagctgtggatgaaggctatgctagatgccgctctggttcagactgagcccgtaaagcgggtcgacaagatcacctctgaaaacgcccccactaaagagactaacaacattccaaatcaccgtgtgctgattaaacctgaaattcaaaataatcagaaaaataaagagatgtcaaagattgaggaaaaaaaagccctcgaagccgaaaagtacgggttccagaaggatgggcaggacagacctttaacaaaaatcaatagtgtgaagctaaatagcctgccatcggaatatgagtctggatccgcctgtccagcacagaccgttcactatcgccctattaacctatcgagtagtgagaacaagatagtgaacgtatcacttgctgatttacgggggggcaatcgtcctaatacaggccccttatacaccgaggctgacagggtcattcaaagaaccaacagtatgcagcagctggagcagtggatcaaaatacagaaaggcagggggcacgaggaagaaactcgcggggtgatcagctatcagacgctccctcgaaatatgccctcacaccgggcacaaataatggctcgttaccccgagggatatcggactctcccacgcaattctaagacacggcccgaaagtatctgtagcgtgacccctagcacgcatgacaagaccctgggcccaggggctgaagagaaacggcgatcaatgcgagatgataccatgtggcagctctacgagtggcagcagaggcagttttataataagcagtcaactttacccaggcactctaccctcagttcccccaaaaccatggtaaacatttccgatcagaccatgcactcaattcccaccagcccatctcacggctccatcgctgcttaccagggatattccccccagagaacctaccgaagtgaagtttcctctcctattcagagaggagacgttactatagacagaagacatcgggcccaccatcccaagcacgtgtacgtgcccgacagaaggtccgtcccggccggcctgaccttacaatccgtgagcccgcaaagcctgcaaggcaaaacattgtcccaggacgaaggacgcggcaccctatacaaataccgcccggaggaggtggacatagatgcaaaactctcacgcctgtgtgaacaggacaaagttgtgcatgcactggaggagaaattacaacaactgcataaagaaaaatacacacttgagcaggctctgctgagtgcttcgcaggagatcgaaatgcacgcagataatccagcagccatccagaccgtcgtacttcagagggatgacttgcagaacggcctgctctctacatgccgggagctctcccgcgcgaccgctgaactcgaaagagcctggcgcgaatacgacaaattggaatatgatgtaacagttactcgcaatcaaatgcaggaacagctggaccatctgggcgaggtacagacagaatcagccggaattcagagggcacaaattcagaaggaactgtggaggatccaagacgtgatggaagggcttagtaagcacaagcagcagcggggaactaccgagattggctcccactttccagtcggagtggtgccccctagggcaaagagtccaactcccgagagcagcaccattgcaagctacgtaaccctaagaaaaacgaagaaaatgatggacctgagaaccgaacgtccgaggtccgctgtggagcagttgtgtctggcagaatctactcgtcctaggatgacggtagaggagcagatggagcgaattcgtagacaccagcaagcttgtctccgtgagaaaaagaaagggctgaacgtgatcggagcatcagaccagtcccctctccagtcaccaagcaatctccgcgacaaccctttccggactacccagacccgccggcgggacgataaagagctggacaccgccattagggagaatgatgtgaaaccagaccacgaaacccctgcaaccgagattgtacaactgaaggagacagaacctcagaatgtcgatttttccaaagagcttaagaagaccgaaaacatttcatatgaaatgctcttcgagccagagccaaacggggtgaattccgtggaaatgatggacaaagagcgcaataaagacaagatgcctgaagatgtgactttttcgccccaggatgaaacacaaacagccaatcataaaccggaagaacatcctgaagaaaacactaaaaactcagtcgacgagcaagaggaaaccgtcatttcctatgaaagtacccctgaggtgtcccgcgggaaccaaaccatggcagtaaaatcactatcacccagtccagagagttcggcatcgccggtgccctctacccagccccagctgacagagggaagtcacttcatgtgtgtgtag

SEQ ID NO: 49516 - DNA, 963 bp, Artificial Sequence
  Description of Artificial Sequence: Synthetic coding sequence
atggccgccgacctgaacctggagtggatcagcctgccccggagctggacctacggcattacaagggggggacgtgttttttttattaacgaagaggccaagagcaccacctggttgcacccagtaactggggaggccgtagtaactggtcatcggaggcagtcaacggacttgcctactggatgggaggaagcctacacattcgagggagcccgatactacattaaccacaatgagagaaaagtcacatgcaaacaccccgtgactggccagcctagccaggacaattgcatcttcgtggtgaatgagcagaccgtcgcaacaatgacttccgaagaaaaaaaagagcgccccatttctatgatcaacgaagcctctaattacaacgtcaccagcgactatgcagttcatccaatgagtcccgtggggagaacctcaagagcgtctaagaaggtgcacaactttggcaaacgctctaactcaatcaagaggaaccccaatgcgcccgtcgtcaggcgcggctggctttataagcaggactccacagggatgaaactttggaaaaagcgttggttcgttctgtctgacctatgtctcttctactatcgagatgaaaaggaggaggggatactcggatctatcctgttgccatcatttcagatagccctactgacctcagaagaccatatcaaccgcaagtatgcctttaaggccgctcatcctaacatgcggacatattacttctgcaccgacactggcaaggaaatggagctctggatgaaagctatgttggatgcagctctggtgcaaaccgaacctgtcaagagggtcgacaaaataacgagcgaaaacgccccaaccaaagaaaccaacaacatacccaatcatagagtgctgatcaaacctgaaatccagaacaatcagaaaaacaaggagaaaaagaaaaaaaaaaagaaaaagtag

SEQ ID NO: 49517 - DNA, 3318 bp, Artificial Sequence
  Description of Artificial Sequence: Synthetic coding sequence
atgaccagcgaggagaagaaggagcggcccatcagcatgatcaacgaggccagcaattataatgtgacttccgactacgccgtgcaccctatgtccccagtgggtcgaactagtagggcttcaaagaaggtccataattttggaaagagaagcaactctattaagaggaacccaaacgcccctgtggtccggcgaggctggctatataagcaggactctaccggtatgaaactttggaagaaacgttggtttgtcctcagtgatctctgccttttttattatagagatgagaaagaggaaggaattcttggctccatcctgttgccaagctttcagattgccctgctcacatcggaggatcacatcaatcggaaatacgcgttcaaagccgcccacccgaacatgcggacatactacttctgtactgacactgggaaggagatggagctgtggatgaaggccatgttggacgctgccctagtgcagacagagcccgttaaacgagtggataagatcaccagcgaaaacgcacccaccaaagaaactaacaatattccaaatcatcgagtgctaataaagcctgagattcagaataatcagaaaaacaaggagatgtcaaagattgaggagaaaaaggccctggaggccgagaaatatggattccaaaaagacggtcaggacagacctctcacaaagatcaattccgtaaagctgaacagcctgccttccgagtatgaatccgggagcgcgtgccccgcccaaaccgtacattaccgcccaatcaacctgtcaagcagcgagaacaaaattgttaacgtttcactcgctgatttgcggggcgggaatcgacctaacaccggtccattatacactgaggccgatcgagttattcagagaacaaacagcatgcagcagcttgagcaatggataaaaatccagaagggcagggggcacgaggaggaaactagaggtgtgatttcctaccagacactgccacggaatatgccatctcaccgcgctcagataatggccaggtaccctgaaggttaccggaccttaccccggaatagtaagacccgccccgagtcgatttgctcagttactccgtctacccatgataaaaccttaggccccggcgctgaagaaaagagacggtccatgcgggatgatacaatgtggcagctgtacgagtggcaacagcgccagttctacaacaagcagtctacactgcctagacattctacactcagttctcctaaaaccatggtgaacatttctgaccaaactatgcatagcatccctacctctccttcacacggatcgatcgccgcctaccaaggctattctccccagcgaacttacagatctgaagtgtcttcacctatacaaagaggagacgttaccatagaccgcagacaccgggctcaccacccaaagcacgtgtatgtgccagaccggcgctccgtgcccgccggtttaacactccaatcggtgtcaccgcaaagcttgcagggtaagacaatgaaggagaatgaacctatcatcacaatggtccacaccatgattgagaatagtgcgctacggcctcagctgtaccagcagttccttaggcagaaatcaaaaatttccctgtactgcctgtcacaggacgagggacgcggcacattgtacaagtataggccggaggaagttgacatcgacgccaaactgtctaggttgtgtgaacaagacaaagttgtgcatgccctcgaggagaagttgcaacagttacataaagaaaagtatacattggaacaggcactgctgtcggccagccaggagatcgaaatgcacgccgataacccagctgcaatccagacagtagtgctgcagcgcgacgacttacagaacgggctgctgtcaacctgtcgggagctgtcgagggcgactgctgagctggaaagagcatggcgagaatatgacaagttggaatatgacgtgactgtgaccagaaaccagatgcaggagcagctcgaccacctgggggaagtgcagacagagtccgccggtatccagcgtgcccaaatccaaaaagaactttggagaatccaggacgtgatggaaggactgagcaagcacaagcaacagcgtggcatgattgggtcaaaaccttttagcacagtaaagtataaaaacgaagaggaggaagtcgtaccccctaggccccctcttcctcgatcatacgattttacagagcagcctccgattatcccaccgctacctagcgattcgagtagcctgctttgctacagcaggggaccggtccatttaccagaagaaaaaaagatgtaccaggtccaggggtatccacgcaacggttctcattgcggcccagactaccggctgtacaagagtgagcccgagctgacaactgtggccgaagtggacgagtctaatggagaagagaagagcgaaccagtgtcagaaatcgagacctctgttgtaaaaggctcacattttccagttggggtcgtaccccccagggcaaagtctcccacgccggagtcaagcaccatcgcttcctacgtgactctcaggaaaaccaaaaagatgatggacctccggactgaacgacctcgatcagcggttgagcagctttgtttagccgaatcaacccggcccaggatgaccgtagaggaacaaatggaaagaattcgtcgccaccagcaggcctgtctccgagagaagaaaaaaggcctgaacgtcataggcgcgtccgatcagtcacctttacagagtcctagtaatttaagagacaaccccttcaggacaacacagacaagacggcgggatgacaaagaactggacacagccatccgcgagaatgacgtcaagccggatcacgagacccccgccactgagatcgtgcagctaaaagaaacagagccccagaatgtcgacttctctaaggaactaaagaagactgaaaatatttcatatgaaatgctgtttgagcctgagccaaatggcgttaacagcgtggagatgatggacaaggaaaggaacaaagataagatgcccgaggacgtgacattttccccacaagatgagacacagaccgccaaccacaaacctgaagaacatccagaagaaaatacaaaaaactctgtggatgagcaggaagagacagttatctcttatgagagcaccccagaggtctcacggggtaatcaaacaatggcagtaaaatcccttagcccatcccccgaatccagtgccagtcccgtgccatctacgcaaccacagttaaccgaaggttctcacttcatgtgcgtgtag

SEQ ID NO: 49518 - DNA, 3525 bp, Artificial Sequence
  Description of Artificial Sequence: Synthetic coding sequence
atggccgccgacctgaacctggagtggatcagcctgccccggagctggacgtatggtataacccgtgggggccgcgtcttttttatcaatgaggaagcgaagagcaccacatggctgcaccccgtaactggcgaggctgtcgtgactggccataggcggcagtcaactgatctgcccacaggctgggaggaggcttacacatttgagggagctcggtactacatcaaccataacgagcgcaaagtcacgtgcaagcatcctgtgactgggcagccttctcaagacaattgcatctttgtggtaaacgagcagaccgtggccacaatgacatcggaggaaaagaaggagcgcccaatcagtatgatcaacgaggcgtccaattataacgtaacctccgactatgccgtgcacccaatgagccccgttgggagaaccagtcgggctagcaagaaagtgcataactttggcaaacggagcaatagcattaagcggaatcccaacgctcctgttgtgaggaggggatggttgtacaagcaggacagcactggtatgaagctctggaaaaagagatggtttgtgctgtctgatctctgtctcttctattacagagacgaaaaagaagagggcattctgggctctatattactaccatccttccagatcgccctgctcaccagcgaagatcacatcaaccgcaagtacgcattcaaagctgcacaccctaacatgcgaacctattacttttgtaccgacaccggcaaggaaatggaactatggatgaaagctatgttggacgccgctctggtgcagacagagccagttaaacgggtggacaaaattacatcagagaacgctccgacgaaagaaaccaacaatattcctaaccaccgcgtgttaatcaaacctgagatccagaataaccagaaaaacaaggagatgtctaagatcgaagaaaagaaggccctcgaagcagaaaaatacgggtttcaaaaggacggccaggaccgaccacttaccaagattaatagtgtgaagctaaactctctgccgtcggagtatgaaagcggttcagcctgcccggcccagaccgtgcactatcgaccaatcaacctgtcatcttcggaaaataaaattgttaacgtgagcctggccgatttgaggggtggtaacagaccaaacaccggacccttgtataccgaggcagatagggtgatccagcggacaaacagtatgcagcaactggagcagtggataaagatccagaagggacggggccacgaggaggaaacacggggggtgattagctatcagacactgccccgaaatatgccgtcacatcgggcccagattatggctagataccctgagggctatcgcactctgccgcgtaatagcaaaactagacccgagtcaatctgttctgtcaccccctctacacacgacaagaccttgggacctggtgctgaagaaaaaaggcgctctatgcgagacgatacaatgtggcagttgtatgagtggcaacagaggcagttttataataaacagtctaccctcccgagacactccacactctccagccccaagactatggttaatattagcgaccagacgatgcatagcatcccaaccagtccttcacatggctccattgcggcgtaccagggctattcgccacagcgcacatatcggagtgaggtttcttctcccatacaacgtggagacgtgacaatcgaccgaagacatcgggcccaccatccaaagcatgtatacgttccagataggcgcagtgtgcctgctggcctcactctccagtcagttagcccacagtcccttcaggggaagacaccagaggagctgacactgctactgatcaagttgagacggcaacaggcagaactttcctccatcagagagcatacactggcacagttaatgcagctcaagttagaagctcactcgccaaagaacgagatcctgtcacatcatttgcagagaaatacaatctatctggaccatcagttgtcccaagatgagggaagaggtactttgtacaaataccgccctgaggaggtcgatattgacgccaaactgtcccggttgtgtgagcaggacaaagtcgttcacgcgctcgaggaaaagttgcagcagctgcacaaggaaaagtacaccctggagcaggccttgctgagcgcaagtcaggagattgagatgcacgccgacaatccggcagccatccagactgtcgttctgcaacgggacgatctgcagaacggcctgctgtctacgtgcagggaactcagtagggccaccgccgagctggagcgcgcctggagggagtatgataagctcgaatacgacgttacagttacccgcaaccagatgcaggaacaattggaccacctgggggaagtgcagacagagtctgccggtattcagagggcgcagattcagaaagaactgtggcggatacaggatgtgatggaaggcttgagcaagcataaacaacaacggggcaccacggagatcggaatgatcggctcaaagcctttttcaacagtgaagtacaaaaatgagggaccggactaccggctgtataagtctgagcctgaattaaccaccgtggcggaggtggacgaatcaaacggggaagaaaagtcggaacccgtcagcgagatcgagacatccgtcgtgaaaggtagccacttccccgtcggtgttgtgccgcccagagctaagtccccaactccagagagctctacaatcgcgagctatgtgacactgagaaaaactaagaaaatgatggacctgagaacagagcgaccacggagtgccgttgaacaactgtgcttggccgaatccacgcggcccagaatgacagtggaggagcaaatggagcggatcaggcgccaccagcaggcctgtctaagagagaaaaaaaagggactgaacgtgatcggggcgtccgatcaaagtcccttgcagagcccaagcaatctgagggataacccattcaggacgacgcagacacgccgccgcgacgacaaagaactggatacagcgatcagggaaaacgacgtaaaacccgaccacgagactccggccaccgagattgttcagttaaaggagacagagccacagaacgtcgacttcagtaaagaattgaagaagaccgagaacattagctatgaaatgctgttcgagccggagccaaacggcgtgaactccgtagaaatgatggataaggagagaaacaaggataagatgccagaggatgtgactttctccccccaagatgagacgcagacagccaatcacaagcccgaggaacatcctgaggaaaacaccaagaacagcgtcgacgaacaggaggaaaccgtcatttcatacgagtccacccccgaagtttccagaggcaatcagacgatggccgtgaagagtttatccccttctccggagagttccgcaagccccgtccctagcacacagcctcagctgacggagggatcacacttcatgtgtgtctag

SEQ ID NO: 49519 - DNA, 1194 bp, Artificial Sequence
  Description of Artificial Sequence: Synthetic coding sequence
tacaccctggagcaggccctgctgagcgccagccaggagatcgagatgcacgccgataatcccgcagctattcagaccgtcgttcttcaaagggacgacctccagaacggcctactgagcacatgtcgagagctgtccagagctacagccgagctggagcgagcatggagagagtatgacaagttggaatacgatgttaccgtcaccaggaatcaaatgcaggagcagttggaccacctgggcgaggtgcaaacagagtcggcagggatccagcgcgcccagattcagaaggagctttggagaatccaggacgtgatggaaggcctaagtaaacataagcagcaaaggggtaccacagagattggctcccattttccggtcggagtagtacctcctcgcgcgaagagtcctactcctgagtcctcaaccattgcatcatacgtgactctgcggaagaccaagaaaatgatggatttgagaacggaaaggccacggtccgcagtggagcaactctgcctggcagagagcacgaggcctaggatgaccgtcgaggagcagatggagcggattcgccgccaccaacaggcctgtctccgcgagaaaaaaaaaggtttaaacgtgattggcgcaagtgatcagtcacctttacagagcccgagcaatctgcgcgacaatccttttcgtaccactcaaacccgtagaagagacgataaagagcttgacactgctatccgcgaaaacgatgtcaagcccgatcacgaaacacccgccacagaaattgtgcagcttaaggaaaccgaacctcagaatgtggatttctctaaggaactaaaaaagacagaaaacatctcctatgaaatgctttttgagccggagccgaacggtgtgaatagcgtggaaatgatggacaaagagagaaataaggataaaatgccggaggacgtcaccttcagcccccaggatgagacccagaccgcaaatcataaacctgaagaacatcccgaagagaataccaagaatagcgtggatgagcaggaagagacggtaatatcttacgaatcgactcccgaagtgagtcgcggaaaccagaccatggccgtgaaaagccttagcccctcacccgagagttccgcgagccccgtcccctcgacccagcctcagctcaccgagggcagccattttatgtgtgtgtag

SEQ ID NO: 49520 - DNA, 2625 bp, Artificial Sequence
  Description of Artificial Sequence: Synthetic coding sequence
atgcggacctactacttctgcaccgacaccggcaaggagatggagctctggatgaaggccatgctcgatgccgccctcgttcaaactgagccagtcaaaagggtggacaagataacgtctgagaacgcccccactaaagaaaccaataacatccctaaccaccgcgtactcatcaagccggagatccagaacaaccagaaaaataaggaaatgagcaagatagaagaaaaaaaagcccttgaagcagagaaatacggatttcagaaggacggccaggatcgtcccctgactaagatcaatagcgtgaaattgaattctttaccaagtgagtacgaatccggatcggcttgtccagcccaaacagtgcactatcggccaatcaacttgagcagctccgaaaacaagatcgtaaacgtgtccctagctgatctgagaggaggcaaccggcctaacactgggcccctttacaccgaagcggaccgagtgattcagagaacaaactctatgcagcagttggagcagtggattaaaatccagaagggccgtggccacgaggaggaaaccagaggcgtaatctcataccagaccttgccccggaacatgcctagtcatcgggctcagattatggcgcggtatccagagggctacagaaccctgccccgcaactcaaaaacccgaccagagagtatatgcagcgtgacacccagtacacacgacaaaaccctggggcccggggccgaggagaaacgtagatccatgagggacgatactatgtggcaattatacgaatggcagcaacggcagttctacaataagcaaagtactctgcctcggcacagcactttgtcaagccctaagacaatggtcaatatctccgatcagactatgcactcaattccaacatctccatctcatgggtcaattgccgcctaccagggatattctccccagcggacctacaggagtgaggtcagctccccaattcagagaggggatgtgacaattgatcgaaggcatcgcgcccatcaccccaagcacgtgtacgtcccggatcgacgctccgttccagccgggttaaccctccaatctgtgtcacctcagtctctccagggcaaaactctcagccaagacgaggggagaggtacactctataagtataggcctgaggaagtagatattgatgctaaactttctcggttatgcgagcaggataaggtggtgcacgccctggaagagaaactacagcagctgcataaggagaagtacactctcgagcaagctctactatctgcgtcacaggaaatcgaaatgcacgccgataatcccgccgcaattcagacagttgtgcttcagcgtgacgatctgcagaacggcctactgagcacatgccgcgagctgagccgggccacagctgagcttgaacgggcctggagggaatatgacaagttggagtacgacgtgactgttacgagaaatcagatgcaagagcagctcgaccatcttggagaagttcagaccgaatccgctggtattcagagagctcaaatccagaaggaactgtggcgcattcaagatgtgatggagggactcagcaaacacaaacagcaaaggggcacgaccgagattggaatgattggcagcaagccttttagtacagtaaagtacaaaaacgagggccccgattaccgcctgtacaagtcagagcctgaactcacaacggtcgctgaggtggacgagtcgaacggggaggagaaatcagaacccgtgtccgaaatagagaccagcgtggtgaaaggatcccatttccctgtgggggttgtcccgccaagggccaagagccccacaccagaatcaagtacaattgcttcatatgtcacactgaggaaaacaaagaagatgatggatcttagaaccgagcggcctcggtctgcagtggagcagctgtgtctggcagaaagcacccgccccaggatgaccgtggaggagcagatggagaggataagacggcatcagcaggcatgtttgcgcgaaaagaagaaaggactgaacgtgatcggagcttccgatcaaagtccattgcaaagtccaagtaatctccgcgataatccttttcggaccacgcaaactaggcgccgggatgacaaggaactggacacggcaattagggagaatgatgtgaagccagatcatgagacccctgcaacagaaatagtgcagctgaaagaaaccgagcctcagaacgtggactttagcaaggaactgaagaaaacagagaatatctcatatgagatgcttttcgaacctgaacctaacggcgttaactcagtcgaaatgatggataaggagcgcaacaaggataagatgccagaggacgtaacattcagcccgcaggatgagacacagaccgccaaccacaaacccgaggaacaccccgaggagaacacgaaaaacagtgttgatgagcaagaggagactgtgatctcctacgagtcaactccagaggtttctcgtgggaatcaaaccatggccgtgaagagtctgtccccctctcccgagtcctctgcctcacctgtgccatcaacgcagccacaattgactgaaggctcgcattttatgtgtgtatag

SEQ ID NO: 49521 - DNA, 3555 bp, Artificial Sequence
  Description of Artificial Sequence: Synthetic coding sequence
atggccgccgacctgaacctggagtggatcagcctgccccggagctggacttacggcatcacacgaggagggcgagtgttctttataaacgaagaggctaagtctaccacatggctgcatcctgtgactggagaggctgtagtgaccggacataggcgtcagtctacagacctgcctaccgggtgggaggaggcctatacgttcgagggcgcccgatactacattaatcacaacgaaagaaaagttacttgcaaacacccggtgacaggccagccttcccaggataattgcatttttgtggtgaacgaacaaacggtggccactatgaccagcgaggaaaaaaaagagcggccgatctctatgatcaacgaggcctctaactacaatgttacctcggactacgctgttcatcccatgagcccagtggggcgtacatcacgtgcatcgaaaaaggtgcataattttggaaagcgtagcaactctattaaaagaaacccaaacgcccccgtcgtgagacgcggatggctctataaacaggactccacaggaatgaagctgtggaagaagcgctggttcgtgctgagcgatttatgtctgttttattaccgggacgaaaaagaagaaggtatcctggggagcatcctgttacctagtttccaaattgccttactgacaagtgaggatcacattaacagaaaatacgcattcaaagctgctcatcctaatatgcgcacctactacttctgtaccgacacaggaaaggagatggaactttggatgaaagccatgctggatgcagccctggtgcagacagaacccgttaaacgtatcttcttttcagatttccgggtcgataaaataacatccgagaatgctccaaccaaagaaaccaacaatatcccgaaccatcgtgtcctgatcaaaccagaaatacaaaacaatcagaagaacaaagagatgagtaagattgaggagaagaaagccctggaggctgagaagtacgggttccagaaggacggccaagaccggccgctgaccaagatcaatagtgtgaagctcaacagcctcccatcagagtacgaatccggttccgcttgccctgcacagaccgtacattatcgccctataaacttatcaagctctgagaataagatcgtcaacgtttccctcgcagacctgcgcggcggtaaccgccccaacacaggaccgctctataccgaagcggacagggtcattcagcggactaattctatgcaacaactcgagcagtggattaaaatccagaaaggccgcggccatgaggaagagacacgcggtgtaatctcttatcagacccttccacggaatatgccttcccatagagcccagatcatggcacgctatccagaaggatacaggacattgccccggaattccaaaacaagacccgaatctatatgctccgtgacaccttccacacacgacaagacactgggtcctggtgccgaagaaaaacggcggtccatgagagatgatacaatgtggcagctctacgagtggcagcagaggcagttctataataaacagtctactctcccaagacattccacactgagcagtccaaagacaatggtgaacattagcgaccagaccatgcactctattccaacctcgccttcacatggtagcattgctgcctatcagggctatagtcctcagcgaacatatcgctccgaagtgtcttctccaattcagaggggcgatgtcaccatagacaggagacatcgggcccaccaccctaagcacgtttacgttccagatagacgctccgtccccgcaggactgaccctgcaatcagtgtcgccacagagtttgcagggcaaaacacctgaggagctcacccttctgctgatcaaactccgccgccagcaagccgagctgtcctctatacgcgagcacacattggctcagctgatgcagctgaaattagaggcccattctcccaaaaatgaaatcctctctcatcacttgcagagaaacactatctacttggaccaccaaatgaaagagaatgagccaatcatcaccatggtgcacaccatgatagagaacagcgccttgaggccccagctctaccaacagttcctgaggcaaaagtctaagatttctctgtactgcctctcacaggatgagggccgcggtaccctctataagtacagacctgaggaggtagatatagatgccaagctgtctcgtctgtgtgagcaagataaggtcgtacacgccctggaggagaaattgcaacaactgcataaagagaaatataccctggaacaagcactcctgagtgcgagccaggaaatcgagatgcatgcagataatcctgctgctatccagaccgtggtgctgcagagagatgacctccagaacggtttactttccacctgccgagagttgagtcgggctacagctgagctggagagggcttggagagagtacgacaaactggagtacgacgtcacagtcacccggaaccagatgcaggagcaactggaccatcttggtgaggttcagaccgaatctgctggtatccaacgcgcccagatacagaaagaattgtggagaattcaggatgtcatggagggactgagcaagcataaacagcagcggggcatgatcggaagcaaaccattctccaccgtgaaatacaaaaatgaggaagaggaggttgtgcccccgcgaccccccttgccgcgctcttacgactttactgagcaaccacccattatacctcccctgccttccgactctagctcactgctatgttacagtagagggcccgtacacctccccgaggagaaaaaaatgtatcaggtgcagggatatccccgaaacggatcgcattgcggacctgactaccgattatataaatcagagcccgagctgacgacggttgccgaggtggacgagtctaacggagaggaaaagtccgaacccgtttccgaaattgagacatcggtggtaaaagggtcccactttcctgttggagtggtgcctccacgagccaagtcacccaccccggagtcgtctaccattgcaagctatgtgacactgagaaagacaaaaaaaatgatggatctacggacagaaagacctcggagtgccgtggaacagctgtgcctggccgagtctacgaggcccaggatgacagtggaagagcagatggagcggatcagaagacaccaacaggcctgcctgcgggagaaaaaaaagggcttaaacgtcattggtgcaagcgatcagagccccctgcaaagtccgtcaaacctgcgggacaatccgtttagaacaacacagacccgacggagagacgacaaagagctcgatacagccattcgcgagaatgacgtgaagcctgatcacgaaactccagctaccgagatcgtacaattaaaggagacggaaccacaaaacgtggattttagtaaagagctcaagaaaacggagaacatcagctatgaaatgctgtttgagccagaaccaaatggggttaactccgtcgagatgatggattag

SEQ ID NO: 49522 - DNA, 3297 bp, Artificial Sequence
  Description of Artificial Sequence: Synthetic coding sequence
atgaccagcgaggagaagaaggagcggcccatcagcatgatcaacgaagccagcaactataatgttactagtgactacgcagtgcaccctatgtcacccgtgggccggacaagcagagcttcaaaaaaagtgcataactttggtaaacgatctaatagtatcaaacggaaccccaacgcaccagtagtgcgaagaggctggctgtataaacaggattccaccggaatgaaactgtggaaaaagcggtggttcgttctgtcggacctctgcctgttctattaccgagatgagaaagaagagggcattttaggatctattcttctcccctcgttccaaattgctttactcacttctgaggatcacatcaatagaaagtacgcttttaaagccgcacacccaaatatgcggacttactatttttgtacagacaccggaaaagagatggagttgtggatgaaagcaatgttggatgcagccctggttcagacagaacccgttaagagggtggataagataaccagcgagaatgcgccaactaaggagacaaataatatccccaaccaccgggtattgataaagccagagatccaaaataatcagaaaaataaggaaatgtcaaagattgaggagaagaaggccttggaagccgagaaatatggctttcagaaagatggccaggatcgcccattaaccaagatcaatagcgtcaagttaaactcccttccctccgagtatgagtccgggtcagcttgcccagctcagacggttcattacagacctataaacctcagcagtagtgaaaacaaaatcgtgaatgtctctttggcggatttgcgggggggcaatcgccctaacactgggcccctgtacaccgaagctgacagagtgattcaacgaactaattctatgcagcaactcgagcagtggattaagatccagaagggtaggggccacgaggaggagacaagaggagtaatctcataccagacgttgccacggaatatgccaagccacagagcccagatcatggcgcgttaccccgaaggctatagaaccctgcctcggaattctaaaactagaccagaatcaatttgcagcgtgactcctagtacacacgacaagactttggggccgggagccgaagaaaagaggcgctctatgcgggacgacaccatgtggcagttatatgagtggcagcagcggcagttctataacaagcagtcaactctgcctcggcacagcacactcagctcccctaagactatggttaacatctcggaccaaaccatgcacagcatacctacaagcccttcccacggctccattgctgcctaccaaggctactctccccagaggacctatagatcagaggtatctagcccgatccagcggggtgacgttacgattgaccgacgtcacagagcccaccatcccaaacatgtttatgttcctgatcggaggagtgttcctgcgggcctgacactgcaaagcgttagcccacagtccctgcaaggcaagacaatgaaggagaacgagcccatcatcaccatggtgcacaccatgatcgagaatagtgctctgcgcccacagctgtatcagcagttgtcccaggatgagggaaggggtaccctttacaaatatcggcccgaggaagtggatatagacgccaagttgtcgcggctgtgcgagcaggacaaggttgtacacgcgctggaggagaagctgcagcagctgcataaggagaaatacacactagagcaggcgctcctgtcggccagccaagaaattgaaatgcacgcagacaatccagcagctattcagaccgtcgtactgcagagagacgacctccagaacgggctgctgagcacctgtcgcgagctctcaagggccaccgctgaactggaaagggcctggcgtgaatacgacaaattggagtacgacgtaactgtgaccaggaaccagatgcaagaacagctggatcaccttggagaagtgcagactgaatctgcgggcattcaacgggctcagatacagaaggagctttggcgaattcaggatgtgatggaaggcttgtccaaacacaagcagcagcggggaactacagaaataggcatgatcggttcgaaaccattctctactgtgaagtacaagaacgaggaagaggaagttgttcctcctcggcctccactcccccggtcatacgactttactgagcagccccccatcattcctccactgccttccgactcaagttctctcctttgctattctcgggggccagtccatcttccagaagaaaagaagatgtaccaggtccaaggatacccccggaacggctcccactgcggccctgactataggttgtacaagtccgaacctgagctcaccaccgttgctgaggttgatgagagtaacggtgaagagaaatctgagcccgtatcagagattgagacttccgtagtgaaggggtctcactttcccgtgggcgttgtaccccccagagcgaaatctccaacacctgaatctagcacaattgcatcttatgttactttgcggaaaaccaaaaagatgatggatttgcggacggagcgtccgcgttccgccgtcgaacagttatgcctcgccgagtccacccgacctcggatgactgtagaagagcagatggagaggattagacgccaccagcaggcctgccttcgtgaaaaaaagaaggggctcaatgtgatcggtgctagtgaccagtccccccttcagtctccttccaacctcagggataaccccttcaggaccacacaaacacgacggagggatgacaaggaactggacactgccattcgggagaacgatgtgaagccagatcacgagaccccagcaaccgaaatagttcagctcaaagagactgagccacagaacgtggatttctccaaggagctgaagaaaactgagaatatttcatatgagatgctgtttgagcctgagccaaacggggtaaattctgtggagatgatggacaaagagaggaataaggacaagatgcccgaggatgtcactttcagtccccaggacgagacccagacagccaatcataagccagaagagcacccagaggagaacacaaagaactctgtggatgagcaagaggagacagtcattagttacgaatctaccccggaggtgagcagaggcaaccaaacaatggctgtaaaaagccttagcccctctccagagagctccgcctctcctgtgccaagtacccaaccccagctaacggaagggagtcatttcatgtgtgtgtag

SEQ ID NO: 49523 - DNA, 3147 bp, Artificial Sequence
  Description of Artificial Sequence: Synthetic coding sequence
atgagcaacaagaccggcggcaagcggcccgccaccaccaacagcgacattcccaaccacaatatggtaagcgaggtgccccctgaacgtccctccgtgagagccacccggacagcccgcaaggccgtagccttcggaaaacgctctcattcaatgaagcgaaaccctaacgctccagtcacaaaagcaggatggttattcaagcaggcctccagcggggttaagcagtggaataagcggtggttcgtcctcgtggaccgctgtctgttctactacaaagacgaaaaggaggagtccatactaggaagcatccctctcctgtcctttcgtgttgccgccgtgcagcctagtgataacatctctcggaagcacaccttcaaggcagaacatgctggagtaaggacctattttttctccgctgagagtccagaagagcaggaggcttggatccaggccatgggcgaagctgcccgcgtccagatacctccagcccagaagagcgtgccgcaggctgttcgtcactcccacgagaaacccgatagcgagaatgtcccaccatcaaagcaccatcagcagccacctcataattcactcccaaaacccgagcccgaggccaagacaagaggggagggtgacggtcggggctgcgagaaggcggaaagacggcccgaaaggcctgaggtgaagaaagagccacctgttaaggctaatggcctgccagccgggcccgagcccgcttccgaaccggggtctccttatcctgaaggccctagggtgcctggtggaggcgaacagccagcacagccaaacggatggcagtaccactctccatctcgcccgggcagtacggcttttcctagccaagatggggagacgggtgggcatcggagaagttttccccctcgaaccaatcccgacaagatcgcccagaggaaaagtagtatgaatcagctgcagcagtgggttaatctacgtcgcggggtgccgcccccagaggacttgcgcagtccttctcgtttctatcctgtgtcccgccgagtgcccgaatattacggaccttattcaagtcagtacccagacgactaccagtattaccctcccggggtccgtcccgagagcatttgcagcatgcccgcttacgataggatttctcccccttgggctctggaagacaagcgccacgccttcaggaatggcggggggcctgcctaccaactgagagagtggaaagagccagcatcctacggaagacaggatgcaaccgtgtggatccccagtccgtcacgacagccggtctactatgacgagttagacgctgcttcgagcagcttacggcggctctcacttcagccccggtcccattccgtgccaagaagcccatctcagggtagctattcgcgagcgcgaatttactccccggtcagatcacctagtgccagattcgaacgcctgcctccacgcagtgaggacatttacgcagatccggccgcttacgtcatgcgcaggtcgattagtagccccaaggttcctccataccccgaggttttcagagactcgctgcacacttataagttaaatgagcaagatacagacaaactgctgggaaagttgtgcgaacaaaacaaagtagtgcgggagcaggacagattggtccagcaactccgagccgaaaaggaatcgctcgaaagcgcactcatgggaacacatcaagagctcgagatgtttgggagccaacccgcttacccggagaagctacggcacaaaaaagattccctgcagaaccagctgattaacattcgcgtggaactttcacaggctaccaccgctctcactaactctacaattgaatacgagcatctagagtcggaggtgtctgccctgcacgacgatctgtgggaacagctgaatttagacacccagaacgaggttttgaacagacaaatccaaaaggaaatctggaggattcaggatgtgatggagggccttagaaagaataacccctcgagggggacggatacggccaaacatcgcggcggcctaggcccatcagccacctacagcagtaacagcccagcctcacccttgtcctccgcctctcttacttcccccttatctcctttctctctggtgagcggaagccagggatcacccaccaagcctgggtctaatgagcccaaagctaattatgaacagagtaaaaaagatccccaccagaccctgcctcttgacactccgcgggacatctcactggtgcccacgcgacaagaagtcgaggctgagaagcaggctgcactgaataaggtgggagtcgtcccccccaggacaaaatcaccgaccgacgacgaggtgacaccatctgccgttgtgcgacgcaacgctagtggcttaacgaacggccttagctcccaagagaggccgaaatcagctgtgtttcctggggaagggaaagttaagatgtccgtggaggaacagattgatagaatgaggcgccatcagtctggctcaatgcgcgagaagcgccggagtctccaacttcccgccagccctgccccagacccatctccacgccctgcatataaagtggtgcgccgccacagaagcattcacgaagttgacatcagtaatctggaagccgctctgagggccgaagaacccggcggccacgcctacgaaacaccgcgcgaggaaatcgccaggttgcgtaaaatggagttggaacctcagcattacgatgtggacataaataaggaattatcaaccccagacaaagtactgatccctgagcgatacattgacctggagccggatactcccctctcgcccgaagaacttaaggagaagcaaaaaaaagtggagaggatcaagacactgatcgcaaagtcttctatgcaaaacgtagttccaatcggcgaaggggatagcgttgatgtcccacaggactcagaaagccagctgcaagaacaggagaagcgtatcgagataagctgtgcactggcaactgaggcaagtcgcagggggcgcatgttatcagtgcagtgcgccaccccatcaccccccaccagcccagcgagcccagctccaccagcaaacccccttagctctgagtctcctagaggcgccgactcttcttacactatgcgcgtttag

SEQ ID NO: 49524 - DNA, 321 bp, Artificial Sequence
  Description of Artificial Sequence: Synthetic coding sequence
cgggcccggatctacagccccgtgcggagccccagcgcccggttcgaaagactgcctccgcggtccgaagatatctacgcggatcccgctgcttacgttatgcggaggtctattagtagtccgaaatacgattatttgggcgataggaggcccgtccccgccggtcttttcccctacaattaccccccaagcccaactgttcacgacaaaatggtgccaccataccctgaagtgttcagggactccttgcatacttacaagttaaatgaacaggataccgataagctacttggaaagctgtgcgagcagaacaaggtatag

SEQ ID NO: 49525 - DNA, 3207 bp, Artificial Sequence
  Description of Artificial Sequence: Synthetic coding sequence
atgagcaacaagaccggcggcaagcggcccgccaccaccaacagcgacattcccaaccacaatatggtctctgaagttcccccagagaggccatctgtgcgggcaactcggacagccaggaaggccgttgccttcggcaaacggagccacagtatgaagcggaatccaaatgctccagtgaccaaagctggctggttattcaaacaggccagctctggagtgaaacagtggaacaagcggtggtttgttttagtggatcgatgcctgttctattacaaggacgagaaagaagagagtattcttggaagtatcccactcctgtccttccgagtcgcagccgtacagcccagcgataatatttctcgcaaacatacctttaaggttactgtctgttgggtcgacgaagccgaagcatcatctaccaggtgtctctcacctcaggcagaacacgctggcgtgcgtacgtatttctttagcgccgaatctcctgaagagcaggaggcttggattcaggcgatgggcgaggcagcacgggtccaaatacctccggcacagaaatccgttccccaggcagtacggcactctcacgaaaaacccgacagtgaaaatgtgcccccatccaagcaccaccagcagccacctcacaactcattaccgaaacctgaaccagaggccaagacacgtggcgaaggtgacgggagaggatgcgaaaaagcagaaaggcgtcccgagcggcctgaagtgaaaaaggagccccccgtaaaggcgaacggccttccagctggccctgagccagcctcggagcctggctcaccatacccagagggacctcgtgtacccgggggaggcgagcagcctgcccagcctaatggttggcaatatcacagcccatctcggcctggctccacggcctttccatcccaggacggcgagaccggaggtcacaggaggagcttccctcctcgaactaatcctgacaagattgcacaacgaaagagctctatgaatcagctgcaacagtgggtgaacttgcggcgaggcgtcccccctcctgaggacctgaggagcccgtccagattttaccccgtttccaggagagtgcctgagtactacggtccatatagctctcagtatcccgatgactatcagtattacccacccggcgtgcgcccagagagcatctgctccatgcctgcttacgatcggatctctccaccatgggcccttgaagacaaacgccatgcattccgaaacggcgggggcccagcctatcagttgcgcgaatggaaagaacccgcctcttatggacgccaggacgctaccgtgtggattccatctccctctagacagccggtgtattacgatgagttggacgctgcctctagctccctccgcagactcagtctccagcctagaagccatagcgttcctagaagcccctcccagggctcatacagcagagccaggatttattccccggtgaggtcccccagcgcccgctttgagcgcttgcccccccggtcagaggatatctacgctgacccagcagcctacgtcatgaggcggtcgatcagttcccctaaagtgcccccctaccccgaagtgttccgagactcactccacacctataagctgaatgagcaggacaccgacaaattgctgggaaagttgtgtgaacagaataaagtggtcagggagcaagatcggctggtccaacaactgcgcgccgagaaggagagcctggagtcagcactgatgggcacacaccaagagttggagatgtttgggtcccaacccgcttatcccgagaaactgcgccataagaaggacagcctccagaaccaactcattaacatcagagtcgagttaagtcaggccaccacagctctgacaaattctacaatcgagtacgagcatcttgagtcagaagtgtccgctctgcatgatgacctgtgggagcagttgaacctggacacacagaatgaagtgctgaaccgccagattcagaaagagatatggcgaattcaagacgtcatggagggacttagaaaaaataatccttctcgaggtacagataccgcgaagcacagaggcggcctgggcccaagcgccacctactctagcaattcccctgcctctccattatcttctgctagcctgacttctccgctttcccctttttcactggtgtcggggtctcagggcagcccaacaaaacctggttctaatgagcctaaagccaactacgagcagtccaaaaaggatcctcaccagacactgcccctagataccccaagggacatttccctggtgcctacgcggcaggaggtggaagcagagaagcaggcagctctcaataaggtaggagtggtcccaccccgcacaaagtccccaacagatgacgaggtgacaccaagcgccgtggtgcggcgcaacgcaagcggcctgaccaacggcctctctagtcaggaacggccgaaaagtgcagtcttccccggggaggggaaggtgaagatgtcagtagaggaacagattgacaggatgaggcgccaccagagcggatctatgcgggagaagcggaggtcccttcagctgcccgcttccccagcacccgatccatctccccggcctgcctacaaagtggtcaggcgtcataggtcaattcatgaggtggatatctctaaccttgaggctgcactgcgagctgaggaaccggggggccacgcctacgagacaccgcgggaagagattgctcgcttaagaaaaatggagctggagccccagcactacgatgtcgatatcaataaggaactcagtactccagacaaggtgctcatcccggaacggtacatcgacctggagcccgacacccctctctctcctgaagaattgaaggagaaacagaaaaaagtggagcggattaagactcttattgcaaagtctagcatgcagaacgtggtgcccattggtgagggggactccgtggacgtgccacaggactcagaaagccaactgcaggagcaggagaagcgcatcgaaatttcttgcgccttggctactgaggctagccgacgcggcaggatgctgtccgttcagtgcgccacgcctagccctccgacgtcccctgccagcccagcaccacccgcaaatcctcttagctcagagtcaccaagaggcgccgacagttcatacacgatgcgggtttag

SEQ ID NO: 49526 - DNA, 315 bp, Artificial Sequence
  Description of Artificial Sequence: Synthetic coding sequence
cgggcccggatctacagccccgtgcggagccccagcgcccggttcgaacgcctacccccccggagcgaggacatttacgccgatcctgcagcttacgttatgcgccgctccatctcttcccccaagatgtccgagagcgaaacacttatctccatggttaatagaatggttgaaaactcatcccctagatctcagttatttatgcaagtccctccctatccagaagtgtttagagactccttgcacacctataagctgaacgagcaggatacagataaactcctgggtaagctgtgtgagcaaaacaaggtgtag

SEQ ID NO: 49527 - DNA, 456 bp, Artificial Sequence
  Description of Artificial Sequence: Synthetic coding sequence
cgggcccggatctacagccccgtgcggagccccagcgcccggttcgagcgcctcccacctaggtcagaggacatttatgcagatcctgctgcctatgtcatgaggcgcagcatctccagccctaaatacgactatctgggggatcggagaccagtccccgctggactctttccatataactaccccccaagccctacagtccacgacaaaatggacgaactgcttgatttgcaactccagcggaatctggaatacctggatcagcagatgtcagagtctgaaaccctgatttctatggtcaataggatggtagaaaactccagtcctcgaagtcaacttttcatgcaagtgcccccataccccgaagtctttcgagattctctccatacctataaactcaacgaacaggacaccgataagttactgggcaaactctgtgagcaaaataaagtgtag

SEQ ID NO: 49528 - DNA, 375 bp, Artificial Sequence
  Description of Artificial Sequence: Synthetic coding sequence
cgggcccggatctacagccccgtgcggagccccagcgcccggttcgagcgacttccgcctcggtccgaggatatctacgcagatccagcggcctatgtgatgcgccgctccatctcttcaccaaagtatgattacttgggcgacaggcgcccagttcccgctgggctcttcccttataactatcctccatcaccaactgtgcatgataaaatggacgaactcctcgacctgcagcttcaacgtaatctggaatacttggaccagcaagtgcccccatacccggaggtcttcagggacagcctgcacacatacaaactgaacgagcaggacaccgacaaactgctcggcaaactgtgcgagcagaataaggtctag

SEQ ID NO: 49529 - DNA, 252 bp, Artificial Sequence
  Description of Artificial Sequence: Synthetic coding sequence
cgggcccggatctacagccccgtgcggagccccagcgcccggttcgagagactccctccacggtcagaggatatctacgccgatcccgctgcctacgtgatgcgccgatccatatctagccccaagtatgactacctgggtgaccgacgccccgtgccggcaggcctctttccctacaattatcccccatccccaaccgttcatgacaaaatgaaattgctcggtaagctctgcgagcagaacaaggtgtag

SEQ ID NO: 49530 - DNA, 402 bp, Artificial Sequence
  Description of Artificial Sequence: Synthetic coding sequence
cgggcccggatctacagccccgtgcggagccccagcgcccggttcgaaagactcccccccaggtctgaggacatttatgccgatccagccgcgtacgttatgagacggagcatttccagtcctaagtatgactatcttggagatagacgccccgtgccagccggcctatttccttataactaccccccaagtcctaccgtgcatgataagatgatgtctgagtcagagaccctaatcagtatggtcaatagaatggtcgagaattcttcccccagaagtcagctgttcatgcaagtacccccctacccagaggtgtttagggatagcctacacacctacaagctcaatgagcaggacacagataagctcctcggcaagctttgtgaacagaacaaggtgtag

SEQ ID NO: 49531 - DNA, 1386 bp, Artificial Sequence
  Description of Artificial Sequence: Synthetic coding sequence
atgaacaacttcggcaacgaggagttcgactgccacttcctggacgaaggcttcacggcaaaagacatcctcgaccagaaaattaatgaggtgtcatccagcgacgacaaggacgctttctacgttgccgatctgggcgacattctgaagaagcatcttcggtggctgaaggctctaccacgggtcaccccattctatgcagtgaagtgtaacgattctaaggccattgtgaaaaccctggcagctaccggtacaggcttcgactgcgcgtctaaaacagagattcagctcgtacagtctctcggagtgcctccagagagaattatctatgccaatccatgcaaacaggtgtcacaaatcaagtacgccgcaaacaatggagtgcaaatgatgaccttcgactccgaggtggaactcatgaaggtggcacgcgcacaccccaaagccaaactcgtgctgcggatcgcgaccgatgattccaaagctgtctgccggctcagcgtcaagtttggtgcgaccctgcggaccagccgactgctgctcgaacgggcaaaggaacttaacattgatgtggtaggagtatcatttcacgttggaagtggctgtactgatcctgaaacatttgttcaggcaatcagcgacgctcggtgcgtgttcgatatgggggctgaagtgggcttttccatgtacctgttggatataggaggaggtttccccggatctgaagacgtcaaactcaagtttgaggaaatcaccggggtcataaaccccgctctcgacaagtacttcccctcagactccggcgttcggattatcgcagaacccggtcggtattatgtggcctccgctttcactttggctgttaatataatagcgaagaaaatcgtactgaaagagcagactggttcagacgatgaggacgagagttcagagcagacttttatgtattatgtaaatgatggagtatacgggagcttcaattgcattctgtatgaccatgctcacgtcaaacctcttctacagaagcgaccgaaacctgatgaaaagtactacagctcaagtatctggggccccacttgtgatggcctcgatcggatcgtggagcgctgcgacctgccagagatgcatgtgggcgactggatgctgtttgaaaacatgggggcttacacagtagcagcggcttccaccttcaacggattccagcgccccacgatctattatgtcatgagcggaccagcctggcagctgatgcagcagttccagaacccggactttccccctgaagtggaggagcaagatgccagcaccctgcctgtgtcgtgtgcctgggagtcaggtatgaaaagacatagggctgcttgtgcgtcagcctcaatcaatgtctag

SEQ ID NO: 49532 - DNA, 930 bp, Artificial Sequence
  Description of Artificial Sequence: Synthetic coding sequence
atggccttcgtgaagagcggctggctgctgcggcagagcaccatcctgaaaagatggaagaaaaattggtttgatctgtggtccgacggccacctcatctattatgacgaccagaccaggcaaaacatcgaggacaaggttcatatgcctatggattgtattaatatccgaaccgggcaggagtgccgcgacactcagcctccagacggaaaaagcaaggattgtatgctgcaaatagtgtgccgggatggtaagacaatcagcctgtgtgctgagagcacggatgactgtctggcctggaagttcactctgcaagattcccggaccaacactgcttacgtagggtccgctgtgatgacagacgagaccagcgtggttagttcacccccgccctatactgcatacgctgcacctgcaccagaagagttgcattctaagggccccaagattcatacaacgacttccgcaaagacccaggctgtcctcccgacccgttgtttctttccgagtgaatcacctattaggagatcagtgcagatttcggttttattgccggccgtgaacatacgacggagaattaagctcaccttcccacagcctgctagaccaagagcccccagatccctgtgtctgtggcagacttggttcgccgggaaaagagcccctagcttgcctactgcagccaccgctcccgccttgccatcttgccccagcccacccgcgcctagtcaggctctgccgcccagccttgctggctggagatctccatctagcgcacccttgcctccggagcaagctttagcaccccggtcctttcagttgtcaaagcatcaggcaaggccaaggcctcaccggccaggaaccccaccagtgcccgcgtggcctggtgtccccccaccaccccccgctagacctcccgccctccggtag

SEQ ID NO: 49533 - DNA, 669 bp, Artificial Sequence
  Description of Artificial Sequence: Synthetic coding sequence
atggccttcgtgaagagcggctggctgctgcggcagagcaccatcctgaagcgctggaaaaaaaactggttcgacctctggtccgatgggcatctgatctactacgatgatcagacccgccagaacatcgaagataaagtacatatgcccatggattgtataaacatacgtaccggccaggagtgccgggacacacagccaccggacggcaaatcaaaggactgcatgttacagattgtctgtcgagacggaaagaccattagcttgtgtgctgaaagcacagacgattgcctcgcttggaaatttaccctgcaggatagcagaacaaataccgcctacgtgggatccgccgtcatgactgacgagacaagtgtcgtgagcagccctcccccttacacagcatacgccgctccggcacccgaacaggcatatggctacgggccttatggaggggcatatccgcctggcacacaagtcgtttatgcggctaacggccaggcgtatgccgtgccataccagtacccatacgccggtctgtacggacaacagcctgccaatcaggtgattatccgggaacggtatcgggacaatgattccgacttggctctgggaatgctggctggcgccgccactggcatggctctgggatccctgttttgggtattctag

SEQ ID NO: 49534 - DNA, 930 bp, Artificial Sequence
  Description of Artificial Sequence: Synthetic coding sequence
atggccttcgtgaagagcggctggctgctgcggcagagcaccatcctaaagcgttggaaaaagaattggttcgacctgtggtccgatgggcatctgatctattatgatgatcagacccgccagaatattgaagataaagtgcacatgcctatggactgcatcaacatacgaacgggccaggaatgcagagatacccagccaccagatgggaagtcaaaggactgcatgctgcagattgtgtgccgggacggaaagaccatttccctgtgcgctgaaagcactgacgactgtctcgcatggaaatttaccctacaagattctcgcacaaataccgcttatgtgggctcagccgttatgacagatgaaacctctgttgtatcatctccgcccccatataccgcctacgcagccccagctcccgaagaactacattcaaaaggcccgaaaatccatactacgacttctgctaagacccaagccgttctgccaacccggtgtttcttcccctcagagtcaccaattaggagaagtgtgcagatttcagtgctcctgccggccgtgaatatccgcagacggataaagctgacattcccccagcctgctcgcccccgggccccccggagtctgtgtctttggcagacctggttcgcaggtaagcgggctcctagccttcccaccgctgccacagctccagcattaccatcctgccccagccccccagctcctagtcaagcactgcccccttcccttgctggatggaggagccctagttcggccccgttgcccccagagcaagccttggccccaagaagttttcagttgtctaagcaccaagcccggcctcggccacaccggccaggcaccccgccagtgccagcctggcccggggtccctcctcctccacccgctagaccacctgcccttcggtag

SEQ ID NO: 49535 - DNA, 669 bp, Artificial Sequence
  Description of Artificial Sequence: Synthetic coding sequence
atggccttcgtgaagagcggctggctgctgcggcagagcaccatcctgaagagatggaaaaagaattggtttgacctatggtcagatggacacctgatctactacgatgatcaaactaggcagaatatcgaggacaaggtccacatgcctatggactgcatcaatattcgaaccggccaggagtgtcgcgatacgcagcctccggatggaaaatccaaggattgcatgttgcaaatcgtgtgcagagacggcaaaaccatttctctgtgtgctgagagcaccgacgattgtttagcctggaagttcaccctgcaggactcaaggacaaacacagcatatgtaggatcagctgtcatgacggacgaaacgagcgttgtctcttctcctccaccttatacagcctatgctgccccagctcctgagcaggcctacggatacggcccgtatggcggggcctaccctccaggcactcaggtggtgtacgctgccaacggccaggcctacgcagtcccctaccagtatccttacgccggcctatatgggcaacagccggcaaaccaagtgattatccgcgagaggtatcgggataacgattctgatttagcactggggatgctagctggagccgccacggggatggctctgggaagtctgttctgggtgttttag

SEQ ID NO: 49536 - DNA, 669 bp, Artificial Sequence
  Description of Artificial Sequence: Synthetic coding sequence
atggccttcgtgaagagcggctggctgctgcggcagagcaccatcctgaaacggtggaaaaagaattggttcgatctttggagtgacggccacctcatctattacgacgatcagactaggcagaatatagaagataaggtccacatgccaatggactgcatcaatatccggacgggccaagagtgcagggatacccagcctcctgacgggaaaagcaaggactgtatgctccaaattgtttgccgcgatgggaaaaccataagcctgtgtgccgaaagcacagacgattgcctggcctggaaatttacactacaggattcacggacgaacactgcttacgtgggctccgccgttatgacggacgaaacttctgtagtgtcatcaccccccccttataccgcctatgcggctcctgcacctgaacaggcctatggttatggaccttacgggggcgcgtatcctcccgggacccaggtggtgtatgccgccaacgggcaggcttatgctgtgccttatcagtatccatatgctggactatacggacagcaacctgcaaatcaggttatcatccgcgagcgctatcgagataacgactctgacttggccctgggcatgctcgccggtgctgcgaccggaatggccctgggatccctgttttgggtgttttag

SEQ ID NO: 49537 - DNA, 537 bp, Artificial Sequence
  Description of Artificial Sequence: Synthetic coding sequence
atggccttcgtgaagagcggctggctgctgcggcagagcaccatcctgaaacggtggaagaaaaactggttcgatctgtggagtgatggccacctcatctattatgacgaccaaaccagacagaatatcgaggataaggtgcacatgccgatggactgcatcaatatcaggaccggacaggagtgcagggacacccagcccccagacgggaaatctaaagactgtatgctgcagatcgtgtgtcgcgatggcaaaacgatctccctgtgcgcagagagcactgacgactgcctggcgtggaaattcacactccaagacagccggaccaacaccgcatacgtgggctctgccgtgatgaccgacgagacgtcagtcgtgagctccccacccccatatacagcgtatgccgccccagcacctgaagactttatggacagcagcttgttgacgaaatcctcctttgaaagtgcgattgaaacgacaaccgccacttggcactgggcctgctggcaagagcagccgagagcatggccatag

SEQ ID NO: 49538 - DNA, 513 bp, Artificial Sequence
  Description of Artificial Sequence: Synthetic coding sequence
atggccttcgtgaagagcggctggctgctgcggcagagcaccatccttaaacggtggaagaagaactggttcgatctttggtctgacgggcacctgatctactacgacgatcagactagacagaacattgaggataaggtgcacatgcctatggattgtattaatattcgcaccgggcaggaatgccgggatacacagcctcctgacggcaagtcaaaggattgtatgctgcagattgtgtgtcgtgatgggaagaccatctccctatgcgctgaatcaaccgacgattgtctgctaatggctatggggcacaccgtcgtgcgcacgcgccaagaactgaaactgagcacgctccgaatgggacgccgcatgccatgccccaccagcacacacatgcaagacttcatggacagtagtctgcttactaaaagtagctttgaatccgcgatagagaccacgacagccacttggcactgggcctgttggcaagaacagcccagggcatggccttag

SEQ ID NO: 49539 - DNA, 525 bp, Artificial Sequence
  Description of Artificial Sequence: Synthetic coding sequence
atgcccatggactgcatcaacatccggaccggccaggagtgccgggacacacaacccccagatggcaagtccaaagactgcatgctccagatcgtgtgccgcgacggaaaaacaatatccctttgcgcggaatctactgacgactgcctcgcatggaagttcaccctgcaggactcaaggactaatacagcttacgtcggcagtgctgtgatgaccgacgaaacttcagtggtatcctcacctccaccttatacagcttatgctgcccccgcacctgagcaagcctatgggtacggaccctatggcggggcctatccacccggaacgcaggttgtgtacgccgctaatggacaggcttacgccgtcccctatcaatacccgtatgcggggctgtatggccaacaacccgctaatcaggtgattattagagagaggtaccgggataacgactcagatttggccttagggatgctggcgggcgccgcaaccggaatggctctgggatcgctgttctgggtgttttag

SEQ ID NO: 49540 - DNA, 1521 bp, Artificial Sequence
  Description of Artificial Sequence: Synthetic coding sequence
atgttcaccagcaagagcaacagcgtgagccccagccccagcctggagcaggcggattccgacgcactcgacataagtacaaaagttcagctgtacggcgtgctttggaagagaccctttgggagaccatcggccaaatggagcagaagatttttcattattaaagagtccttcctcctttactattctgagagcgagaaaaagagtttcgagacgaacaaatacttcaacatccatcccaaaggcgttatccctctggggggttgcttggtcgagccgaaggaagagcccagtatgccttatgccatgaagatttcacaccaggacttccatggtaacattctcctggcagctgaatcagaatttgagcaaacccaatggctcgagatgctgcaagagtccgggaaggtcacatggaagaatgcccagctgggtgaagcaatgatcaaatcactcgaagcccagggcttgcagttggccaaggagaagcaggaatatttagacaagctcatggaagaaacagaggagctgtgtttacagcgcgagcagcgggaggaactggagcgcttaaatcaggtcctagaggcagaaaagcaacaattcgaggaggtcgtgcaggagctgcgcatggaacaggagcagattaagcgcgagttagagctgaccgcacggtgcctgaaaggtgtggaacaggaaaaaaaagaactgcgccacttgacggagtccctgcagcaaacgctcgaggagctctcaatagaaaagaagaaaacactggagatgctcgaggaaaacgaaaaccatctccagaccctagcgaaccagtcagagcagccaccacccagtgggggtcttcatagtaatttgaggcagatcgaggagaaaatgcagcagttgctggaagaaaaacttcttgcggagaagcggatgaaggagaatgaagaacgttccagagcactcgaagaggagcgcgagttctactcgtctcagagtcaggccctccagaatagtctccaggagctgaccgcagaaaagcagcaggcagagcgcgagctcaaggcagaagtgaaggttcggatggacctggagcgtagactgcgagaagcagagggggccctcagatcactggaacagggtttgaattccaaggtgcgcaacaaggagaaagaagagaggatgagggctgacgtgagtcacctgaagaggttcttcgaggaatgcattaggaatgccgagctcgaagccaagatgccggtcatcatgaagaattctgtgtatattcataaggccgcaactcgccgaatcaaaagttgccgatttcatcgtcggaggagttccacttcctggaatgacatgaaaccctcacaatctttcatgaccagccagttggatgctaacaacatggaggaactgaaggaggtcgccaagagactctctcgtgaccaaagatttagagaatcaatttatcatattatggccacccagccaggggccccttccgcgctgtcgcggggaggaaagtag

SEQ ID NO: 49541 - DNA, 4158 bp, Artificial Sequence
  Description of Artificial Sequence: Synthetic coding sequence
atggagctgagcgacagcgaccggcccgtgagcttcggcagcaccagttcctccgcctcctcacgtgactcccacgggagtttcggatctcgaatgacgctagtgagcaactcccacatggggctctttaaccaagacaaggaggttggagcaatcaaactcgagttgattccagctcggcccttttcctcaagcgagctgcagcgtgataaccccgctacagggcagcaaaacgcggacgaaggaagtgaacgcccccccagggcacagtggcgggtggactcaaacggcgctcccaagactatcgctgacagcgctacaagccctaaactgttgtacgtggatcgggtggtgcaggagattttagaaaccgagaggacgtatgttcaggatctgaagtctatagttgaagactaccttgattgtattagggatcagaccaagcttccacttgggaccgaggaaagatccgcccttttcgggaatattcaggatatttaccattttaactccgagctgcttcaagacctcgagaattgcgagaacgatccagtcgccatcgcggagtgcttcgtgtcaaagtctgaggaatttcacatttacacccagtattgcactaactacccccggtctgtagctgtgcttactgagtgtatgaggaacaaaatcctggccaagttctttagggaacgccaggaaactctgaaacacagcttaccgctgggctcctacttgctgaaaccggtccagcgtatcttgaagtaccacctgctgcttcatgagatcgagaatcatctcgataaagacacagagggctacgacgtagtgctggacgcaattgacacaatgcagcgagtagcctggcatatcaatgacatgaagcgcaagcacgaacacgccgtgcgactccaggaaatccagagtctgttgacaaattggaagggcccggacctcacttcatacggggaacttgttttggaaggaacattcaggattcagcgcgctaaaaatgaacggacactgtttctctttgataagcttttactgatcaccaagaagcgggatgacacctttacctataaggcacacatactgtgtggaaacctcatgctcgtggaagtgatccccaaagaacccctctctttcagtgtctttcactataagaatcctaagcttcagcacactgtacaggcaaagagtcaacaagataagagactgtgggtgttacatttgaagaggctaattctcgaaaaccacgcagccaagattcccgccaaagctaagcaggcaattttggagatggacgccattcatcacccaggtttttgctacagcccagaaggagggaccaaagccttgttcggatccaaggaaggcagtgccccttacaggctccgcagaaaatcagaaccatcttccaggagccataaagtccttaaaaccagcgagaccgcccaggacatccagaaggtgtcccgggaggaaggctcgccgcaactgtcttcggctcgcccatctccagcccagcggaattcgcagccctcctcatctaccatgatttccgttctgcgggcaggaggggcactaagaaacatttggactgaccatcaaatacggcaagctctgtttcccagtagacggagtccacaggagaatgaagatgatgaggatgactatcagatgttcgttccgtcgttttcaagctcggaccttaatagcactaggctgtgcgaagactctaccagctcccggccttgctcctggcacatggggcagatggaatctaccgagactagttcaagcggacaccggatcgttcgccgggcttcttcagccggagagagcaacacatgtcccccagaaataggcacgtccgataggacccgcgaactccagaatagccccaaaaccgaagggcaggaagagatgacccctttcggctctagcatcgagctgacaatcgacgacatcgatcatgtttatgacaatatttcctacgaagatctcaaactgatggtcgccaagagggaggaagctgagagtacgccttcgaaatcggcgagggacagcgtcagacccaaaagtacgccagagctggcctttactaaacggcaggctggccactctaagggctccctgtacgcacagaccgatggtactttgtccgggggggaagctagtagccaatcaactcacgagctgcaggctgtcgaggagaatatctacgacacgatcggcctccccgaccccccaagtttgggctttaaatgcagctcccttaaacgtgcaaagaggagcacatttctcggacttgaggcagattttgtttgttgcgactccttacgcccctttgtgtcccaggacagcctgcagctctctgaagatgaagcgccctaccatcaggccaccccagaccacggctatttgagcctcctttacgactctcctagcggcaatttatcaatgcctcacaagccggtgtccgacaaactgagcgaggaagtggatgagatatggaacgacctggagaactatattaagaaaaatgaggacaaagcgagagatcgactgctggccgcgtttcccgtgagcaaagacgacgtgccagaccggcttcacgctgaaagcactccggaactgtcccgagacgtcgggcgttcagtttccactctctccttgcctgagagtcaggcactgctcactccagtgaagtcaagggcagggagagccagcagagctaactgtccgtttgaggaagacctcatcagtaaggaggggtccttcatgagtcttaacaggctgtctctggccagcgagatgccactgatggacaatccgtacgacctggcgaactccgggcttagccagaccgatccagaaaacccagatctgggaatggaagctacggataagactaagagtagagtgttcatgatggctcgacaatacagtcagaagatcaagaaagccaaccagctcttaaaagtcaaatccttagagttggagcagccacctgccagtcaacatcaaaagagcatgcacaaagacttagctgctatcctggaagagaagaagcaggggggcccagccatcggggcccggatcgcagaatacagtcagctgtacgaccaaatcgtattcagagaatcgcccctcaaaatccaaaaggatggatgggcaagtccacaggaaagttctctccttagatcagtctcccccagtcaggtgcaccacggctccggcgactggctgcttcacagtacatacagtaacggagagctggccgatttctgccttccacctgagcaagacctgcgcagcaggtatcctactttcgagataaacactaagtcaacgccccggcagctcagcgccgcttgttccgtgccgagtcttcagacctccgatcccctaccaggaagcgtgcagcggtgctcggtagtggtgtcacagcccaacaaagagaattggtgccaggatcatctgtataatagcttgggtcgcaaggggattagtgccaaaagccagccctatcatcgaagtcaatcttcttccagcgtgctgattaacaagtccatggacagcatcaactatccctctgacgtgggcaaacagcagttgctgtccttgcacaggtctagccgctgtgagtctcatcaagatctgcttccagatatcgccgacagccaccagcagggaaccgagaaactgtccgacctgaccctgcaggattcacagaaagttgtcgtggtgaaccgcaacttgccgctgaacgcgcagattgcaactcagaattatttcagtaactttaaagagacagacggtgatgaggatgactacgttgagatcaagtccgaggaggatgagtctgagttggagctcagccataacaggcggcggaaaagcgattccaagttcgtggatgccgacttttccgacaacgtatgcagcggaaacacgttgcattctctcaactccccacggacaccaaagaagccagtgaactctaagcttggcctgtctccctacctgacgccatataacgacagcgataagctgaatgattacctgtggcgcggcccaagtcccaaccagcagaacattgtgcagtcattgcgggagaaattccagtgtctgtcttctagttcttttgcatag

SEQ ID NO: 49542 - DNA, 141 bp, Artificial Sequence
  Description of Artificial Sequence: Synthetic coding sequence
atggagctgagcgacagcgaccggcccgtgagcttcggcagcacctcctcctccgccagcagtcgtgatagccacggctcatttggtagccgcatgaccctggtgagcaattcccatatgggactctttaatcaggactag

SEQ ID NO: 49543 - DNA, 4158 bp, Artificial Sequence
  Description of Artificial Sequence: Synthetic coding sequence
atggagctgagcgacagcgaccggcccgtgagcttcggcagcacctcaagctctgcctcttctcgagactctcatgggtcttttggatcaagaatgacgctagtctctaattcccacatgggtctatttaatcaggacaaagaggttggtgcaatcaagctggaattgattccagcgcgccccttcagctccagcgagctgcagcgggacaacccggctaccggacagcagaacgctgatgaaggaagtgagcggccacctagggcccagtggcgcgttgactccaacggagctccaaaaaccattgcggactctgcaacttcgcccaaactgctttatgtggatagggttgtgcaggaaatcctggagactgagcggacctacgtccaagatctgaagtccattgtagaggattatctagactgcatccgtgatcagacgaaattgcctctgggcaccgaagagagatcagctcttttcgggaacattcaggacatctaccattttaacagtgagcttctccaagatctcgagaattgtgaaaacgatcctgtggcaatcgcagaatgtttcgtatcaaagtccgaggagtttcacatttatacgcagtactgcacgaactaccccagaagcgttgccgttttaacagagtgcatgcgaaataaaattcttgcaaaattcttcagggagagacaggagacactcaaacactctctgcctctaggttcttatctgttgaaaccagtccagcgcattctcaaataccacctgttgttgcacgagatcgagaatcatcttgataaagacacggagggatacgatgtagtgctggatgcaattgatacaatgcagagagtggcatggcatattaacgatatgaaaagaaagcatgaacatgccgttagactgcaagaaatccaatctctgctaactaactggaaggggccagatctcacttcctatggcgaactcgttcttgaaggcaccttccgaatacagcgggctaaaaacgagcgtaccttatttttatttgataagctcctccttattacaaaaaagagggatgatacctttacttataaagcacatattctctgtggtaacttgatgctcgtggaagtcatccctaaggagccactgtctttcagcgtgtttcattacaaaaacccaaagctgcagcataccgtacaggccaaaagccagcaggataagcggctttgggtactacatcttaagcggttaatactggaaaatcacgctgcaaaaattcccgcaaaggccaagcaagcaattctggaaatggacgccatccatcatccaggcttttgttacagcccagaaggcggcacaaaggccctattcgggagtaaggagggttcagcaccataccgtctgaggaggaaatctgaaccaagttctcgctcgcacaaggtgcttaaaacttcagagactgcccaggatattcagaaagtgagcagggaagaggggtcaccccagctgtcgtccgcccgacccagtccagctcaacgtaattcccagccatcctcctccacaatgatatccgtacttagagccgggggcgcactgagaaacatatggacagatcatcagatacgccaggctctgtttccctctcggaggagtccccaggaaaacgaagatgacgaggatgactatcagatgttcgtgcccagctttagtagttccgacctgaactcaactcgcctttgtgaggactctacatcgagccgtccatgctcctggcacatggggcagatggagtcaacggaaacgagcagcagcggtcatcgcattgtgagaagggcctccagtgcaggagaaagcaacacatgccctcccgaaatcgggacctctgaccgaacacgcgagttacagaactcccctaagacagaaggacaggaagagatgaccccctttggctcgtctatcgaattgacaattgacgacattgatcatgtctacgataacatcagttacgaagatttgaagctgatggtcgctaaacgggaagaggctgaatcaacacccagtaaaagcgccagagattctgtccggcctaaaagtaccccagaactggccttcaccaaaagacaggcaggacatagtaaagggtcactgtacgcgcagacagatgggacgctgagtgggggcgaggccagttcccagtctactcatgagttgcaggcggtagaagaaaatatctacgatactatcggcctgcccgatcctcccagcctggggttcaagtgctcatctttgaagagagctaaaagaagtacgtttctcggattagaggccgatttcgtctgttgcgattccttgcgaccattcgttagtcaggactctctgcaactgtcagaagacgaggccccatatcaccaggcaaccccggatcacggatacctgagtctcctctatgattcaccatccggcaacctgagcatgcctcacaagccagtttccgataagctgtctgaggaggtggatgaaatttggaacgacctcgagaactatataaagaagaacgaggataaggctcgcgatcgactgctcgccgcttttcccgtgtctaaagacgacgtgcctgataggttacatgctgagagcaccccggagctttcccgcgatgtcggcagatctgtgagtacactgagcctgcctgagagccaggcccttttaacaccagttaagtcaagggccgggagggcctcccgcgccaactgcccttttgaggaggacttgattagtaaggagggatctttcatgtccctgaacaggctatccctggccagcgaaatgcctctgatggataacccatatgatcttgccaactccgggctttctcagacagacccagaaaatccagacctcgggatggaagctactgacaagaccaaaagtcgcgtgtttatgatggcacgacagtactctcagaagatcaaaaaggccaatcagcttctgaaggtcaaaagtctcgagctggaacagccacccgcctcacagcaccagaaaagcatgcacaaagatttagccgctattttggaggagaagaaacagggagggcctgctattggcgctagaattgcagaatactcccagttatatgatcagatcgtgttccgagaatctcctctgaagatacagaaggatggttgggctagccctcaagaatcttcgcttctaagatctgtgtccccaagtcaagtgcaccatggcagcggagactggctgctccactccacgtacagtaatggagagctagcagacttctgccttcccccagagcaggacttgcgttcccgctacccgacgttcgagattaacacaaaaagcacacctcggcagctgtccgcagcctgctccgtgccgagtctccaaacctccgacccactgccgggtagcgtacaacgttgttccgttgttgtcagtcagcctaacaaggaaaactggtgccaggatcacctgtacaatagcctaggacgaaaaggcatttccgctaagtcacaaccgtaccatcggtcccagtcttctagctcagtcttaattaataaaagtatggacagtataaattatcccagtgatgtcggcaaacaacagctcctgtccctccaccggtcttcccgctgtgaaagccaccaagacttattgcccgatattgccgactctcatcagcaggggactgagaagctgtccgatttaacattgcaagactcacagaaggtggtggtggtcaatcggaatctacctttgaatgcccagatcgctacccagaattacttttctaacttcaaggagacagatggagatgaggacgattatgttgagattaagtccgaggaggatgagtctgagctggaattatcccacaaccgccgaaggaaatcagacagcaaatttgtagatgctgacttttcagacaatgtgtgttccggcaatacattacactccttaaactcacccaggacccccaagaagcctgtgaacagcaagctgggcctaagcccgtatctgacaccatacaatgactccgacaagttgaacgattatctgtggcgcggcccaagtcctaatcaacaaaacatcgtccagagcctcagggaaaaattccagtgcttgagctcatcgagttttgcttag

SEQ ID NO: 49544 - DNA, 2859 bp, Artificial Sequence
  Description of Artificial Sequence: Synthetic coding sequence
atggagctgagcgacagcgaccggcccgtgagcttcggcagcaccagttcctcagcctcaagtagagacagtcatggatcatttggaagccgcatgactctggtgtccaattctcacatgggcctgttcaatcaagacaaggaggtcggcgccattaaactggagctgatccctgcaagaccttttagctcctctgagttgcaaagagataatccggccaccggccaacagaacgccgacgaaggctccgagcggccccccagggcacaatggcgggtggactccaatggcgcgccaaaaacaattgccgattccgctaccagccctaagctgctctacgtcgatcgcgttgtgcaggagattctggaaaccgaacggacctatgtgcaggatcttaagtcaatcgtagaagattacctggattgtattcgggaccaaactaagttgcccctgggcaccgaggagagaagcgctttgttcggtaacattcaagatatctaccactttaattccgagttgctgcaagacctggagaattgcgagaacgaccccgttgcgatcgccgaatgcttcgtatctaagtcagaagaattccatatttacacccagtactgtacaaactatccacgctctgtggctgtcctaactgagtgcatgcgtaataaaatactggcaaaattcttcagggagaggcaggagaccctgaagcactcgctcccgcttggtagctatctgttaaaaccagtgcagaggatcctcaaataccacttgctgctgcacgagatcgaaaatcacctggataaagacaccgaggggtacgatgttgtgctggatgcgattgacaccatgcagagggttgcctggcatataaatgatatgaaaagaaagcatgagcacgctgtgcggctacaggagatccagagtttgctgactaactggaaaggccctgatctgactagctacggggaactagttctggaaggcaccttccggattcagagggccaaaaatgaacgcacactgttcctgtttgataagctgctgcttatcacgaaaaagcgagacgatacgtttacctacaaggcccacattctatgcggaaatcttatgcttgtcgaagtgattcctaaagagccactctcattctccgtcttccactataagaaccccaagcttcagcatacagttcaggccaagtcccaacaggataagaggttgtgggtgctacatttaaaaagactaatcctggaaaatcatgctgctaagatcccagctaaggccaaacaggcaattctggaaatggatgccatccaccacccagggttttgttactccccagagggcggcaccaaagccttgtttggttccaaggaggggagtgcgccctaccgactccgacgaaaaagcgaaccatccagcaggtcacataaagtgctgaagaccagtgagacagcgcaggatattcagaaggtctccagagaagagggctccccgcaattatcttctgcgagaccaagccctgctcaaaggaatagccaaccgtcctcaagcacaatgatttccgtgctacgtgctggcggtgctctaaggaatatatggacagatcaccagattagacaggcactgttcccgtcaagacggagcccccaggaaaacgaagatgatgaagacgactatcagatgtttgtgccgtctttctcgagttcagaccttaactccactcgtctgtgtgaagacagtacatcaagcaggccgtgcagttggcatatgggccagatggaatccacggagactagcagctccggtcatcgcattgtgaggagagcctcgagcgccggggaatcaaatacttgtcctccagagatcggtacatctgatcgaacccgcgagctccagaacagcccaaagacggagggccaggaagaaatgaccccttttgggtctagtattgagcttacaattgatgacattgaccatgtgtatgataacatatcttatgaggacctgaaactgatggtcgccaagagggaagaggccgaatctacacccagtaaatcggctcgggactctgttagacctaagtccacccctgaactcgcctttacgaagagacaagccggacactctaaggggtcactctacgctcagacagacggcacactgagcgggggggaagctagttcacagagcactcatgagttgcaagctgttgaggaaaacatctatgatactataggactgccagatccaccctccctgggctttaagtgtagtagcctgaaaagagctaagcgctctactttcctcggtctagaggctgatttcgtatgctgcgactcactgaggccctttgtttcacaggacagtttgcaactttctgaggacgaagccccatatcatcaggctacgcccgaccacggatacctgtcccttctgtacgattccccttcggggaatctgtccatgccacataaacccgtgtcagacaagctatctgaggaagtggacgaaatctggaacgatttagagaactatatcaagaagaacgaagacaaagcccgcgatcggctcctcgccgcttttcctgtttccaaggacgacgttcctgacagacttcacgctgaatctacgccagaactgtccagagacgtgggcagaagtgtgagcactctgtccctcccagagtcacaagcgttgctgacccctgtcaagtcccgagccggccgggcatcccgcgccaattgtccctttgaagaggaccttatctcaaaagagggaagttttatgagcctgaaccgcctcagcctggcctctgagatgacactgtgtcaggccctttgtcgagatgcagcttggtag

SEQ ID NO: 49545 - DNA, 3492 bp, Artificial Sequence
  Description of Artificial Sequence: Synthetic coding sequence
atgcccgtgagcaccagcctgcaccaggacggcagccaggagcggcccgtgtccctgactagtacaacatccagcagcggcagctcctgcgattctcgtagcgctatggaagaaccaagcagctctgaagcccccgcaaagaatggggctgggtccctacgtagccgacatctgccaaacagtaataataatagctcctcttggctaaacgtgaagggccctctgtctccctttaacagccgcgccgctgccgggccagcgcatcacaagctgagttatcttgggcgggtggtgcgggaaatagtcgaaaccgaaaggatgtacgtacaagatcttcgaagcatcgtggagtctcaagaatttgacatttacacacagtactgtaataattatccaaactccgttgcggcgctgactgaatgtatgagggacaaacagcaggccaagtttttccgcgaccggcaggagctcttacagcactctctccccctgggttcttacttgctgaagccagttcagcgcatattaaagtaccacctgctcctgcaggagatcgctaagcatttcgacgaggaggaggatggcttcgaagttgttgaggacgcgatagataccatgacctgcgtggcctggtatattaatgacatgaaacgtaggcacgaacacgcggtgcgcctccaggaaatccagtccttgctgatcaattggaaaggacctgacttaaccacatacggggaactggtcctggagggtacctttcgggtccaccgggtacggaacgagcggaccttctttttattcgacaagactctcttaatcactaagaaaagaggagaccacttcgtgtacaagggaaacatcccttgcagctctctcatgctgattgaaagcactagagactctctgtgttttaccgtgacccattacaaacactcaaagcagcagtacagtatccaagctaagaccgtggaggaaaagagaaattggacacaccatatcaaaaggttgatcctcgaaaatcatcatgccacgataccccagaaagcaaaggaggccatcctggagatggattcttactacccaaaccgttatagatgctctcccgaaaggctgaaaaaagcgtggtcctcccaggacgaggtcagcacaaacgtgcgccaaggcagaagacagtctgaacccacaaagcaccttcttcgccaactcaatgagaaggccagagcggctggcatgaaaggaaaaggaagaagagagtccgagagctcgaggagctctaggcggccatccggcaggagtccaactagtaccgagaagcggatgtccttcgaatcaatcagcagcctgccagaggtcgagccagaccctgaagccgggtcagagcaagaagtgtttagtgcagtggaaggccctagcgcggaggagaccccctctgacaccgaatcaccggaggttttggaaacgcagctggacgcccatcagggtttgctgggcatggatcctcctggagatatggtggattttgtggcagccgaatccaccgaagacctcaaagccttaagtagcgaggaagaggaggaaatgggtggagcagcgcaggaacccgagtctcttctgccgccttctgttttggaccaggcctctgtgatcgccgagaggtttgtgagctctttcagtagaaggagctctgttgcccaggaagattctaagtcatccgggtttgggagcccccgtctggtgtccaggagttcaagtgtgttatccctcgagggctcggaaaaaggcttggctagacacggcagcgcaacagactccctgagctgtcaactgtcccccgaggtcgacatttctgttggggttgctactgaggacagtccgagcgtgaacggtatggaacctccctccccaggttgccccgtggaacctgaccgcagttcctgcaagaagaaagaatctgctctgtctacccgcgaccggctcctgttggacaaaataaaaagctactatgagaacgcagaacatcacgacgcaggtttttctgtgcgtagaagggagtccctctcttatatcccaaagggacttgtgagaaactcaatttctagatttaactccctcccccgccctgatcctgagcctgtccctcctgtcggatccaaaaggcaagtgggtagtcggccgacatcctgggctctatttgaactgccggggcctagccaggcagtgaaaggggaccctccccccatcagcgacgcggagttcagaccctcatccgaaatcgtcaaaatttgggagggtatggagtcaagcggaggaagcccggggaaaggccccggtcagggacaggctaatggtttcgacctgcatgaacctctctttatcctggaggaacatgagttgggagccattaccgaggaatctgcaactgcatcccccgagtcaagctccccgactgagggtaggtctcctgcacatctcgcgagggagctgaaagaactcgttaaagagttgagctctagcacgcagggggaactcgtggctcctctgcacccaaggattgtccagctgagccacgtgatggattcacatgtgagtgagagggttaaaaacaaggtgtaccagctcgcccgacaatattctctccgcataaaatccaataagcccgttatggctcggccccccctgcaatgggagaaggtggccccagagagagatgggaagtcacctaccgtcccttgccttcaggaagaagccggagagcccctaggcggaaagggaaagagaaagcctgtcttgtcgctgttcgactacgagcagctgatggcacaggaacattcccctcctaaaccaagctctgcgggcgaaatgtccccacaaaggttttttttcaacccgagtgcagtgtcgcagagaaccacctctccaggggggcgtccatctgcaagaagcccactgtctcccacagaaaccttctcgtggcccgatgtaagagaactgtgttctaagtacgcaagtcgggacgaggccagaagagctggggggggacgacccaggggcccacccgtcaatcgctctcacagtgtgcctgaaaacatggtcgaaccgcccctgagtggaagggtcgggcgatgtaggtcactgtcaacaaagcgaggccgtggcgggggagaggcggcccagtcacctgggcccctgccccagagcaagcccgacggtggtgagactctgtacgtgacggccgacttaacacttgaagacaatcgaagggtgattgtcatggaaaagggacccttgccttcacctactgctggactcgaagaaagcagcggacaggggccttcctcccccgttgcattgttgggccaggtacaggatttccagcagtctgctgagtgtcagcccaaagaagaaggcagccgcgacccagccgaccctagtcaacagggcagggtccgaaacctgcgggaaaagttccaggctctcaactccgtgggatag

SEQ ID NO: 49546 - DNA, 3660 bp, Artificial Sequence
  Description of Artificial Sequence: Synthetic coding sequence
atgcccgtgagcaccagcctgcaccaggacggcagccaggagcggccagtgtctctaaccagcacgacctcatctagcgggagcagctgcgatagccgctctgccatggaggagcccagctccagtgaggcaccggctaaaaacggcgccgggagcctacgaagcagacacctaccaaactcaaacaataattccagctcttggcttaatgtcaagggacctctgagtcctttcaactcacgcgccgcagctggccctgcacaccataagctcagttatttgggccgcgtcgtgcgtgagatcgtggaaaccgagagaatgtatgtacaagatctgcggagcatcgtggaagattacctccttaagatcatcgacacccctgggctgctgaagcccgaacaggtgagcgccttgtttgggaatatcgagaatatttatgccctgaatagccaactccttcgggatctggactcttgcaactccgatccagtcgccgtggctagctgctttgtggaacgctcccaggagttcgatatttacacccagtattgcaacaattatccaaattcagtcgccgctctaacagagtgcatgcgtgacaaacagcaggcaaaattctttagggacaggcaggaactgttacagcattccctgccactggggagttaccttcttaaacctgtccagcggattctgaaatatcatctgctgttgcaggagattgcaaagcactttgatgaggaggaggatggcttcgaggttgtggaggatgccatcgacaccatgacatgcgttgcttggtatatcaacgatatgaaacggcggcacgaacacgctgtcagacttcaggagattcagtccctcctcatcaattggaagggccccgacctgacaacctacggagagctggttttggagggcacatttcgcgtgcatcgcgtacggaatgagagaacgtttttcttgttcgacaaaactctgctgatcactaaaaagcggggggaccatttcgtctacaagggcaacattccctgctctagtctgatgctcatcgaaagtacgagggattccctgtgttttacagtaacacactacaaacacagcaagcaacagtactccatccaggccaaaactgtggaggaaaagaggaattggacccaccacatcaaaagactgattttggagaatcaccacgcaacgatcccccagaaggctaaggaggctatccttgaaatggattcatactacccaaaccgctaccgatgctctcccgagcggctgaaaaaggcctggtcctctcaagacgaggtaagcaccaacgtccgtcaaggccgaagacagtccgagcccaccaaacatctactacgccagcttaacgagaaggcgcgagcggcagggatgaagggaaaggggaggcgcgagagtgaatcatcacgtagttctcggagaccatccggaagaagccctacgagcacagagaagcgcatgtctttcgagtccatctctagtttacctgaagttgagcctgatcctgaggctggtagtgagcaagaggtttttagcgcggtggaggggccttctgcagaggaaactccgagcgataccgagtccccagaggtgctcgagacacagctcgatgcccatcaggggttactcggtatggacccgccaggagatatggtcgacttcgtggccgctgagagtacagaggatctgaaagccctgagcagcgaagaggaggaagaaatgggcggtgccgcccaggagcctgagtctctgcttcctccctctgtgctagaccaggctagcgtcatcgcagaacggttcgtgtcctccttttcccggcggagctcagtggctcaggaggattcaaagagctccgggtttgggtctccgaggctggtgagccggtcaagtagcgtcctgtccctggagggatccgaaaaagggctggccaggcacggcagcgccaccgacagtctttcatgtcagctgagccctgaagttgacatttctgttggtgttgcgacagaggacagcccatccgtaaatgggatggagcccccgagccctggttgtccagtcgaacctgatcggagctcatgtaagaagaaggagtccgcattgtctacacgcgacaggctgctattggacaaaattaagtcgtactacgagaatgctgaacatcatgatgcaggattctccgttagaaggagagagagcctgtcatacattcctaagggccttgtcaggaacagcatatccaggtttaatagcctgccccgaccagacccagaacccgtgcctccagtcggctctaaacggcaggtggggtcccgcccaacctcttgggcgctgtttgagctccctggaccttcccaggccgtgaagggagatccacctccaatttccgacgcggaatttcgcccttcaagcgagatcgtgaagatctgggagggcatggagagctctggcggcagtccaggaaaggggccaggacaggggcaggctaatggcttcgatctccatgagccactgtttattctggaggagcacgaactgggggcgatcacagaggagagcgctaccgcctctccagaatctagttcgcccaccgaagggcggtcccccgctcatctcgctcgggagctgaaggagctcgtcaaagagctgtccagcagtacacagggcgaactggtggccccattacatccacgcatcgtacaattatctcacgttatggactctcacgtctcagagcgcgtcaaaaataaggtctaccagctcgccagacagtatagtttacgtattaaaagtaacaagcctgttatggcacgcccacctctacagtgggagaaggtggcaccggagcgcgatggcaaaagtcccacagtcccttgcttacaagaagaggccggagagccgctgggtggaaagggtaagcgcaaaccagtgctgtctctttttgactacgaacagcttatggcccaagagcacagcccacctaagccctccagcgcgggagagatgagccctcagagatttttctttaatcctagtgccgtatcacagcggactacttcccccggagggcggccctccgcaaggtcacctctgagtcccaccgagaccttcagttggccggacgtgagggagctctgctcaaagtacgctagcagagatgaggcacggcgagccggaggggggaggcccaggggcccacccgtgaacagaagccattctgtgcctgagaatatggtggaaccacccttgtcaggccgtgttggcagatgtcgctccctgtcgacaaagcgaggcagaggcggaggagaagctgcgcagtccccgggcccgctcccacaaagcaaacctgatggaggcgagaccctgtatgttaccgctgatctcaccctcgaggacaacaggcgcgtcatcgttatggaaaagggacctctgccaagtccgacggccgggctggaggaatcaagtggtcaggggccaagctctcccgtggcccttctggggcaggtgcaggacttccagcagtccgccgagtgtcagcccaaagaagaaggatctcgagatcccgctgatccttcccagcaggggagagtgaggaatctgcgcgagaagttccaggcgctcaacagtgttgggtag

SEQ ID NO: 49547 - DNA, 486 bp, Artificial Sequence
  Description of Artificial Sequence: Synthetic coding sequence
atgcccgtgagcaccagcctgcaccaggacggcagccaggagcggcccgtgagcctcacctccacgacaagctcctccggcagcagttgcgactcaaggtcagcaatggaagaaccttctagcagcgaagctcctgcgaagaatggcgcaggcagcctgcggtcccggcatctccctaattctaacaacaattcaagcagctggctgaatgtaaaaggtcctctcagccccttcaattccagggccgctgcgggccctgcccaccacaaactctcttatctaggcagggttgtgagagaaatagtggaaacggagcggatgtatgtacaagaccttaggtctatcgtcgaggactatctgctgaaaattatcgacacacccggcttgcttaagccagaacaggtatccgctctgttcggtaatatcgagaatatttacgccttgaatagccagctcctccgggacctcgattcatgtaacagctag

SEQ ID NO: 49548 - DNA, 567 bp, Artificial Sequence
  Description of Artificial Sequence: Synthetic coding sequence
atgcccgtgagcaccagcctgcaccaggacggcagccaggagcggccggtcagtctgacatctacaaccagcagcagcggcagcagctgtgattctagaagtgccatggaggaaccttcctcttccgaagctcccgccaaaaatggcgccggttcccttcgcagccgacatcttccaaatagtaataataatagcagtagctggctgaatgttaagggccctctaagcccattcaatagccgggcggcagctggcccagcacatcacaagctgagttatctgggcagagtggttagagaaatcgtggagacagaacgcatgtacgtacaggacttgcgcagcatcgtcgaggactatcttttaaaaattatcgatactcctggtctactgaagcccgagcaggtgtcagcactgttcgggaacatcgagaatatttatgcattaaattcccagttactcagagatctggattcctgtaacagcgatcccgtggccgtagcatcatgtttcgtagagagatctcaggaatttgatatctatacacaatattgcaataattacccatag

SEQ ID NO: 49549 - DNA, 3816 bp, Artificial Sequence
  Description of Artificial Sequence: Synthetic coding sequence
atggaggccctgcggaaccccatgcccctgggcagcagcgaggaggcacttggcgacttggcctgtagcagcctcactggggcctcgcgcgatctgggtactggagcagtagccagcgggacacaggaggagacgtcgggaccgcggggggaccctcaacagacaccgtccttagagaaagaaagacacaccccttcacgcacaggcccgggtgcagctggaagaaccctgcctcgtagatcacggtcttgggagagagctcccagaagctcccgcggtgcccaggcagctgcgtgtcatacctcccaccacagtgccggctcgagaccaggcgggcacctaggcgggcaagccgtgggcactccaaattgtgttcccgtcgaaggccccgggtgtacgaaagaggaagatgtccttgcatccagcgcctgcgtaagtactgacggcggatcactacactgccataaccccagtgggccctccgatgttccagcacgacagcctcatccggaacaggagggctggcctccaggaaccggtgacttcccatctcaggtgccaaagcaggttctggacgtctcgcaggaacttttacagtctggcgtagtcaccctcccggggacaagagatcggcacgggcgagctgtggtgcaggtccgtaccagaagtctgctatggacaagggaacactcctcttgtgcagaactgacccgattactcctgtactttcactcaatcccacgcaaagaggtacgagatctcggattggttgtactcgtggatgcgaggaggagcccagccgcacccgcggtttcacaggctctgtccggcctccagaacaatacgagccctatcatccatagcattctgctgctggtggataaggagtccgctttcaggcccgacaaggatgctattatccagtgcgaggtggtgagctcgctcaaggctgtgcacaagttcgtcgacagctgtcagctcactgccgatctggacggatcatttccctacagccatggcgactggatctgctttcgccagcggcttgaacactttgcagcaaattgcgaagaggccataattttcttgcaaaactcattttgctcgctcaatacacacagaactccccgcaccgcccaggaagtggccgaattaatcgaccagcatgaaacgatgatgaagctggtcttagaagaccccctgctggtgagcttgagacttgaggggggcaccgtgctcgcacgactccgtagagaggaacttgggaccgaggacagtcgcgataccttggaggctgccacctccctgtacgatagagtagacgaggaggtccatcgccttgtgctaacctctaataataggctgcagcagctcgaacacctgagggaactagcttcattattagagggtaatgaccagcagtcatgtcagaagggtctgcagctcgccaaagagaatccgcaaaggacagaggagatggtccaggattttagacgaggcctgagcgccgtggttagccaagccgagtgccgggagggggaactggctcgatggaccaggtctagcgaactgtgcgagacggtatcatcctggatgggccctcttgatcccgaggcctgccccagctcccccgtagcagaatgcctgcgctcatgtcaccaagaggctacctcagttgcagccgaggcgttcccaggtgcaggcgtggctgtgctcaagccgcacgctctgggcaaaccatgggcatcgcagcaggatctatggttgcagtatcctcaaaccagacttagactcgaagaagccctcagtgaagctgccccagacccctcgctacccccactagcgcagagccctcctaaacacgaaagggcccaggaggcaatgcggcgccaccagaaacccccatcatttcccagcacagacagcggaggaggcgcttgggagcccgctcaacccctcagcgggcttcctggtcgagctctgctgtgtggccaagacggggaaactctcagacccggtttgtgcgcactgtgggaccccctgagccttctccgtggactccccggcgctggcgcaacaactgctcatttagaggactcctcagcatgcagtagcgagcccacacagacactcgcatcgcgccccaggaaacacccacagaagaagatgatcaaaaaaacccagtccttcgaaatcccacagcccgacagcggtccccgcgatagctgccagcctgatcacacgtctgttttttccaaaggcctggaggttacctcaacggtagccacagagaaaaaactgccactgtggcaacatgctcggtctcctcctgtgacacagtcccgtagtctatccagccccagtggccttcacccggcagaggaggacggacgacagcaggtaggatcttctcggcttagacatattatggccgagatgattgcaactgaaagggagtacatacggtgcttgggttacgtgatcgataattacttccccgaaatggagagaatggatcttccccagggattacgggggaagcaccatgttatcttcgggaacttagagaagcttcacgattttcatcaacagcactttctgcgcgagctggaaagatgtcagcattgccctctggccgtcggacggtcgttccttcgccacgaagagcagtttggcatgtacgttatttactccaagaataagcctcagtctgatgctttgctctcttctcatggaaacgctttcttcaaggataagcagcgtgagttaggagacaaaatggatctggcaagttatctcttgagacccgtgcaaagggtggcaaaatacgccctcctcttacaggatcttttaaaggaggcaagctgcggcctcgcacagggacaagaactgggtgagctgagggctgctgaagtggttgtctgcttccagctgagacacgggaacgaccttctggccatggacgctataaggggatgtgatgtgaatctaaaggaacaagggcagcttcggtgccgagatgagtttattgtatgctgcggcagaaagaagtatcttcgccacgtattcctgtttgaagacctgattctctttagtaaaacccagaaagtggagggctcccatgacgtctatctttacaagcagtcttttaaaaccgccgagattgggatgaccgaaaacgtaggcgacagcggcctgaggttcgagatctggttccgtaggaggaggaagagtcaagacacatatatcctccaagctagctctgcggaggtgaagtctgcctggaccgacgtgattggcagaatcctttggcgccaggcgcttaaatccagggaactcaggatccaggagatggcgagtatggggatcgggaaccagccgtttatggacgttaagcctagggatcggacgcctgattgtgctgtaattagtgacagggctccaaagtgtgctgtcatgagcgatagagtgccggattccatagtgaaaggtacagagtctcagatgcgcggatcgactgccgtgagttcttctgaccacgccgctcctttcaaacggccacactccacaatctccgatagttctacttcaagcagtagtagccagtctagcagcattctgggtagcctcggcctacttgtctcaagctcccccgcgcacccaggactgtggtctccggctcactctccgtggagttctgatatccgggcctgcgtggaagaagatgaaccagagcccgaactggaaacaggcacccaggccgctgtctgcgagggcgccccagccgtactgctctcccgtacgcggcaggcttag

SEQ ID NO: 49550 - DNA, 1140 bp, Artificial Sequence
  Description of Artificial Sequence: Synthetic coding sequence
atgatcttcatgaacaccctgcggtacctgcagacccacgagtacctgctggatgttgacctgtggagactgtttgcaaacctcgaggagttgacccagacaagtctgggattcgtaaattctcttttcggtattatcaaagattacgtcgacgctagcgaaatctcctccagcctagactttatcagtgttcttaccaagtattttcgtggctccctgtgccagagtcaccagacgtattgcctgaactactctgccgcaattttctacttggagagtctcagacagcgggatgatttcggcatctatttgaaatggtgcgagcaaaacgaacagtgtaggcggctgcacgttccggaactcctggtggcacccctccagcgtctgacgagataccccctcctgctgaagaatatctggaaacggagcatggattcggccgaaaagataatgatctattctatcaaggagaaggtcgagaaatctatccgagacctggaggggaaagtgaaatggctcgacaactttcagaagtttcggtatctgcaagagatcatcgtgtggcctccgctttgggatagagataaacggttctttattcccgagtgcctcaaacacattttcaaggaacatatggccgagaacatactgtctcctacatctcgccacctgctgtacgaggggaaactgactctcgccgaatcaacccgattcctggatgtgtacctgtttcttttcaatgacttcctgttagtaactaagacgaaatgcaacaagaagaaactgggaggatcagacccagggcttatgtgccccagcctgacacctgaactacaggcagtgataaaagagggtgggtcttgcaccgtgttggaccaaccgatcccattggacaggctggtggtcaagagtatagaaccccttcacgttagcgtgtttggactgaggaatgcattcctgatccaacacgaaaacaggtataggcagtgcattgctgcatttctgctgcaggcccaaaccgagaacatcaagaaaacctggatggcacagataaccactgcgatctcttgcttcaccaagtcccaggagacaaaaaagatttctttgttcactcttcccgcagaatcatccgagatttag

SEQ ID NO: 49551 - DNA, 4095 bp, Artificial Sequence
  Description of Artificial Sequence: Synthetic coding sequence
atggccgagctgaaggtggaggcccccgccagcgtggactggcagaagagatgcttgaccttagagacacagctttttagattccgcctgcaggcctctaaaatcagagagctgctagcagacaagatgcaagaactggaacaacgcctcctagaggccgaacagcgcgcagagaatgctgaaacccaagttggggtgatggaagaaaaggtgaaactttctaacctcaagaatgtcgattcagaaggaagccttcatcgtaagtaccaagaattattaaaggccattaaaggcaaagacgagctaatctctcagctggaggcccagcttgaaaaacaaaaacaaatgcgtgccgaggaagctaaaactgttcaggagaaggcagcaaagatcaaagagtgggtgacccttaaactcgctaagttggagatggaaaatcagcatctcaaatcccacaaccaacggttggtcgagcaagtgggatctctccaggacgcactggaagccatccagatcgcaccctcacgcaagcttttggtgccgccatatggtgctgccgagcaggactccgttccatctgagccaggtattcagccaatgggtcaggactctggatctcaggctcagggcctcaaagccgctgtcctggcccccagcccaggcgcgcttcagagtaaggacagcgtgtcagaggccgccagtccactcgaagacagcagctcctcgaccgtccattctggtgaaaccgtggaagcaaagccactccagccccacctggggagggagtctccccctcaccagccctgtatgaagttgctaacctttaggtgcagctccgcctcttggggggaggggctcgttaccgcccaacggggcatgctgccaggcacaaagacgtctgctcgcgagggtggtccaggttcatctctgaccctgcctaaggtcagagctcccggaacccctagggatagcatccagctcgcgaaacgccaccatagccagccccaggtagggcacggacactttggccgggttgtcaatattgagactgaagccttttccgcgctgcacccgagtggtctgcccgaactcgagtccagagctaggagcagagaagagcccgagaagatggagatggaggagccacccccagccggcaagaatgaagagcgagagagccctaaggccttaggagccgaactggaagaggttgagttggggaacaagcctcccaccccccctctgcatcaattttcgtcatgggagagtcgaatctacgcagtggccacatctggcatgaggctctcggacatgtcccctaggtcgaacactgcatgttgcgcaagctctcccccagcactcgtttcccctgggtctttttccggtctagtctacaaaaatgtgaccgtccccgtgtacactgcgctgaaaggtagagccacccagatttctaatatgccctttatggatgaaagcagcggatccgatgacgactgctcctcccaggcctcgtttcgcattagcgttccatcctcggaatctagaaagacttccggcctgggaagtccaagagccataaagcgaggggtatccatgtctagtctgtcatcagagggagactacgctatcccaccggacgcgtgcagtctagattccgactattctgagcccgagcataagctgcaacgcacatcatcatactctactgacgggctgggactaggtggggagtctctggagaagagcggatacttgctcaagatgggctcccaggtaaagacctggaagcgcagatggttcgtgctgaggcaggggcagataatgtactacaagagcccttcagatgtgatcaggaagccccagggccaggtggatctaaactctcggtgccaaatcgtgcggggtgagggtagccagaccttccaactgatatctgaaaagaagacgtactaccttactgccgattcaccctccctgctggaggaatggattagagtcttacagtctctgctgaaggtccaagctacagggcccccagcactcctgcgagggggaactaagcctaccgtgaaagggtggctcacaaaagtgaaacacggccactccaaagtggtgtggtgcgcgctcgtggggaagattttctactactatagatcccacgaggacaagagacccctgggctgtctgccggtccgagatgcacacatcgaagaagtcgatcgttcatgtgactctgacgaggactacgaggccggcggtacccgaaggctgctgagttctcactgcacccttgtcatccacccaactgagcactctcccacatatctccttatagggaccaagcacgaaaaggatacttggctgtaccatttaacggtcgccgccggaggctcttctgcgaaagtgggaaccgcgtacgagcaactcatcgggaagctgatggatggcgagggagaccctgattctcccttatggcgacaccccatgctgtgctattccaaagacggcctgtatgccagtctgactactctgccatctgaagcattgcaaactgaagccttaaaactgtttaaaagctgccagttgttcataaatgtccccgtagaggcagcaagcgtggactatcatgtttctcttgcacagacggccttgcaggtctgcctcgtgcaccctgaacttcagagtgaaatttactgtcaactcatgaagcaaacttcttgcagaccaccccaaaagtactctctaatgcagtgttggcagctccttgctctgtgtgctcctctgttcctcccccagcaccacttcctctggtatgtgaaacagcaattgcagcgacacgcagacccacggtcagagaccggccagtacgcaacttactgccagcgcgctgtggaacgcacattgagaactggagaacgcgaagccaggcccagcaggatggaggtggtttcgattctgctgcggaatccttttcatcactcactccctttttccattcccgtgcactttacaaacgggacgtatcatgtagtcggatttgatgggtcctccaccgttgacgagttcctgcagagactcaatcaggagattggtatgaggaagccgtcacattctgggttcgcgctctttaccgatgacccttctgggcgggacctcgaacattgtctacaggggtctgtgaaaatctgcgatgccatttccaagtgggagcaggccatgaaagaactgcaccctggaaagagtgaaggaggtacccgagttgtgaaacttatgtacaaaaataggctgtattttcgatcacaggtcaagggagagacagatcgcgagcgcctcctgttagcttcccagaccagtcgcgaaatcgttgccgggaggttccccattaataaggaactcgctctagagatggctgcgctaatggcacaggtggagtatggcgaccttgagaagcctgcattaccaggcccgggaggtacaagccctgccaaggcccagcacctactacagcaggtgttggaccgttttcatcctagaaggtatcgccacggagcgccagctgagcagctgaggcatcttgcagacatgttaacgacaaagtgggctaccttacaaggatgttcgccccccgagtgtatacgcatttacttgaccgtagctcgtaagtggcccttctttggggccaaactattcgctgcccagcccgcacagctcagttccaaagagaacgcactagtgtggatagcggtgaatgaggacggggtgtcaatcctggaccacaataccatgcaggttcatatcacatacccctactcgagtgtcacaacattcggtggctgccgggatgacttcatgctcgtgatacggtctattccagataagtcatccggtaaatctcacatcgagaaacttatatttcggatggcggctcccaaaatcgctgaggccaccttcatcatggcgagttacatgaaccactgcaccacgaccgtgaatccgcccacaaatccccccggggcttgccagttatgggagctagatggaagacagttttttagttctgtatcttgtgcgacaaaggggcctacactgctctag

SEQ ID NO: 49552 - DNA, 990 bp, Artificial Sequence
  Description of Artificial Sequence: Synthetic coding sequence
atggccgccctgatggcccaggtggagtacggcgacctggagaagcccgcacttccgggaccaggcgggacatcacccgccaaagcacagcacttgctgcaacaggtgctagataggttccacccccggaggtaccgccatggcgccccagccgaacagctgcgtcatctggcggatatgctgaccacaaaatgggcaaccctgcagggatgttctcctcctgaatgcattagaatctatctgactgtggctcgtaagtggcctttcttcggagccaaactatttgcggcccaaccagcccagctcagctccaaagagaatgcacttgtatggattgcggtgaacgaagacggagtctcgattctcgatcataatactatgcaagtgcatatcacatacccgtattcatccgtcaccacctttgggggctgcagggacgacttcatgctcgtcatcaggagtatccccgataagagttcgggaaagtcgcacattgaaaagctcatttttaggatggccgcgccaaaaccccagcaccacgctgtgctcagttgggtgctgacctgttcctcactgccttgcagtagcccgcaggggcgggccgattccagcctgcgcgctaaccagtcccgcacacttggcctgttgttcagtgagggccactgtgcttccgagcggatcagcagacctactggcgcgcacacgacgggccccctaaatagcacagtgatgattccattcgggtattttctgccggattgccgttcatacctgcaccatggacagctttacgagccattgcactacaactgcgaacctccccatcagccaaccagatctctccctgccgtgggaacaggctggacaacagttctgttcttttgttttttgtgttaccagggcgcaaacgtggcagtcaacattagcccgaccagattccctaatacgacaagtgccagtggcttccgcgacatatacccccgggtctag

SEQ ID NO: 49553 - DNA, 2382 bp, Artificial Sequence
  Description of Artificial Sequence: Synthetic coding sequence
atgcccctgcccggcggcctgtggtggctgctgtgctgccggcggggtttcaccttgctgcacagagattacggcgatggggaactgtcaggcgatggcgatgaggatgaagacgaggagaccttcgaactgagaacgccttcgcctgccggcggtggccgtggacctttggaagttacgcttacccaacccgtgcgctcggggcctgtgagcaataggctccagtcttgggaggaaacatggtcactgatccccgagaagggcttgccagaggacgacccggacatcgtggtcaaggggtggttatatagggagccccggggaggcggagcaagaccgtggttgcccccacgcagggcgtggttcgtcctgacacgggatagtctggatcagttttcatctagcggtaagggagcgcgtcgcctgggatctcttgttctcacctctctctgctccgttactggcccagaaagacgcagaaaagaaactggactttggtcggtgactgtaagcggccgaaaacactctgtccggctttgttctcctcggcaggccgaagcagaacgatggggagtagccctgagagaagtgattgcgagcaaggctcccctagagacgcctacccagctgctgctcagggatatccaggaatcctgtggagatcctgaggcagtcgccctgatctaccttagaaacccaattctgagacacaccagtggcgcgctctatgcacctttactgccccttccctacggggttagcgcccctggccccggctacgcccctcttcgagaggaagctgtgaggctgtttcttgcccttcaggcactggagggcgcccgcaggccaggccccttgatgcagggcgttttgcagacttgtcgagatctacccgccttgcgagacgagctctttttgcagctggccaagcagaccagcggcccggcgggtccgccaggattacccgcgacccaagaccccgctgcactgcggtactggcagctactcacctgtatgtcttgtacatttcggccaggaggcgctgtcagaggacacttgttaggacacctcgaacggactgagcaagcccttcctgattcagaactggccgagtacgctcggtttattcgtaaggcactgggtcgtacccgaggaagagaactggtgccatctctagctgaaatctccgctctgagtcagaggcaggagctcctgtgcactgtgcactgcccaggtgccggggcctgcgctgtggctatcgactctcatacgaccgccggtgaggtggcccgagaacttgttgggcgactaggattggccagatcacggaacgccttcgccctctacgaacaaaggggggctcaggaacgcgcacttgccgggggaacactggttgccgatgtgctgactcggttcgaaaacttagcagccgaggaggctggccttgaggatagtcccgacagcgggtggcggttatgcttgcgcctccatgggcccttgcatccagaaggtctttctcctgacggacacgagttaccgtttctatttgagcaagcacacgccctcctgctgagaggcagacctccaccaccagacgataccctgcgtgccctggccgctctgaggctgcagagcctgcagcgggacttctcgcctcgcgtgccactaccgcggctggataggctgcttccacctcctgccccaccgagggaagacccaccgcgaccaacccccagaccacctcctagtgccgccttactcgcaggtgcgctgtggtccccagggctggcaaagagaagggcggaacgcgctaggcgcgggggtgccggccgcaccgcaggctccatcgcgcgagagggggggggaggagccgggaccgcagcagcagtgctggggggctggaagaggttgcgtgggatgggtcgtgctgaagcgatggccgcctatttggccttggcggctcagtgccccggttttggggctgccaggtacgatgtcctggagctcagtacagagcccggcaggggcgccccacagaaattgtgtctcgggctgggggcgaaggctatgtcactgagcagaccaggtgagacagaacccattcacagtgtgagttatggtcacgtcgccgcatgccagttaatgggaccccacaccctggccctcagagtgggagagtcacaattgttgctgcagtctcctcaggtggaagaaattatgcaactggtcaacgcttacctcgctaatccaagtcccgagaggccatgcagttcctcttcacctccatgccaggacttgccagacacatctcctccctcccaaaggcctggcctcgacgaaccacaggggcagtccgggtgcctgggccagctccaggattag

SEQ ID NO: 49554 - DNA, 1851 bp, Artificial Sequence
  Description of Artificial Sequence: Synthetic coding sequence
atgcccctgcccggcggcctgtggtggctgctgtgctgccggcggggatttaccctgttacatagggactacggggatggcgagctatcaggcgacggagacgaagacgaggatgaggagacgtttgagctacggaccccctctcccgccgggggcggccgcggccccttagaggtcaccctgactcagccagtccgatcaggccctgttagcaaccgcctccagtcctgggaagagacatggagcctgattcctgaaaagggtttgcccgaggacgatcctgacatagtagtgaaggggtggctctatagggagccacgcggcggtggcgctcgaccgtggttgccacctagaagagcgtggttcgtcctcactagagactccctcgaccagttcagctcctcaggcaaaggagccagaagactcgggagcttagtgttgacttcactgtgttcagtcaccggccccgagcgccggcgcaaagagactgggttgtggtcggttacagtttcagggcgcaagcatagtgtgagattgtgctcaccaaggcaggctgaggctgagcgatggggtgtggccttgagggaagtaatcgcctccaaagcacctctggagacccccactcagctgctactccgggacattcaggagagttgtggtgacccggaggctgtggctttgatttaccttagaaatccaatattacggcacacctcgggggcactctacgcacctctactgccactaccatacggcgttagtgctcctggccccggctatgccccccttagagaggaggctgtgaggctattcctggccctgcaggctctggagggtgcccggcgccctggccctctcatgcaaggcgtcctgcagacctgccgagatctcccagcactgcgagatgaacttttccttcagctcgctaagcagactagcggccctgccggtcccccagggttacccgctacacaggatcccgccgcactgcggtactggcaactcctgacctgtatgtcctgtacattcaggccagggggtgctgttagagggcaccttttagggcacttggagaggacagaacaagctctgccagatagcgaactcgctgagtacgcacgattcatacgtaaggccctgggcaggacaaggggccgggaactggttccttctttggctgaaatctcagccctgagccagcgtcaggagctgctttgtaccgtgcattgccccggagccggcgcttgtgccgtagccatcgacagtcatacaaccgccggcgaggtcgctagagagctagtgggccggctgggcctggcacgcagcaggaatgccttcgccctatacgagcaacgcggagcccaggaacgagcattggcgggcggcaccctggtcgccgacgtattgacatcattggccgccgaggaggccggtctggaggattcacccgacagtggctggcgtctgtgcttgaggctgcatggcccactccaccctgaaggactgagtccagatggccacgagctcccatttctctttgaacagccagactccgcttcgctcagcgctggcgcatggagtggctatggccatgtggctgcatgccagctaatgggaccgcacactctggcactgagggttggagagagccagctgctgctccagtctccacaggtcgaagagattatgcagctggtgaacgcctacttggccaacccatccccagagcggccgtgttccagcagttcgcctccatgtcaggacctcccagacacaagcccaccgtcccagcggccggggttagatgagccgcaggggcaatctggctgcttggggcagctacaggattag

SEQ ID NO: 49555 - DNA, 1095 bp, Artificial Sequence
  Description of Artificial Sequence: Synthetic coding sequence
atgagctgcaccttccggcccggcggcgccgtgcggggccacctgttggggcacctcgagcgaacagagcaggcgctccccgacagcgagttggctgagtacgcgagatttatccgcaaggcacttggaaggacaagagggagagagctagtgccttctctggcagagatctcagcactttcacagcggcaggagctgctgtgtaccgtccattgccccggtgctggtgcatgcgctgtggccattgactctcacactaccgcaggagaggtcgcaagagaactcgttggtcggctcggactcgccagatctcgcaacgccttcgccctctatgaacagcgcggcgcccaagaaagggcgcttgccggtggcaccctggtcgctgacgtgctcacaagcctggctgctgaagaggctggtcttgaggactctcccgactccggatggagactttgtctccgcctccatggaccactacatccagaagggctaagccccgacggtcacgaattgccattcctcttcgagcaggctcacgcgctgttgctaagaggacgcccgcctccccccgacgataccctccgggcactggcagccctgcggctgcagtctttgcagcgagacttctcccctagagtgccgttgccgcggcttgacaggctactaccccctcccgcacccccccgagaggatccgcctaggcctacgcccaggcccccaccatcagcggcactgctggcaggggctctgtggtctccaggtctcgccaaacgacgagctgaacgagctcggcgggggggtgccggtagaacagcagggtccatcgcaagagagggcggtggaggcgcaggcaccgctgccgctgttttaggaggttggaaacggcttcggggaatgggacgtgcggaggccatggccgcatatcttgccctagccgcacagtgtcccgggttcggagccgctcgctctctcgtaggcgtgttacaccgctcatgcgcctgggcatgggaacccagaccctgtccttcccctggtcagggaagaaggagtcccagcacggtgagcgctatggccatgtggccgcccgcaagctag

SEQ ID NO: 49556 - DNA, 450 bp, Artificial Sequence
  Description of Artificial Sequence: Synthetic coding sequence
atgcggtacaacgagaaggagctgcaggccctgagccggcagcccgcagagatggccgcggagttaggcatgcggggcccaaagaagggatctgttctgaagagacggctcgtgaagctggttgtgaactttctgttttattttcgcaccgacgaggcagagcctgttggtgctttgctcttggagcgctgtagggttgtgagagaggagcctggtaccttctcaatttcttttatagaggaccccgagaggaagtaccatttcgaatgttccagcgaagagcagtgccaggaatggatggaagccttacgacgggcctcctatgagttcatgaggagaagcctgatattttaccgcaatgagatccgcaaggtgacgggtaaagacccactggaacaattcggtatctcggaagaggcccgattccaactgtctggcctgcaggcctag

SEQ ID NO: 49557 - DNA, 3000 bp, Artificial Sequence
  Description of Artificial Sequence: Synthetic coding sequence
atggagcccggcgaggtgaaggaccggatcctggagaacatcagcctttccgttaaaaaactgcagagctatttcgccgcgtgcgaggacgagatccctgcaattagaaatcatgacaaggtgctgcagcgcttatgtgagcacctcgaccatgcattactgtacggtcttcaggatctgagctccgggtattgggtgttggttgtccatttcacaagaagggaagctatcaagcagatcgaggtgctccagcatgtggccacaaatctcggaagatctcgagcttggctgtacctcgcacttaacgagaacagcctggaaagttatttgaggctgtttcaggagaacttaggcttgttgcacaagtactacgtgaagaatgctttagtgtgtagtcatgatcacctgacactgtttctaactttggtcagcggactagagtttattcgcttcgagctcgacttagatgccccatatctggacctggcaccgtacatgcccgactactataagccacagtatctgcttgatttcgaagaccggctgccctcctcagttcatggctccgactctctgagcttaaacagttttaactccgtgacttccacaaatttggaatgggatgactctgccatcgccccgtctagtgaggatggagacctcactgacactgtcagtggcccccgatccaccgctagcgacttgactagtagcaaagccagcactcgcagccccacccagcgtcagaatccctttaacgaggagcccgccgaaacagtgtctagcagcgacacgacgccagtgcacacgaccagccaggaaaaggaagaggcacaggcacttgatcccccagatgcatgcaccgaattagaagtgatccgggtgacaaaaaagaagaaaatcggaaagaagaaaaaatccagaagcgatgaggaagcctcacctctccaccccgcatgtagtcagaaaaaatgcgctaaacagggagacggggatagtcgcaacggcagcccgtccctggggagagactcaccagacacaatgctcgcctccccacaagaggagggagaaggtccatcatcgacaactgagtcaagcgagcggagcgaacccggattgctgatcccagagatgaaagacacctctatggagcggcttggtcagcccctatccaaggtcatcgatcagttaaatggacagctggacccatccacgtggtgcagtagggccgaacctccagatcagtctttccggacaggtagtcccggagacgcccctgagaggccccccttatgcgactttagtgagggactatcagcccccatggatttctatcggtttacagtggagagcccttccactgtgacatccggcggtggacaccacgaccccgccggcctgggacagccacttcatgtccccagcagccccgaggcagccgggcaggaggaggaaggcgggggcggtgaaggacaaacaccccgtcctctggaggacaccactagagaagcccaggagctggaggcccagcttagcctggtccgcgaaggtcccgtgagcgagcccgagcctggtacacaggaagtgctgtgtcagcttaaacgtgaccagccttctccatgtctgtccagcgctgaagactcgggcgttgacgagggtcaggggagcccgagtgagatggtgcacagtagcgaatttagagtggataacaatcatttactgctgctcatgatacacgttttccgggaaaatgaggaacagctctttaaaatgataaggatgagtactggacacatggaaggaaacctgcagttgctgtatgtactcctcaccgattgttatgtctacctgcttcgtaaaggcgccaccgaaaaaccatatctagttgaagaggcggtgtcgtacaacgagctggactatgtctccgtcggtcttgatcagcagaccgtgaaactggtttgtacaaataggcgcaaacagttcctgctagacactgctgatgtggcactggccgaatttttcctggcaagcctcaaaagcgctatgattaagggatgccgagagccaccgtaccctagtatattgacagacgcgactatggaaaaactggccctagctaagttcgttgcacaggagagcaaatgtgaggcttctgctgtaaccgttcgattttatggattagtgcactgggaagatccaacagacgaaagcctgggtcccacaccatgccactgctcccctcctgaggggaccattacgaaagaagggatgctgcattacaaggcagggacctcgtacctcggtaaggagcactggaagacctgctttgtggtcctatcaaacggcatcctgtaccagtaccctgatagaacagatgtcatccctctgctttccgtaaatatggggggcgaacagtgtggtggttgtcgccgcgcaaataccaccgacagacctcatgcattccaagtgattctgagcgaccgcccttgcctggaactgtccgccgaaagtgaagccgaaatggcagagtggatgcagcatctgtgccaagccgtaagcaaaggagtgatcccccagggtgtcgctccgtccccttgtatcccatgttgcctggtgctgaccgatgaccggctctttacttgccatgaggactgccagacctccttctttaggtccttgggcacagccaagttgggcgacatctctgcagtgagcaccgagccgggaaaggaatattgcgtgttggagttttctcaagatagccagcagctgcttccaccatgggttatctatctctcgtgtaccagcgaactagaccgcctgttatccgcattgaacagtggttggaagacgatttatcaagtcgatctgccgcatacagctattcaggaagcaagcaacaaaaagaaatttgaggatgcattatccctcatccactccgcctggcaacgaagcgattcgctgtgcaggggcagggcctcaagagatccatggtgctag

SEQ ID NO: 49558 - DNA, 2154 bp, Artificial Sequence
  Description of Artificial Sequence: Synthetic coding sequence
atggaggccctggaggtggacgacatcagccccgccctggaggtgacagaagaattctttagcactctagacagtaacttggaaaaggccgtacagcaggccgaggtctatggaatccaggaggtgcccgaattagtcgggcatgaagttctcagtaatataacggataatggggcaatgcgtaatgtaacctccctcggtaaaggcggtatgatttgggaccactgtaagtccagactgctggaaacaaaggcacagaacgtgttccctgccaaggaacagttcatggttcagcgagggacgacccccgacaatctttcatggatggaacagaaagaggcctcaacatttaatttcttcaacatatgccagaggagacgagaccggcctcgcagcgttaatgacctactggacgaaaccagcacgttcaagcctggtcacgcgaggtcccggtctgatataactcaagtagattggcgggtcgttctgaaaaccaccccgctacagcagcagcagcagcaacaacccctcttacagggccctcatgtcactcgccccagttttctactcccctcacctaataaaattgaagatgctcagggcaacactgagcataaacagaccttccccaacatcctgaagaagggctatcttgagataaggaaggatcacgatagctactggcagtcatgctacgccgagctgagtccttacaacctttacttctattccttggatagctccgggaatcagaacctctatgccacctatcagttatcgcactttcagagcataagcgtgctagggaacctcgaagcacgcatggtagacaccgtcctgtacgataacacccaactgcaactgaaagccgaatccccttgggaagctctggattggggacagaaactttgggaagtggtacatgcagccgttcctggctacatgggccgccagaacgagttgactataagcccggggctgggccaccatgacgattacacccagaaccatagcttccagaaaaaaacctccggtctgctgccaccgagtccagtgctggacagcagcaaacagtatcaaaacatcctgaagtccggaactttgtaccggcttacggtccagaacaattggaaagccttcaccttcgtcctttcgagggcttatttgatggcatttcagcccggcaagttagacgaggatccactcttaagctacaatgttgacgtttgcttggcagtccagatggacaatcttgatggctgcgatagctgttttcaggtgatctttccacaggacgttctgagattgcgagcagagacacgccaaagggctcaggaatggatggaggccctcaagatcgctgccaacgtggctcgcagctcagaacagaatctgcaggtgactctgcggaataagccgaaagaccaaatgggtggccatgaactgaggaagaataagcgccaatcagtaaccacttcattcttgtcgatcctgaccacacttagtctcgaacggggcctcaccgcacagtcgtttaagtgcgcaggatgccaacgatcaatcggccttagcaacggtaaagctaaagtgtgtaactacagtggatggtactactgctcttcttgtcacgtggacgactccttccttatccccgcacggattgtgcacaattgggacacctcaaagtacaaagtttctaagcaggcaaaggaatttctcgagtacgtttacgaggagcccctgatcgatattcaacaggagaacgctatgctataccaccatgctgagcccctagcggctgtccttagattgcggcaacgcctgaagtccctgcgggcctacctgttcagctgccgtgctgctgttgcagaggacctcagaagacgaatcttcccacgtgagtacctcctacagcagattcatctctatagcctggccgacctgcagcaggtgatagagggcaagctggccccctttctcggcaaagtaataaagtttgcaacctctcacgtctactcatgctctctgtgttcgcagaaaggctttatttgcgaaatttgcaataatggagagatactgtatccctttgaggacatctccaccagcagattcggagatccttacgcagatctgctccagggatacgtggcctag

SEQ ID NO: 49559 - DNA, 2286 bp, Artificial Sequence
  Description of Artificial Sequence: Synthetic coding sequence
atggaggccctggaggtggacgacatcagccccgccctggaggtgactgaagaattctttagtaccttggactcaaacctggagaaagctgttcagcaagcagaggtgtacgggatccaggaagtacccgaacttgtgggccatgaagtcttgagtaacatcactgacaatggcgcgatgcgtaatgtcacatccttaggaaagggaggtatgatatgggatcactgtaagtcccgtctcctcgagaccaaagctcagaacgtgtttccggccaaggaacagtttatggtgcagagaggcaccacaccagacaacctctcatggatggaacagaaggaagcctcaacttttaatttctttaacatttgccagaggcgccgtgatagaccgcggtcagtcaacgacctcttggacgaaactagtaccttcaaacctggccacgcccgatctaggtctgatatcacccaggtagattggcgggtggtactgaagacaacacctctccagcagcagcagcaacagcagcctctactccagggaccacacgtgacacggccctctttcctgctaccgtctccaaataaaattgaggacgcacagggcaacactgagcacaagcagactttcccaaacattctcaagaagggctacctggaaatccggaaggaccacgacagctattggcaatcctgctatgccgagctgagcccctataatctatacttctattccctcgactccagtggcaaccagaatctgtatgctacctatcagctctcacactttcagtcaatttcagtgctgggaaacctcgaagctcgtatggtagacaccgtcctgtacgataacacccagctccagctgaaggcggaaagcccgtgggaagctctggattggggacaaaaactctgggaggtggtccacgccgcagttcccggttacatgggtcggcagaacgagctcaccattagcccaggcttgggccaccacgacgattacacccagaaccactcattccagaaaaagaccagtggcctgctccctcccagccccgttctcgactcttccaaacagtaccaaaacattctgaagagcggaaccctttacaggctgactgtgcagaataactggaaggcgtttacctttgttttatctagagcttatctaatggcgttccagcctgggaagctggatgaggatcctcttttgagttacaatgtggacgtgtgtctcgccgtgcaaatggataatctggacgggtgcgacagctgtttccaggttatcttcccccaggacgtattgaggctgcgggccgagactcgccaacgggctcaggagtggatggaagcacttaaaattgcagccaacgttgctcgtagctccgaacaaaacttgcaggtcacactgcgaaataaacctaaggaccagatgggtgggcatgagcttaggaaaaacaaacggcagagcgtcacaacaagtttcctctcgatattaactactcttagcttagagcgcggtctaacagctcaaagtttcaagtgtgccggctgccagcgatcaatcggcctgagcaacggcaaggccaaggtgtgtaattactctggatggtactattgttccagttgtcacgttgacgactccttcctcattcctgccaggattgtgcataattgggatacaagcaaatataaagtttctaaacaggctaaggaatttctagagtatgtgtatgaggagcctctaatagacattcaacaggagaacgcaatgctttaccaccacgcggaacctctcgctgcggtgctgcgcttgaggcaaaggctcaagtctttgcgcgcttacctttttagttgtagagctgcagttgccgaggatctaagaagacgcatttttccgcgtgaatacttacttcagcagattcatttatatagtttagctgatctccagcaggtgatcgagggcaagctagccccattcctgggcaaggtgattaagtttgccaccagtcacgtttactcttgtagcctttgctcccagaaggggttcatttgcgaaatctgcaacaatggggagatcctttaccccttcgaagacatctccacaagcaggtgcgaatcatgcggagctgtgtttcactcggagtgcaaggaaaagagtgtgccctgcccccgctgcgtgcggcgcgagctgcagaaaaagcagaaatccttctggcagcggctcaacatggacgagagtctggaagaagcctgcacaatgttcgagctgtcttatcaaaacacctag

SEQ ID NO: 49560 - DNA, 1410 bp, Artificial Sequence
  Description of Artificial Sequence: Synthetic coding sequence
tgaaaccagaacctgtacgccacctaccagctgagccacttccagagtataagtgtgctgggcaacctggaggcgagaatggtggatactgtgttgtatgacaatactcagctgcagctcaaggccgagagcccatgggaagccctggattgggggcaaaaactgtgggaggtcgttcacgcagccgtgcccggttatatgggccgccagaatgaactgacgatttccccgggcttaggtcaccacgacgactatacccagaaccacagctttcaaaagaagaccagcggactgctgcctccctcaccagtcctggactcatcaaagcagtaccaaaatattctgaagtccggcacgctgtaccgtcttacagtgcagaacaattggaaggccttcacatttgtgctcagccgggcataccttatggccttccagccgggaaaacttgacgaagacccgctgctatcatacaatgtcgatgtgtgtctagccgtccagatggataatcttgacggatgcgattcctgtttccaggtaattttcccccaggatgtgcttcgtctgagggccgagacccgccagagggcacaggaatggatggaagcattgaaaattgcggccaatgtagccagatcctctgaacagaacttgcaggtgactctgcgcaataagccaaaggatcagatgggaggccatgagcttcgtaagaacaagaggcagagcgttacaaccagcttcttgtccatactgaccacactttccctcgagcgggggctcaccgcacagtccttcaaatgcgccggctgtcagcgcagcatcggtctgtctaacgggaaggctaaggtgtgcaactattctgggtggtactattgtagtagctgtcacgtggatgacagtttcctcatcccagccaggatcgttcacaactgggacacctctaagtacaaggtcagcaagcaggctaaggagtttctagaatatgtgtatgaggagcccctgattgatatacaacaggaaaacgccatgttataccatcacgccgagcccctcgccgccgttttaagactgaggcagcgcctcaaaagtctgagggcctatctgtttagctgtagggcggcggtggctgaagacttgagaagacgcatcttcccacgggagtatcttctccagcagattcatctgtactcactggcggacttgcagcaagtcatagaaggcaagcttgccccctttctgggcaaggtgatcaagttcgctacatctcacgtgtacagttgtagtctatgcagccagaagggcttcatctgtgagatttgcaacaatggtgagatattgtatccctttgaggatataagtacttcaagatttggggacccatacgccgacttgctgcagggctacgtagcatag

SEQ ID NO: 49561 - DNA, 1731 bp, Artificial Sequence
  Description of Artificial Sequence: Synthetic coding sequence
atgggcaacagccactgcgtgccccaggccccccggcggctgcgggccagtttttctagaaagccaagcctaaagggcaacagggaggattctgcccgcatgtctgcaggcctgcctgggccagaggccgcccgctccggcgacgccgcagctaataagttattccactatattcctggaaccgacatcttagatttagagaatcagagggaaaatctggagcagcccttcttatcagtatttaagaagggacgcaggcgggttccggtgagaaacctcgggaaagtcgttcattacgccaaagtccagttgcgctttcagcacagccaagacgtttcagattgctacctcgagctgtttccagcacatctgtattttcaggctcatgggtctgaagggttaacctttcaaggcctgcttccgttgaccgagctgagcgtttgccccctggaggggtctcgagagcatgcatttcagatcactgggcctctcccggcaccactccttgtgctctgtcctagcagggcagaactcgaccggtggctgtaccacttggagaagcagaccgccctgctgggcggcccaaggagatgccatagtgctccaccccaaggcagttgcggcgacgaactcccatggacactgcagagaaggcttactaggttgaggacagcgtccgggcacgaacccggtggtagcgcagtctgtgcctctagggttaagttgcagcatctcccagctcaggagcagtgggataggttgctggtgttatatccaacaagcctggctatattcagcgaagagcttgacgggctgtgcttcaagggggaactaccacttcgcgccgtgcatataaaccttgaggagaaagaaaagcaaatcagatcattcctgatcgagggacccttgattaatactataagggttgtttgtgcgagctacgaggattatggacattggctgctgtgcctccgcgcagtgacacatcgggaaggtgcacctccactccccggggctgagtcttttcccggcagccaggtaatgggatctggccggggctctctgtcatccgggggtcagaccagctgggatagcggatgtctagcaccaccctccacaagaacaagtcactccctgccagaaagctccgtgccatctactgttggctgctcctcacagcatactcccctccatagactgtccctggagtcatcccctgacgcaccagatcacacctccgagacatcccattctccactgtatgccgatccttatacgcctccggctacgtcacaccggagagtgaccgatgtgagaggtctagaagaatttttgagcgctatgcagtctgcaaggggacctacaccaagcagccctttaccctctgtgccagtctctgttccagctagtgaccctcggtcttgcagtagtggccctgcaggtccctatctcctctctaagaaaggcgcactgcagtcccgcgcagctcagagacatagaggttccgccaaagacggcggccctcagccacctgacgccccccagctggtgtccagcgcccgggaaggctcacctgaaccatggctgccactgactgacggtagatcgcccagacgctcgcgcgacccgggatatgaccacctgtgggatgagaccctgagtagcagccaccagaagtgtccacagctggggggtcccgaggcgagcggcggccttgtgcagtggatttag

SEQ ID NO: 49562 - DNA, 1992 bp, Artificial Sequence
  Description of Artificial Sequence: Synthetic coding sequence
atgggcaacagccactgcgtgccccaggccccccggcggctgcgggcatcgttttctcgcaaaccctcactgaagggcaatagggaagacagcgcccggatgtccgccggcctgccaggcccagaggcagcccgctctggagatgccgcagccaacaagctcttccattatatccccggcactgatattctggatctagaaaaccaacgggaaaatttagagcagcccttcttgtcggtctttaagaagggtagacggcgggtacccgtacgcaatcttggaaaggtggtccactatgcaaaggtacaactgcgctttcaacacagtcaggatgtgagcgactgctatctcgagctgttccctgcccacctttacttccaggcccatggttccgagggcctcaccttccagggtctgctgcccctaaccgagctctcggtgtgtccactcgaaggcagtagagaacatgcctttcaaatcacaggagtgtgggatgcttctagggctcccagaggaacacctgaccctggcctcggagaagggcccgctctgtggctgcgctcaacttgtgtctatgtgtgcgctctgagcgctcttcccgctggaccgctgcccgctccactgctggtcctgtgcccttccagggccgagctggatagatggctctatcatctcgagaagcagacagcgcttctgggcggtccacggaggtgccactcagccccgcctcaaggcagctgtggagacgagctcccttggacccttcagaggcgccttacccgcctgcgcaccgcatctggtcacgagcctggtggcagcgccgtttgtgccagccgcgtgaagcttcagcatctccctgcacaggagcaatgggacagactacttgttctataccctacgagcctggctattttctcagaggagctcgatggactctgctttaagggtgagctgcctttgcgagctgtgcacattaaccttgaggaaaaggaaaagcaaattcggtcattcctgatcgaggggccactgattaatactattagagtggtgtgtgccagttatgaggactacggccattggttgctttgcctcagagcagtgactcacagagaaggggccccgccgctgccaggtgcagagtcattccccgggagtcaggtaatgggaagcggccggggctccctatcctctggtgggcaaacctcttgggactccggctgcctggcacctccaagtacaaggactagtcattccctgccagagagttcggtcccctccacagtggggtgtagtagtcagcatacacctgaccaggccaatagcgatagagcatcaataggacgaaggcggactgaacttagaagatccggctcctctcgaagccccggttcgaaggctagggcagaggggagaggcccagtgacccctcttcatctggaccttacccagcttcaccggctgagccttgaaagctcccccgacgccccagaccacacctcagagaccagccattctcctctttacgccgacccgtacacaccccccgccacctcccacagaagggtgacagatgtgcgcggcctggaggagttcctctctgctatgcaaagcgctagggggcctacacctagcagccctctgccctcagtccccgtgtctgtgccagcttctgaccccagaagctgtagctccggcccagctggcccttaccttcttagtaagaagggggcgctgcagtctagggcagctcagaggcatagaggctctgctaaggacggcgggccacagccccctgatgctccccagttggttagctcagctagggaaggaagtccagaaccatggttgcccctgaccgatggaagaagcccacgacgctctagggatccagggtatgatcacctatgggacgaaacactcagctctagccatcaaaagtgcccccagctgggcggccccgaagcctccggtggactggtccagtggatctag

SEQ ID NO: 49563 - DNA, 1836 bp, Artificial Sequence
  Description of Artificial Sequence: Synthetic coding sequence
atgggcaacagccactgcgtgccccaggccccccggcggctgcgggcatcattttcaagaaagcctagcctcaagggtaatcgcgaggactcagccagaatgtctgctggcctgccgggaccagaggccgcaagatccggggatgcggcagcaaacaagttgtttcactacatcccgggcacagatattcttgatcttgagaatcaacgcgagaatttggaacagcctttcctgagcgtctttaagaaaggtcgtagacgcgttccagtgcgcaatctgggcaaagtagttcactatgcaaaggttcagcttcggttccagcactcccaggacgtcagcgactgctaccttgaactgttccccgctcatctgtactttcaggctcacgggagtgaagggctaaccttccagggtctcttgccgctcactgagttgtctgtgtgccccttggagggtagccgcgaacatgcctttcagatcacgggacctcttccagctccattattggtcctgtgcccgtctagggctgaactcgacaggtggttgtatcatttagaaaaacaaaccgccttactggggggcccaagaagatgccactctgcacctccacagcggaggctaacgcgattgagaacggcgtctggacatgagccgggaggctcagctgtgtgtgccagtcgtgtgaaactgcagcaccttcccgcccaagaacagtgggataggctactggttctgtacccgacctctttggcaatattctctgaggagctggatggcttgtgcttcaagggagaactgccacttagagccgtacacatcaacttagaggaaaaggagaaacagattcgttccttcctcattgagggccctctgattaacacgattagagtagtttgcgcctcatacgaagattacggccattggctgttgtgcctcagggcagtgacgcacagagaaggagcaccgccccttcccggggccgagagctttccaggatcccaggtcatgggctctggccgaggatccctgagctcagggggacagaccagttgggactccggttgtcttgctcctccttccacaagaacctcacattcactcccagagagctctgttcccagcacagttggatgtagttctcaacatacacctgaccaggcgaacagcgatcgagccagtatcggaagacgccggaccgaacttagacgcagtggctcctcccgaagccctgggtctaaggcccgggctgagggccgtgggccggtcacgccactccacctggatcttacccaattacatcgactgtccctggagagtagcccagacgccccagaccacaccagcgagaccagccattcccctctgtacgcagatccctatactccaccagccacatcccacagaagagtcactgacgtgagggggctggaggagtttctttctgctatgcaatccgcccgaggaccaacaccttctagtcccctgcccagcgtccccgtgtctgtgcccgcatcagatccgaggtcttgcagtagcgggccagctggcccatacctcctgagcaaaaagggcgcactgcagagtagggcagctcaacgccaccgtgggagcgcaaaagacggcggacctcaaccgccagatgcgcctcagctggtgtcctccgctcgggaagggtcgccagagccgtggctgccgctcaccgatgggaggtccccacggaggtcaagggaccctgggtatgatcacctgtgggacgaaacactgtcgtcttcacaccagaaatgtccgcagctgggaggccccgaagcaagtggagggctggttcagtggatttag

SEQ ID NO: 49564 - DNA, 1473 bp, Artificial Sequence
  Description of Artificial Sequence: Synthetic coding sequence
atggaggaggagggcgtgaaggaggccggcgagaagccccggggcgctcagatggttgacaaagccgggtggattaaaaaatccagcggcgggttgttagggttttggaaggatcgttatctgctcctctgtcaagcgcagctgcttgtctatgaaaatgaggacgatcaaaaatgtgtggagaccgtagagcttggctcctacgaaaagtgtcaagacctcagggctctactgaaaaggaagcacaggttcatcctcctgcgatcacccggcaataaggtttccgacattaaattccaggcaccaaccggagaagagaaggagtcctggattaaagccctcaatgagggaattaaccgcggtaagaacaaagccttcgatgaagtgaaggtagacaagtcctgcgccctcgaacacgtgacccgtgatcgcgtccgaggcggccagaggcggcgccccccgacacgcgttcacttgaaagaggtggcttcagccgcctcagatggactccttcgactggacctcgatgtgccggacagcggacccccggtgtttgctccctccaaccatgtcagcgaggcccagccacgggagacaccacggccactcatgcctcccactaagccttttcttgcgccagagacgacgagcccaggggacagggtagaaaccccagtaggcgagcgggctcctactcccgtctctgccagttccgaggtctcacccgagtcccaggaagacagtgagaccccagccgaagaggacagcggatcagagcagccacccaacagcgtcctacccgacaaactcaaggttagttgggaaaacccttcaccacaagaagcccccgctgccgagtcagccgagccctcccaggctccctgttcagagactagcgaagcagcccctcgggaaggcggcaaaccccctacaccgccccccaaaatattgagtgaaaagctgaaggcctcgatgggcgagatgcaagccagcgggccacccgcgccaggaaccgtgcaggtgagtgtgaatgggatggatgatagtcctgagccagctaagccttcacaggcagaaggcaccccaggaacaccacctaaggatgccacaacctctacagcccttccaccgtgggatctgccacctcagtttcatccacgctgctctagtctaggggatctgctgggtgaaggaccacgacaccctctgcagcccagagaacgattataccgagcacagttggaagtgaaagtggcgtctgagcaaacagagaagttattgaacaaggtgctgggctctgaacccgcaccggtgtccgctgagacattattatctcaggccgtggaacagttgagacaagcaacccaggtccttcaagagatgcgagatctaggtgaactttcgcaggaggcccctggccttcgggaaaaacgtaaggagcttgttactctgtacagacggtcagcaccctag

SEQ ID NO: 49565 - DNA, 672 bp, Artificial Sequence
  Description of Artificial Sequence: Synthetic coding sequence
atggaggaggagggcgtgaaggaggccggcgagaagccccggggcgcacaaatggtggataaagccggatggataaaaaaatcatccggtgggctgctggggttctggaaggaccggtatcttcttctgtgccaggcacagctgttagtgtatgagaatgaagatgaccagaaatgcgtggaaacggtggaattgggttcatatgaaaaatgtcaggacctccgagcacttctgaagcgcaagcatcggttcatcctgctgcgaagccctgggaacaaagtctcagatatcaagttccaggccccaactggcgaggaaaaggagtcctggattaaggccctaaatgaggggattaacagagggaagaacaaggccttcgatgaggtgaaagtcgacaaaagctgcgcccttgagcacgtcacacgcgacagagtccggggtggccaacgtaggcggcctcccacgagagtgcacttgaaagaagtcgcctctgcagcttccgacgggctgctgcgcctcgacctggacgtacccgattccgggcccccagtgttcgcccccagcaaccacgtgtccgaggcccagccccgagaaaccccaagaccactcatgccccctacgaaacctttccttgctccagaaacgactagtcctagttctcacctgttctag

SEQ ID NO: 49566 - DNA, 1923 bp, Artificial Sequence
  Description of Artificial Sequence: Synthetic coding sequence
atgggcacccggagcagccccgaggagggcacccccccccccctggtacctgagtgcgacgttgaggtccagccacagggtcaccccgaggaaagccgagaacaggaagcttcggaggtcctggccgaaccatcaagcagggggggcgcagagcaacaggccgaagaggaggaggtcggcgaggggtcctccaccgagtcttcccgggatgccccagaggcaacccctcccatcgctatggccgctacaccccctgcctccaccagcagcagggagggtgtgcggggcgcagcccggaggctgcagggacaacaactggaggccctgacacgcgtggccctgatggaacagagagtaaaggagttacaacgccaacgcaaagagttacgaattgaaatggaggtcgaggtcgccttactgagaggcgagctggctggggaacgagtggcagcaagacgcgaggaagagcagcttcgcgagctgctggaacagcaggcagcaagcgagcagcgcggccggcaacagcgggaacaagaacagagaaggctctcacaagagcgtgacagactggaaggtcttcggcagagacttcggaaggcgcaggggcagctggactcgcaacccgaggatcagagagagcgactcctccagggtgtccaagagatgagggaacagctggatgtggctcagcgcgcatatgaagacctggagttccagcagttagagagagagagccgacaagaagaggaggatagagactccccaggcccacaggttcccgacccgaaggtccaagagcttcaggccagtatggctcagcaccggcggggcgcgttgcagcatcgaattagggtgttggaggagcagctcaaatcactgggtgagcagatggccgcagagtcccgaggtctcagccgtaagaaagaggaagcactccaggcacttagccaagaacgctcacggctgctggagctgaattgcctgcagggcactccgggaggagacttttcagagcctaaccctgccctgactaaacttcttttcacacaaaagaccgaccgacagctccttgtgttacaagatgccgtagcccattctgctgccaccccaacaagcagttgcctctttagcgtgcacagctcactccaaggtagcattggattgcagcggacaggtagtctgcctcgcaagagaggagagagaggctcccaaagagggagccccagacctctgtcgttccactgtaccgaaagtttagaggcgagcgccctgcctccagccgttggagatagcggacgttatcccctgtaccagctgcttaattgcggacgtggaaattcatgcggcgccatccaccccgatattgcacacatggagagattgctgcaacaggccatggccgaacgggagaggctcttgaaggctagagagggcacaagacggggcaccgagggaagctcagggcctgccgttcctgctatcaccgctcctcctacccccccccatccacctggccccagaatcctggacctgcgccagcatctggagggatggggtcacaatcctgaaaactgcccacacgtgcaggtgtcaggctgctgctgtcgcggacctttggtgaagatggggggtaggattaagacttggaggaagcggtggttctgttttgatagacaggcaagacggttggcttactatgccgataaggaggaaacaaaactgaagggggtcatctacttccaggccattgaagaagtctattacgaccatctgaggtgtgcgtttaaatctcctaacccgaggttgacgttttgtgtgaagacatacgaaagattgttttacatggttgccccgagcccagaagctatgcgtatctggatggacgtgatcgtcacagccgcagatgagaaccacgccccttag

SEQ ID NO: 49567 - DNA, 528 bp, Artificial Sequence
  Description of Artificial Sequence: Synthetic coding sequence
atggccgaggccagcagcgccaacctgggcagcggctgcgaggagaagaggcatgaaggttcaagcagcgaatcggtacccccaggcaccactattagtcgggtgaaattactggacaccatggtcgatacgtttcttcaaaagctcgtggcagcaggctcctaccaacgtttcacagattgctataaatgtttttaccagttacagcctgctatgacccaacaaatttacgataaatttatcgctcaactgcaaacatccatccgcgaagagatttctgacattaaagaagagggaaacctcgaggcggtgctgaacgcactcgacaaaatagtggaggaaggcaaagtgcggaaggagccagcctggtgtgaggctcagcgctgtagggtacaacagagatgttccctgtgtgtgcaagcagggggccaaaggggcagcgaggaaacccaggcacttcctgtgagtatggcaggatctccttcccccctgccgggctccccaggagcacaagaggggggcgtatag

SEQ ID NO: 49568 - DNA, 663 bp, Artificial Sequence
  Description of Artificial Sequence: Synthetic coding sequence
atggccgaggccagcagcgccaacctgggcagcggctgcgaggagaaaaggcatgagggatcaagctctgagtcagttccaccaggcaccacgatctcccgcgttaaactattagacaccatggttgatacctttttgcagaagctcgtagcagcggggagctatcagcgcttcacggactgttataagtgcttttaccagctgcagcctgcaatgactcaacagatctacgacaagtttatagcacagttgcagaccagtatcagagaagaaatttcagatatcaaggaggagggcaacctggaagctgtgcttaacgcacttgacaagatcgtcgaggaagggaaggtgcgcaaagaaccagcctgcaacggcaccccttgtggcgctatgtgccgcaatagaagacctcgcacaagcagctggcaaatgccctcatggcagggtggaggcaggtggcgatcttgcagttataggtctcgccccagtagccggccaggcagatgcgaagcgcagcggtgtagagttcagcagcggtgttcgctttgcgtccaggcgggcggacagcgcggatccgaggaaacacaggctctgcccgtgtctatggccggaagtccctcgcctctccccggaagtcctggggctcaggagggtggagtgtag

SEQ ID NO: 49569 - DNA, 2010 bp, Artificial Sequence
  Description of Artificial Sequence: Synthetic coding sequence
atggcccaccacctgcccgccgccatggagagccaccaggacttcagatcaatcaaggctaagtttcaggcaagtcagcccgagccctctgacctgcctaaaaagcccccaaaacctgagtttgggaaattgaagaagtttagccagcctgaactctcagagcatccaaagaaagctccccttcccgagtttggggccgtgtccctaaaaccgccaccgcccgaagtcaccgacctgccaaaaaaaccccctcccccggaagtgacggatcttcccaagaagccacctccccctgaggtgactgacctcccaaagaagcccccaccacctgaggtcacagacttaccaaagaagcctagcaaacttgaactaagcgatctctctaaaaaattccctcaactcggcgccaccccattcccgaggaaacccctgcagcctgaggtcggcgaagcaccccttaaagcctccctccccgaaccaggagcaccagcgcgaaagcctttacagccagacgagctgtcccaccccgcacggccaccctctgagccaaagtcgggcgctttcccccggaaattatggcaaccagaggcaggggaggcaacgccaaggagtccacagccagaactgtcgaccttccctaagaagccagcccagccagagttcaatgtatacccaaagaagcctccccagccgcaggtgggagggctccccaaaaagagcgtcccacagcccgaattcagcgaagcagcccagactccactgtggaagcctcagtcaagtgaaccaaaaagagattcaagtgcatttcccaagaaagcttcacagcctccactcagcgactttcccaaaaagccaccccagcctgagctaggagatctgactagaacctcctccgaacctgaggtgtcagtgctgccaaaacgaccgcgccccgccgaattcaaagcgctgtctaagaagcccccccagcccgaacttggcggcctgccacgcacttccagcgaacctgagtttaactccttaccacggaagctgctccaaccggaaaggcgcggccctcctcggaagttcagtcagcctgagccaagcgcagtgcttaaacggcacccccagccagagttttttggagatttacccagaaaacctcccctcccctcgagcgccagtgagagcagcctgcccgccgccgtggccggattctcttcccgtcatcccctgagccccgggtttggtgccgcgggaactccacgttggagaagcggtggcctcgtgcatagcggcggggctcgcccggggctgcgcccatcccacccccctagaagaagaccactccctccagccagttcattgggacatccccccgccaagccgccccttcctcctggaccagtggatatgcaatcatttcggcggccaagcgccgctagtatcgacctgcggcgcacacggtccgcagccggactccatttccaggatcggcagcctgaggacattcctgtgcccgatgagatttacgaactttatgatgacgtggaacctcgtgatgactcgagtccgtctccaaagggtcgtgatgaagcaccttccgttcagcaagcagctaggaggccccctcaagacccagctctccggaaagaaaaggatcctcagccacaacaacttccccctatggaccccaagctgctgaagcagctaaggaaggctgaaaaagccgagagggaatttcgcaaaaaattcaaatttgagggtgaaatcgtggtgcataccaagatgatgatagatccaaacgccaaaacccgcaggggcggcggtaaacatctggggataagacggggcgaaattctggaagtcattgagtttacttccaacgaggaaatgctgtgtagggatccaaagggcaaatacgggtacgtgcctcggaccgccctgctaccactggaaaccgaagtatacgatgacgtagacttttgtgacccacttgagaatcagccgctgccccttggtcggtag

SEQ ID NO: 49570 - DNA, 2013 bp, Artificial Sequence
  Description of Artificial Sequence: Synthetic coding sequence
atggcccaccacctgcccgccgccatggagagccaccaggacttcagatctatcaaggctaagtttcaggcctcccagcctgaaccatctgacttgcccaagaaaccccctaagcccgagtttgggaagttaaaaaagtttagccagcctgaactgtctgaacatccgaaaaaggccccccttcccgaatttggcgctgtgtcattaaagccacctccacccgaagtgacagacctgccaaagaaacccccaccccctgaggtgaccgatcttcccaaaaaaccccccccgccagaggtcaccgacctccccaagaagcccccccctccggaggtcaccgatctgcctaagaagcccagtaaactggagctctcagatttgtctaagaagtttcctcagctcggtgcaacccccttcccgcggaagcccttgcagcccgaggtgggggaggcaccactgaaggctagcctcccagagccaggtgcccccgccaggaaaccccttcagcccgatgaactcagccatcctgccagaccgccttcagagcctaagagcggggccttccccaggaaactgtggcagcctgaggcgggcgaggcgacccccaggagccctcaaccagagctgtccacgttccccaagaaaccagcacagccagagttcaatgtttacccgaaaaagcccccacagccgcaagttggtggactgcccaagaagtctgtgccacagcccgaattttcagaagctgcccagacgcctctctggaaaccgcaaagcagcgagcctaaacgggattcatcggcattcccgaagaaagcttcccagcccccactctccgatttccccaagaaaccaccacaacccgaactgggtgacttgacccgtacgagcagcgagccagaagtttcagtcctgcctaagcggccccgtccagcagaattcaaagcactgagcaagaaaccaccacaaccagaactgggcggcctgccccgcacctccagcgagcctgaattcaactcgcttcctaggaaactgctgcagcccgagagaagaggtccacctagaaagttttcacagcctgagccctccgccgtcctgaagcgccatccacagccagagttttttggagatttgcctaggaaaccaccactaccatcttccgccagcgagagctctctgcctgctgctgtcgctggttttagttcgcggcaccctctgtcccccggctttggggccgccggcacccccagatggcgcagcggggggttggtccactcaggaggagcccggccgggtctgcggccttcacacccaccccgacgtagaccgctccctcctgctagctctctcggacacccgccagcaaagcctccattgccgccagggcccgttgatatgcaatccttcaggcgcccctcagcagcgtcaattgatcttaggaggacaaggagtgccgccggactacacttccaagacagacaaccggaggacatcccccaggtgccagacgagatctatgagttgtacgacgacgtcgagccaagggatgacagttcacctagccccaaagggagggacgaggctccttctgtgcagcaggccgcacgcaggccaccccaggacccagccctcagaaaagaaaaagacccacagccacagcagctgcccccgatggatcccaaattgctgaaacaattgaggaaggcggagaaggcggagcgagaatttaggaagaagttcaagttcgagggtgagatcgtggttcacacgaaaatgatgattgaccccaacgctaaaacaagaagaggcggcggcaagcatctcggcattagaaggggagagattctggaagtgatcgaatttacatcaaacgaggagatgctctgccgggatccaaaaggcaagtatggctacgtgccaaggaccgccctccttcctcttgaaaccgaagtttacgatgatgtagacttttgcgatcctttggagaatcaacctctaccactcggtcggtag

SEQ ID NO: 49571 - DNA, 72 bp, Artificial Sequence
  Description of Artificial Sequence: Synthetic coding sequence
aagttcagccagcccgaggtggccgagggcatgagccggcagaaccttggcttgaagctgcggggcaggtag

SEQ ID NO: 49572 - DNA, 1320 bp, Artificial Sequence
  Description of Artificial Sequence: Synthetic coding sequence
atgagcaagaccatggccatgaacctgctggaggactggtgccggggcatggaggtcgatatccatcgatcactgctcgtgaccggcataccagaagactgtggccaagccgagatcgaggagactctgaacggagtgctctcaccgctaggcccatacagggtgctcaacaagatattcgtgagagaagagaatgtgaaagcggcgctgatcgaggtgggggagggtgtcaatctctctaccatcccaagggagttccccggaaggggcggcgtgtggcgggtggtatgcagagaccccactcaagatgcggagtttctgaaaaacctgaatgaatttctcgacgctgagggaagaacatgggaagatgtcgtccgactcctccagcttaaccaccctacattaagccagaatcaacatcagccccctgagaattgggctgaagctttaggggtgctactaggagcagtagtccagatcattttctgcatggacgccgagattcgttcacgggaagaggcgcgggcgcaggaagccgccgaatttgaagaaatggccgcctgggcactggcagctgggaggaaagtcaagaaagaacctggactggccgctgaagtcggctctgcactgaaagctgagacaccaaacaactggaatgcaaccgaggaccagcacgagcctacgaagcccctggtgcgccgagcgggggccaaaagccggagcagacgcaaaaagcagaagaagaatagccggcaggaggccgtgccgtggaaaaagccaaagggaatcaatagcaattccaccgctaatcttgaagatcccgaggtgggcgacgctgagagcatggcaatttcagaaccaattaaaggcagtagaaagccatgcgtgaataaagaggagctggccttaaagaaaccaatggcgaagtgcgcctggaaaggccctcgggaaccacctcaggatgcccgtgcagaggctgaatctcccggtggcgcaagtgagagcgaccaagacggcggccacgagtcaccaccaaagaaaaaggcagtggcatgggtctcagctaagaatcctgcacctatgcgtaaaaaaaaaaaagtcagcctaggccctgtgtcctacgtgttagtcgactctgaggatggcaggaaaaagcctgtgatgccgaaaaagggtcccggatctcgccgggaagcaagtgatcagaaggctccccggggacagcagcctgccgaggcgacagcctcgacctcaagagggcctaaagccaaacccgagggcagcccaaggcgggcgacgaacgagagtcgcaaggtatag

SEQ ID NO: 49573 - DNA, 615 bp, Artificial Sequence
  Description of Artificial Sequence: Synthetic coding sequence
atgagcaagaccatggccatgaacctgctggaggactggtgccgggggatggaggtggacatccatcgatccttactagtgaccggcattcccgaggattgtggacaggccgaaattgaggagaccctgaacggggtgctgtcaccgctcggaccataccgcgtgcttaacaaaatctttgtgcgcgaggagaacgtcaaagcagccctcatcgaagttggtgaaggggtgaacctctctacgatccccagggagttccccggacgcggcggagtgtggagggttgtctgccgtgaccctacacaggatgccgaattcttgaaaaacctgaatgaattcctagacgctgagggccggacatgggaagacgtggtgagactcctacagctaaaccatccaacgttgtctcagaatcagcaccaacctcccgagaattgggctgaggcgctcggcgtgttactaggcgcagtggtccaaatcatcttctgcatggatgcagagatcagatcacgcagagaggaaggggaggaaagaaccggggcctgctcccgaggggggttttgtctgaaagggcgcgaccctcaacagttggagtgtcacggcaggccagcgtag

SEQ ID NO: 49574 - DNA, 1137 bp, Artificial Sequence
  Description of Artificial Sequence: Synthetic coding sequence
atgagcaagaccatggccatgaacctgctggaggactggtgccggggaatggaggtggacatccatagatctctcctagtgacagggatcccagaggactgtggtcaagcagaaatagaagagacgttgaatggcgtgttgtcccctctgggcccctatagggtccttaacaaaatcttcgtgcgggaggaaaacgtaaaagccgcacttatcgaagtgggcgagggtgtgaatctttctacgattccccgcgagttccctggacggggaggggtgtggcgagtagtctgcagagaccccacccaggacgcagagttcttgaagaatctcaacgagtttctggacgccgaaggccgcacttgggaagatgtagtgcgactgttgcagctgaatcatcctacgctctcccagaatcaacaccagccaccggaaaactgggctgaggcacttggggtcctccttggggcagtggtgcaaattattttttgtatggacgccgaaatcaggagccgggaggaagcccgtgctcaggaggccgctgaatttgaagaaatggcagcatgggctctggcagcgggccggaaagtcaagaaagaacctggcctcgcagccgaagtgggatccgctctgaaagccgaaacacccaacaattggaatgcaacagaagaccagcacgagccaactaagcccttagtgagaagggccggggctaagtctaggtcccgcagaaagaagcaaaagaaaaacagccggcaagaagccgtgccatggaaaaagccaaagggaatcaatagcaactcaacagccaatttggaggaccccgaggttggcgacgccgagtctatggcgataagcgaaccaattaaaggatcccgcaagccttgtgtgaacaaggaagaactcgctctgaagaaaccaatggccaagtgtgcatggaagggtccacgggaacctccacaggatgcccgggctgaggccgaatcgccgggcggggcctctgagtccgatcaggatgggggccacgagagtccgcccaaaaaaaaagcagtagcctgggtgtctgctaaaaatccggcccccatgaggaagaaaaagaagaatcccgaaagattcgacttgggcgatcatccgtactag

SEQ ID NO: 49575 - DNA, 840 bp, Artificial Sequence
  Description of Artificial Sequence: Synthetic coding sequence
atggccatgagcctgctgcaggactggtgccggagcctggacgtggatgcccatcgtgccttgctcgtcacggggataccagagggactggaacaggccgatgttgaggccgtcctgcagccaacacttctccctctgggaacctttcggctcagacatatgaaggccctcatgaatgagaaagcccaggccgcgctggtggaatttgtggaagacgtcaatcacgcagctataccaagagagatccccggaaaagacggggtttggcgcgtgctgtggaaggaccgcgcccaggacacccgggtgctacggcaaatgaggcggcttctcctggatgacgggccaacacaggcagcggaggctggcactcctggggaagctccaaccccacctgcaagtgagactcaggcacaggattccggcgaagttactgggcaggcagggtctctgctgggagcggccaggaacccaaggcggggccggcgcggtcgcaggaatagaacccgtcgcaaccgactgacccagaagggtaagaaaagaagcagaggtggcagacctagcgccccggctagatcagaagctgaggattccagtgatgaatctctgggaattgtcatagaggagattgatcagggcgatttgtccggagaggaggaccagtccgccctttacgctaccctccaagctgccgcgagggagctagtgcgtcagtgggcgccttgcaattcagaaggcgggccctgccctacctgcccttgggaaggcattggaggattcggctgcgatctcaccgtgcaaacgcgtctttcccagtcatatgtccgggatacgcaaatgtag

SEQ ID NO: 49576 - DNA, 1221 bp, Artificial Sequence
  Description of Artificial Sequence: Synthetic coding sequence
atggcctggtgcgtggccaccgccgaccccgcccacaccagccggcctctgtttaccggcttggccgtaagccgcggatccgcaggacacgcctggtcagccggttttgactgggcggctgtggttgtggtgaccggcagaagatgtcggagtggccagaccgtgcccggggcagcccgctctccccttctgcctcatccattgccctcaccactacgtgtgcccccccctactggagctctcgggagacccttacctaggtggcctcagccaagacggactccgttctggtccgtgatctcgaaggctactaagttgcgcagcccaccctggacctctgcgccaacagcaagtaatttagagcgtgaccgacggatatccagaatcgatcccataagatcccccacaatggctggtgggctatttgctgtttccaagaagtatttccagtaccttgggacttacgacacgggtatggaggtctggggcggggagaatttagaactttcttttcgagtctggcagtgcgggggcaaactcgagatccatccctgcagtcacgttgggcatgtgtttcctaagcgagctccttacgcgcggcctaattttctgcagaacaccgcccgtgctgctgaagtgtggatggatgagtacaaagaacatttctataacaggaacccccccgcccgtaaggaggcctatggagacattagcgaacggaagctgctcagggagagactgagatgtaaaagcttcgactggtatctgaagaatgtgtttcctaatcttcatgtaccagaggaccgcccgggttggcatggcgctataagatcccgcggaattagctccgagtgtctcgactataacagtcccgacaacaaccccaccggtgctaatctgagcctgtttgggtgccacggccaaggtggcaatcaattttttgaatatacaagcaataaggaaatcaggttcaatagcgtgaccgagctttgcgctgaagtcccagagcagaaaaattatgtgggcatgcaaaactgcccgaaggacggttttcccgtccccgcaaacatcatttggcacttcaaggaagacgggaccattttccacccacactcaggtctgtgcctgtcagcctatcgcacccccgaggggcgacccgacgtccaaatgcgcacctgcgatgccctggacaagaatcagatctggtcattcgagaagtag

SEQ ID NO: 49577 - DNA, 1728 bp, Artificial Sequence
  Description of Artificial Sequence: Synthetic coding sequence
atggccagcgccaccgaggaccccgtgctggagcggtacttcaaggggcataaggcagccataacctctctggatctgagcccaaacggcaagcagctgggtgctggacgggctcgggaactgggttcacggagactgagtgatttgcagaaaaacactgaagatctgtcccggcccttgtacaagaaacctcccgccgattctcgggcactgggcgagtggggcaaggcatcaaaactacagctcaacgaggacgagcttaagcagcaagaggaactgattgaacggtatgctatcaatatctacttatctgaccggatttcactgcatcggcacatcgaagataaacgcatgtatgaatgcaagtctcaaaagttcaattatagaacactgccaactaccagtgtgattatcgccttctacaacgaggcatggagtactttactgcgaaccatccacagcgtgcttgagaccagccccgccgtgctgttgaaagagataatcctggtggacgatctgtcagatcgagtttacctgaaaacacagcttgaaacctatatcagcaatctggatagagtgcgattaattaggacaaacaaacgggaggggctagttcgtgctagactgattggcgctaccttcgctacaggtgacgtcctgactttcctggattgtcattgcgaatgcaattccgggtggctcgagcccctcctcgaacggatcggacgcgacgaaaccgcagtggtctgtcccgtcatagacacaatagactggaatacttttgaattttatatgcagatcggagaacccatgataggcggttttgattggagactcaccttccagtggcactctgtgcccaaacaggaacgggatagacgaatttctcgtatcgacccaattaggagccccaccatggcgggcggactgttcgccgtatcgaagaaatattttcagtatctcggcacttatgacaccgggatggaagtgtgggggggagagaaccttgaactgtccttccgggtttggcagtgcggaggcaagctcgagattcacccttgctctcatgtggggcatgtcttcccgaagagagcaccctatgcaaggccaaacttcctccagaatactgccagggctgctgaagtgtggatggacgaatataaagaacacttttacaaccgcaatccacctgccagaaaagaggcgtatggagacatctccgaacggaaactactgagggagcgcctgcgttgtaagagcttcgattggtatctgaagaacgtatttcctaacctacacgtgcctgaggatcggcctgggtggcatggcgctatcaggtccagagggatctcttccgaatgtctggactataattctcctgataataatccaaccggcgccaatttatcactctttggatgtcatggtcagggtggcaaccagttttttgaatatactagcaataaggagatcaggttcaactccgtcactgaactttgtgctgaagtgcccgagcagaaaaattacgttggcatgcagaattgccctaaagacgggtttcctgtacccgctaacatcatatggcacttcaaagaagatgggactatcttccacccacattctggcttatgtttgtccgcttatcgtaccccagagggacggcctgacgtgcagatgcgcacatgtgacgctctcgacaagaaccaaatctggtcctttgaaaaatag

SEQ ID NO: 49578 - DNA, 1476 bp, Artificial Sequence
  Description of Artificial Sequence: Synthetic coding sequence
atggagaacgaggagagcgacgtgaagccccccgactggcccaacccgatgaatgctacaagccagtttccgcagccccagcattttgattcgttcggcctgcggctgccacgcgacatcaccgagcttcccgaatggtcggaggggtaccccttttatatggcaatgggcttccctggctatgacctctctgccgacgatatcgccgggaaattccagtttagcaggggaatgcggagatcctacgatgcgggatttaaactgatggtggttgagtacgctgaaagcactaataattgccaggcagccaagcagttcggcgtcctggaaaaaaacgtcagggattggcgcaaggtgaagccacagctccagaacgcccacgcaatgagacgagcttttagaggtccaaagaacggacgatttgctctggtggatcaacgcgtggcagaatacgtgaggtacatgcaggccaagggagatcccatcactcgcgaagcaatgcagctgaaggcactggaaatcgcccaggagatgaatattcccgagaaaggcttcaaagcgagtctgggttggtgtcggcgcatgatgagacgttacgatttgagcctcaggcacaaagtcccagttccgcagcaccttccagaggaccttaccgaaaagcttgtgacgtatcaacggagcgtgttagcactgagacgggcccacgactacgaagtcgctcaaatggggaacgctgacgagactcctatctgcctggaagtgccctcccgtgtcacggtggacaatcaaggtgagaaacctgtgttggtcaagacacctggccgggagaagctcaagatcactgctatgcttggtgtgctggctgatggaaggaagttacctccttatatcattctccgtggcacttacatcccaccaggtaaattcccctcgggcatggagatccgctgccaccggtacggatggatgactgaagacctcatgcaggattggcttgaagtagtctggaggagacggacaggggctgtccccaaacagcgcgggatgttgatcctgaacggattcagagggcacgccaccgacagcgtcaagaactccatggaatctatgaatactgatatggtaatcatccccgggggacttacatcacagctccaggttttggacgttgtcgtgtacaagcccttaaacgactccgtcagggcacagtattcaaactggctgctcgcaggcaatctggccctgtcccctaccggtaacgccaaaaagccgccgctcggtctcttcctggaatgggtgatggtagcatggaactctatctcttcggagagcatcgtgcaagggttcaagaagtgccatatcagttccaacttggaggaggaggacgatgtcctgtgggaaatcgagagcgagcttcctggcgggggtgaaccgccgaaagactgtgacacggagtcgatggccgaatcgaattag

SEQ ID NO: 49579 - DNA, 1011 bp, Artificial Sequence
  Description of Artificial Sequence: Synthetic coding sequence
atgtacaccgtgctgaccggcaccccccccttcatggccagccccctatccgagatgtaccagaacattagggagggtcattacccagaacctgctcatctatcagccaacgctcggcgccttatcgtgcacctgctggcaccgaaccccgccgaaagaccgtccctagaccacttactccaagacgacttcttcacccaagggtttaccccagatcggctcccagcccacagttgccattccccgcccatcttcgccattccacctccactcggtcgtatttttaggaaggtgggccagagactgcttacgcagtgtcggcccccttgcccattcacccctaaagaagcttccggaccgggtgaaggaggcccagatccagactccatggaatgggacggtgaatctagcctaagtgcgaaggaagtaccttgtctggaaggtcctatacatctcgtcgcacagggcactcttcaatccgatctcgccggaccagagggcagtagaaggccagaggtggaggccgcactgcgtcatctccagctctgtctggatgtaggccccccggcaacacaggatcctctgggcgaacagcaacctatcctttgggcccccaagtgggtggactatagctccaaatacggcttcggctaccagttattagatggcgggaggacagggcggcatccccacgggcctgcgaccccgagacgtgaaggtactctgccaacccccgtccctcctgccggccctggtttgtgcttactccgtttcttggcttcagaacacgctttactcctgttattctcaaatggcatggtgcaggtctccttctccggggtgcctgctcagcttgtgctctccggcgagggagaaggactacagctgactctctgggaacagggtagtccaggaacctcctacagccttgacgtgccccgctctcacggctgcgccccaaccactggacagcatctccatcacgctctgcggatgttgcaatctatttag

SEQ ID NO: 49580 - DNA, 1893 bp, Artificial Sequence
  Description of Artificial Sequence: Synthetic coding sequence
atggacatcaagggccagttctggaacgacgacgacagcgagggcgataatgaaagtgaagaattcttgtacggcgtgcagggaagctgtgctgccgatctatatagacaccctcaattggacgccgacatcgaggcagtaaaggaaatatattccgaaaattccgtctccattagagagtatggcacaatcgatgatgttgatatagatctccacataaatatctcctttctggacgaggaagtgtcgacagcgtggaaggtgctcagaacagaaccaattgtgctgcgactcaggttttccctgtcacagtatttagatggacctgagcctagtatagaggtctttcaaccgagcaataaggagggatttggactgggtctccagcttaagaagattttaggcatgttcacgagccagcaatggaagcacctctctaacgattttctgaagacacagcaagagaaacggcactcatggttcaaggcctccgggacaatcaagaaatttcgcgccggactgagtatcttcagccctatccccaagtcaccatcgtttcccatcattcaggactcaatgttgaaaggaaaactgggagtccccgaactgagggtaggaaggcttatgaataggtccatcagctgtacaatgaaaaaccctaaggtggaggtatttggataccctcccagtccacaggctgggctgttgtgcccgcagcatgttgggctgcctccacctgcccggacttctcctttggtgtcgggacactgtaagaacatacccacattagaatatggcttcctggtacagataatgaagtatgctgagcagagaataccgactctgaatgagtattgcgttgtttgcgacgaacaacacgtcttccagaatggttccatgttgaaacctgccgtgtgcacgagggagctgtgcgtattcagcttctacacactgggcgtgatgtcaggcgcagcagaggaggtggccaccggtgcggaagtagttgatttgctcgtagcgatgtgtcgagccgccttggaaagcccccgaaaatccatcatctttgagccctatccatccgtggtcgatcccacagaccccaagacactggccttcaacccaaaaaaaaagaactacgagcgactgcagaaagctctggactccgtgatgagcatccgggagatgactcaaggatcctacttggaaattaagaaacaaatggataagctggatcccctggcccacccactgctgcagtggattataagtagcaataggtctcacattgttaaactgccattgagccgacttaaattcatgcatacctcacaccagttccttttgctttcgtcacccccagccaaagaggcccgctttcgcacagccaaaaaattgtatggctcgacttttgcctttcatggctcccacatagaaaattggcactcaattctcagaaatggacttgtgaatgcgtcatacactaaacttcaactgcatggtgccgcctacggaaaagggatatatctcagtcccatctcaagtatatccttcggctattcaggaatgggtaaaggacagcatcggatgcctagcaaggacgagctggtccagcggtacaacagaatgaatacaattcctcaaacacggtccattcagtccaggtttctccaatccagaaaccttaattgcatcgccctgtgcgaggtgattacatccaaggatctgcagaagcacggaaatatctgggtgtgtcccgtctccgaccacgtgtgtacccgattcttcttcgtgtacgaggatggccaggtcggcgatgctaatatcaatacacaggacccaaaaatccagaaggagatcatgcgtgttattgggacacaggtgtacactaattag

SEQ ID NO: 49581 - DNA, 405 bp, Artificial Sequence
  Description of Artificial Sequence: Synthetic coding sequence
atgctgctggtgctgctgagcgtggtgctgctggccctgagcagcgcccaaagtaccgacaatgatgttaattacgaagattttaccttcaccatccctgacgttgaggacagctctcagcggcctgaccagggtcctcagcggcctccaccagaaggactcctaccacggcctcctggtgactctggaaaccaggatgatgggccccagcaaaggccccccaaacccgggggccatcatcggcatccaccccctccaccctttcaaaatcagcagagaccccccaggaggggacaccgacagctctcacttccaaggttccctagtgtcagcctgcaagaggcatcctcgttcttccagcgcgaccggcctgcgcgccacccacaggagcagcccttgtggtag

SEQ ID NO: 49582 - DNA, 699 bp, Artificial Sequence
  Description of Artificial Sequence: Synthetic coding sequence
atgttccacaaggccgaggagctgttcagcaagaccaccaacaacgaagtcgacgacatggacacgagcgacacccagtggggttggttttacctggccgagtgtgggaaatggcatatgtttcaacctgacacaaacagccagtgtagcgtgagtagcgaggatatcgagaaatcattcaaaaccaatccatgcggctctatctcattcacaacttcaaagttctcctacaagatcgattttgccgaaatgaagcagatgaacctaactacaggaaagcagcgccttatcaaaagagcccccttcagcattagcgccttttcttatatctgcgaaaatgaggcgattcccatgccccctcactgggagaacgtgaacacccaggtaccttaccagctgattccccttcataaccaaacccacgagtacaacgaggtcgccaatctgttcggtaaaaccatggataggaaccgcatcaaaaggattcagcgaatacagaacctggatttgtgggaatttttctgtcggaaaaaggcacaacttaaaaaaaaacggggggtgccacagattaacgagcagatgttgtttcacggtacctcttccgaatttgtggaggccatttgtattcataacttcgattggcggatcaacggtattcacggcgcagtttttggcaaggacaacatgtggaagctttag

SEQ ID NO: 49583 - DNA, 774 bp, Artificial Sequence
  Description of Artificial Sequence: Synthetic coding sequence
atgtgggaggtggcccacgtgagcgagatgaagcagatgaacctgactaccggaaagcagcggctgattaaaagggctccctttagtatctcagccttttcttacatatgtgagaacgaggcaatacccatgccccctcactgggaaaacgtcaacacccaggttccatatcagctgatacctctccacaaccaaacccatgagtacaacgaggtggcaaatctgttcggaaagaccatggaccgcaacaggattaaaagaatccaaagaattcaaaatctggacctgtgggaatttttttgtcggaagaaagcccaattaaagaagaaacgtggggtcccccagattaacgagcagatgctgttccatggcactagttctgagttcgtcgaggccatctgcattcacaattttgactggcgcattaacggcatacatggggccgtcttcggcaaggggacgtacttcgctagggatgcagcatatagttcgaggttttgtaaagacgatattaagcatggaaacacttttcagattcacggagtgtctcttcagcagagacacctctttcgcacctacaagtccatgttcctggcccgagtgctcattggagactacattaatggtgattctaagtacatgcgacccccttcaaaagacggctcatacgtcaacctttacgatagttgcgtcgacgacacatggaaccctaaaatttttgtggtgtttgatgccaaccaaatatatccagagtaccttatcgattttcactag

SEQ ID NO: 49584 - DNA, 774 bp, Artificial Sequence
  Description of Artificial Sequence: Synthetic coding sequence
atgtgggaggtggcccacgtgagcgagatgaagcagatgaacctgactacgggcaaacaaaggttgatcaagcgcgcccccttctcaatctccgctttcagttacatttgcgagaacgaagccattcctatgcctccacattgggaaaatgtgaatactcaggtgccataccagttgatacccctccataatcagactcacgagtacaatgaagttgctaatctgttcggtaaaactatggaccgcaataggatcaagaggatccagcggatccaaaacctggatctatgggagttcttttgtcgcaaaaaagcccagctgaagaagaaaagaggcgtgccccagatcaacgagcagatgctgtttcatggaaccagtagcgagtttgtcgaggccatttgtattcataatttcgactggcgcatcaatggcattcacggagctgtgttcggaaaggggacatacttcgcccgagacgctgcctatagttctcggttctgcaaggacgatattaagcacgggaacaccttccagatccatggcgtgtcgctacaacagagacatctgtttcgcacctacaagtccatgtttctggctagggtgctcatcggggattacattaatggggattccaaatatatgagacctccttccaaggacggatcttatgtgaatctctatgacagttgcgtggacgacacatggaacccaaagatttttgtggttttcgatgccaatcagatttatccagaatacctaatagacttccactag

SEQ ID NO: 49585 - DNA, 141 bp, Artificial Sequence
  Description of Artificial Sequence: Synthetic coding sequence
atgaagtggatgacctggacccggcagatccccagcggcgccggcttcacatggcaaaatgtgggctcaggtacttgtttttcaagaatcccgaccgtaagtgtgcagttagcagtcaagatatccaaaaaggccagctag

SEQ ID NO: 49586 - DNA, 1557 bp, Artificial Sequence
  Description of Artificial Sequence: Synthetic coding sequence
atggacatcaagggccagttctggaacgacgacgacagcgagggcgataatgaaagtgaagaatttctctacggggtgcagggcagttgtgccgccgatctgtataggcaccctcaactggacgccgatatagaggcagtgaaggagatctattcggagaatagcgttagtatacgcgaatacggcactatcgatgacgtggacatcgacctgcacatcaatatcagcttccttgatgaggaggtcagcactgcgtggaaggtactccgcactgaacctatcgtcttaagactccggtttagcttatcacaataccttgatggaccggaaccttctattgaggtgtttcaacccagtaacaaggaggggttcggactggggttacagctgaaaaaaatcttggggatgtttacaagccagcaatggaaacacctgtctaatgactttctcaaaacccagcaagagaaacgtcattcatggtttaaggccagcggtaccattaaaaaatttcgcgccggccttagcatctttagtcctattcctaaaagcccatcattccccattattcaggactctatgctgaagggcaagctaggcgtgcccgagttgcgggtaggcaggcttatgaataggtctatcagctgtaccatgaaaaaccctaaggtggaggttttcggctatccccctagtccgcaggctggcttgttatgcccacagcatgtgggcctgcccccacctgctcggacgagccctttggtctccggtcactgcaaaaacataccaactttggaatacgggttcttagtccagatcatgaaatacgccgaacagcggatccctacattgaatgagtactgcgtggtttgtgatgaacaacatgtgttccagaacgggagtatgctgaagcctgctgtatgcacgcgcgaactgtgcgtgttcagtttctacacattgggcgtaatgtctggcgccgccgaggaggtggcaacaggagctgaagttgtggacttactcgtggctatgtgccgcgctgcactagagtcacctagaaagtccatcatcttcgagccttatccgagcgtggtggacccaacagaccccaaaacgctcgcattcaatcccaagaaaaagaactacgaaagattacagaaggctctggacagcgtcatgtccatccgggagatgacacaaggatcctacttggagattaagaagcagatggataagctggacccactggcccaccccctcctccagtggataatatcctcaaacagaagccatattgtgaaactcccacttagcaggcttaaattcatgcataccagtcatcaattcctgctcctgtcttccccaccggctaaggaggcccggttcagaacagccaagaagctgtacggcagtacgttcgccttccacggttcacacatcgaaaactggcatagcattcttagaaatggtctggttaatgccagctacaccaaactccaggagtgggagaaagactctaccggctgccctcccaggatgtcctggtcacgcgacaccacaggctag

SEQ ID NO: 49587 - DNA, 1893 bp, Artificial Sequence
  Description of Artificial Sequence: Synthetic coding sequence
atggacatcaagggccagttctggaacgacgacgacagcgagggcgataacgagtcggaagaatttctctacggcgtacagggctcatgcgctgcagatctctaccgtcacccacagctggacgccgacatagaagcagtgaaggaaatttattccgagaactcggtcagtatccgggagtatggtactattgatgatgtggacattgatctgcacataaatatatcattcctggacgaagaggtctccacagcatggaaggttttgcgcacagaacccatcgtgctgcgtttaaggttttctctgtcccagtacctggatggacctgaaccctccatcgaagtctttcaaccttccaacaaggaggggttcggactgggactccagctaaaaaagatcttggggatgtttacttcacagcagtggaaacatctcagcaacgatttcctgaagacacaacaagagaaacgccatagttggtttaaggccagtggcacaatcaagaagttcagagcaggcttgtccatcttttctcccatcccgaaatcaccctctttccctatcattcaggattccatgttaaaaggtaaactgggcgtccccgagttgcgggtgggccgcctgatgaacaggtctataagttgcaccatgaagaatcccaaggtagaagtctttggctatcctccttcaccgcaggccggcctgctgtgcccccaacacgtggggcttcctccgcccgctaggaccagccctctcgtatctggccactgcaaaaacatccccacactggagtacggattcctggtccaaattatgaagtatgctgagcaacggatcccaacattgaatgagtattgcgtggtgtgtgacgagcagcatgtgttccagaatggatcgatgctgaaacctgccgtgtgtaccagggaactatgcgtgtttagcttttataccctgggagtaatgtctggcgccgcagaagaagttgcgaccggagctgaagttgtggaccttctggtggctatgtgtcgtgccgctctcgagtcccccagaaagagcattatcttcgaaccatatccttccgtagtggatcccaccgatcccaaaacgctcgcttttaatccaaaaaaaaaaaactacgaaaggctgcaaaaagccctggattctgtgatgtccattcgcgagatgacacaggggagctacttggagattaaaaagcagatggacaagttagatcctctggcccatcccttgctgcaatggattatctcatccaaccgttcacatattgtgaagttgccactgagccgactcaaattcatgcacacatctcatcaatttttactcctgtcttctccccccgcaaaggaggccaggtttcgcacagcgaaaaaactgtacggttctacttttgcttttcacggctcacacatcgagaactggcattctattctgcggaacgggttggtcaacgcatcatacactaagttgcagctccacggggccgcgtatggcaaaggcatctatctgagtcctatttcctctataagctttggctacagtggcatgggcaaaggccaacatcgaatgccttccaaagatgagctggtgcagaggtacaatcgcatgaatacaatccctcaaacccggtcaattcagagtcgcttcctacaatcccgcaatctgaattgtattgccttgtgcgaggtgatcacctcaaaggatctgcagaaacatgggaacatatgggtttgcccagtcagtgaccatgtgtgcaccaggtttttcttcgtttacgaggatggccaggtgggagatgccaatatcaacacacaggacccgaagattcagaaggagataatgcgggtgatcggaacccaggtctatactaattag

SEQ ID NO: 49588 - DNA, 1167 bp, Artificial Sequence
  Description of Artificial Sequence: Synthetic coding sequence
atggacatcaagggccagttctggaacgacgacgacagcgagggcgacaacgagtcagaagaatttctgtatggtgtgcagggatcctgcgcagcagacttgtatcggcatccgcaactggatgcagacatcgaggctgtcaaggagatatactcagagaattcagtcagtatacgggagtatgggaccatcgacgacgtggatatcgatctgcacataaacatttcattcctcgacgaagaagtgtccacagcctggaaggtactgagaacagagcctattgtgctcaggctacggttttctctctctcagtacctcgacgggcctgaaccgtccattgaggtgtttcaaccttcaaacaaagaaggatttggcttgggcctacaattaaagaagatactgggcatgtttacgagtcagcagtggaaacatctgtcaaacgacttcctgaaaacacagcaggaaaagaggcatagttggttcaaggcctcggggacaatcaaaaaattccgtgccggactatcaatttttagtccaatccctaaatcaccatcattccctatcatacaggactcaatgctgaaagggaagttgggtgtgcccgaactccgagtggggcgtctcatgaaccgatctatttcctgcacaatgaagaatccaaaagtggaagtgtttggctatccacctagccctcaggccgggcttttatgtccccagcacgtgggccttcctccaccagctcggacatcacctctggtatccggacactgtaagaatatccctaccctggagtacggatttctggtacagattatgaagtacgcggaacagaggattccaaccctaaacgagtattgcgtggtctgcgatgaacagcatgtgttccagaatggctcaatgttgaagccagccgtctgcaccagggagctttgtgtgttctcattttatacactcggcgtgatgagcggggccgccgaagaggtggccacaggcgcggaggttgtggaccttttggtcgccatgtgcagagcagcactggagagccccagaaaatccatcatcttcgaaccttatccctctgtggtggatcccactgaccctaaaacagttgccttcatggtggagcttgatcccaggactacaccacactctgacggacccgactag

SEQ ID NO: 49589 - DNA, 858 bp, Artificial Sequence
  Description of Artificial Sequence: Synthetic coding sequence
atgttcaccagccagcagtggaagcacctgagcaacgacttcctgaagactcagcaagaaaagaggcattcttggtttaaagcctccggcactataaagaaattcagagcgggactcagtatctttagcccaatacccaagtcaccctccttccctatcattcaggattcaatgctaaaaggcaaactcggagttccagaattacgagttggccgccttatgaaccgaagtatctcatgtactatgaagaatcccaaagtagaggtgtttgggtacccccccagtccccaagtttccggccactgcaagaacataccaacgctggaatacggatttctggtgcaaatcatgaagtatgccgagcaaagaattcccactctgaacgaatactgcgtggtctgcgatgaacaacacgtgttccaaaatggaagcatgctgaaaccagctgtctgtacgcgagaactctgtgtattttccttttatacactcggtgtgatgagcggcgctgccgaagaggtggccaccggagcagaggtggtcgatttactggtcgccatgtgcagagctgcactggagtcccctcggaaatctatcatttttgaaccctacccaagtgtggtggacccgactgatccgaagaccctggcatttaacccaaagaaaaagaactacgaaagactacaaaaagctctcgacagtgtgatgagcatcagagagatgacccagggcagctatctggaaatcaagaaacagatggacaaacttgacccactggcacaccctctgctgcagtggatcatctcaagcaaccgcagccacatcgttaagctgcccctctctagatgggtccctcattag

SEQ ID NO: 49590 - DNA, 1665 bp, Artificial Sequence
  Description of Artificial Sequence: Synthetic coding sequence
atggacatcaagggccagttctggaacgacgacgacagcgagggcgacaacgaatcagaggaattcctgtatggcgtacaggggtcttgtgcggctgacctatacagacacccacagctggatgcagatattgaggctgtaaaggaaatctactctgagaactccgtgagtattcgggaatacgggactattgacgatgtagatattgatttacacataaacatttccttcctggatgaggaagtgtccaccgcatggaaagtgctgagaactgaaccaattgtacttaggctccgcttcagcttgagtcagtatcttgatggtcccgaaccttcaattgaggtgttccagccatcgaacaaagaagggtttgggttgggacttcagctaaagaagatcttggggatgttcacttctcagcagtggaaacatctctccaatgactttctgaaaacacaacaagaaaagagacacagctggttcaaggcctcgggtacaattaagaagttccgcgcgggtctgtcaatcttctcaccaatcccaaagagcccttcctttccaattattcaagacagcatgttaaagggcaagctgggtgttcccgagcttcgtgttggccgattgatgaacagatctattagctgtacaatgaagaaccccaaagtggaagtgttcggctaccctccatccccacaggctggactgttatgtccgcagcacgtcggcctacctccccccgcgagaacatctcctttggtgagtgggcattgcaagaatatcccaaccctggagtacggttttctcgtgcagatcatgaagtacgctgaacagcggattcccacactaaacgagtattgtgtcgtctgtgacgagcaacacgtgtttcagaacggctcaatgttaaagccggcggtctgcactagagaactttgcgtgttctctttttataccttgggcgtcatgagcggggcagccgaagaagttgccacaggcgctgaagtggtcgacctcctggtggcgatgtgccgggcagccttggagtcgccgcgaaaaagtattatcttcgagccataccccagcgtcgtggacccaaccgaccccaagactttagcatttaatcctaagaagaagaactatgagagattgcagaaagcactggactctgtaatgtcgattcgagagatgactcagggctcttatcttgagatcaagaagcagatggacaaacttgaccccctcgcacatcctttactacaatggatcatttcaagcaacaggtcccatatagtgaaattacctctgtctaggcaattgaagttcatgcatacaagccatcagtttcttcttctgtcaagccccccagccaaagaggcaaggtttcgcacagcaaagaaactctacggctccacttttgcctttcacggaagccatatcgaaaactggcacagtatcttacgaaacggactggtaaatgccagctacaccaagctgcagctccatggcgctgcttacggtaaaggcatctacctttctcctatctcctcaatttcctttgggtattccggcatgggcaaaggtcaacaccgaatgccgagcaaagatgaacttgtgcagcggtataatcgcatgaacactatcccccagcgccgaagttttcagatttag

SEQ ID NO: 49591 - DNA, 750 bp, Artificial Sequence
  Description of Artificial Sequence: Synthetic coding sequence
atgttcaccagccagcagtggaagcacctgagcaacgacttcctgaagacccaacaagagaaacggcactcttggttcaaggcttctggaacaattaagaagttccgcgctgggctgagcatcttctctccaatacccaaatccccctccttccccatcattcaggactctatgcttaaggggaagctgggcgtgccagagctccgggttggaagattgatgaacaggagcatttcttgcactatgaagaaccccaaagtggaggtctttggataccctccttctccccaggtttccggacactgcaagaatataccaaccctggaatacggttttctggtgcagatcatgaaatacgccgaacagcgaatccctacactcaacgaatactgtgttgtttgtgatgagcagcatgtgttccagaatggctccatgctgaaacccgctgtgtgcacacgagagctctgcgttttttcgttctacactctgggagtgatgagcggagcggccgaagaggtggccacaggggctgaggttgtcgacctgctggtggctatgtgtagagcggcgctggagtctccgcgcaagagcatcatattcgaaccataccctagcgttgtggatccaacagatccgaaaaccctcgctttcaatcctaagaagaagaattatgagagactccagaaggctctcgattccgtcatgtccatccgagagatgacccagggatgtcggaattgcatcaagtag

SEQ ID NO: 49592 - DNA, 2565 bp, Artificial Sequence
  Description of Artificial Sequence: Synthetic coding sequence
atgggcatgtgcagccggcaggagcggatccagaaggacatcgacgtcgttatacagaaatccagggccgagaaggactgcctgtttgccgattttaggtactctgactcaacattcacattcacctatgtgggcggcccgcgcagtgtctcttatagcgtacacgtctctgaggattatcctgataacacctatgtgagtagctcagagaacgatgaggatgtcctggtgaccacagaaccaatccctgtcatcttccacaggatcgcaacagaactgagaaaaaccaatgatatcaactgttgcctctccattaagtcaaaactgcaaaaggaaaatggggaggagtcccggcaaaatagtaccgtagaggaggatagcgaaggtgacaatgactcggaggaattctattatggaggacaggtgaattatgacggagaactccataaacacccccaactcgaagccgacctgagcgccgtccgtgaaatttacggtcctcatgcggtatccttgagggaatatggagccatcgatgatgtggacatcgatcttcatattgacgtgagctttctcgacgaagagatcgcagtcgcctgggaagtcatcagaactgagcccattatcgtgcggctgcactgtagtcttacacaatatctcaacggcccagtgccaaccgtggacgtatttcagatcagcaccaaggaacgcttcggcctgggccaccagcttaaaaagattatgcagaccttcgtcactcagcaatggaagcagtctaaagagaaatctaactgcttgcataataaaaagcttagtgagaaaaaggttaagtcccctttacacctgtttagcaccctcaggcggagtcccagttatccccccccggggtgcggcaagtccaagtcaaagctcaaatcagagcaggatgggatctcgaagacgcataagttgttacggcgaacctgttctagcacagtgaaaaccgatgacgtttgtgtgaccaaatcccaccggacctttggtagaagcctgagcagtgatccgagagccgaacaagcaatgacagccataaagagccataagctgcttaaccgcccttgccctgcagcagtgaaatccgaggagtgtctgaccctcaaaagccatcgcttgctgacccgcagttgttctggggatccacgatgtgagcacaatacaaatttgaaacctcacaagttgctatcaagatcctactctagcaacctgcgcatggaggagttatacggtttaaaaaaccacaagctcttatctaaatcgtattcgtcggccccgaagtcatcaaagacagagctctttaaggaaccaaacgccgaaggcagaagacttagcctgacctcaggcctgattggaattctgacaccctcctcgtcctctagctcgcagctcgctcccaatggagcaaagtgcattccggtgagagatagggggtttctcgtgcagactattgaattcgctgaacagagaatccccgtgcttaacgaatactgtgtggtgtgcgacgagccccacgtgtttcagaatggccccatgctgaggccaaccgtatgtgaacgggagctgtgcgtgttcgcattccagaccctaggggtgatgaacgaagctgcagatgagatcgcaaccggtgcccaggtcgttgacctcctggtgtccatgtgtaggtccgctctggaatccccgaggaaagtggtgatttttgagccctacccttctgttgtagacccgaacgatccacaaatgctggccttcaacccacggaagaagaattatgaccgcgtcatgaaggcgctcgattcaataacctccatacgggagatgactcaggcgccctatctcgaaattaagaaacaaatggacaaacaagaccccctcgcccatccactcctccagtgggtgattagtagcaaccgctcacatatagttaagcttcccgtgaatcggcagctaaaatttatgcataccccacatcaattcctcctgctctcaagccctcccgcaaaagagtctaattttagagccgctaagaagttgttcgggtccacctttgcattccacggttcccatatcgagaattggcactcaatccttcggaacggcctcgtggtggcgtctaacacaagactgcagctacacggtgccatgtatggcagcgggatctacctttccccaatgagctccatctccttcggatactccggaatgaataagaagcaaaaggtgtcagctaaagacgagcccgcctcctcaagtaagagctctaatacatcacagagtcagaagaaaggtcagcagtcccagtttcttcagtctagaaacctcaagtgcatcgctctgtgtgaggtcatcacctcgagtgacttgcataaacacggggaaatttgggtcgttcctaacacagatcatgtgtgtacgaggtttttcttcgtctatgaggacgggcaggttggcgatgccaatatcaatacacaggagggcgggattcataaagagatactccgggtaattggcaatcagactgcaaccggatag

SEQ ID NO: 49593 - DNA, 1482 bp, Artificial Sequence
  Description of Artificial Sequence: Synthetic coding sequence
atgcagaccttcgtgacccagcagtggaagcagagcaaggagaagagtaactgtttacacaacaagaagttgtcggaaaaaaaagtcaagtcaccgctgcacctcttcagcacgttacgccgctcccccagttacccacctccaggctgcgggaaatctaagtcaaagctgaagagtgagcaggacgggattagcaagactcacaaactgctcagacggacatgttcttctacagtaaagactgacgacgtgtgcgttacgaagtcacatcgtactttcggtcggtccctgtcatctgatcctcgtgctgagcaagcgatgacggccatcaaatcccacaagttacttaatcgcccctgtccagcagcagtcaaaagcgaagaatgtctcaccctcaagagccaccgccttctgactaggtcatgctctggggatccccgctgcgagcacaacacaaatctgaagcctcataaactcctgtctcggagttacagttctaaccttaggatggaagagctctacggcttgaaaaaccacaagctccttagcaaaagctactctagtgcccctaaaagttcaaagactgaattattcaaagagccgaacgccgaaggtagaaggttgagcttaacctcgggcctgatcggaattctcacaccaagttcctcatcaagctcccagctggcaccaaacggggccaaatgcatccctgtgcgcgatcggggctttctggttcagactatagagttcgcagaacaaagaattccagtcttaaatgaatactgtgtggtttgcgacgaaccccatgtgttccagaatgggcctatgctccggccaactgtgtgcgagcgtgaactttgcgtgttcgcctttcagaccctcggggtgatgaacgaggcagccgacgagatagcaactggtgcccaaaaaaaaaattacgatcgggtgatgaaggccctcgacagcattacaagtatccgagaaatgacccaggcaccttacctcgaaatcaagaaacagatggataagcaggaccctctcgcccaccccttgttgcaatgggtaatctcctctaatcgcagccatatagtgaagctgccggtaaatcggcaactgaagttcatgcatacaccccaccagtttctactcctttcctcaccgccagccaaagaaagtaactttagggctgcaaagaagctgtttggctccacattcgctttccatggctctcacatcgagaactggcactccatcctgcggaatggcctggtagtggccagcaatacacggctgcagttgcacggtgccatgtacggtagtggcatttatctgagccccatgagttctatctcattcggttactcagggatgaacaaaaaacaaaaggtgagcgccaaagatgagccagcttcttcctcaaagtcttcaaatacgtctcagtcccagaagcggactgctattcctattccggcaaagccatag

SEQ ID NO: 49594 - DNA, 174 bp, Artificial Sequence
  Description of Artificial Sequence: Synthetic coding sequence
atgggcatgtgcagccggcaggagcggatccagaaggacatcgacgtggtgatccagaaaagccgcgcagaaaaagattgcctgttcgcggacttcagatactccgattctaccttcaccttcacctacgtggggggacccaggaggaatagtgaactggcaccaggcatgtag

SEQ ID NO: 49595 - DNA, 2439 bp, Artificial Sequence
  Description of Artificial Sequence: Synthetic coding sequence
atgggcatgtgcagccggcaggagcggatccagaaggacatcgacgttgtcatccaaaagagccgggcggagaaggactgcttgtttgctgattttcggtatagcgatagtacatttacttttacatacgttggaggaccaagatcagtttcctactcagtccacgtaagcgaggattaccccgacaatacttatgtcagttcctccgagaacgacgaggatgtcttggtgaccaccgagcctatccctgtcatattccaccgcattgcaaccgagttgaggaagactaatgacattaactgttgtcttagcatcaaatcgaaactacagaaggagaatggagaagagagtagacaaaatagcacagttgaggaagactctgaaggagacaatgactccgaagagttttattatggtggccaggtcaactatgatggcgagctccacaaacaccctcagcttgaagcggatcttagcgctgtccgcgaaatctatggaccccatgcagtgtcgctgcgagagtatggcgccatagacgacgtggacattgacctccacatagatgtgtcattcctggatgaagagattgcggtagcatgggaagtgatacgaacggagccaattatcgttcgcctgcactgttctctcactcagtacctcaatggacctgtgcctacagtggacgtattccagataagcaccaaagagaggtttggtctcggacatcaactaaagaagatcatgcagacgttcgttacccaacagtggaaacagtctaaggaaaagtcaaactgcttgcacaacaagaaacttagtgagaaaaaggtcaaatcacctctgcatctgttcagcactcttcgacggtcgcctagttatcctccccccggctgtggcaagtctaagtctaaactgaaatcagagcaagacggtatcagcaaaacacacaaacttctgcgtcggacttgctcatcaaccgtcaaaactgatgatgtgtgcgtcaccaagtctcaccggaccttcggccgtagcttgtcctctgatccacgcgctgagcaagctatgacagccatcaaatctcacaagctattgaaccgaccctgccccgcagccgtaaagtctgaagaatgcctgaccctgaaatcgcaccgcttgctaaccaggtcatgttctggagatccacggtgcgaacacaatacaaacttgaagccacacaagcttctgtcgcggtcatatagctccaatctacggatggaggaactatacggactgaaaaaccataaactcctgtcgaagtcctactcttctgcccccaagtcctccaagactgagctgttcaaggaacctaacgctgaggggagacggctcagtttgacgtcgggtcttattggcattttgactcccagttcaagtagcagttctcagttggctcccaatggggccaaatgcattcccgtccgcgatagggggttcctggtgcagacaatcgagttcgcggagcagagaatcccggtgctgaacgagtactgcgtggtctgcgacgagcctcacgtgtttcagaatggcccgatgctgcgaccaaccgtctgtgaacgggagctctgtgtcttcgcatttcaaaccttgggcgtcatgaacgaagctgccgatgaaatagccactggggcacagaaaaagaactacgatcgcgttatgaaggccctggattctatcactagcatccgggagatgacccaggccccctatttggagatcaagaagcagatggacaagcaggaccccctcgcccacccgcttctgcaatgggtcatatccagtaaccgttcccatattgtcaagctcccagttaacagacagctcaaattcatgcatacccctcaccagtttctgctcttatctagccctccagcgaaagagtcaaactttcgcgctgcaaagaagctgtttgggagtacctttgcctttcacggttctcatattgagaactggcattcaatattacgcaacggcctggttgttgcctctaacacgcgactgcaactccacggggcgatgtacggttcaggcatttatctgagcccaatgtcttccatttccttcggctatagcgggatgaacaagaagcaaaaggtgtcagcgaaagatgaaccggccagcagcagtaagagctccaacaccagccagagtcagaagaagggacagcagtcacaattcctacaatcaagaaacctgaagtgcatcgcactgtgtgaggtgatcacaagctctgatctgcacaagcatggtgagatctgggtagtgcctaatacagatcacgtctgtacccggtttttttttgtgtatgaagatggccaagtgggcgacgcaaatatcaacacacaggaaggaggcatccacaaagagatcctgcgggtcataggcaaccaaaccgcaaccgggtag

SEQ ID NO: 49596 - DNA, 2502 bp, Artificial Sequence
  Description of Artificial Sequence: Synthetic coding sequence
atggagcccgccgccctgcggtgcgcctacttccggtacagcgacagcaccttcaccttcacttacgtcggtggaccaagatctgtgtcttatagtgttcacgtcagtgaggattatcccgataacacctatgtaagctctagcgagaatgatgaggacgtcctggtgaccactgagccaatcccagttatcttccaccgtatcgcaacggagctcaggaagacaaacgacatcaattgctgcctcagtattaagtccaagttgcaaaaggaaaacggcgaggagtctcgccagaacagcacggtcgaagaggactccgaaggagataacgacagtgaagagttttattatggcggacaggtcaattatgacggcgagttacataaacaccctcagctggaagctgacctttcagcggtccgggagatttacggcccacatgccgtcagcctaagggagtacggagccatcgatgacgtagatatagacctacacattgatgtgtcattccttgatgaggagatagcagtggcctgggaggtaatccgcaccgagcctattatagtgaggttacattgtagtcttacacagtatttaaacggacctgttccaacggttgatgtgtttcaaatttcaaccaaagaaaggttcggcctgggccaccagctaaagaaaatcatgcagacctttgttacccagcaatggaagcagtccaaagaaaagtccaactgtctgcataacaagaaactgtctgaaaaaaaggtcaaaagccccttgcaccttttttctacactgcggagaagcccctcctatcccccacccggctgcggaaagagcaagtctaaacttaaaagcgagcaggatggaatctccaaaactcataagctcctaagaagaacctgctcctctactgtcaagactgacgacgtgtgtgtcacaaagtcacatcgcacgttcggaaggtccctaagttccgacccccgggccgaacaggcaatgaccgcaattaaatctcataagctcttaaaccgcccttgccccgccgcagttaagtccgaggaatgtctgacgctgaagtcccatcggctgttgactcgaagctgtagcggtgatcccagatgcgagcacaatacaaacttaaaacctcacaagctgctctcccggagttatagctcaaacctgaggatggaggagctgtacggactgaaaaatcataagctgttgagcaaatcctattccagtgccccaaagagttctaaaacagaactgtttaaagaacctaatgccgaaggcagaaggctttccctgacttcaggtcttatcggtatccttacaccctccagtagttcctccagtcagctggctccaaatggtgctaagtgcatccctgttcgagaccgaggcttcctggtgcagacgatagaatttgcagaacaacgtatcccggtactgaacgaatactgcgtggtctgcgacgagccccatgtgttccaaaacggacccatgcttagacccaccgtatgcgagcgtgagctgtgtgtttttgcctttcagacgttaggggtgatgaacgaagctgccgacgagattgccactggagcacaagtcgtggaccttcttgtgtctatgtgccggtccgccctggagtctcctcggaaggtggtcatcttcgagccctacccgagcgtagtcgatcccaatgatcctcagatgctcgcatttaatcctcggaagaagaactatgatcgcgttatgaaggcacttgacagcatcacttctatccgggagatgacacaggcaccctaccttgaaattaagaagcaaatggacaaacaggatcccctggcacatccactgcttcaatgggtaatcagctctaatcggtcccacatcgtgaaactgcctgtgaaccgacagctcaaattcatgcatactccgcatcagtttcttctgctcagttcgccccctgcaaaagagtccaacttccgagcagcaaaaaagctcttcgggtccaccttcgccttccacggctctcacatcgaaaattggcacagcatcctacggaacggcttggttgtagctagtaacaccaggttgcaactgcatggcgcgatgtacggctctggaatctatctttccccgatgtcgtctatttccttcggctacagtggtatgaataagaagcagaaggtgagcgcgaaggatgaacccgcctcgtcttcgaaaagctcgaataccagtcagagtcagaagaagggacagcagagccagttcctgcaaagcaggaatcttaaatgcatcgcgttgtgtgaggtgatcacctcttcagatctacacaagcacggtgaaatatgggtcgtccctaacactgaccatgtgtgtacacgctttttctttgtctatgaggatggtcaggtgggcgacgccaatataaatactcaagaagggggcatccataaagagattctgcgagttatcggcaaccagacggcaacaggctag

SEQ ID NO: 49597 - DNA, 2565 bp, Artificial Sequence
  Description of Artificial Sequence: Synthetic coding sequence
atgggcatgtgcagccggcaggagcggatccagaaggacatcgacgtggtgatccagaaaagccgggcagagaaagattgcttgtttgccgactttagatactcagattccactttcacatttacctatgtgggtggcccacgttccgtgtcctacagcgttcacgtgtccgaggactacccagacaacacatatgttagctcaagcgaaaacgacgaagacgtcctggtgactacagaacctatcccagtgatcttccataggatcgcaactgaactgcggaaaaccaacgatatcaattgttgcttgtctatcaagagcaagttgcaaaaagaaaatggcgaagaatctcggcagaacagtaccgtggaagaggattcagagggtgataacgattccgaagagttctactacggcggccaggtcaattatgacggtgagctgcataaacacccccaacttgaagccgacctatccgcggtgagggagatctacggtccacatgcagtgagcctgcgggagtacggcgccatagatgacgtggatattgacctgcacatcgacgtatccttcttggatgaagagatagcagtggcctgggaggtgatcaggactgagccgatcattgttcgtctccactgcagcttgacccagtacttgaatggtccagtgcctacggtggacgtttttcaaatctccactaaagagcgcttcggtctgggccaccagttgaagaagatcatgcagacttttgtgactcagcagtggaaacagtcaaaggagaagagcaactgtctgcacaacaagaaattatctgagaaaaaagtaaaaagccctctacatctgttttcaacactgcggagaagtccctcttaccctcccccaggatgtggcaagtccaagtccaaacttaaatcagaacaggacggcatctcaaagacacataagctcctcagacggacttgttcgagcaccgtgaagacagacgacgtttgcgtgacaaagagccatagaactttcggcaggtctctctccagtgatccgcgggcagagcaagctatgaccgccattaaatctcacaagctactcaacaggccttgccccgccgctgtaaagagcgaggaatgtttgaccttaaagagccacagattattgacccggtcttgttcaggagacccccgatgcgaacacaatactaacctgaagccgcataaactcctgtctagatcttactcatctaacctcaggatggaggaactctacggattgaagaaccataaactgttgagtaagtcttactcctctgcgcctaaaagtagcaaaacagaactgttcaaggagccaaacgcagagggccgacgcctgtcattgactagtggcctgataggcatcctcactccctcctctagcagttcttcccagctggcgccaaacggagctaagtgcatccccgtccgcgacaggggatttctggtgcagacgatcgagttcgctgagcagcgcatcccggtcctcaatgagtactgtgtggtatgcgacgagccgcacgtgttccaaaatggcccaatgttacggcccaccgtgtgcgagcgggaactgtgcgtgtttgccttccagacattaggtgttatgaacgaggcagccgatgagattgcaactggagcccaggtggtggatctgctagtttcgatgtgtcgcagcgccctagagagcccgagaaaggtggtcatttttgaaccatacccaagcgtcgtcgaccccaacgatccacaaatgctggcctttaatccgaggaagaaaaactatgacagagtcatgaaagccctcgattcaatcacatcaatacgcgaaatgactcaggcgccctatctagaaataaagaagcaaatggataaacaggatcccttagcccaccccctgttgcagtgggttatttcttcaaacagatcccacatcgtaaagctccctgttaatagacagctcaagttcatgcatactcctcatcaattcctgttgttgtcctccccccctgctaaggagtctaactttcgcgccgctaaaaagctgtttggatccactttcgccttccacggcagccacatcgaaaattggcactccatcttacgaaacggcctagtggttgcatcaaatacccggctgcagctgcacggcgctatgtacggcagtggcatctacctctcgccgatgtcctctatctccttcgggtactctggcatgaacaaaaaacagaaggtaagtgccaaggacgaacccgccagctcaagcaaatctagtaacacatctcagtcacagaagaagggacagcaaagccagttcctccagtctaggaatctcaagtgtattgcgctctgcgaggtaattacctcaagtgatttgcacaagcacggagagatatgggtggtacccaacaccgatcacgtctgcacacggttttttttcgtctacgaagacggacaagtgggagatgcgaacattaacacacaggagggtggcatccataaggagatcctccgtgttatcggcaaccagaccgcaaccggttag

SEQ ID NO: 49598 - DNA, 2439 bp, Artificial Sequence
  Description of Artificial Sequence: Synthetic coding sequence
atgggcatgtgcagccggcaggagcggatccagaaggacatcgacgtggtgatccagaaaagccgggccgaaaaggattgcctgtttgctgattttagatactccgactcaacatttaccttcacatatgttggcggccccaggagcgtctcctattccgtgcacgtgagtgaggactatccagacaatacatatgtgtcttccagtgagaatgatgaggacgtgctcgtcactacagaacccattcctgtgatttttcaccggatagccactgagcttaggaagaccaacgacataaactgctgccttagcattaaaagtaaactacagaaggagaatggagaagaaagcagacagaacagcactgtggaggaggatagcgaaggcgataatgattctgaggagttctattatggcggacaggtaaattacgacggtgagttgcataagcatccacagttagaggccgacctgagtgccgtgcgcgaaatatatggccctcacgctgtatctctgcgcgagtacggcgctatcgatgacgttgatattgatctgcatattgatgttagcttcctcgacgaggagatcgcagtggcatgggaagtgatccgaacggagccaataatcgttcgcttacactgttccctgactcagtaccttaatggaccggtcccgacagtggacgtctttcagattagtacgaaggagcgttttggactcggacaccagctcaagaaaatcatgcagaccttcgtgacacagcaatggaaacaatccaaggaaaagtctaattgcttacataataagaaactgagcgaaaagaaagtgaagtctccactacacctgtttagcactctgcgccgatccccgagctatccaccccctggatgcggcaagtctaaaagcaagcttaagagcgagcaggacggtatcagcaaaacccataaattgttgcgacgaacctgctcaagcaccgttaaaaccgacgatgtatgcgtgacaaagtcccatcggacgtttggacgctccctgagcagcgacccaagggcggaacaggccatgacagccatcaaatcccataaactgctcaatcgcccatgcccagctgcagtgaagagcgaggagtgtctgactcttaagtcccatcgccttttgacaagatcttgcagcggcgaccctcggtgcgaacacaatactaatcttaagccccacaagctgctgtcccgaagctattcaagcaatcttcgcatggaggaactctacggcctgaaaaatcataaactcctgtcaaaatcgtactctagcgcccccaagtcttccaagaccgagttgtttaaggagcccaacgctgaggggcgccggctgtctctgaccagtggactaatcggcatcttaactccgtcaagcagctcttctagtcaactggccccgaacggagctaagtgcatccctgtcagagacagggggttcttggtccaaactattgagttcgcagagcagagaatcccagtgctcaatgaatactgcgtggtctgcgacgagcctcacgtgttccagaacggcccaatgctccgtcccacagtttgcgaacgggagctttgcgtcttcgcctttcagacacttggggtcatgaatgaagctgccgacgagatagcgaccggcgctcagaagaaaaactatgaccgtgtgatgaaagctcttgacagcataacaagtatccgggagatgactcaggctccctacctggagatcaaaaaacagatggataagcaggatcccctagctcatccccttcttcagtgggtcattagttctaacagaagccacatcgtcaaattacctgttaataggcagcttaagttcatgcacactcctcaccagttccttttactctctagcccccctgccaaggaaagcaacttccgcgctgcaaaaaagttgtttggtagcacttttgcttttcatggatcccacatcgaaaattggcactcaatcctgaggaatggactggtggtagcctctaatacccggctccagctgcatggagccatgtacggaagcggcatctatctgagccccatgtctagcataagctttggctatagcggaatgaataaaaagcaaaaagtgtcggccaaagacgagcccgctagcagcagtaaaagctccaacacatctcaatcacagaaaaaggggcagcagtcgcagttcttacagtccaggaacttgaagtgtatagccctctgcgaagtaatcacatcatcggacttacataagcatggggaaatttgggtggtgcctaacacagatcacgtgtgtacccgttttttctttgtttatgaagatggccaggtgggagatgcgaacatcaacactcaagaaggaggcatacacaaagaaatcctgcgtgtgattggtaaccagacagctaccgggtag

SEQ ID NO: 49599 - DNA, 1485 bp, Artificial Sequence
  Description of Artificial Sequence: Synthetic coding sequence
atgcagaccttcgtgacccagcagtggaagcagagcaaggagaagtccaattgcttgcacaataagaaactaagcgaaaagaaagttaagagccctttgcacctgttcagcactctgaggcgctcgccgagttaccctccaccgggctgcggaaaaagcaaaagtaaattaaaaagtgaacaggacggcatttccaaaacccacaaactgctccgacgcacgtgtagttcgactgtgaaaactgatgacgtttgcgtgactaaatcacaccgtaccttcggtaggtcacttagctcagatccgcgggctgaacaggctatgaccgctatcaagtctcataagttgttgaatcgtccctgcccagctgccgtgaagtcagaagaatgcctcacattgaaatcccataggctgttgacgaggagctgctccggtgaccccagatgtgaacacaatactaatctgaaaccccacaagttacttagtagatcttacagctctaatcttaggatggaagagttgtatgggctgaagaatcataaactgctctctaaatcatatagcagcgcccctaaatcttctaagaccgagctttttaaggagcctaatgcagaaggacggagactctcattgacttctggattaatcgggattttgactccctcatcttccagctcttcacagctggctcctaatggagctaaatgcattcctgtgcgagatcgcgggtttctcgtacagaccatcgagtttgctgagcagcgtataccggttctcaacgaatactgtgtggtgtgcgatgagccccacgttttccagaatgggccaatgctgaggccaaccgtctgcgaacgggaactatgcgttttcgctttccagaccttaggggtcatgaacgaggcagcggacgaaattgctactggcgcgcagaagaaaaattatgatcgggtgatgaaggccttggactcaatcacatcaatccgagagatgacccaggctccatacctggaaattaagaaacaaatggataaacaggatccactggcacacccattgttgcaatgggtgatcagctcgaaccgatcgcacatagtgaagctcccagtaaatagacaattgaaattcatgcacacacctcaccaattccttcttctgtcctcccccccagcaaaggaatccaacttccgggccgctaaaaagcttttcggttcgacttttgccttccatggcagtcacatcgaaaactggcacagtatactgcgcaacggactggtggtggccagtaacacgaggctccaactgcatggagccatgtacgggagtggaatttacttgagccctatgagttccatctcctttggatatagcgggatgaataaaaaacagaaagtcagtgccaaggatgaacccgcaagctccagtaagtcctcgaatacttcccagaagacaaagaaaaggaccgcaatcccgatccctgccaagccctag

SEQ ID NO: 49600 - DNA, 603 bp, Artificial Sequence
  Description of Artificial Sequence: Synthetic coding sequence
atggccagcctgtacgtgggcgacctgcaccccgaggtgaccgaggcaatgttgtacgagaagttcagcccagctggcccaatcttgagtatcaggatatgcagggacaagatcacaaggaggtctctcggatatgcctatgtcaattatcagcaacccgttgacgcgaaaagggccctcgaaacactgaatttcgatgtgatcaagggtcgcccagtcagaattatgtggtcccagcgggatccctcgttgcgcaagtcgggagtaggcaatgttttcattaagaatttagggaaaacaatcgataacaaagccctatacaacatcttctccgcattcggtaacattctgagttgtaaggtcgcctgcgacgaaaagggacccaagggatatggatttgtgcactttcagaaacaggagagcgcagaacgagctattgacgtcatgaacgggatgttcctgaattaccgaaaaatcttcgtaggaaggtttaagagtcataaagagagggaagctgagaggggtgcttgggcaagacagtctacatctgctgacgtgaaagatttcgaggaagatacagatgaagaggcaaccctgcgatag

SEQ ID NO: 49601 - DNA, 603 bp, Artificial Sequence
  Description of Artificial Sequence: Synthetic coding sequence
atggccagcctgtacgtgggcgacctgcaccccgaggtgaccgaggccatgctgtacgagaagttctcccccgccggtcctatattgagtattcggatatgtcgggacaagatcacgaggaggtccttaggttatgcttacgtgaactaccagcagcccgtggacgcaaaaagggcactcgagaccttgaactttgacgtcattaaaggtagaccagtccgtatcatgtggtcgcaaagagatccaagcctacggaagtccggcgtcggcaacgtattcattaagaacctgggtaagactattgacaacaaagccctctacaacatcttcagcgcttttgggaacattctttcatgcaaagtcgcatgcgacgagaagggccccaaagggtatggcttcgtacatttccaaaagcaggagtccgctgagagagccatcgatgtgatgaatggcatgtttttaaactaccgcaagatcttcgtgggacgcttcaaaagccataaggagcgcgaggccgaacggggcgcctgggctcgccaaagcaccagcgcggacgtcaaggactttgaagaggatacggacgaagaggccacccttcggtag

SEQ ID NO: 49602 - DNA, 1113 bp, Artificial Sequence
  Description of Artificial Sequence: Synthetic coding sequence
atgaacgtggccgccaagtaccggatggccagcctgtacgtgggcgacctccatgcggatgtgactgaagatctgttgtttcgcaagtttagtactgtcggcccggtgctttcaattaggatttgccgagaccaagtcacccggcgatcgctaggctacgcttatgtgaatttcctgcaacttgcagacgcacaaaaggcattggacactatgaatttcgatatcattaaaggcaagtcaatacgcctgatgtggtcccagcgcgacgcctatctcagacgttcgggcattggcaatgtgtttatcaaaaacctcgataagtctatcgataataaaacactgtatgagcacttctccgccttcggcaagattctctcttctaaagtgatgtctgatgatcagggatccaaaggctacgcgttcgtgcactttcaaaatcagagtgctgccgatcgcgcgatcgaggagatgaatggaaagctgctgaagggctgtaaagtgttcgtgggtaggtttaagaaccgtaaggaccgggaggctgagctgagatctaaggcctcagagtttaccaatgtttatataaagaatttcggcggtgacatggatgatgaacgcttaaaagacgtcttcagcaaatatgggaaaacgctgtctgtcaaggtaatgacagattcttccggaaagtccaagggctttgggttcgtcagcttcgatagccacgaggctgccaagaaggccgttgaagaaatgaatggtagggacatcaacggccagctcatcttcgtgggtcgcgcccagaagaaggtggaacgccaagccgagttgaagcagatgtttgaacagctcaagcgagaaagaattcgcggctgtcagggcgtcaaactgtatattaagaacctggacgacactattgacgacgaaaagctgaggaatgaatttagttccttcggctctataagtagggttaaggtgatgcaggaggaagggcagtcaaaaggattcggtctgatttgctttagttcacccgaggacgccacaaaagccatgacggaaatgaatggccgcattcttggctcaaaacctcttagcatcgctttggcccagcgtcactag

SEQ ID NO: 49603 - DNA, 1287 bp, Artificial Sequence
  Description of Artificial Sequence: Synthetic coding sequence
atgcgggtgctgcccgagctgggcgagagctgcctgaacagcatcgcctggcctctgtgcggcgaccctgaggcctcgacattggaacctggacagtcttgcgacctcgtgtctcctcacagggactgcagcaaaaattctagaggtcagacccacagtggcaaggacaaagagatgaacgttgcagccaaataccggatggcttctctgtatgttggtgacctccacgctgatgtgacagaggatctcttatttcgtaagttctctacggtgggaccagtgctgagcattaggatctgccgcgaccaggttactcgccgctcccttgggtatgcttatgttaatttcttgcagctagcggacgcacagaaagcactggacaccatgaacttcgatattatcaaagggaaatccatcagacttatgtggagtcagagggatgcctatttacggaggtctggtattggcaatgtgttcattaaaaatcttgataagtcgattgataacaaaacactttacgagcatttttccgcgtttggcaaaatcctctcctccaaggtcatgagcgacgatcaagggagcaagggctatgcctttgtgcacttccagaatcagtctgctgcagatagagccatcgaagaaatgaatggaaaactcctgaagggatgcaaagtcttcgtaggccgttttaaaaatcgtaaagacagagaagccgaactgcggagtaaggcatccgagttcactaacgtgtatatcaagaattttggaggagatatggatgatgaacggctcaaggatgtcttcagtaagtatggcaaaacgttgtcagtcaaggtgatgactgacagctccgggaagtccaagggattcggttttgtcagcttcgactcccacgaagccgccaagaaagcggtggaggagatgaatggtcgtgacattaatgggcagctcatcttcgtaggtcgtgctcagaaaaaagtcgaaaggcaagctgaactgaaacaaatgtttgagcagcttaagagagagcgtatcaggggttgccaaggagtaaagttgtacattaagaaccttgacgacacaattgatgacgagaaattaaggaacgagttttccagcttcggaagcatcagtcgcgttaaagtgatgcaggaagagggccagtcaaaggggttcggtctgatttgcttttcatcgcctgaggatgcaaccaaggctatgactgagatgaatggacgtattctcgggtctaagcccttgagcatcgccctcgcccagaggcattag

SEQ ID NO: 49604 - DNA, 762 bp, Artificial Sequence
  Description of Artificial Sequence: Synthetic coding sequence
atgcccctgctgcccagcaccgtgggcctggccggcctgctgttctgggctggccaagcagtcaacgctcttatcatgccgaacgccactccggccccagcccagcctgagtccactgcgatgcgcctgctaagtggcctggaagttccccggtatagaaggaaacggcatatttcagttagagacatgaatgctctgctcgactatcataatcatatccgcgcttccgtctacccccctgcggccaacatggagtacatggtctgggataaacggctcgctagggctgcagaggcttgggcaacccaatgtatctgggcccacggaccatctcagttgatgaggtacgtcggccaaaatctgtccattcactcgggccagtataggagcgttgtggatctcatgaaatcttggtccgaggagaaatggcactacctgtttcccgcccctagggactgtaacccccattgtccctggagatgtgacggtcctacctgttcccattatacgcaaatggtctgggcctcatccaaccggcttggctgtgcaatccatacatgtagctccattagcgtatggggcaatacctggcaccgagctgcctacctggtatgtaactacgccataaaaggaaactggattggcgaaagcccatataagatgggaaaaccatgctcttcatgtccaccttcttatcaggggtcctgtaatagcaatatgtgcttcaaaggcttaaaaagcaacaaattcacctggttttag

SEQ ID NO: 49605 - DNA, 1845 bp, Artificial Sequence
  Description of Artificial Sequence: Synthetic coding sequence
atgaacgccagcggcagcggctaccccctggccagcctgtacgtgggagacttacatcctgatgttaccgaagctatgctgtatgagaagttctcccccgccggtcccattctgagcatccgggtgtgtcgggatgtcgccaccaggcggtcacttgggtacgcctacataaacttccagcagcctgccgatgctgaaagagcactggataccatgaatttcgaaatgttgaaaggccaaccaattcgaattatgtggagccagcgggatcctggattgcgcaaaagtggagtgggtaacattttcataaaaaacctggaagactccatcgataataaggcactctatgataccttctctacctttggcaatatactgagttgtaaggtggcttgcgacgaacatggaagccgcggctttgggtttgttcacttcgagacccatgaagccgctcagcaagcgatcaacaccatgaatggaatgctgcttaacgataggaaagtgttcgtcggccacttcaagtcgagacgggagcgcgaggcagaattgggggcaagagccctggagttcacgaacatctatgtaaaaaaccttcccgtcgacgtggacgaacaggggctgcaagatttattttcccagtttggaaaaatgctctcagtaaaagtgatgcgggacaacagtggccattcacgttgttttggctttgtgaactttgagaagcatgaggaagcccagaaagctgttgtgcacatgaatggtaaagaggtgagtggaagactgctttatgctggtcgtgcacagaaacgagttgagcgacaaaacgagctgaaacgcagatttgagcagatgaagcaggataggctgcgcaggtaccagggtgtcaatttatatgtgaagaatctggacgacagcatcgatgacgataagctccggaaggaattctctccatacggagtaatcacaagcgccaaagtcatgacggagggcgggcactccaaaggattcggatttgtgtgtttttcctcccccgaggaagcaactaaagccgtcactgagatgaatggtagaattgttggtactaagcccctctatgttgctctggcccagcggaaagaggaaagaaaggctatcttaaccaatcagtatatgcagcgtctgtccactatgcggaccctgagcaacccgctccttggctcttttcaacagccttcgtcctattttctgcctgctatgccccagccacctgcacaggcagcctattacggctgtgggcctgtgacccctacccagcccgcgccccgctggaccagtcagccgcctcgtccgtcatgtgcttccatggtgcgaccacctgtggttcctcgtagaccgcccgcccacattagctcagtgcggcaagctagcactcaagtgcccaggaccgtcccacatacgcagcgagtagcaaatattggtacccagactaccggaccaagtggtgtgggctgttgcaccccaggacggcctctgctcccttgcaaatgttccagcgccgctcacagcacttatagggtgcaggaacccgccgtgcacatcccaggacaggagccccttaccgcaagtatgcttgccgccgcccccctacatgaacagaaacagatgattggcgagcggctgtatcctctcattcatgacgtccacactcaactggcaggtaagatcaccgggatgctgctcgagattgacaactccgaactcctcctcatgttagagtctccagaatcacttcatgcgaagattgatgaggccgtggcggttctgcaggctcatcaggcaatggagcagcccaaggcttatatgcactag

SEQ ID NO: 49606 - DNA, 993 bp, Artificial Sequence
  Description of Artificial Sequence: Synthetic coding sequence
atgaacgccagcggcagcggctaccccctggccagcctgtacgtgggcgacctgcaccctgacgtcacagaggctatgctctatgagaaattcagtcccgccggtcctatcctgtccatccgggtgtgcagggacgtcgccaccaggaggtcactgggctacgcatacataaacttccagcagcccgctgatgccgaacgcgccctggataccatgaactttgagatgctgaagggacagcctatcagaatcatgtggagccagcgagaccctggtctgaggaaatcaggagttggcaatatttttatcaagaatctggaggattccattgacaataaggccctgtacgataccttttctactttcgggaatattctgagttgcaaagtcgcttgcgatgagcatggatcacggggctttggcttcgttcactttgagacccacgaggctgcccagcaggctatcaataccatgaacggcatgctcctgaatgatcgtaaggtgtttgtgggccattttaaaagcagacgggagcgggaggcagagttaggagccagggctctggagtttactaacatctatgtgaagaatctgcctgtcgacgtggatgagcaaggactccaggacttattttctcagttcgggaaaatgctgtcagtcaaggtgatgagagataacagcggccacagtcgctgttttggctttgtgaattttgagaagcatgaagaagcccagaaagcggttgtccatatgaacggcaaagaagtatcaggtaggctgctttacgctggacgggcacaaaaacgcgttgagagacagaacgagctcaaacggagattcgagcagatgaaacaagacaggctccgacggtaccagggagtgaacctgtacgtcaaaaatctggatgacagcatcgacgacgacaaactacggaaagagtttagtccttacggcgtgataacatcagccaagaaacgtcgacagcggccctag

SEQ ID NO: 49607 - DNA, 1845 bp, Artificial Sequence
  Description of Artificial Sequence: Synthetic coding sequence
atgaacgccagcggcagcggctaccccctggccagcctgtacgtgggcgatctgcatccggacgtcaccgaagcgatgctctatgagaaatttagccctgcagggcccattttgtccatcagggtctgccgggatgtcgccaccagaaggtcgctcggctatgcatacatcaacttccagcagcctgcagacgccgaacgggctttggataccatgaacttcgagatgctgaagggacaacccatccgcatcatgtggagccagagggacccagggctgcggaagagcggcgttgggaacatcttcattaaaaacttggaggactctatcgataataaggccttgtatgacaccttcagcactttcggcaacatactgtcctgtaaggtggcctgcgatgaacatggcagccggggtttcgggttcgttcacttcgagactcatgaggccgctcagcaagccataaatactatgaacggtatgctgctaaatgaccgaaaggtctttgtggggcacttcaagtcacggagggagcgggaggctgaacttggagcccgggctttagagttcacaaatatctatgtcaaaaacctccccgttgacgtcgatgagcaaggactgcaggatctgttcagccagttcggcaagatgctgtctgtcaaggttatgcgggacaatagcgggcactcccgttgcttcggatttgttaacttcgagaagcacgaagaggcccagaaagccgtggtccatatgaacgggaaagaagtttcaggacgcctcctgtatgccgggcgcgcacaaaaaagagttgaaagacaaaatgagttgaagcgccgtttcgaacagatgaaacaggataggctacggcggtaccagggcgtaaacttgtacgtgaaaaatcttgatgacagtattgacgacgacaagcttcggaaggaattttcgccatacggcgttatcacttccgcaaaggtcatgaccgagggagggcatagtaagggtttcggcttcgtgtgcttttcatctccagaagaagcaaccaaggccgtgactgaaatgaatgggcgtattgttgggacgaaaccactatatgtagccctcgcccagcggaaagaggaacggaaagcaatcctcaccaaccagtatatgcagcggctctccacaatgagaaccctctcaaatccactgctcggctctttccaacagcccagcagttactttctcccggctatgccccagccccccgctcaggcggcatattacggatgtggcccagtaacaccaacgcagcctgcgccaaggtggacaagccagccccctcgccctagttgtgcatctatggtgcgaccgcccgtggtaccccggcggccccctgcgcatatatcctccgtcaggcaggctagcacacaagtcccccggacagttcctcacacacagcgcgttgccaacattggaacacagacaacaggcccgagtggtgtggggtgctgcacgcctgggcgcccgcttctaccatgcaaatgttcctctgccgctcactcaacctaccgggtccaagagcctgccgtgcacatacccggccaggaacctttgaccgcatctatgctggctgccgcccctctgcatgagcagaagcagatgatcggagaacgactgtacccgctcattcatgacgtgcacacacagttggccggtaagatcacagggatgctcttggagattgataacagtgagctgctcctgatgctggagagccccgagagtctgcacgccaagattgatgaagccgtcgcagttttgcaagcacaccaggccatggaacagccaaaagcgtatatgcactag

SEQ ID NO: 49608 - DNA, 450 bp, Artificial Sequence
  Description of Artificial Sequence: Synthetic coding sequence
atggtgcggccccccgtggtgccccggcggccccccgcccacatctcgtccgtaaggcaggcctcaactcaagtgcctcgcacggtgccacatacacagcgcgtggctaacatcggtacacagacaaccgggccgagcggggtgggctgttgtacaccaggtaggcccctcctgccatgcaagtgctcctcagctgcccactccacatatcgtgtgcaagagccagctgtgcacattccagggcaggagcccttgacagcctcgatgttagcagctgccccactccacgagcagaagcagatgattggggaacgtctgtatccactgatccatgacgtgcacacccagctggccggcaagataaccggaatgctgctggagattgacaactctgagttgctccttatgctggaatcccctgagtcactgcatgccaaaataagtgcgtag

SEQ ID NO: 49609 - DNA, 582 bp, Artificial Sequence
  Description of Artificial Sequence: Synthetic coding sequence
atggtgcggccccccgtggtgccccggcggccccccgcccacatcagctccgtgagacaggccagtacacaggtgcccaggaccgtgccacatacacagagagtcgcaaacattggtacacagaccacagggccctctggagtcggctgttgcacgcccggacggccgctgctgccttgcaagtgtagctctgctgcgcacagcacttacagggtgcaggaacctgctgtgcacatacctggtcaggaaccactgaccgccagtatgctggctgcagctcctctgcatgagcagaagcagatgattgggacctgctatctggtcctgaaacgatggtcagactggatggtcctgtccttcctccccctgctgctgagctgcgacttcgaggggtctgtgagcaccccgctgtccatgatgtccactccaagttggctggctagatcccgcgcatgttgctggcgcctgactacacagagctgctgttcctgctggagcctgcagaatcccagtatgcctcgtaaaggtaatcccagatttcacgggtgtcagaaagattcagtctccggatctcagccatag

SEQ ID NO: 49610 - DNA, 405 bp, Artificial Sequence
  Description of Artificial Sequence: Synthetic coding sequence
tgcaagtgcagcagcgccgcccacagcacctaccgggtgcaggagcctgccgtccacatccccggccaggagccccttaccgcctcaatgcttgctgctgcacctcttcacgaacagaagcagatgatcggaacgtgttacctggtcctgaagcgttggtccgactggatggttttgagcttccttccactcctactgtcatgtgatttcgagggatcagtctctacgcccctgtctatgatgtctaccccaagctggctggcccggagtcgggcatgctgttggcgactgacaacccagagttgctgctcatgctggagcctccaaaatccaagtatgcctcgcaaaggtaatccccgctttcacggctgtcagaaagatagcgtgtccggctcacagccttag

SEQ ID NO: 49611 - DNA, 507 bp, Artificial Sequence
  Description of Artificial Sequence: Synthetic coding sequence
atggtgcggccccccgtggtgccccggcggccccccgcccacatctcatccgtccgacaagcatctacacaggtgccgaggacagttccccacactcagagggtagccaatattggaacccagacgactgggccatccggagtgggatgctgtactcctgggaggcctctactcccgtgcaaatgcagcagcgcagctcactctacataccgtgtacaggagccagccgtgcacatcccgggccaagagcctctaacagcttcaatgctcgcagccgctcccctccatgaacagaagcagatgataggtgagaggctgtatcctttgattcacgatgtgcacacccagctcgccggtaagatcacaggtatgctgcttgaaatcgacaatagcgagttacttttaatgttggagagcccagagtccttgcacgcgaagattgacgaggcagtcgcagtcttacaggcccatcaggctatggagcaaccaaaggcctatatgcattag

SEQ ID NO: 49612 - DNA, 459 bp, Artificial Sequence
  Description of Artificial Sequence: Synthetic coding sequence
tgacaggccagcacccaggtgccccggaccgtgccccacacccagagagttgcgaatataggaacacagacgaccggtccaagcggtgttggatgctgtactcccgggcgccccttacttccgtgtaaatgtagcagcgcagctcactcaacttatcgggttcaggagcctgcagtgcatattcccggccaggaaccacttaccgcctccatgctagctgccgctccgctgcacgagcagaagcagatgatcggcgagcgactttacccgttaattcacgatgtgcacacccagctggccgggaagattaccggaatgcttctagaaattgataacagcgagctgctgctgatgctggaatcccctgaatctctgcacgcaaaagctcagaggagaaaagtacagcggcttgtcaaatatatactcgcacttaaggagctgagcacccagaacttatag

SEQ ID NO: 49613 - DNA, 513 bp, Artificial Sequence
  Description of Artificial Sequence: Synthetic coding sequence
atggtgcggccccccgtggtgccccggcggccccccgcccacatcagttctgtacgtcaagcttctacacaggtgcctagaaccgtccctcacacacaacgggtggctaacattggaacacagactacggggcccagcggggtggggtgctgcacacctgggcggcctctcttgccttgcaagtgttcctccgcggcccactctacttatcgggtgcaagaaccggcggttcatatccccggccaagaaccgttaacagccagcatgctggctgccgctccgctgcatgagcagaaacagatgattggagaacggctgtatcctctaattcacgatgtacacacccagctcgcgggcaaaattactggtatgctgctcgagatagacaattccgaactgctcctcatgctggagtctcccgagtcactgcacgccaaggcccagaggagaaaggtccagaggctggtgaagtacatattggctttgaaggagttgtcaacacaaaatctttag

SEQ ID NO: 49614 - DNA, 993 bp, Artificial Sequence
  Description of Artificial Sequence: Synthetic coding sequence
atgaacgccagcggcagcggctaccccctggccagcctgtacgtgggagatctgcatcccgacgttaccgaggcaatgctgtatgagaagtttagcccagccggaccgatactaagcattcgcgtatgccgggatgtggctacaaggagatcgctcggctatgcctatatcaactttcagcagcctgctgatgctgagagggcactcgacaccatgaactttgagatgcttaagggtcagccgatcaggataatgtggtcacagagggatccgggacttaggaaaagtggagtgggaaacatttttatcaaaaaccttgaggatagcatcgataacaaggctctgtacgacactttctccacatttggaaacattctgagttgcaaggtggcttgcgacgagcacggctctaggggctttggctttgttcatttcgagactcacgaagcggcacagcaagccattaatactatgaacggcatgctgctcaatgatagaaaggttttcgtgggacacttcaagtctcggagggagagagaggctgaactgggggcccgggcactggaattcaccaacatctatgtgaagaatctccccgtggatgtggacgagcaaggcttacaggatttattctctcagttcggcaaaatgctgtctgtgaaagtgatgcgtgacaactcaggtcacagtagatgctttggcttcgtgaattttgagaagcacgaagaagcccagaaagccgtggttcacatgaatgggaaagaagtatcagggagactgctgtatgctggaagagctcagaaacgtgtggaacggcagaatgagctgaaacggagatttgagcagatgaagcaggataggctgaggcgctaccagggagtgaatctgtatgtgaaaaacctggatgactcgatagatgacgacaaactgaggaaggagtttagcccctacggtgtgatcacgagtgctaaaaaacgccgccagcggccctag

SEQ ID NO: 49615 - DNA, 603 bp, Artificial Sequence
  Description of Artificial Sequence: Synthetic coding sequence
atggccagcctgtacgtgggcgacctgcaccccgaggtgaccgaggctatgctgtacgagaagttcagcccagccggaccaatactgtcaatccgaatctgcagagataagatcacccgacgcagcctgggctacgcttacgttaactaccaacaaccagtggacgctaaaagagccttggagacccttaacttcgatgtcatcaagggcaggccagtccgtattatgtggtcacagcgtgatccctccctaagaaaatcaggagtggggaatgtctttattaaaaatctggggaagaccatagacaacaaagctctgtacaatatcttcagcgcatttgggaacatattatcatgcaaagtcgcatgtgatgagaaaggacctaaaggttatggcttcgtgcacttccagaaacaggaaagtgctgaacgggcaattgacgtgatgaatggcatgttcctcaactacagaaagattttcgtaggcaggttcaagtctcacaaagaaagagaagctgagcgaggggcctgggccagacagagtaccagcgcagacgtgaaggatttcgaagaagacaccgatgaggaggcaacactcaggtag

SEQ ID NO: 49616 - DNA, 603 bp, Artificial Sequence
  Description of Artificial Sequence: Synthetic coding sequence
atggccagcctgtacgtgggcgacctgcaccccgaggtgaccgaggcaatgctttatgagaaattttccccagcgggacccattctcagtatccgtatctgcagagacaaaattacccggagatcgctgggatacgcttacgtgaactaccagcagcccgtggatgctaagagagcactagaaactttaaatttcgatgtgataaaaggccgaccagtgcgcatcatgtggagtcaacgggatcccagtctcaggaaaagcggggtgggtaatgtgtttattaaaaaccttgggaagacaatagacaacaaagccttgtataacattttcagcgccttcggaaatatcctgtcctgtaaggtggcctgcgacgagaaaggaccaaaaggctatggctttgttcactttcagaaacaggagagtgctgagagagccatcgatgtgatgaatggtatgttccttaactataggaagatctttgtgggcaggtttaaatctcacaaggagcgggaggccgaaaggggagcctgggctcggcagtccacgagtgccgacgtgaaagattttgaagaggacacggatgaggaagctaccctcaggtag

SEQ ID NO: 49617 - DNA, 603 bp, Artificial Sequence
  Description of Artificial Sequence: Synthetic coding sequence
atggccagcctgtacgtgggcgacctgcaccccgaggtgaccgaggccatgctgtatgagaagtttagcccggctggaccgatccttagtattagaatctgtagggataagatcactagaaggagcctgggatacgcatacgtaaactaccagcagcccgtggacgccaagcgcgcactggaaaccttgaacttcgatgtgattaaggggcggccagtgcgcataatgtggagccagcgcgacccatccctaagaaaaagtggggtggggaacgtgttcattaagaaccttggcaagaccatcgacaacaaagctctctataatattttctccgccttcggtaacattctgtcttgcaaggtggcatgcgatgaaaagggaccaaaaggctacggattcgtccactttcaaaagcaggaaagtgccgaacgagccatcgacgtgatgaacggcatgtttctaaattatcgaaaaatcttcgtgggcagatttaagagtcataaggagcgcgaagccgagcgaggcgcatgggccaggcagtctacctctgctgacgtcaaggattttgaagaggacaccgatgaagaagcaacactacggtag

SEQ ID NO: 49618 - DNA, 603 bp, Artificial Sequence
  Description of Artificial Sequence: Synthetic coding sequence
atggccagcctgtacgtgggcgacctgcaccccgaggtgaccgaggctatgttgtatgaaaaattcagccccgccgggcctatactgtctattcggatctgccgtgataagatcactcgacggagcctgggttatgcatacgttaactaccagcagccagtggacgctaagagggccctcgagacgctcaactttgacgttatcaagggtagacctgtgagaatcatgtggtcccagagggatcctagcctgcgtaaaagcggagtggggaacgtgtttatcaagaatctgggaaaaactatcgacaacaaggcactctacaacatcttttcggcttttggaaatatattgtcctgtaaagtggcctgtgatgaaaagggcccaaaagggtacggctttgttcacttccagaaacaggagtcagccgaacgagcaattgatgttatgaatggaatgtttctgaattatcggaagatcttcgtggggagatttaagtcgcataaagagagagaggcagagcgcggtgcgtgggcccgccagtctaccagcgctgatgtgaaagatttcgaggaggatacagacgaagaggctacccttcggtag

SEQ ID NO: 49619 - DNA, 1134 bp, Artificial Sequence
  Description of Artificial Sequence: Synthetic coding sequence
atgagcggcagcgacggcggcctggaggaggagcccgagctgagcatcactctgacgctgagaatgctgatgcatggaaaggaagtaggcagcataataggtaagaaaggagaaactgtgaagcgcatcagagagcaaagctctgcccggattactatcagtgaagggagttgtcccgaacgcatcactaccattacaggatccacagcagccgtgtttcatgcagtctccatgatcgcgtttaagcttgatgaagatctgtgtgctgctccggctaatggaggaaatgtcagtaggccaccagtgactttgaggctcgttatcccggcatcccaatgcggcagcctcatcggaaaggctggtacaaaaattaaggaaatacgcgaaaccacaggagctcaggtccaggtcgccggcgacctactgcccaacagtaccgagcgagctgtcaccgtttctggtgtgccggatgcaatcattctttgcgttaggcagatctgtgccgtaatccttgagtcccctccaaaaggtgccacaatcccctatcatcccagcctcagcctgggaacggtgcttctctccgccaatcagggatttagcgtgcagggtcagtacggcgccgttacacccgcggaggttacgaaactacagcagctttcttcacacgctgtgccatttgccaccccatctgtggtccctggcctagacccaggcacccagacctccagccaggagttcctcgttcctaatgaccttattggttgcgtgatcggtaggcaagggtctaaaatttcggagattagacaaatgagtggagctcatatcaaaatcggtaaccaagccgaaggggcaggcgagagacatgtaacaattactggtagtcccgtatctatcgctctcgctcaatatttgatcactgcttgtctggagacagccaagtctacatccggtggcaccccgtcgtccgctccagctgacctgccagccccctttagtcctcccttgacagctccgcagctgcctctcgcttgttgggcccaccctatgccttcccccagtcctacctctagcgcacaagcgcacgccttgctcggcttcaccacttgctttcctcgcgccgccgcggggttgtag

SEQ ID NO: 49620 - DNA, 732 bp, Artificial Sequence
  Description of Artificial Sequence: Synthetic coding sequence
atgatcgccttcaagctggacgaggacctgtgcgccgcccccgccaacggcggcaacgtaagccgtcctcctgtgacactacgcctcgttattcccgccagtcagtgtgggagcctcatcggaaaagcaggaaccaagattaaagaaattagggaagttactaaacttcagcaactttcatcgcacgctgtgccctttgcaactcctagtgtggtaccagggctggaccccggaacacagactagttctcaggaatttctggtccccaacgacctgataggatgcgtgattggacgccagggcagcaagatcagcgagattcgtcaaatgtctggtgctcacataaagatcggcaatcaagccgaaggtgccggggagcgacacgttactattacagggtccccagtcagcatcgcactggcacagtacctcatcacagcctgcctcgagaccgctaaatcaacctctggtggaacaccatcttccgcccccgccgatctccctgctcctttctcaccgccattgacagccctgccaacagcaccgcctggcctgctgggcacgccttacgctatctccttatccaattttataggacttaagccaatgccttttctggccctcccacctgcctcaccagggccccctcctggcctcgctgcctacacagctaaaatggcagccgcaaacggaagcaaaaaagccgagaggcagaagttcagcccctattag

SEQ ID NO: 49621 - DNA, 1275 bp, Artificial Sequence
  Description of Artificial Sequence: Synthetic coding sequence
atgccccggtgccccgccctgatcctgtacctgcagagcagcgccagaattacaatctcagaggggagttgcccggaacggatcaccaccatcactgggagcaccgccgccgttttccacgccgttagcatgattgcattcaagctggatgaggacttgtgcgccgcaccggctaacggaggcaatgtcagtcggccacctgtcaccctgaggctggtaatccccgcgtcccagtgcggctcgctgatcgggaaggcaggtactaagatcaaggaaattagggaagtcaggggtgaaatctatcacccacagggtatcagaggcaaaggtgcagtagttcgaggcgtgcttggcctttggcgccccccacatctggagagcagtgaaccaggacagccctttagcggactctgggaacagcctgaggtcgcgccagtgctgtgcttacagaccaccggagcacaggtccaggtagctggagatcttctgccaaactccaccgagagggcagtgaccgtgtcgggggtaccagatgcgattatcctgtgtgtgcgacagatctgtgctgtgatactcgagagccctccgaaaggcgctacaattccctaccacccctctctgtcccttggcacagtgcttctgagcgccaatcagggattttcagtgcaaggccagtatggtgccgtaactccagccgaagtgacaaaactgcaacagctgtcctcccatgctgttcccttcgcaacgcccagcgtggtgccgggtctagaccccggaacacagacgtctagtcaggaattcctcgtgccaaacgacctgataggctgtgtgatagggcggcagggttccaagatttcagagatacggcagatgtccggcgctcacatcaagattggcaaccaggctgaaggtgccggcgagcggcacgtcacaataactgggtctccagtaagtatcgcgctggcccaatacctcatcacggcctgtttggagaccgcaaaaagtaccagtggcgggaccccaagcagtgcccccgccgacctgcctgcccccttttctcctcctctcacggccctccctaccgcccccccaggactacttggcaccccctacgcaatctctctgtcaaattttatcgggctaaagcccatgccttttttggcactccctccagcgagtcctggacccccccctggcctcgccgcctacaccgccaaaatggccgccgccaacggaagcaaaaaggcagagcgacagaaattctccccatactag

SEQ ID NO: 49622 - DNA, 1083 bp, Artificial Sequence
  Description of Artificial Sequence: Synthetic coding sequence
atgagcggcagcgacggcggcctggaggaggagcccgagctgagcattacactgacactgaggatgctgatgcatggaaaggaggtggggagcatcatcggcaaaaaaggggaaactgtcaaaagaatccgcgagcagtcctccgctcgcatcacaatttcggagggatcatgtcctgaacggataaccactatcacaggaagcacagcagcagtcttccatgctgtctccatgattgccttcaaactggatgaagatttgtgcgcggcccctgccaatgggggaaatgtgtcccggccccccgtaaccctgcgacttgtcatccctgcttcgcagtgtggcagtctgattggtaaggccggtacgaaaatcaaagaaataagggaatccccacccaaaggcgcaactatcccctaccacccttccctgtccttaggaaccgtccttttgagtgccaaccagggattttccgtgcagggacaatatggggctgtcacccccgctgaagtgactaaactccagcagctctccagccatgccgtgcccttcgccacgccaagcgtggtgccagggctggaccctggaactcagacatcttcacaggagtttctggttcctaatgatttaatcggctgcgtgatcggacgtcagggcagcaagatctccgagatccgacagatgtctggcgctcacattaagatcggtaaccaggcggagggcgccggcgagcgacacgtcacaataacggggtctcctgtgagcatcgctctggctcagtatcttattaccgcctgtctcgagactgcaaagtccacctctggcgggacacctagttcagctccagctgatctccccgcccctttctcccctcccctgaccgctctaccaactgccccaccggggctgctcggcacaccatacgccataagcctgagcaattttataggactcaagccaatgcctttcctagctctgccacctgcatcccctggacctccgcccggcttggccgcatatacggctaagatggctgctgcaaatgggtcaaagaaagcagaaaggcaaaaattttcaccatactag

SEQ ID NO: 49623 - DNA, 141 bp, Artificial Sequence
  Description of Artificial Sequence: Synthetic coding sequence
atgagcggcagcgacggcggcctggaggaggagcccgagctgagcatcaccctgacgctgaggatgttgatgcatggcaaagaggtgggaagcatcatcgggaagaagggtgagacggtgaaaagaattcgtgaacagtag

SEQ ID NO: 49624 - DNA, 375 bp, Artificial Sequence
  Description of Artificial Sequence: Synthetic coding sequence
atgagcggcagcgacggcggcctggaggaggagcccgagctgagcattacgctgacgctgcgcatgctcatgcatgggaaggaggtgggcagtataataggcaaaaaaggagaaactgttaagaggatccgtgagcaaagcagcgcaaggattaccatatccgagggctcttgtcccgaacgaatcaccaccatcactggatccactgccgctgtgtttcacgccgtctcaatgatcgccttcaaactcgatgaagacctttgcgcagctccagccaacgggggtaacgtgtccagaccccctgtcacactccggctggtgattcccgcgtctcaatgtgggtccctgattggaaaggcgggtacaaagatctag

SEQ ID NO: 49625 - DNA, 507 bp, Artificial Sequence
  Description of Artificial Sequence: Synthetic coding sequence
atgagcggcagcgacggcggcctggaggaggagcccgagctgagcatcaccctgaccctgcggatgttgatgcacgggaaggaagtaggaagcattattgggaagaagggcgagacggtgaaacgtattagggaacagagcagcgcacgcattaccatctcagagggaagctgtcccgaacgcatcacaactatcaccggcagcactgccgccgtcttccatgcagtcagtatgatcgctttcaagttggatgaggacctctgcgcagcacctgccaatgggggcaatgtgtcgagaccccccgtgaccctgaggctagtaataccagcctctcaatgtgggagtctcattgggaaggcgggcactaaaattaaagagatccgggaaactactggtgcccaggtccaggttgcgggggacctgcttcccaacagcactgagagagccgttactgtgagtggtgttcctgacgcgatcatcctttgcgtccggcagatttgcgcctag

SEQ ID NO: 49626 - DNA, 228 bp, Artificial Sequence
  Description of Artificial Sequence: Synthetic coding sequence
atgagcggcagcgacggcggcctggaggaggagcccgagctgagcatcacactcaccttgcggatgttgatgcacggaaaggaagtcggctctatcatcgggaaaaaaggtgaaaccgtgaaacggatacgtgagcagagttccgcccgcatcaccatttccgagggaagctgcccggaacgcatcaccacaataactggttctaccgccgccgtatttcacgcctag

SEQ ID NO: 49627 - DNA, 1083 bp, Artificial Sequence
  Description of Artificial Sequence: Synthetic coding sequence
atgagcggcagcgacggcggcctggaggaggagcccgagctgagcatcaccctaaccctgagaatgttgatgcatggcaaggaagttggcagtattattggaaaaaagggcgagaccgtgaaaaggataagggaacagagctcagccaggatcacaatttccgaggggtcttgccccgaacggattactacaattacaggaagcactgccgctgtgttccatgccgtttccatgatcgcctttaagttagatgaggacctgtgcgcagcccccgccaacggcggcaacgtcagcagacccccagtgactctgagattggtgatcccagctagccagtgcgggtctctcattgggaaagccggtaccaagatcaaagagatcagggagtccccccccaaaggggctaccatcccgtatcatccaagcctgtctctaggtactgtgctcctcagcgccaaccaaggtttttctgtgcaagggcagtacggggccgtcacccctgccgaggtgacaaagttacaacagctcagcagccacgcagttcctttcgcaacgccaagcgtggtgcctggcctggatcccggaacccagactagcagccaggaatttttggtaccgaatgatctgattggttgtgtgatcggtcgccagggctcaaaaatttcagagattcgccaaatgtccggggcgcacatcaagattggcaaccaggccgaaggcgccggggaacggcacgtgaccattacgggatctcccgtgtcaatcgccctggcacagtatcttataacagcctgtctcgaaactgccaaaagcacttccggcggtacaccaagctctgcacccgccgacctgccagcaccattctctccccctttgactgcccttcctacagcaccccctgggctgcttggcaccccatatgctatcagcctcagcaattttatcgggttaaaaccaatgccgtttttggcacttccaccagctagccctggcccgccaccaggcctggcagcatatactgcgaaaatggcagccgctaatggatcaaagaaggccgaaaggcaaaaattcagcccttattag

SEQ ID NO: 49628 - DNA, 279 bp, Artificial Sequence
  Description of Artificial Sequence: Synthetic coding sequence
atgagcggcagcgacggcggcctggaggaggagcccgagctgagcattaccctgacgctgcgtatgctcatgcacgggaaagaagtgggctctattattggaaagaagggagagaccgtgaaacgaataagagaacagtcctccgctcggattactatctcagaggggtcttgtcccgagagaatcacaactattacaggcagtaccgcggccgtatttcatgctgtgagcatgatcgcttttaagctcgacgaggatttatgtgccgcccccgcctag

SEQ ID NO: 49629 - DNA, 261 bp, Artificial Sequence
  Description of Artificial Sequence: Synthetic coding sequence
atgagcggcagcgacggcggcctggaggaggagcccgagctgagcattaccctcacattgagaatgttgatgcacggcaaagaagtaggtagcatcattggcaagaagggggagacagtcaaaagaatccgggaacagtctagtgcccggattacaatctctgaaggtagctgccccgagcggataaccaccatcactgggtccacggccgccgtgttccacgccgtgagcatgatcgcattcaagctggatgaggtctag

SEQ ID NO: 49630 - DNA, 324 bp, Artificial Sequence
  Description of Artificial Sequence: Synthetic coding sequence
atgagcggcagcgacggcggcctggaggaggagcccgagctgagcatcactctgaccctacgcatgcttatgcatggcaaggaagtgggctcaattattgggaaaaaaggagagactgtgaagcggattcgcgagcaaagcagcgctagaattacgattagcgaggggtcatgccccgaaaggatcaccactattaccgggagcacagccgcagtgttccacgccgtcagtatgattgcattcaagcttgatgaagatctgtgcgctgcgcctgctaatggcggcaatgttagtaggccccctgtcaccctacgtctggtatag

SEQ ID NO: 49631 - DNA, 3024 bp, Artificial Sequence
  Description of Artificial Sequence: Synthetic coding sequence
atgaaggacgaggccggcgagcgggaccgggaggtgagcagcctgaacagtaagctgctttccctgcagctcgacatcaaaaatcttcatgatgtctgtaaaaggcagcggaaaacactgcaggataatcaactgtgcatggaggaggctatgaacagtagccacgacaagaaacaggctcaagctcttgccttcgaggaatccgaagtggaatttgggtcctctaagcaatgtcatctgagacagctgcaacagctgaagaaaaaactgctcgtcctgcagcaggagctcgaattccatacagaggagttgcagacttcatattacagccttcgacagtaccagtcgatattggagaagcagacctccgacctggttctgctgcaccatcattgcaagctcaaagaagacgaggttattctatatgaggaggaaatgggcaatcacaatgagaacacgggcgagaagttgcacctggcccaggagcagctagctctcgcgggtgataagatcgcgagcctggagcggtccctgaacctttatcgagataaataccagtcttctttaagcaatatcgagctgctggaatgccaggttaagatgctccagggggagcttggcgggatcatggggcaagagcccgaaaataagggcgaccattcaaaagtgcggatctacacatccccgtgtatgatccaagagcaccaagagactcagaagaggctgagcgaggtatggcagaaggtgagtcaacaggacgacctgatccaggagctaaggaacaaattagcctgctccaacgctttagtcctggagcgggagaaagcccttataaaactccaggctgattttgcctcttgtaccgccacacataggtaccctccctcctcgagcgaggaatgtgaggacatcaaaaagatcctgaagcatctgcaggagcagaaggacagccagtgcctccacgtggaagaatatcagaacctggtcaaagatttaagggtggaattggaagccgtctctgaacagaagcgtaatatcatgaaagatatgatgaaactcgaactggatcttcacggactcagggaggagaccagtgcccacattgaaaggaaagacaaggacattaccatcctgcagtgcagactgcaggagctgcagctggaattcacagagacgcagaagctgactttaaaaaaagataaattcttacaggagaaagacgagatgctccaagaactggagaagaaacttacacaggtgcagaactctctgctgaaaaaggagaaggagctagagaaacagcagtgcatggcaaccgaattagagatgacagtgaaggaagccaaacaggataagtcaaaggaggccgagtgcaaggctctccaggcggaagttcagaagctgaaaaacagcctagaggaagctaaacagcaggagcggctggctgcacagcaggctgcacagtgcaaggaggaagcagctttggccgggtgtcacctggaggatacccagagaaagctgcaaaagggacttctcctcgataaacagaaagcggataccattcaggaactccagcgcgaattgcagatgctgcagaaggaatcttcaatggcagagaaggagcagacatccaaccgtaagagagtggaggaactgagtcttgagctgagtgaagctctgcggaaactagagaattcagataaggaaaaacgccaactgcaaaagaccgtggccgaacaggatatgaagatgaatgacatgttggataggatcaagcatcaacaccgcgagcagggcagcatcaagtgtaagctcgaggaagacctacaggaggctaccaagctcctcgaggataagagggagcagcttaagaagagtaaggagcacgagaagctgatggaaggtgaacttgaggctctcagacaagagttcaagaagaaagataagacacttaaagaaaactcacggaaattagaagaggaaaacgaaaacctgagagccgagttgcaatgctgtagcactcagctcgaatcctctctgaataaatataacacgagtcaacaagtcatccaagacctgaataaagagatcgccctgcaaaaagaatcccttatgagtctgcaagcacaactggataaagccctacagaaagaaaaacattatttgcagaccacaataacaaaagaagcttatgacgcactgtctcgcaagtctgcagcttgtcaagatgatctgacacaagcattggagaagctgaaccatgtgactagtgagactaaaagtctgcaacagtctttaacgcagactcaggaaaaaaaggcacaactggaggaggagatcatagcttacgaagaaagaatgaagaaactcaatactgaacttcgcaagttacgcggattccatcaagaaagcgaactggaagtacacgcctttgataaaaagctggaagagatgtcttgtcaggttttgcaatggcaaaaacagcatcagaacgaccttaagatgttggcagccaaggaggaacagctgagggagtttcaggaggagatggcagccctcaaggaaaacttactcgaggatgataaagaaccttgttgtctccctcagtggtccgtacccaaggatacatgtagactgtatcgaggcaacgaccagattatgactaacttggagcagtgggctaagcagcaaaaggtggccaatgaaaagctggggaatcagttgagggaacaggtcaagtacatcgctaaactgtcaggcgaaaaagaccacctgcactcggtgatggtacacctccagcaggagaataagaagctcaagaaggagatcgaggagaagaaaatgaaagccgaaaacacccggctttgtactaaagccctggggccttctaggacagaatccacccagcgcgagaaggtttgcggtactctggggtggaagggccttccccaggacatggggcagagaatggatttgactaaatatatcggtatgccacactgcccaggatccagttactgttag

SEQ ID NO: 49632 - DNA, 2649 bp, Artificial Sequence
  Description of Artificial Sequence: Synthetic coding sequence
atgggcaaccacaacgagaacaccggcgagaagctgcacctggcccaggaacaactcgccttagccggagacaaaatcgcctctctggaacgcagtctaaatctctatagggataagtaccaatcttcattgtcaaacatcgagctgctagagtgccaggttaagatgttgcagggagagttgggcggcatcatgggccaggaacctgaaaataaaggcgaccactccaaagtgaggatctatacgtcaccctgtatgatccaggaacatcaagaaacacagaaaagattgagcgaggtctggcagaaggtgagtcaacaggacgatctcattcaagaactgcgcaataaactggcctgctccaacgcgctggtgctggaaagggagaaggcactgatcaagttgcaagcggactttgcaagctgcactgccacccatagatatcctccatcctcaagcgaagagtgcgaggatatcaaaaaaatcttgaagcacttgcaagaacagaaagattcccagtgtctgcacgtagaggagtatcagaacttggtaaaggacctgagagtggagttggaagccgtgtctgagcagaagcgaaacatcatgaaagacatgatgaaactggagttggatctccacggcctccgggaggaaacttcagcgcacatcgaacgaaaagataaggatatcaccatactgcagtgtagactgcaggagctgcagttagagtttactgagacccaaaaacttacattgaagaaagacaaattcctgcaggagaaagatgaaatgctgcaggagctggaaaagaagctgacacaggtgcagaactctctacttaagaaggaaaaggagctggagaagcaacagtgtatggctaccgaactcgagatgacggtcaaagaagccaagcaagacaagagtaaggaagccgagtgtaaggcattgcaggcagaggtgcagaagctcaaaaatagcttagaggaagccaagcaacaggagagactcgccgcacagcaagctgcccagtgtaaggaagaggctgcgttggctggctgtcatctcgaagatactcagcggaagctccagaaaggcctgctccttgataagcaaaaggctgacacaatacaggagctacaaagagagctgcagatgttgcagaaggaatcctcaatggctgaaaaagaacagacatctaacagaaagcgagttgaagagttaagtcttgagctttcggaggctcttaggaaattggaaaacagcgacaaggagaagaggcagctgcagaagacagttgccgagcaagacatgaagatgaatgatatgctggatagaatcaagcatcaacacagagaacaggggtctatcaagtgtaagctggaagaggatctgcaggaagccaccaaactgttggaggacaagagggagcagctgaaaaagtccaaggaacatgagaaactgatggagggagagctggaagccctccgccaggaatttaaaaaaaaagacaaaacattgaaagaaaacagccgtaagctggaagaagagaacgagaatctaagggcagagctccagtgttgttccacccagctggagagtagcctaaataagtataatacatctcaacaggtgatccaggatctgaacaaagaaatcgcccttcaaaaagagtctctgatgtcgttgcaggctcaattggacaaggcactacagaaggaaaaacactaccttcagaccactatcaccaaggaggcctatgatgccctaagtcgaaaatcagctgcatgccaagacgacctgacgcaggctcttgaaaagctcaaccatgtaacatcagaaaccaaaagccttcaacagagcttgactcagacccaggagaaaaaggcccagctggaagaagaaattatcgcctatgaagagagaatgaaaaaactgaatactgaactgagaaaactaagaggatttcaccaggaatcggaactggaggttcatgcattcgataaaaagctggaggaaatgagctgccaagtgctgcaatggcagaagcagcaccagaatgacttaaagatgctcgccgctaaagaggaacaattaagagaattccaggaagagatggcagctctgaaagaaaatttgttggaggacgataaagagccttgttgcctgcctcaatggtccgtcccaaaagatacttgcagactctatcgcggcaacgaccaaattatgacaaaccttgagcagtgggccaagcagcaaaaggtcgcaaatgagaaactgggtaatcagctccgggagcaggtgaagtacattgcaaagttgtccggcgaaaaggaccgcgagccaacccgggcttcatcccctaacacaaccagaccatcttccccatcacattcccacctacattccgtcatggtgcacctgcagcaggagaataagaagctcaaaaaggaaattgaggaaaagaagatgaaggccgaaaacaccagattatgcactaaagccctcggacctagccgtacggaaagcacccagcgagagaaagtctgcggaactctcggctggaagggattgccccaggacatgggccagcgaatggacctcaccaagtacatcggtatgccccattgtccaggaagcagctactgttag

SEQ ID NO: 49633 - DNA, 474 bp, Artificial Sequence
  Description of Artificial Sequence: Synthetic coding sequence
atgaaggacgaggccggcgagcgggaccgggaggtgagcagcctgaactctaaacttctttccttacagctcgacatcaagaatctccacgacgtgtgcaaaaggcagagaaaaaccctacaggacaatcagctctgcatggaagaagccatgaatagctcgcatgataaaaagcaagcccaggctcttgccttcgaggaaagtgaggtggagtttggcagctcaaagcagtgtcacttgcggcaacttcagcaactaaagaagaagctgctcgttctgcaacaggagctggaattccatactgaggaactccagacttcatattactccctgaggcagtaccagtcgattctggaaaaacagacttcagaccttgtgctgctgcaccaccactgcaagctgaaggaggatgaagtcatcctctatgaagaagaaatgggcaatcacaacgagaacacaggagagaagttgtag

SEQ ID NO: 49634 - DNA, 207 bp, Artificial Sequence
  Description of Artificial Sequence: Synthetic coding sequence
atgaaggacgaggccggcgagcgggaccgggaggtgagcagcctgaattccaagctcctatctctccaactggacatcaagaacctgcatgatgtgtgcaagagacaaagaaaaaccctccaagacaatcagttgtgcatggaagaagctatgaattcctcgcacgacaagaaacaggcccaggcactggcattcgaagagtcatag

SEQ ID NO: 49635 - DNA, 3069 bp, Artificial Sequence
  Description of Artificial Sequence: Synthetic coding sequence
atgaaggacgaggccggcgagcgggaccgggaggtgagcagcctgaattcaaagctcctgtctcttcagcttgatattaaaaacctgcacgacgtatgcaaacggcagcgcaaaaccctgcaagataaccagctctgcatggaggaggccatgaatagctctcacgacaaaaaacaagctcaggcgctggctttcgaagagtcggaagtggagttcgggtcctctaaacagtgccatctgcgacagctccagcagctcaaaaagaaactactggtgcttcagcaggagctcgaatttcatacagaggagctgcagacgtcatactattctctaaggcagtaccagagcatactcgaaaagcagacctcggacctagttctcctacaccatcactgcaaattaaaagaggacgaggtgattctatacgaggaggaaatgggcaaccataacgaaaataccggagagaaactgcacttagctcaggagcagctggctctggcaggagataaaatcgcctcattggagcgctccttgaacttgtatagagataagtaccaatcaagcttgtctaatatcgagctgttagagtgccaggtcaagatgctgcaaggcgagctcggaggcatcatgggccaggagcccgagaacaagggcgaccatagtaaggtgaggatttacacgtcaccctgcatgatacaggagcaccaagaaactcagaagagattgtcagaagtatggcagaaggtgtcccagcaagacgatttgatccaggagctgaggaataagctggcttgcagcaatgccttggtgctggagcgagagaaggctcttatcaaacttcaggccgattttgcatcttgcacagcaactcaccggtaccccccgagctcatccgaggaatgcgaggacatcaagaagatcctcaagcatctgcaggaacaaaaagacagccaatgtctccatgtcgaggagtaccagaacctggttaaggacttaagagttgagctggaagccgtgagtgaacagaagagaaatattatgaaggacatgatgaaactggaactggatcttcatggattaagggaagaaacctcagctcatattgaacggaaggataaggacatcaccattctccagtgtcggctccaggagttgcagctggaatttacagagacacagaagctgacccttaaaaaggacaagtttctgcaggagaaggacgagatgttacaggagctggaaaagaagctgacgcaggttcagaacagcctgcttaaaaaagagaaggaactcgagaagcagcagtgtatggccacagagttagagatgaccgtcaaggaagccaagcaggataaaagtaaagaggcggagtgcaaagcgttgcaggctgaggtccagaaactcaagaatagtctagaagaagcgaagcagcaggagcgacttgccggggaagcacccgccgcgcagcaggcagcacagtgcaaagaggaagcggctctggccggatgccaccttgaagatactcagcggaagctgcaaaaagggcttcttctggataagcagaaagcagatactattcaggagctgcagcgagaacttcagatgctccaaaaggagtctagcatggcagaaaaagagcaaactagtaatagaaaaagagtggaggagctctcactcgagctgtccgaggcccttaggaagctcgaaaactctgataaggaaaagaggcagctacaaaaaaccgtcgctgaacaggacatgaagatgaacgacatgttggaccggattaaacaccagcatcgagagcaggggtcaatcaaatgcaagttggaagaggacctgcaggaagctacaaaactgctagaggataaaagagagcagctgaagaagtctaaagagcatgaaaaacttatggagggagagctggaggcccttcgccaagagtttaaaaagaaggacaaaacactgaaagaaaattcgcggaaactcgaagaagagaatgagaacttacgcgcagagctgcaatgttgttccacacagctggaatcctccctaaataagtacaatactagtcaacaggttattcaggatttgaataaagaaatcgcattgcaaaaggaatctttgatgtcactgcaagctcaacttgacaaggccctccagaaagaaaaacactatttacaaactaccattaccaaagaggcatatgatgcattaagccgtaaatcagctgcttgccaagacgatctgactcaggctctggagaagcttaaccacgtaacctcggagacgaaaagcctgcagcaatcacttacgcaaacacaagagaaaaaagctcaactggaagaggagatcattgcatacgaggagcggatgaagaagttaaacactgagctgaggaaattacgcggcttccaccaggagtccgagctggaggtgcacgcctttgacaagaagctagaggagatgtcctgccaggtattgcagtggcagaagcagcatcagaacgatctcaaaatgctggcagctaaggaagagcagttgcgcgagtttcaggaggagatggccgcactgaaggagaacctccttgaggacgataaagagccctgctgcctgccccagtggtccgtgcccaaagacacttgccgactctatcgcggcaacgaccagatcatgaccaatctggagcagtgggctaagcagcagaaggtggctaacgaaaaactggggaatcagctgcgtgagcaggtaaaatacatcgctaagctctcaggcgagaaggatcatctgcactctgtaatggttcacctccagcaggaaaataagaagctgaagaaagagatagaggagaaaaagatgaaagctgaaaatacgagactgtgcactaaggccctgggacccagtcgcactgaaagtacacagcgtgagaaggtgtgtggcaccctggggtggaaagggctgccacaggatatgggacaacggatggatcttacaaagtacatcggcatgccccattgcccaggcacctccgcaatttgtcaaaaaaacaagtgcgatttttttctttag

SEQ ID NO: 49636 - DNA, 333 bp, Artificial Sequence
  Description of Artificial Sequence: Synthetic coding sequence
atgaaggacgaggccggcgagcgggaccgggaggtgagcagcctgaatagtaaattgctctctttgcaattagacatcaagaatttacacgatgtttgtaagcgacagcggaaaaccctgcaggacaaccagctgtgcatggaggaagcgatgaacagcagtcatgataaaaagcaggctcaggccttggctttcgaagagagcgaagtcgaatttgggtcatctaaacaatgccatttgaggcagctacagcagctaaagaagaagctcctagtcctccagcaggagcttgaatttcatactgaagagctccagacatcctattattcatag

SEQ ID NO: 49637 - DNA, 144 bp, Artificial Sequence
  Description of Artificial Sequence: Synthetic coding sequence
atgaaggacgaggccggcgagcgggaccgggaggtgagcagcctgaacagcaaattgctatccttgcagttggacatcaagaatctccatgacgtttgtaagcggcagcgtaagaccctacaggacaaccagctgtgcatgtag

SEQ ID NO: 49638 - DNA, 1536 bp, Artificial Sequence
  Description of Artificial Sequence: Synthetic coding sequence
atggagagcaccggcagcgtgggcgaggcccccggcggcccccgggtgctggtggttgggggtggtatagccggcttgggcgccgctcagagattatgcggccacagcgcttttccacatctcagagtcctagaagctaccgcaagagcgggcggtagaatcagatccgaaaggtgtttcggcggagttgtagaagtgggggcgcactggatacatggtccatcccggggaaaccctgtgtttcaactcgccgccgaatacggcttgcttggcgagaaagaactctctcaggagaatcagcttgtggaaacggggggacacgtcggtctgcccagtgtgagctatgcctcgtccggcgcttctgtgtcgctgcagctcgtcgctgagatggcaactttgttttacggactcattgatcaaacacgggagttcctccatgccgctgagacccctgtaccttctgtaggggagtaccttaagaaggaaattggacagcatgtggctggctggactgaagacgaggaaactcgaaaattgaaactggctgtcctcaactccttctttaaccttgagtgttgtgtcagcggaacccattccatggacctagtggctttggccccatttggtgagtatactgtgctccccggtttagactgtacctttagtaaggggtatcagggcttaactaattgcatgatggccgcactgcccgaagacaccgtggttttcgagaaacccgtgaagaccatccactggaatggctcattccaggaagccgccttcccaggcgagacttttccggtgtcagtggagtgtgaagacggtgacaggtttcctgcacaccacgtgattgtgaccgtgccccttggcttcctcagagaacacctcgatactttttttgaccccccgctgccggctgaaaaagcggaagccatacgaaagatcggcttcggaacaaataacaaaatctttttagagtttgaagagccattttgggagccagattgtcagctgatccagttggtgtgggaggacacctcccccctggaagacgccgcacccgagctgcaagatgcctggttccggaaactgataggctttgtggtgttaccggctttcgctagcgttcacgttctgtgcggattcatcgcaggattagagagcgagttcatggagaccctgtccgacgaagaagtcttgctgtgtttaacacaggtcctgcgcagagttaccggtaatcctcgcttacccgcaccgaagtctgttttacgcagtcgctggcactctgccccatatacaagagggtcctactcctatgtggctgtgggatcaaccggcggagacctagatctcctggcacagcccctgcccgcggacggcgcgggggctcagctgcaaattctgttcgccggtgaagctacccaccggactttctattctaccacccacggagcccttctatcagggtggcgcgaagcagaccggctgctgtccttgtgggctccccaggtgcagcagcccaggccaaggctctag

SEQ ID NO: 49639 - DNA, 1461 bp, Artificial Sequence
  Description of Artificial Sequence: Synthetic coding sequence
atggagagcaccggcagcgtgggcgaggcccccggcggcccccgggtgctcgtagtcgggggcgggattgcaggactgggcgccgcccagcgactctgtggccattctgccttcccccatttgcgagttctggaagctactgccagagctgggggccggattagatctgaacgttgctttggcggcgttgttgaggttggagcacactggattcacggcccctctcgcgggaaccctgtattccagctcgccgcagaatatgggctcctcggagagaaagaactatctcaggagaaccagctggtcgaaacgggcggccacgtaggacttcccagtgtgagctacgcatctagcggagccagcgtcagccttcagttagtggccgaaatggcaacactgttctacgggctcatagatcagacacgtgaattccttcatgctgcagagaccccggttcctagtgttggcgaatacctgaaaaaggaaatcggacagcatgttgcgggatggacggaggacgaagagacccggaagctcaagctggcagttctgaactcctttttcaatttggaatgctgcgtgagcggcactcactcaatggatttagtcgcactcgctccatttggggagtacactgttctacccgggctggattgcaccttctcaaagggctatcagggactgaccaactgtatgatggctgcgctgcctgaggatactgtggtgttcgaaaaaccagtcaaaaccatccactggaacgggtccttccaggaggccgcgttccccggcgagacattccctgtgtccgtagagtgtgaagatggggatcgcttccctgctcaccatgtaatcgtaacagttcctcttggctttctcagggagcatctggataccttcttcgatccccccctacctgccgaaaaggctgaagccattcggaagataggctttggcaccaacaacaaaatctttttggagtttgaggagcctttctgggagccagactgtcagctgattcagctcgtctgggaagacaccagccccctcgaggatgccgccccagaactgcaggatgcctggttccggaagctgatcggatttgtggtgttgccagccttcgcaagtgttcacgttctgtgcgggtttattgctggactggaatctgaatttatggaaacccttagcgacgaagaggtactgctttgtcttacgcaggtactccggcgggtcactgcccccgacccagtgtgcggggggagccataccagccacgttcttctgcatgatgcaaggggatcagctgtgggaatggagggaggccgcccccccccacagagtgtcggaccggccggggccgcggctcaagcacaggctctagctggcccctcactcctgtgctccacacgcgtcggcggacgcttgggaccatcctttctcttgaccgatttcagcctcgcatag

SEQ ID NO: 49640 - DNA, 342 bp, Artificial Sequence
  Description of Artificial Sequence: Synthetic coding sequence
atggccaccctgttctacggcctgatcgaccagacccgggagttcctccatgcggctgagacgcccgtgccatccgtgggagaatatctcaagaaagagataggacaacatgtagcgggatggaccgaagatgaggaaacacggaaactcaagttagctgttctgaatagtttcttcaacctcgagtgttgcgtgtctggcacgcatagacgaacaggcttgtgctgtcgcgacggcggacgtcctacagccagctctgtgtgtggacctcgccggtgcagttcccccggccctgggtcttcctgggcccagccaacactgttccatccctgtagaggatag

SEQ ID NO: 49641 - DNA, 699 bp, Artificial Sequence
  Description of Artificial Sequence: Synthetic coding sequence
atggagagcaccggcagcgtgggcgaggcccccggcggcccccgggtgctagtggttggaggcggaattgccggactgggggccgcacagaggttatgcggccatagtgcctttccacacttgcgagtgctggaggctacagcccgggccgggggccggatccgatcagaacgctgcttcggcggagtggtggaggttggtgcccactggatccacgccgctcccgaactgcaggacgcttggttccgaaagctgataggcttcgtcgtactgcctgccttcgcgtccgtccatgtgctctgcggctttatcgcggggcttgagtcggagttcatggagacgctgtcagatgaggaagtgctcctctgtctgacccaggtattaaggcgtgtgacaggcaatcctcgactccctgctcctaaatccgtattaagaagtcgttggcatagcgcgccttatactcgtggtagctattcctacgtcgccgtcgggtccacagggggagacctcgatctgctggcccagcctctgcctgcagatggggcaggcgcccaattgcagatcctgttcgcaggcgaagcgacccatcgcacgttctacagtaccacccacggagccttgctcagtggatggcgggaagctgatcggcttctctccttatgggccccccaggttcagcaaccgcgaccgagactgtag

SEQ ID NO: 49642 - DNA, 210 bp, Artificial Sequence
  Description of Artificial Sequence: Synthetic coding sequence
atggagagcaccggcagcgtgggcgaggcccccggcggcccccgggtcctggtcgtgggtggaggaattgcgggtctgggagcagcacagaggctttgtggccatagcgcattcccacatctgagagtgcttgaggccacagcgcgagccggtggcagaattaggagcgagcgctgctttggtgcaataaaagacagtcagaccgcctag

SEQ ID NO: 49643 - DNA, 1392 bp, Artificial Sequence
  Description of Artificial Sequence: Synthetic coding sequence
atggagagcaccggcagcgtgggcgaggcccccggcggcccccgggttttggtagtggggggtgggattgcgggtctgggagctgcccaacgcctgtgtggacacagtgcttttcctcatctaagggtgctcgaggccacagcaagagccggagggcgaattcggtccgagcgttgttttggtggtgtggtcgaggtcggggcacattggattcatggcccctcacgcggcaaccctgtgtttcagttggctgcagagtacggtctgttaggggaaaaagagttatcccaggagaaccagctggtcgagacgggaggacatgttggcctaccgagcgtttcatacgcaagctctggcgcatccgtttctctccaactcgttgccgagatggctacgctgttctatggcctaatcgatcagaccagggaatttttgcacgccgcagaaaccccagtaccgtctgtaggagagtacctgaaaaaggaaatcggccagcacgttgctggttggactgaagatgaggagacacggaaattaaagctcgccgtcctcaattctttctttaatctcgagtgctgcgtgtctggcacacatagtatggacctcgtggcactcgccccattcggtgaatacacagtcttaccgggactcgactgtaccttcagcaaggggtatcagggcctaaccaactgtatgatggccgctctgcctgaagatacagtagttttcgaaaaacccgttaagactatccattggaatggcagttttcaggaggctgcgttccctggcgagacttttccagtatcagttgaatgcgaggacggcgatcgctttccagcccatcacgtaattgtcacagtacctttaggattcctgcgcgaacacctcgatacctctccgctggaagatgccgccccagaactgcaggacgcctggtttaggaagctcatagggtttgtggtgctgcccgcctttgcctcggtgcacgtactgtgcggttttatcgcaggtctcgagagtgaatttatggagactctgagcgatgaggaggtgctgctatgcctgacacaggttttacgaagggttacaggcaacccaagactgccagctcctaaatcagttttaaggagccgatggcacagcgcgccttatacacggggtagttatagctacgtagcggtgggcagcacggggggtgacttggacctgctggcccagccactccctgcggacggtgcaggtgcgcagctccaaatcctcttcgccggcgaagctacacataggactttttattcaacaacgcacggcgcccttttgtccggatggcgggaggctgaccgattgctaagtttgtgggcaccgcaagtgcagcagcccaggccgcgtctgtag

SEQ ID NO: 49644 - DNA, 252 bp, Artificial Sequence
  Description of Artificial Sequence: Synthetic coding sequence
atggagagcaccggcagcgtgggcgaggcccccggcggcccccgggttctcgtggtggggggtggaatatcacgaagctgtctcaggggcaagccccatattgcaagattcacgcctcgaaggacgggtttatgttgcagagacggcgggcgcccaactgcctcgtccgtttgcggtccccgacgctgtagcagtcctggacccggatcatcttgggcccagcctactctgtttcatccttgtcgcgggtag

SEQ ID NO: 49645 - DNA, 978 bp, Artificial Sequence
  Description of Artificial Sequence: Synthetic coding sequence
atggagagcaccggcagcgtgggcgaggcccccggcggcccccgggtactggtagtgggcggggggatcgccggcctgggggctgcacagaggctttgcgggcactcagcttttccacatctgcgcgtcttagaggccactgctcgagccggtggaaggattcggagcgagaggtgtttcggcggcgtggtggaagtgggcgcccactggatccatgggccctcccgaggcaacccggtgttccaattagctgcagaatatgggttgctgggcgaaaaggagttgtcccaggagaatcagctcgtcgaaacaggaggccacgtgggcttaccttcagtctcatacgcttcttctggggcgagtgtttccctgcagttggtggccgaaatggccaccctcttttacggactgatcgaccaaaccagagagtttctgcacgccgccgaaactcccgtgccgtcagtgggtgagtatttgaagaaggagattggccagcatgtagccggctggaccgaggacgaagagacccggaagttgaaacttgccgtgcttaatagcttcttcaatctcgaatgttgcgtgtcaggcacacattccatggacctagtggccttggccccttttggcgagtataccgtgctgcccgggcttgattgtactttcagcaagggttaccaaggtctgacaaattgtatgatggccgccctgcctgaagatacggtggtattcgagaaaccagtgaaaactatacattggaacgggtcgttccaggaagcagccttcccaggagagacctttcccgtttctgttgaatgtgaggacggcgatcggtttcctgcccaccatgtgatcgttaccgtgccactcggcctatcgacgttttcagtgggttcattgccagatctgtctttgtcgtcatggcgtctatgccggatgaagaaatatttttgtgtttctcccaaatgtagtggggaatag

SEQ ID NO: 49646 - DNA, 132 bp, Artificial Sequence
  Description of Artificial Sequence: Synthetic coding sequence
atggagagcaccggcagcgtgggcgaggcccccggcggccggcacggcccccgccggggccctcacccactgggtgccttgctgcggtggaggggcgggggaggtagggcattggatccatgctgcccttag

SEQ ID NO: 49647 - DNA, 2976 bp, Artificial Sequence
  Description of Artificial Sequence: Synthetic coding sequence
atgagcgccgtgggcctggtgctgctggtgctggccctgcggctgagagcaactacagtcaagcccgaagaggggagcttctgctcaaatagccaggtcgctttcagagacgcttgctatgaattcgtgcctttgggaagaacgtttcgggatgcccagtcctggtgcgaagggcaggggggtcatctggtctttatccaagatgaggggacccaatggtttctgcaaaagcatatcagtcaggaccgcgagtggtggatcgggctgacatggaacctggcacgcaatggtactacagagggcccaggaacatggttggatacaagcaacgttacttacagcaactggcacggcggacaggctgctgccgcacccgacacgtgcggtcacataggcagaggcccgagcagcgaatgggtgacgtccgactgcgctcagaccttcgctttcatgtgcgagttcagggtgggtcagagtttggcctgcgaggggctcaatgccactgtccactgtggtctgggacaggtcatccaggttcaagacgcagtctatgggagacagaatccccatttttgtactcaagatgccggccgcccttctgatctagagcagggctgttcctgggctaatgtgaaggaggaagttgctggacaatgccaagagctgcaatcatgccaggtagccgcggacgagacatattttgggaatctgtgtccaacccaggggtcatacctttgggtgcagtaccagtgtcgtgaagcactgcagctgatggtgtcgtcagaatctttcattttcgataatgtcactatttctttaacatggctgctgagcccttatatcggtaatctttcctgtattattagtaccggggacagtcacaccttcgacccatacaacccgccctccgtcagctcaaatgtcacacatcagtttaccagtcctggggagtttaccgtgtttgcagaatgcacaacaagtgaatggcatgtgactgcacagaggcaggtgactgtccgagacaagatggaaacattgtcagtgaccgcttgctcagggttgtctcagtccggggcaggcccgttgtgtcaggcagtctttggtgacccattatggatccaagttgaactggatggcggtaccggagtgacttacacggtcctcctaggtgacattaccctagccgagtccacgactcaaaagggctctctcccatacaacctgattctcgacagggagacccaaaaactgatgggccctggcagacaccggcttgagatccaagccaccggaaatacgaccacatccacaatctcccgcaatatcaccgtccaccttgttgaattactcagtggcttacaggctagttgggcctccgatcacctggagctggggcaagacctgctaatcactatttccctggcacaggggaccccggaagagctcaccttcgaggttgcaggcctgaatgctacttttagtcacgagcaggttagtttcggagagcctttcggcatctgtagactcgctgtcccagtggaggggacgtttctcgtgactatgcttgtgcgtaatgccttttctaatttatcactggaaataggtaatatcaccatcaccgctccctcaggccttcaggaaccatctgggatgaacgcagagggtaagtctaaagataagggcgatatggaggtgtatatccaaccaggaccctatgtcgacccattcacaacagtgacattgggctggcctgacaatgacaaagaactccgcttccagtggagttgcggaagttgctgggcactctggtctagctgcgtcgagaggcagttgcttcggacggatcaacgtgagctggtggtacccgccagctgcctgccaccaccggactccgccgtgacactgcgactggctgtcctccgcggacaggaactggagaaccgtgcggagcagtgcctatatgtgtctgcaccatgggaactgcggccaagggtctcttgcgaacggaactgtagacctgtgaacgccagcaaggacatccttctccgagtgaccatgggagaggactcacccgttgcaatgtttagctggtaccttgataacaccccgacggagcaagctgagccactgctggatgcttgtaggttgagagggttctggccacgctctttgacattactacagagcaatacaagcactctgttactgaattcttcctttttacagagtagaggcgaggtcatccgaattagagccactgctctgacgagacacgcttatggagaggacacgtatgtgatatccaccgtgccccctagggaggtgccagcctgcactattgctcccgaagagggtaccgtgctgacctcgttcgctatattctgcaatgcgagcacagcactcggtccgctcgagttttgtttttgccttgagtcgggatcatgccttcactgtggccccgaacccgcgctaccgtctgtgtatttaccccttggcgaggaaaacaacgatttcgtactaacagtcgtcatttccgccactaatagggccggggacacccagcagactcaagctatggccaaggtagccctcggtgatacgtgcgtagaagatgtcgcttttcaggccgccgtgtctgagaaaattcccactgcactgcaaggggaggggggaccggagcaattgctgcagctggccaaagccgtgtcctcaatgttaaatcaggaacatgaatcccaggggagcggacaatctctctcaatcgatgtgagacagaaagttagggaacatgtcctgggctctttgtccgccgtgacaactggacttgaagacgttcagagagtccaggagctagcggaggtgcttcgtgaggtgacctgtagaagtaaggaattaactccctctgcccagggtagctgcatgggagactcctgggaaggtgccccccctgctgcccacgtcagccatgctaggtag

SEQ ID NO: 49648 - DNA, 1560 bp, Artificial Sequence
  Description of Artificial Sequence: Synthetic coding sequence
tgactggcccagggcacccccgaggagctgaccttcgaggtggccggcttaaatgcgaccttctcccacgaacaagtcagtttcggtgagccctttggtatttgcaggctagcggtccctgtggagggaacattcctggtcacaatgctagtgaggaatgcattctccaatctaagtctggagatcggaaatatcactattacagcccctagcgggctccaagagccctccgggatgaatgcggagggtaaatccaaagacaaaggagacatggaggtctatattcagcccggaccatatgtggatcctttcaccacggttacactcggctggcccgacaatgacaaagagctccgatttcagtggtcctgcggcagctgttgggcactatggagctcctgcgtggaaaggcaattgctccgaacagaccagcgggaactggttgtgcctgcttcatgcttaccacctcccgattcggcagtgacccttcggctggcagtcttgcgtgggcaggagctggagaatcgggccgaacagtgcctgtacgtgagtgccccttgggagctaagacctcgggtttcctgcgaacggaattgtcgcccagtcaatgcctctaaagacatccttctgagggtcaccatgggggaggattcaccagtggctatgttcagttggtatttggataatacccctacagagcaggccgaacccctgctggacgcttgccgcctgcggggcttctggcccaggagtttaaccctgctgcagtctaatacttctaccctgctcctcaattcctccttcctccagtctcggggtgaggtgattcggattcgcgccaccgcgttgacccggcatgcatacggagaagacacctacgtgatcagtacagtgccgcctagggaggtgcctgcttgcaccatcgccccagaggagggcactgtattaactagcttcgccatcttctgcaatgccagtactgctcttgggccactagaattctgcttctgcctggagtccggcagctgtttacactgtggcccagagcctgccttgccctccgtctacttacccttaggagaggagaacaacgatttcgtcctgaccgtggtcatcagcgcaacaaaccgggctggggacacccagcagacccaggctatggcaaaagttgctctgggcgacacttgcgtggaggacgtcgcttttcaggccgctgtcagcgagaagatccctactgcgctccagggcgaaggcgggccggagcaactgctgcagcttgccaaagcggtcagctctatgcttaaccaagaacacgagtctcaggggtcaggccagagtctcagtattgacgtaaggcagaaagttcgggagcatgttctaggcagcctctcggctgttacgacaggtctcgaggatgtgcaaagggtccaggagctggccgaagttttgagggaggtgacctgcaggagcaaggaactgacccccagcgcccagggcagttgcatgggcgactcctgggaaggcgcacctcctgcggcccacgtgtcgcacgcaaggtag

SEQ ID NO: 49649 - DNA, 798 bp, Artificial Sequence
  Description of Artificial Sequence: Synthetic coding sequence
atgcccctgcccgtggccctgcagacccggctggccaagcggggcatactgaaacatctggagcctgagcctgaggaggagattatcgccgaggactacgacgacgatcccgtagattatgaagccacccgccttgaagggctgcctccctcttggtacaaagtgttcgatccatcctgtgggttaccgtactactggaacgcagataccgacctggtttcctggctcagtccccatgatccgaactccgtcgtgaccaagagcgctaaaaaactcagatcaagcaacgcggatgcagaggagaaactggaccgctcccacgataagtctgaccgcggtcacgataaatctgataggagccacgagaaattggaccggggacacgataagtccgaccggggccacgacaagtccgatcgagacagggagcgtggatacgataaggtggaccgggagcgagagagagatagggaacgcgatcgcgataggggctacgacaaggccgatagagaagagggtaaggaaagacgtcatcatagaagagaggagcttgccccttaccccaagtctaagaaagctgtttccagaaaggatgaggagctggatcctatggacccaagctcctattcagacgctccaaggggaacctggagcactgggctcccaaaacggaacgaggccaagactggggccgatactaccgccgcagggcccctgtttcaacagcggccctacccgtcccccggcgcagttctgagggccaatgcagaggcctcccggactaagcagcaggattag

SEQ ID NO: 49650 - DNA, 798 bp, Artificial Sequence
  Description of Artificial Sequence: Synthetic coding sequence
atgcccctgcccgtggccctgcagacccggctggccaagcggggcattctcaagcatctcgagcctgaacccgaagaggaaattattgccgaagactatgacgacgatcccgtggattatgaagccacaagattagaaggtctgccaccatcttggtacaaggtcttcgacccatcatgcgggcttccttactattggaacgccgatacagacctagtgtcatggctgagccctcacgaccctaattccgtggtgactaagagtgcaaagaaattgcgatcttcaaacgccgatgcagaagagaagctggaccggagccacgataagtctgaccggggccatgataaatctgaccggagccatgaaaagctggaccggggccacgacaaatccgatcggggccatgacaagtcagaccgcgacagagaacgggggtacgataaagtggatagggagagagaaagagatcgggaacgtgaccgagacagaggctatgacaaagccgatcgcgaagaggggaaagagaggcgacaccacaggagggaagaattagccccttatccaaaatcaaaaaaggctgtcagccggaaggacgaggagttggatcccatggatcccagcagctattcggatgctccgcggggaacttggagtaccgggctcccaaaacgaaatgaggccaagacaggtgctgatacaacagcggctggacccctgtttcagcaacgaccttacccttcacccggcgcagttctgcgagcaaacgccgaggcctcccggactaaacaacaggactag

SEQ ID NO: 49651 - DNA, 798 bp, Artificial Sequence
  Description of Artificial Sequence: Synthetic coding sequence
atgcccctgcccgtggccctgcagacccggctggccaagcggggcatcctgaagcacttggaacccgaacctgaagaagaaatcatcgccgaagattatgatgacgatcccgtagattacgaagccacacgattagaagggctgccccctagttggtataaggttttcgacccgtcttgcgggctcccttactactggaacgcagacaccgatctggtctcgtggctgagtccacacgaccccaactccgtagttactaagagcgccaagaagctccggtcttcaaacgccgacgcggaagaaaagctggacaggagtcacgataaatccgatagagggcatgataagtcagacaggtcccacgagaagctggaccggggccacgacaagagcgacaggggacatgacaagagtgatcgagacagagagagaggctacgacaaggttgacagagagcgtgagcgcgaccgggaacgcgatcgagacagaggttatgacaaggcggacagagaggaggggaaagagagacgacatcataggagagaagagctggccccatacccaaaatcaaaaaaggcagtgagccgaaaagatgaggaactggaccccatggacccttccagttattctgacgctcctagaggtacctggagtacaggcctccctaagcggaatgaagctaagacaggtgccgacacaaccgctgccggtcctcttttccagcaaagaccttaccccagcccaggggcagtgttgcgtgcaaacgcagaagcctctaggaccaagcaacaggattag

SEQ ID NO: 49652 - DNA, 513 bp, Artificial Sequence
  Description of Artificial Sequence: Synthetic coding sequence
atgcccctgcccgtggccctgcagacccggctggccaagcggggcatcttaaagcatctggagccagaacctgaggaagagatcatagcagaagattatgatgatgatccggttgactacgaagccaccaggctcgagggtctgccaccttcgtggtataaagtgttcgatccctcttgcggattaccatactattggaatgcagatactgacctggtatcatggttatcgccacatgacccaaattccgttgtgaccaaatccgcaaagaaactgcgctcttcaaacgccgccgtgagccggaaggatgaggagctcgaccccatggatcctagcagctatagtgatgctcctaggggaacttggtcgaccggactgcccaagcgaaatgaggcaaaaacaggtgctgataccacggccgctggcccactcttccagcaaagaccctatcccagccctggcgctgtcctccgcgccaacgcggaggcttctcgcaccaaacagcaagactag

SEQ ID NO: 49653 - DNA, 1446 bp, Artificial Sequence
  Description of Artificial Sequence: Synthetic coding sequence
atgtaccaggccagcgccgtgagcctgctgccccgggacatcccctcatgccactccccttccccaggcttctctcatttgccaacaagttcctcacagctcgcaccagacctcctgcagttccccctgggacaggacccgtctttcctcgctatcccaatcctgacactccccccatctgactccctggtgccgccttatattgtctggtacatcgtgtggccaagtgcgttaatttcgttcctgggatgcaccctgaccgtgcagttctctaatggtaaactgcagtcacctggaaatatgcggtttaccctgtacgagaataaggactctaccaacccccgcaagcggaaccagcggattttggctgccgaaactgatcggctttcctatgtcgggaacaatttcggtacaggcgccctgaagtgtaacacactgtgtcgccattttgttgggatcctgaacaaaacaagcggccagatggaggtgtacgacgccgaacttttcaacatgcagcccctattttccgatgtcagcgtcgaaagtgaactcgccctggagtcccagaccaagacttaccgcgagaagatggacagctgtattgaggcatttggcaccaccaagcaaaaacgagccctgaacacacgccgcatgaaccgggtgggaaacgaaagcttgaacagagccgtggctaaagctgccgagacaatcattgacacgaaaggcgttaccgcattagtgtccgatgctattcataacgatttgcaggacgattcgttatatttgcctccatgttatgatgatgctgccaagcccgaagacgtgtataagttcgaggacctgctcagccctgctgagtacgaagccctgcagtcaccttccgaagctttccgcaatgtgacgagcgaggagatcctgaagatgatcgaggagaacagccactgcaccttcgtgatagaggctctgaaaagcttaccaagtgatgtggagagccgcgaccgtcaggcaaggtgtatttggttcctggatacgctgattaaattcagggcccacagagtggtgaaaaggaaatctgccctcgggcccggcgtgccccatatcatcaatacgaaactccttaaacattttacctgcttaacctacaataacgggagactcagaaatctcatttctgatagcatgaaagcaaagataactgcatatgtcattatcctggctttacacatccatgattttcaaattgacctcacggtgcttcaaagggacttaaaactgagtgagaagcgtatgatggagatcgccaaggcaatgagactgaaaattagcaagagacgtgtgagtgtagccgccggtagtgaggaggaccacaaactaggcactctctctctgcccctcccacctgcccagacctctgatcgtcttgctaagaggaggaaaataacatag

SEQ ID NO: 49654 - DNA, 1260 bp, Artificial Sequence
  Description of Artificial Sequence: Synthetic coding sequence
atggccgccgaggtgctgcccagcgcccggtggcagtactgcggcgctcctgatggaagccagcgggctgtgctggtacagttttctaatggcaaattgcagagccccgggaatatgcgctttaccctctacgaaaacaaggacagcacaaatccccgtaagcgaaaccaaagaattctagctgcagaaacagataggctgagttatgtgggtaacaatttcggaaccggagcactcaaatgcaacaccctatgccggcattttgtgggaatcctcaataaaacaagcggacagatggaagtgtatgacgctgagctgtttaatatgcagccactgttcagtgacgtcagtgtcgaatctgaactcgccctcgagagtcagacgaagacctaccgcgagaagatggattcttgcattgaagcgttcggcacgaccaaacagaagagagctttgaacactcgccgcatgaatagggttggcaacgagagcctgaatcgggccgtagctaaagccgccgaaacaattattgacacaaagggcgtgaccgctctcgtgagcgatgccatccataatgatctgcaggatgatagtctgtatctccctccgtgctatgatgacgccgcaaagccagaggacgtttacaaattcgaagatctcctctcccccgccgagtacgaagcgctccaatcacccagcgaggcttttcgtaacgtgacctctgaggaaatactaaagatgatcgaagaaaacagtcactgcacattcgtgatagaagccctgaagtcgttgccttccgatgtggagtcacgcgacagacaggcccgctgcatttggtttctagataccttaattaaatttcgggcccatcgggtggtcaagagaaaaagcgccctcggccccggtgtgcctcatataatcaatactaaactgttgaagcacttcacgtgtctgacatacaataacggtcgactgcgtaatctgatttccgactctatgaaggcaaaaataacagcctacgtgattatcttggctttgcacatccatgacttccagattgacctcactgtactgcagcgggacttgaaattgtccgagaagaggatgatggagatcgcgaaggctatgcgcttaaagatatcaaaaaggcgcgtttcagtggcagctgggtctgaggaggatcataaactcggtactctctccttacccctccccccggcccagacctccgacagacttgccaagcgccgaaagatcacatag

SEQ ID NO: 49655 - DNA, 561 bp, Artificial Sequence
  Description of Artificial Sequence: Synthetic coding sequence
atggccgccgaggtgctgcccagcgcccggtggcagtactgcggcgcaccagatggctctcaacgagcagttttggtccagttttcaaacgggaaactgcagtcaccaggcaatatgcgctttaccctgtacgaaaataaggattcaaccaacccgagaaagcgcaaccagcgcatcttggcagctgaaactgatcgattgtcctacgtgggcaacaacttcgggaccggggcgctgaagtgcaacaccttgtgtcgccactttgtcggtatcttgaacaaaaccagcggacagatggaggtctacgatgccgagctcttcaatatgcagcccctattttcggatgtttcagtcgagagcgagttagccctggagtcccagactaaaacatatagggagaagatgacaccttccacgttccttccagctatgatgatgcagcctagcttgaagacttgtataaacttgaagatattcttccccttatggcgagccgagactgccaggccagatgcatatggattttggataccctcctccaatttcgagcttattggctag

SEQ ID NO: 49656 - DNA, 1050 bp, Artificial Sequence
  Description of Artificial Sequence: Synthetic coding sequence
atgatgctgaactgcagcacctgcagccactacttccaggtgttccaccaggagtccaaaataatcttttggaaagaaccgaggacatgcttcttgattcttagtctgccccttcctggcgagctgacatgggatgtgtccgtggagtctgagttggccctcgaaagccaaaccaaaacatatcgtgagaagatggacagctgtatcgaggcgtttggcacaaccaagcagaaacgggctttaaacacaaggcgaatgaaccgcgtgggaaatgaatctctgaaccgcgccgtggccaaggcggccgagaccatcatcgatactaagggagtcaccgcccttgtgagcgatgccatccacaacgatctccaagacgacagcctctacctcccaccctgctacgacgacgccgccaaaccagaggacgtgtataagttcgaagacctcctgtctccagccgagtacgaagcgctgcagtcaccgtcagaagcttttagaaatgtgacaagcgaagaaatcctgaagatgatcgaagagaacagccattgcacttttgtgattgaagcactgaagagtctgccaagtgatgtggaaagccgtgatcgtcaggcaaggtgtatttggtttctggatactctgataaagttcagagcgcacagggtcgtgaagagaaagtccgcgctgggtccaggcgtacctcatatcatcaataccaagctcttgaaacacttcacatgtctgacctacaacaatggcagactccgaaatctgatttccgacagcatgaaggccaagatcacggcttatgtcattatcctggctttacatattcacgattttcaaatcgacctgaccgtgctccagcgagacttgaagctgagcgagaaaaggatgatggaaatcgctaaggctatgcggctgaagatttccaagagacgcgtcagcgtcgcggccgggagcgaggaggaccacaagctcgggactctgagtctgccactgccccctgcacagaccagcgatcggcttgcaaagcggaggaaaattacttag

SEQ ID NO: 49657 - DNA, 588 bp, Artificial Sequence
  Description of Artificial Sequence: Synthetic coding sequence
atggccagccggggcggcggccggggccggggccggggccagctgaccttcaatgtcgaagcagtggggatcgggaagggcgatgctctacccccacctactcttcaaccctctcccttatttccccccctcgaatttagaccggtacccctgccttcgggagaagagggagagtacgtgttggccttgaagcaggaactccgaggcgccatgagacaacttccctatttcattagacctgcggttccaaagagggactggagacgcctgcctagggagcttaaaatccgtgtaagaaaactgcagaaggaaaggattactatcctccttcccaaacgtcctcccaagacaactgaagataaggaagaaacaatccagaagctcgagacgctcgagaagaaagaagaagaggttacctcagaggaagatgaggagaaggaggaggaggaagagaaggaagaagaggaagaagaggagtatgacgaggaggagcacgaggaggagactgactatattatgagctattttgacaatggcgaggatttcgggggggattccgatgacaatatggacgaggccatatactag

SEQ ID NO: 49658 - DNA, 657 bp, Artificial Sequence
  Description of Artificial Sequence: Synthetic coding sequence
atggccagccggggcggcggccggggccggggccggggccagctgaccttcaatgtcgaggcggtcgggatcggcaaaggagacgcactacctccccctactctgcagccttctcctctgtttcctccattggagttcaggcccgtcccattaccctcgggcgaggagggagaatacgtgctggccttaaagcaggagctccgcggcgccatgcgtcagctgccctactttatccgccccgccgtccctaaaagggatgtggagcgatattcagacaagtaccagatgtcggggccaattgataatgctattgactggaatccagactggcggcgcctccccagggaactgaagattcgggtgcgcaagttacagaaagagagaatcaccattctgctccccaagcgacctccaaagacaactgaggacaaagaggaaacaatccagaaactggagacactcgaaaaaaaggaagaggaggtcacctctgaagaggacgaagagaaagaggaagaagaagagaaagaagaggaggaagaggaggaatatgacgaagaagaacatgaggaagaaactgattatatcatgtcatactttgacaatggcgaggactttggaggtgacagcgatgataacatggacgaggcgatctattag

SEQ ID NO: 49659 - DNA, 1680 bp, Artificial Sequence
  Description of Artificial Sequence: Synthetic coding sequence
atggccaccgccaccatcgccctgcaggtgaacggccagcagggcgggggttctgaaccagccgcagcggccgcagttgtagccgcaggcgataaatggaagcccccccagggcactgacagcattaagatggaaaatggccagagtaccgccgcaaaacttggactacccccgctcacaccagagcagcaggaagccttgcagaaagcaaaaaaatatgccatggaacagagcattaagagcgtcctggttaaacagaccattgcgcaccagcagcagcagctgacgaatcttcagatggcagcggtgaccatggggttcggagatccgttgtcacctctacagtcaatggctgcccagcgacagcgggccttggctattatgtgtcgtgtgtacgttggtagcatttactatgagctcggagaggacactatacggcaggctttcgccccatttggacccattaaatctatagacatgtcctgggattcagtgaccatgaagcataagggatttgcttttgtggaatatgaagtaccagaggccgcacagttggctctagaacaaatgaactccgtgatgttgggcggaagaaacataaaggttggacgtccttccaacattgggcaggctcagcctattatagaccaacttgcagaggaagcgcgggcttttaatcgaatctatgttgcatcagtgcatcaagacctaagcgatgacgacatcaaaagcgtctttgaggcattcgggaagatcaagtcttgcacccttgccagggatcccaccaccggcaaacataaaggatacggcttcattgagtatgagaaggctcagagcagccaggacgcggtttctagtatgaatttattcgacctgggaggacagtatctgcgagtgggaaaggctgtgacacctccaatgccccttctcacacccgcaactcccgggggtctcccgcctgcagcggcagtggcggcagctgcggctaccgcgaagattaccgctcaggaggctgtcgcaggcgcagccgtgctgggtacactgggcacacccggcttagtttcccccgctctaactttagctcagcctctgggtacccttccccaggccgttatggctgcccaagctcccggggtgattacgggtgtgacaccagctcgccctccgattcccgtgacaatccctagcgtgggtgtcgtgaacccaatcctcgcaagcccgcctaccctcgggttgctggaacccaaaaaggagaaggaagaagaagaactgttccctgaatccgaaagacctgaaatgctgtctgaacaggaacacatgtcaatttctggctcttctgccagacatatggtgatgcagaagctccttaggaaacaagaaagtactgtgatggttctgagaaacatggtggatccgaaagatattgatgacgatctggagggggaggtgactgaggaatgtgggaagtttggcgcagtcaaccgggttattatttatcaggaaaagcagggggaggaagaggacgcagagattatcgttaagatcttcgtagaattctctatcgctagcgaaacacacaaagccattcaagccctaaatggcaggtggtttgccggccgaaaggttgtcgccgaagtgtacgatcaggagaggtttgataatagcgatctgtccgcgtag

SEQ ID NO: 49660 - DNA, 1500 bp, Artificial Sequence
  Description of Artificial Sequence: Synthetic coding sequence
atggagaacggccagagcaccgccgccaagctgggcctgccccccttgactccagagcagcaggaggcactccaaaaggccaagaaatatgccatggaacagtccattaaatcagttctggtgaagcaaacaattgcccatcagcagcagcaactgactaatctccaaatggcagctcagcgacagagggctctggctatcatgtgccgtgtctatgtgggtagcatttattacgagcttggagaagatacgattaggcaagcgtttgccccatttggtccgatcaagtctatcgacatgagctgggactcggttaccatgaagcacaaaggattcgcctttgtagaatacgaggtgccggaggccgcccaacttgccttggagcaaatgaactctgtgatgctgggaggacggaacataaaagtcggacggccatctaatatagggcaggcccagcccattattgatcaactggccgaggaggctcgggcgtttaatcgcatctatgttgctagcgtgcatcaggatctcagcgacgacgatatcaaatctgttttcgaggcctttggcaagatcaagtcttgtacacttgcgcgagacccaaccactggaaaacacaaaggctacggtttcatcgagtatgaaaaggcccagtccagtcaggatgcagtcagctcgatgaacttgtttgacctcggtggacagtatctgcgcgtaggcaaggctgttacaccacccatgcccttgcttactccagccactcctgggggactgccgcccgcagccgccgtggccgcagccgctgctaccgccaagatcactgcacaggaagccgtggccggcgcagcagtgctaggaactctggggacccccggactggtgtcacctgctctgaccctggcccagcctctcgggaccctgcctcaggctgtgatggccgcccaggcccctggggtcatcacaggggttacccccgcccggccgccaatcccagtgaccatacctagtgttggtgtagtgaaccccatactcgcctcgcctccaacgctcgggctgttggaacctaagaaagagaaggaagaagaggagctgttccccgaaagcgaacggcccgaaatgctctctgaacaggaacacatgtccatatctggttctagcgctcggcacatggtgatgcaaaagttattgaggaagcaagaaagcaccgttatggttctgcggaatatggtggacccgaaagatatagatgatgatttggagggagaggttactgaggagtgtgggaagttcggcgctgtgaacagggttataatttaccaggagaagcagggggaagaagaggacgccgagattatcgtgaaaatcttcgttgagttctccattgcttccgagacacataaagcgattcaagctctcaacggaaggtggttcgctggcaggaaagttgtcgccgaagtttatgatcaggagagatttgacaacagcgatttgtcagcttag

SEQ ID NO: 49661 - DNA, 1629 bp, Artificial Sequence
  Description of Artificial Sequence: Synthetic coding sequence
atggccaccgccaccatcgccctgcaggtgaacggccagcagggcggaggatcggaaccggcggcagctgcggcggtcgtggccgctggcgataagtggaagcccccacagggcacagactcaatcaagatggaaaacggacaatcgacagcagccaaattgggtctacctccacttacgcctgagcagcaggaagctctccagaaagcgaaaaaatatgccatggagcagtccatcaagtccgtgttggtgaaacaaaccatagcgcatcaacaacaacagctgaccaacctccaaatggccgctcagcgtcaaagggctctagcaataatgtgcagagtctatgtaggctccatttattacgaactgggagaagatacaatcaggcaggcctttgctccttttggccccatcaagtccatcgacatgagttgggattctgtgacaatgaaacataagggattcgcatttgtagaatacgaggtgcctgaggctgctcaactggccttggaacagatgaacagtgttatgctggggggccgaaacatcaaagtcgggcgcccaagcaatattggacaggcgcagccaataattgatcagctggcggaagaggcaagggctttcaacagaatctatgtggctagtgtccatcaggatttaagcgatgacgatattaaatctgtattcgaagcttttggcaagatcaagtcttgtactctggcccgggaccctactaccggtaaacacaagggatatggctttatcgagtatgagaaggcccagagctcgcaggacgcagtgagcagcatgaatcttttcgacctcggcggccagtatctcagggttgggaaagcagtcacacctccgatgcccttgctgacccctgctactcccgggggtctacctcccgccgccgctgtagcagcggctgccgcgacagctaagattacggcccaggaggccgtggctggcgctgccgtactgggaacgctgggcaccccagggcttgtctcaccagcccttactctggcacagccactgggcaccctacctcaagcagtcatggccgctcaggcccccggagtgatcacgggcgtaacccccgcacggccacccatccccgtgacaatcccatccgttggcgttgttaatccaatcttggcgtcgccccctactctgggcctgttggaaccaaagaaggagaaggaagaggaggagctctttccggagtccgagcggccggagatgctgagtgagcaagagcacatgtccatcagcggtagtagtgccagacatatggttatgcagaagcttttgaggaaacaagaaagcactgtgatggtgctgcgaaacatggtcgatccaaaagatatcgatgatgatctggagggagaggtcaccgaagaatgtggtaaatttggcgccgtaaatagggtaattatctatcaggagaagcagggagaggaggaggacgctgagatcatcgttaaaatctttgtcgagttctcgattgcttcagaaacgcataaggctattcaggcccttaacggcaggtggtttgctggtcgcaaagtcgtggcagaggtgtacgatcaagaacggttcgataattcggatctaagtgcctag

SEQ ID NO: 49662 - DNA, 891 bp, Artificial Sequence
  Description of Artificial Sequence: Synthetic coding sequence
atgggcgccgccgcccccgccgagagcgccgacctgggcaacttctggaaagctggtgagccccttctccaaggacccgacgcactcgccgcccctatgagtagatccccctctaccccacagaccacaccgtccccacagggtaggcaatcaccttggcccctccggtcccttacacagagccacatccagtatttccaatgggggcgtccggtccctagcacccatctcatagaggtgaggcctacgcaggatcccgccaagccccagcgcgtggtgtccgagggctggcgtcggcctgccctccccggagagacagcacttgggcgggatctgtcctgcgcttgggaggggtgcatgaagggaggactctgtcgagcctggaaccctgggcgaacttggagccctgtcaccattggcattgccccacccgagcgccaggagagtccttggcgaagtccggggcagcgagctagaccagccggccggccagcagcccaagagcttctagatccctgtactagggagaccttgctcggggcattgtcacagtgccctaagggcagcgccaggtttgacggacctctttggttcgaggtctccgatagcaagggtgggagaaggaacctgcagccgaggccttcggcattcaaaccactgtccaagaacggtgccgtggctagcttcgtcccacggcccggccccctgaaacctagcttggggccctggagccttagtttctgcgatgatgcatggccctcagttctggtgcagcccgccccctccgccatatgggacttctgggaagccacaaccccctcatgcgggtcctgctcacgcgtgtcctttgcacttgaggtcacccagtccgcaggtcccttcgggagctag

SEQ ID NO: 49663 - DNA, 2916 bp, Artificial Sequence
  Description of Artificial Sequence: Synthetic coding sequence
atgggcagcttcctgagcaagctggagctgagccccagcagccccgcccaggtgcgtaccgacctacccgaacggccaacaaaaagacggccacctcagcctttacaccaagtgcaccgggtccagtttgtgcatcgcgcccaccccgccccacgctaccggcctgtgaggcgaagacctaacctagacccggccaacccaacaacctggctggcaaatgaggcctggcgccggtttcccatgaagaagagtcagaactccccactgggacccttgccatcagactggtgggagtcatacctaaagcgcaccatctggagcctccggcaccctaggccaatctggtcacctgtcaccatccgcatcaccccgccggatcagcgggtccccccctctacctcgccagaggatgtgattgcgctggcagggctgcccccaagcgaagagcttgcagatccatgtagcaaggaaaccgtattgcgcgccctcagggagtgcaggaagggcaagggacggctggaggagcctctttttccagaaagcttggattctaaaagacggtcccccgaaactaggccaagcgcattcaaaccattgatgaagaatggcactttaaccagcttcgtcccgcggccggggccactgaaaagatctctccacagctggggctccgaccatagcctgactaaacgtccgaattgcagctccatgagttctttagcatccatatacaggggaggaacgctctcctctaagcggaacgcgattggctcttcatattcctcttgtcgaaatttcagcgatccgtggaagagatccgtgcctagcgtgagcttcgagacacccgagtggccaattaaaaaagaaaagtcttgccacaggccctctagtccagtccctcttgtcagcgatttcgagagtcttgggggaagcgagtcatctggacaacagaaccagaaaatcccccagctgccttcttctcccgaaaacctggtgtctgagattccacctcctcaactcggatacgcagtcagtgatgagaacctcaccctgggtaaaaaagctgaacttcagagtaccggcgaagccacctcggtcgcacactcacccctgaagacaccctcgttaccaactcctccgggatgttcacagtctgaacttctgccaggcacctcccctgatagtaaacctacggccacctttatcttattgactcctacctcaccaacgctgccagtgacagacacaacctggcctcccagcaccagtcaggccgaccggagtcctatgcctcccgacccaccagcacctcctacaattcaatcgacactgttaggaatggtgagcagcccaacctcccacctgtcagcgagcgcacccccagatgcaacttctgcgcacttgatgttaaagccgatccttggaccccttcacaactctgagataggttccagcagctattctaggatcagcgtaacagccgccgcctcatccatcagcagcctgagcactatccaaggcacactgaccccaacctttaaaccgatatttggttccatcgaccccctgaagactactcccatgatcgccccgttttcatccaaacagaccccgccacctttcacccatgcatcaacacaccactttcacggtctggttaaagctactagcgtcgtcatgagcacgactcttgcctcaacgtccaaggactccgtgtttaaaccacctctggattttggcgtcgttaacgtgacctccgccgtagggaatacctactccgtgccttccacatgtgacaccttcttgctcggcactgcccaagccttcagagcagattttactcctgcgactgggttcatcttccctccccatcatcacccaactataccaacagtgcacaccgtaacaatgtttacgcaggtccttagctcggtggtccaaatctccccacgaagctctaccgccaacttcaggggaatgggcagtcctctacctgcttcagcactagtcagcaccaactggttagcctcaaccccgtccatcagcaatctgactccagcaattacttcccccctgggctcatctagccgccctcctttccccctctcccagggggccaaccctcagcctgcgtttggcgctacgaacggtcagaagcagggaccctcacagccggctctcatgcccagcgtgagttctagttttcttttcggttcgagcgccgtggccctgcctacccccatgcctaccccagctcagcccgcatttatctctactacacaatccgcactgggctgcctgacccccagtgcctcaacctcgcagacgcctgcctccacttggtccgggattggggggataccggctggctttccgatcagccaagcctcaacgacaggctttaggatcgtgatacagacacaccaatcgggagcttttggctcagtatttggaagcagagctccacagcccttcacgttcggcggctttgttacccctatggactgcgatgagagcggaatcattatgaccgggcccgacatgtcccccacctcaggagccttcagcatcggggccctgccatcaggaaccacgaacaccatgattccattcggcaagggatggagccagaatacggagggcctgccatctcaccggaccgccttttctctgggccgtggatctatcagcgctcgcaaaacgatggcacccatcgcacagaacactcccgtccccggtcaggctaaagcaggctcatccgtgggctttgggatgcctttccctcccgcgcaggggtccgttgggaggggaccgttccgcagcagcgcaagttccttttccattggggcaaagagcaaaacccccaagaacagagaaaaaggacattctcgccgccaccatgcatataagaaatag

SEQ ID NO: 49664 - DNA, 3108 bp, Artificial Sequence
  Description of Artificial Sequence: Synthetic coding sequence
atgggcagcttcctgagcaagctggagctgagccccagcagccccgctcaggtacggaccgatctgccagagaggcccaccaaacgaagacccccgcagccactgcatcaggtgcatcgggtgcagttcgtccatagagcacatcccgctccccgatataggcctgtgcggaggcgacccaacctcgatccggctaaccctaccacctggttggcaaatgaagcatggcggcgcttcccgatgaaaaagtcccagaactcccccctgggcccattacctagcgattggtgggaatcatacctcaaacgcacaatctggtcactgcgtcatccccgccctatctggtcccccgtaactatccggatcacaccgcccgaccagcgggtccccccctcaacctcccctgaggatgtgatagcccttgcaggacttcccccctccgaggagttggctgacccctgttccaaagaaaccgtcctacgggccctcagagagtgtcgcaagggtaaaggcagactcgaagaacccttattcccggagagcctggatagcaagagacggtcgcctgagacgagaccgtccgccttcaaacccctcatgaaaaatggtaccctgacaagctttgtccctcgacccgggccactgaaacggtctttgcattcttggggctcggatcactcgttgaccaagcgacctaattgcagttcaatgagctccctggcctccatctaccgcggagggacactcagctcaaaaagaaacgccattggtagctcgtatagttcttgtcgcaatttttccgatccttggaagagatcagtgccctctgtcagttttgagacccctgaatggcctatcaagaaagagaaatcatgccatcggccatcatcccctgtccccctcgtgtccgacttcgagagccttggaggatctgagagttctggccagcaaaatcagaagatcccgcagcttcccagcagtccagaaaatttggtatccgagatcccgccaccccagttgggatatgctgtgtctgacgagaatttaactctcggcaagaaagctgagttgcaggtgtccaacaatgcaggagaggatacaaccgaggtcaacacagacccgttccctgagacatggttggccattcaacctagcttgagcttggctctgccttccagcgaaaccgacttaacccagggcgctaatccccagctggaaaatctcagaaaaatgcaaaagagccttggtcccctagcctcaccacagtcgacgggcgaagctacatcggtggcccatagtcctcttaagacccctagtctacctacgccaccagggtgtagtcagtcagaacttctccctggaactagccccgattccaagccaacagctacttttattctactcaccccgacaagtccaaccttgccagtgactgacaccacctggccccctagcacctctcaggctgacaggagcccaatgccccctgacccaccagcacccccaactatacagagcactctgctgggcatggtgagctctccaacctctcacctctcagcgtctgccccccccgatgccacaagtgcccacctaatgctgaagcccattttagggcccctccacaacagcgaaatcggatcatcatcttacagcagaatctccgtaacagccgccgccagctccatctcgagcctcagcaccatccagggcactctgactccaacattcaagccgatttttggctcgatcgacccactgaaaaccacccccatgatcgcacctttcagctctaaacagaccccacctcctttcacccatgcaagcacccaccacttccatgggctggtgaaggccaccagtgtggtgatgagcaccacgctggctagcacctctaaggactccgtttttaagccccccctggacttcggcgtggtgaacgtcacttccgcagtcggtaacacctattccgtcccatcaacttgtgataccttcttactgggcactgcacaggctttcagggccgattttactcccgccactggatttatttttcctccacatcatcacccgaccatccctaccgttcatacagtgactatgttcacccaggtgctgtcctctgttgtacaaatctcaccgaggtcctctaccgccaattttaggggtatgggatccccactgcctgcaagcgcactggtaagcacgaactggttggcttccacccccagtatatcaaacttaactcccgcaattacatcacccctgggctcctcctctcgaccgccttttcccctgtcccaaggcgcaaaccctcagcccgctttcggtgcaaccaacgggcagaaacagggtcctagccagcccgccctgatgccaagcgtgtcctcgagcttcctcttcgggagctccgccgttgcactgcctactcctatgcctactcctgcgcaacctgccttcatctctactacccagtccgccttaggatgcctgactccctcagcctctacaagccagactccagcctctacatggtctgggatcggagggatccccgcagggttccctattagccaggccagtactacgggattccggatcgttattcagacacatcaatctggtgcgtttggctccgtttttggctccagggctccccaaccattcacttttggggggttcgtcactccaatggactgtgacgaaagtggtatcatcatgactggccctgacatgtctcctacctcaggagcattctccatcggggccttgcccagtggaacaactaatactatgattccatttggaaagggatggtctcaaaacactgagggactgccatcccacaggacggccttctccttagggcgtggctccatcagcgctaggaagactatggcaccaattgcacagaatactccagtccccgggcaggcgaaagccggttcctcagttgggtttgggatgcctttccccccagcccagggttccgtggggcgaggcccttttaggtccagcgccagctcattctcaattggtgcaaaaagcaaaacgccaaaaaatcgggaaaaagggcattcacggagacatcacgcatacaagaaatag

SEQ ID NO: 49665 - DNA, 1374 bp, Artificial Sequence
  Description of Artificial Sequence: Synthetic coding sequence
atggacagcctgtggggccccggcgccggcagccaccccttcggcgtccataattcccgcttgtctcccgatctatgtccaggcaagatcgtcctgagggccttgaaggaatcgggtgctggtatgcctgagcaggacaaggacccccgcgtgcaggagaaccctggtgatcagcgacgcgtgcccgaggtcaccggggatgccccaagtgcgtttcgcccactaagggacaatggcggtttaagcccatttgttcctggacccgggcccctccagacagatctgcacgcgcaacggtctgagatccggtatgatcagtcttcccagacatcctggacgagctcatgtacaaacaggaacgcaatcagttcttcatattcgagtacaggtggcctcccgggccttaaaaggcgtaggggaccagctagcagtcattgccagcttaccctcagctcaagcaagaccgttagcgaggaccgaccacaggccgtgagcagcgggcacacccagtgtgaaaaggtggcagagaaagctccgggccagaccttagccctccggaatgacagctctaggagcgaagcctcccggccgtcaacccggaagttcccactccttccccaccgacggggagaacccctcatgcttcccccaccagttgaactcggctacagagtgactgccgaggacttggactgggagaaagaagccgcattccagtgtatcaaatcagctctgcaggtggaggacaaggccatctccgactgtcggccctctaggccttcccatacacttagttctctcgcgaccggtgcctctggactgcccgcagttagtaaggcccctagcatggatgcacagcaagagagacacaagagccaggactgtctcgggttggttgctcccttggcgagcgcaactgaggttccttccaccgccccgatgagcggggaaaaacaccggccacctgggcctttgttcagttccagtgaccccctacctgccaccagcagccactcccaggacagcgcacaggtgacgtctctgattcccgctccctttcccgcggcttctatggatgccggcatgcgccggacccgccccgggacctcagcaccagccgccgcagccgccgcacccccaccttccactctcaatcgtacactgggatcacttctggagtggatggaagccctgcacatctctggtccacagccccaactgcagcaggtgccgagggggcaaaatcaacgcagccaaacatcccggacctcttcttgccccaaaagaaacgctatcagtagttcttgttcctccacaggtgatctgcccggcagaaagaggaaaagacggcagcctcacccaaccgcgagttag

SEQ ID NO: 49666 - DNA, 1389 bp, Artificial Sequence
  Description of Artificial Sequence: Synthetic coding sequence
atggacagcctgtggggccccggcgccggcagccaccccttcggcgtccataacacacgcctgagtcctgatctgtgtccaggcaaaatcgttctccgagctctcaaagagtccggtgccggaatgccagaacaggataaggaccccagagtccaggagaacccaggcgatcaaaggagagtccccgaagtcactggcgacgccccctcggcctttagacccctgagagacaatggcggccttagcccattcgtgccaggccctgggcctcttcagaccgaccttcatgcacagcgaagtgagattagatacaaccagactagtcagacctcatggacatcctcctgtaccaatagaaacgctatttccagcagctactcatctacaggtgggctgccaggcttaaaacgacgccgtggtccagcctctagccactgccaattgactcttagttcatctaagacagtgagtgaggatcgcccccaggccgtgtccagtggtcacacgcagtgcgagaaagccgccgatattgcccctgggcaaacattggccttgcggaacgacagtagcactagcgaagccagccggccttccacgcataaatttcccctccttccgcggcggagaggggaaccactcatgctccccccccctctggaactggggtatcgggtgaccgtagaggatctagaccgggagaaggaggccgccttccaaagaataaactccgcacttcaggtagaggacaaagctatatctgactgccgcccttcccgtcccagccataccttgtcttcactagctactggcgccagcggcctgcccccggtgtcaaaagccccctcgatggacgcccagcaagaaacacacaagtcacaggactgcttgggtttgctggctccactggcatctgctgcaggagtcccatcaaccgcccctatgagcggcaagaaacaccgccctcctgggcccttattttctagtagcgatccattgccggcaacaagcagtcactcgcaagactcagcccaggtgactagtctgatacctgcccctttccccgccgcgagcatggacgcgggcatgaggcgcactcgctgcgggactagcgcaccagcagccgcggcagcagctcctcctccatccactctaaatcctacactcgggtctctgctggagtggatggaagcactacacataagcggccctcagccacagttgcagcaggttccaagaggccagaaccagaggtcacaaaccagtcgtacgtcgagctgtcccaaacgcaacgctattagttccccataccgctcaactggaggtctgccagaacggaagcggcgacgcggaccggccagctcgcactgtcagctgacactgtcatcatag

SEQ ID NO: 49667 - DNA, 1389 bp, Artificial Sequence
  Description of Artificial Sequence: Synthetic coding sequence
atggacagcctgtggggccccggcgccggcagccaccccttcggcgtgcacaacactcggctgtcacccgatctttgccctgggaagattgtcctgcgggcccttaaggaatctggtgccggaatgcctgaacaggacaaggatcctcgcgtccaggaaaatccaggagaccaaaggcgggtccctgaggtcacaggggatgccccttcagcattccgccccttgcgcgataacggagggctctcacccttcgtgccaggccccgggcccctacaaactgatctgcacgcccagcggagcgagatcaggtataaccagacctcccagactagctggacctcttcatgcactaacagaaatgctatctcgtcaagctacagcagcacaggcggccttccaggcttaaaaagaagaaggggccccgcgagtagccattgccagctcacgctgtctagtagtaaaacagtgtcagaggacagaccacaggcagtgtctagcgggcatacccagtgtgagaaggctgctgatatcgcgcccggccagaccctggccttgaggaatgactcctccacctctgaagcgtctaggcccagcacccacaaatttccactccttccacggcgcagaggggagcctctgatgctcccgccgcccctggaactagggtaccgtgtgacagtggaagatctagacagggagaaagaagctgcatttcaaaggataaatagcgccctacaagtcgaggacaaggccattagcgactgccgccccagccggccatctcacacgctgtcatcactggcaaccggggcgagcggccttccacctgtgagcaaggcgccttctatggacgctcagcaggaaacacacaaatctcaagattgtttaggacttctggcgccgctcgcatccgcagccggcgtcccaagtacagcacctatgtcaggcaagaagcacagaccccctggtcccctttttagtagttccgatccactccccgccacgtctagccacagtcaagacagcgcccaggttacgagcctgatacctgccccttttcctgctgcttccatggatgctggtatgcgtagaaccaggtgcggcacatcagcccctgcggccgccgccgccgccccccctccaagtaccttgaatcccaccctggggtcactgctggagtggatggaagcgctgcacatatctggaccacaacctcagctgcagcaagtgccccgcgggcagaatcagaggtcgcaaacctcacgtactagctcctgtcccaagaggaacgcgattagctctccgtacaggagtactggtgggctgccagaaaggaaacgtagacgcggccccgctagcagccactgtcagcttaccctgtcatcatag

SEQ ID NO: 49668 - DNA, 3000 bp, Artificial Sequence
  Description of Artificial Sequence: Synthetic coding sequence
atggtgtgcagccccgtgaccgtgcggatcgccccccccgaccggcgatttagtagaagcgccatccccgagcagataattagttccactctgagcagtccttctagtaatgccccggatccctgtgcaaaggaaaccgtgctgagtgctcttaaagagaaggaaaagaagagaacagtcgaggaggaggaccagattttcctagatggccaagagaacaagcggcgaagacacgattcctcaggcagtggtcactcagccttcgagccactggtggctaatggcgtgcccgcctcttttgttccaaagcctgggtccctaaagcgagggctcaactcccagtcttccgatgatcatttgaataagaggagcagatcttcttctatgagcagcttgacaggggcttacgcatctggaattccaagtagctcccgcaatgccatcacttcaagctatagttccaccagaggcatctcacaactgtggaagaggaacgggccgagcagctcgccattcagcagtcccgcatcaagcagatctcagacccctgagcgtccagccaaaaagatcagagaggaggagctgtgtcatcatagctcaagttctactcccttagctgccgacagggaatcacagggagaaaaagcagcagacactactcctcggaaaaaacagaatagcaactcgcaaagcacaccaggctccagcgggcagaggaaaaggaaagttcagctgctgccatcacgtagaggagagcagttaactctccctcctccgccacagctcggctactccatcactgcggaagatttggatttggaaaagaaggcctctctccagtggtttaaccaggccttggaggacaagagtgacgccgcctcaaattctgtcactgagacaccaccaatcacacaaccaagctttacgttcacgctgcctgccgccgcccccgcatctcccccgactagcctcttggctccgtcaactaaccccctccttgagtcactcaagaaaatgcagacacctccctctctaccaccatgccccgagtccgccggcgctgcgaccacggaagccttgtcacctcccaagacccccagcttgctacccccgctgggtttgagccagtcagggccccccggattactgccttcaccctctttcgattccaagccccctaccactctgttgggcctaatcccggccccttctatggtgcccgcgacagacaccaaggccccgcccacgctgcaggctgagactgccactaagccacaagccacgtctgccccctctcccgcccccaagcaaagttttctgttcggaactcagaacacttctccgtcatcgcctgctgcaccagccgccagctcagcaccgcccatgtttaagccaattttcacagccccacccaagtccgaaaaggagggaccaacacctcctggaccatcagtaactgctaccgccccatcatccagcagcctgcccactactacgtccactaccgcccccacctttcagcctgtgttttcttcgatgggacccccggcctccgttccgctacccgctccatttttcaagcaaacaaccaccccagctactgctcccaccacaactgctcctttgttcaccggattagcttcggcaacttctgcggtggctcccattacgtctgccagccctagtacagactcagcgtcaaagcctgcattcggctttggtattaactccgtcagttccagctcggtgtctactacaactagcacagcaacagccgcatcacagccttttctctttggcgctccccaggcatctgcagcttccttcacccctgccatggggagtatctttcaatttggtaagcccccagccctgcccacaactacaaccgtaaccactttttcacagagtctccacaccgctgttcctacagccacatcctcctctgctgctgattttagtggattcggatctacgctagctacgagcgcccccgctacaagctcccagcccaccctgaccttttctaatacgagcacgcctactttcaatattccgttcgggtcaagtgctaagtcgccgctgccaagctatcctggcgcgaatccacaacccgcgtttggagccgcagaggggcagcctccaggcgcggcaaaacccgcactggcccccagtttcggatctagtttcacattcggcaatagtgcggcacccgctgccgctccaacaccagccccgccctctatgatcaaagtagttccagcctatgtacccacgccgatccatcccattttcggcggcgccacccactccgctttcggcctcaaggctacggcgtccgcattcggggccccagctagttcacagcctgcattcggcggcagcaccgccgtcttctttggcgcagctacgagctctggctttggagccaccacgcagacagcttcttccggttcttcttcatccgtttttggtagtactacaccttcacccttcacatttggtgggtctgcagcccccgccggaagcgggtcttttggcattaacgtggctactcctggtagctctacaactacaggcgcgttttctttcggagctgggcagtctggcagcaccgccaccagtacaccattcgcaggtggcttggggcagaatgctcttgggacaactggacagtctactccattcgctttcaacgtgtcgagcactactgaaagcaaaccggtcttcggtggtaccgcaaccccaacttttggacttaacactcctgctcccggcgtcggtaccagtggttccagcctttctttcggggcatcttccgccccagcacagggttttgtgggcgttgctcccttcggcaatacctttgcacatcaacaggaacatagccctcgtaaggggcctaacaatctgtccaagcgcaaactactacctgctgtgagagctcagggcctcccaagacggggccaggccagctcttttcccaccaggaaagagtag

SEQ ID NO: 49669 - DNA, 1386 bp, Artificial Sequence
  Description of Artificial Sequence: Synthetic coding sequence
atggccaccttcagccggcaggagttcttccagcagctgctgcagggatgtttgctacccaccgcgcagcagggcctggatcagatttggctgcttttagccatctgtctggcctgcagacttctctggcggttaggcctgccttcttacttgaaacatgcttccactgttgccggcggatttttttccttatatcacttttttcagctccatatggtctgggtggtactactgagtctgctttgttatctggtgctgttcctgtgcagacatagctcacaccgcggcgtgtttctttctgtgactatcctcatctatcttctgatgggagagatgcatatggtggacacagtcacttggcacaagatgaggggcgctcagatgatcgtggctatgaaggcagtatccctcggctttgatcttgatcggggtgaggtggggacggtcccgagcccggtggaatttatgggatacctgtactttgtcggtaccatcgtttttggcccgtggatatcattccacagctacctgcaggccgtgcagggccggccactgtcctgtagatggttgcagaaggtggcaaggtccctcgccctggcactcctgtgcttagtcctgagtacgtgtgttggcccttacctctttccctacttcatcccactcaacggagatcgcctgctccggaacaaaaaacgtaaggcgaggggaaccatggttcggtggcttagggcttacgagagtgccgtcagctttcattttagcaactattttgtcggctttctctcagaggcgactgcaactctggcaggggccggtttcacagaggaaaaggatcaccttgagtgggacctgacggtcagtaagcccttgaatgtggagttgcctagatccatggtagaagttgtgacctcgtggaatctccccatgtcttattggttaaataattacgtgttcaagaacgccctacgccttggcaccttctcagctgtccttgtgacttatgccgcctcagcccttctccatggtttctccttccatctggctgcagtgttactttctctagcctttattacatatgtggaacatgtactacgtaagagacttgctcgcatcctctctgcctgtgtgctcagtaagcgatgtcctccagattgctctcaccaacaccgtctaggtttgggggtgagggcactgaatctgctgttcggagcccttgccatatttcacctcgcttatctgggctctctcttcgatgtcgatgtggatgatactaccgaagagcagggttatggcatggcctatactgtgcataagtggtccgaactgagttgggccagccactgggtcacctttggatgttggatcttctataggctcatcgggtag

SEQ ID NO: 49670 - DNA, 1368 bp, Artificial Sequence
  Description of Artificial Sequence: Synthetic coding sequence
atggccaccttcagccggcaggagttcttccagcagctgctgcagggctgcttgctccctaccgcccaacaaggactcgaccaaatctggcttctacttgccatttgtctggcctgccgcttattgtggcgcctggggctgccaagctacctgaaacacgcgagtaccgtggccggaggattcttttctctataccacttcttccaattgcacatggtctgggtagttttgttgtctctactttgttatctggtgttgtttctgtgtcgccactcttctcaccggggcgtgttcctgagtgtaacaatcttgatttacctgctgatgggagagatgcatatggtcgacaccgtgacgtggcacaaaatgcgtggagcccagatgatcgtggccatgaaggcagtttcactcggatttgacctagatcgaggcgaggtggggaccgtgccatcccccgtggaatttatgggctacctttactttgttggcactatcgtgttcggaccatggattagcttccacagttacttgcaggcggtccagggcaggcctctctcgtgccggtggctgcagaaagttgcgcgcagcctcgccctggccctcctgtgtctggttctctcaacctgcgtgggtccatacctcttcccctattttattccactgaacggcgatcgtctacttcgaaaaggcacaatggtgcgatggcttagagcttacgaaagtgcagtgagtttccattttagcaactattttgtcggttttctgtccgaggctaccgcaactttagctggagctgggtttacagaagaaaaggaccatttagagtgggacttgaccgtatctaagcccttgaacgtggagttgccaagatccatggtggaggtggtcacttcttggaatctgcccatgagttattggctgaacaactatgtattcaaaaatgcactcaggttgggaactttctcagcagtcctagtaacctacgccgcgtccgcgctgctacacggtttctcatttcacctcgctgcagtactgctttctttggcctttattacatatgttgaacacgtattacggaaacggctcgcaagaatactgagcgcatgtgtgctgagtaagcgatgtcctcctgattgcagccaccaacacaggctggggcttggcgtaagggcgctaaatttactgtttggcgcccttgcaatttttcacttagcttatctcggctcgctgtttgatgtggacgtcgatgatacaactgaagagcaaggttatggcatggcctacaccgtccataagtggtcagagctttcttgggcgtcccactgggtgaccttcggatgctggatcttctaccgactgatcggttag

SEQ ID NO: 49671 - DNA, 1146 bp, Artificial Sequence
  Description of Artificial Sequence: Synthetic coding sequence
atgagccggcacgagggcgtgagctgcgacgcctgcctgaagggcaacttcagaggacgcagatataagtgcctcatctgttacgattacgatttgtgtgcatcgtgctacgagtctggggctaccaccactcgccacacaactgatcaccctatgcagtgcatacttactagggtcgatttcgacctctactacggcggtgaggccttctctgtggagcaaccccaaagttttacttgcccctactgcggaaaaatgggctatacagaaacatcgctccaggaacacgttacctctgagcacgcagagacttcaactgaagtcatctgcccaatatgcgcagcactccctgggggagatccgaatcacgttacagatgactttgctgcacatttaaccctcgaacacagagccccaagggatctggacgagtccagcggtgtgcgtcacgtgagacgcatgtttcaccctggaagaggcctcggcgggcccagggcccggaggagtaatatgcactttacgtccagcagcacggggggcctgtctagttctcagtcgtcatattctccttctaatcgcgaagccatggatcccattgctgagttactctctcagctttccggcgtccggcggtccgctggagggcaactgaattccagtgggccctccgcgtcccagctccagcaacttcagatgcagctgcagctcgagcgacagcacgcccaggccgcacggcagcagctggagactgccaggaacgcgacacgacgcactaacacgtcaagtgtgactacaacaattacacagtcaactgccactaccaatatagcaaacactgaaagttctcagcagactttacagaacagtcagtttcttcttacccgactgaatgaccccaaaatgtccgagacggagaggcagtctatggagtctgagagggccgaccgctcactttttgtccaggaattgctactgagcacactcgtcagagaagagagttcttccagcgatgaggacgaccgaggtgaaatggccgacttcggcgcgatgggctgcgtggatatcatgcctctcgacgtggccctggagaatcttaatttgaaagagagcaacaagggtaacgagcctcctcctccacccctgtag

SEQ ID NO: 49672 - DNA, 705 bp, Artificial Sequence
  Description of Artificial Sequence: Synthetic coding sequence
atgccccaccggaaggagcggcccagcggcagcagcctgcacacccacggtagtacagggacagccgagggtggcaacatgagcaggctcagcctgactcgttcgccagtgagtccactagccgcccagggaattcctctcccggcccagctgaccaaatcaaacgcccccgttcacattgacgtggggggccacatgtacaccagcagtcttgctacacttaccaagtatcccgattccaggatttcaagactgtttaacggaaccgagcccattgttttagatagtctgaaacagcattattttattgacagggatggcgagatcttcagatacgtactgtcgttccttaggaccagtaaactgctgctgcctgatgatttcaaggacttttcattgctctacgaagaggccagatactaccagcttcagcctatggtacgcgagttagagaggtggcagcaggaacaggagcagaggcggaggtctcgcgcatgcgactgtctggttgtgagagtcactccagaccttggagagaggatcgcccttagcggagaaaaggcgctgatcgaagaagtctttcctgagacgggtgatgttatgtgtaattctgtgaacgcaggatggaatcaggaccctacccacgttattcgattcccactgaatggctactgtcggctcaattccgtccaggatgtgctttag

SEQ ID NO: 49673 - DNA, 915 bp, Artificial Sequence
  Description of Artificial Sequence: Synthetic coding sequence
atgaccctgcggaccagcgtgtgctgcacccggcggcgggccaccatctcatcctcaccatggtgtgcttcatggtccgcggggtcgcgaagtaggagttctggggcagcagcgggcccggtgactgcctggtggtgcgcatctagacctacttgggcctccgggtcacactctgccgcacgcagaccatctagcagacgtagcagcccccgccccgagacctcctgcgctacaccaagtacacccgccggcacccggactcctcgtacgtcaagcgcatccagatctatggctacagcggggagcactcggtaccggtcctggtccggctgctccagaggagtctcagcatggcttagaccagtcggggcagtgtggacaccaccatcatccgcaagtatgtgttttgctggtaggtcaggggggagaagcccccctcccttgcttttcgagagcagtcgaaacccttggacacgcccctgcttttccgcccatctggggcctcctcgggacctggaaacagtcctgggaagctccgcttgtgtgtatctggcggtgggaatgcgacctcgagttaggctggaggggcccaagcttgcccaacgcgctcccgggagtcaggtgagttggcaacagaacgttgggtgctggcggcacgcctgtcgacggacagtagatgctacccagaggtacagcggtggaatcagcgccgcatctagtccgagcccatcagcctctcagcccggcgcagcctcttctgaggccccaggtcccgtgggggctgggctggaagaacccagcgccgctacaagcgaggagttgtttatcccactccatgcaggtcaaactttagcaggcttgctggcctccgaacgttggcttatctttcagtatctgaaatggatgcagccctag

SEQ ID NO: 49674 - DNA, 498 bp, Artificial Sequence
  Description of Artificial Sequence: Synthetic coding sequence
atgagcgaccccatcaccctgaacgtgggcggcaagctgtacaccacatcattggccacactgacctccttccccgattccatgctgggcgccatgttctccggaaagatgccgacaaagagagattcacagggaaattgtttcatcgacagagatggcaaagtcttccggtacatcctgaactttctgaggacatcgcatctggacttgccagaggattttcaggagatgggccttctcaggagagaagctgatttctatcaggtgcaacctctgatcgaggctttgcaggagaaagaggtggagctaagcaaggcagaaaagaatgccatgctgaacataaccctgaatcagcgcgtgcaaaccgttcatttcaccgtgcgagaggccccccagatatattccctgtcatcctccagtatggaagtgttcaatgctaacattttcagcacatcatgtctgtttctaaaactgctggggagcaaactgttttactag

SEQ ID NO: 49675 - DNA, 114 bp, Artificial Sequence
  Description of Artificial Sequence: Synthetic coding sequence
atgagcgaccccatcaccctgaacgtgggcggcaagctgtacaccacatccctagccacccttacaagcttcccagactccatgctcggggccatgttttctgggaagatgtag

SEQ ID NO: 49676 - DNA, 351 bp, Artificial Sequence
  Description of Artificial Sequence: Synthetic coding sequence
atgagcgaccccatcaccctgaacgtgggcggcaagctgtacaccacaagcttggcaacacttacttctttcccggattctatgttaggggccatgttctccgggaagatgcccactaagcgcgacagccagggcaactgtttcatcgatcgcgacggtaaggtgttccgctatatcctcaacttccttagaacctcccacctcgacttgccagaggactttcaggagatgggattgcttcgcagagaggcagatttctaccaagtgcagcctctgattgaggcccttcaagagaaggaagtggaactgagcaaagccgaaaagaacgcaatgctcaatatcaccctctag

SEQ ID NO: 49677 - DNA, 216 bp, Artificial Sequence
  Description of Artificial Sequence: Synthetic coding sequence
atgagcgaccccatcaccctgaacgtgggcggcaagctgtacaccacctccctggctaccctgacgtctttccctgacagtatgctgggggctatgttttctgggaagatgccgaccaagagagattcacaggggaactgttttattgatcgagacgggaaggtgttcaggtacatcctgaacttcctacgcacaagtcatctggatcttccttag

SEQ ID NO: 49678 - DNA, 3450 bp, Artificial Sequence
  Description of Artificial Sequence: Synthetic coding sequence
atgttccagaccaagctgcggaacgagacctgggaggacctgcccaagatgagctgcaccaccgagatacaagcagcattcatcttatcttcttttgtaacttttttcagtggtctgattattctgctcattttcagattaatttggcgatccgtgaaaaaatggcagataattaaagggaccggcataatcctggaactgtttacgagtggaactattgccagatcacatgtgaggagtctgcacttccagggccagttcagggatcacattgagatgctgctttctgctcagacattcgtcggacaagtgctcgtgatactagtcttcgtattgagcatcggtagtcttatcatctatttcatcaattccgcagaccctgtggggtcctgtagtagctatgaggataaaactattccgatcgatctggtctttaacgccttcttttccttctatttcgggctgaggttcatggcagcagacgacaagataaagttttggctggagatgaactcaattgtggacatcttcacaattccacctacttttatttcttattacctcaagtctaactggctcggactgcggttcctccgtgccttacggcttctggaactgcctcagatactccagattctgagggctatcaaaacctccaacagcgtgaaatttagcaaactgcttagtatcatcctctcaacgtggtttacagctgccgggtttattcatctggtagaaaatagcggagatccctggctgaaaggccgcaatagccagaacatctcctattttgaatcaatatatttggtgatggccacaacttccacggtcggcttcggtgacgtggttgccaaaacttcattggggcgcacctttattatgttctttacccttggatcgctgattctctttgctaattatattccagagatggtcgaattatttgcaaacaaaaggaaatatacttctagttatgaggctctaaaaggcaagaaattcatcgtcgtctgtgggaatatcaccgtggatagcgtgaccgctttcctgcggaatttcctccgcgataaatccggcgaaattaatacggagatagtttttctgggggagacccccccaagtctcgagctggaaacaattttcaagtgttacttggcgtacactacattcatctctggatccgccatgaaatgggaagacctgcggcgagtcgccgtggaatctgctgaagcttgtctgatcatcgcaaacccgctgtgttctgacagtcacgccgaagatatctccaacatcatgagagtgttatcaatcaagaactatgacagtacaacacgaattatcatacagatactgcagtcgcataataaggtatatctgccaaagattccatcttggaactgggacacaggtgataatatcatttgcttcgcagagcttaaactgggcttcatcgcccagggctgcctagtacccggtctgtgtacttttctcaccagtttgtttgtggagcagaacaagaaagtgatgcccaagcaaacttggaaaaaacactttctgaactctatgaaaaataaaatccttacacaacgcctatcagatgattttgcaggtatgagctttcctgaggttgctcgcttgtgcttcctgaagatgcatctgttgctgattgctattgagtacaaaagtctctttacggatgggttttgcggcctgatcctaaacccaccgccacaggtgcggatcaggaagaatacactcggtttcttcatcgcagaaacaccaaaggacgttcgcagggccctgttctattgcagtgtctgtcacgatgatgttttcattccagagcttattacaaattgtggatgtaagagcaggtcacggcagcatatcaccgtgcctagtgttaaaaggatgaaaaagtgtcttaagggtatttcctcgcggattagtggccaggattcacctccccgtgtgagcgctagcacatctagtatctccaatttcactacaaggaccctacaacatgatgtcgagcaagactcagatcagctggactctagtgggatgtttcattggtgtaagcccacttccctcgacaaagtgaccctgaagcggacaggcaaatctaagtacaaattcaggaatcatatagttgcatgtgtgtttggagacgcccactctgcgccgatgggccttcgcaacttcgtaatgccactgcgcgcatcaaattatactagaaaagaacttaaggacatcgtgtttatcggaagcttagactatctgcagcgcgagtggcgttttctttggaattttccccagatctatatcttgcctgggtgcgccctctattcgggcgatttgcacgccgccaatattgagcagtgttcgatgtgcgctgtgctcagcccaccgccgcaaccgtcctccaatcagacccttgtggataccgaggccattatggcaacattgactataggcagtctgcagattgactctagcagcgacccgtccccatcagtatctgaggaaacacctggctataccaatgggcataacgaaaaatcgaattgccggaaggtgcctattctgacagaactgaagaaccccagcaatatccactttattgaacaactgggcggccttgagggctccctccaagagaccaatttgcacctcagcactgccttctctaccggcacggtattttccgggagctttctcgattccctgcttgccaccgccttttataactaccacgtgttggagctgctccagatgctggttacgggcggtgtgtcctcgcagctcgagcagcacctggataaggataaagtctacggagttgctgatagctgcacatctctcttatcagggcgcaaccgctgtaaattgggactcctctcccttcatgaaaccattctgtccgacgtgaatcccaggaatacgtttggccagctgttctgcgggtccttggacctgttcggcattttatgtgtcggcctctaccgcatcatcgatgaagaagaattaaatccagagaataagaggttcgtcatcaccaggcctgctaacgagtttaaattgctgcctagtgacctggtgttttgcgcgatcccgttctctaccgcatgctataagagaaatgaggaattctctctacaaaagtcatacgaaattgtaaataaagcttctcaaaccaccgagacacattcagatacaaattgccctcccacaatcgactcggtgactgagactctgtacagtcccgtttactcttatcaaccgcggacaaattccttgtcatttcctaaacagatagcatggaaccaatccaggaccaactctatcatttcttcgcaaataccccttggcgacaacgctaaggagaatgaaagaaagacaagtgacgaggtgtacgacgaagacccattcgcctatagcgagcctctgtag

SEQ ID NO: 49679 - DNA, 1302 bp, Artificial Sequence
  Description of Artificial Sequence: Synthetic coding sequence
atgaccgccgccagccgggccaacccctacagcatcgtgagcctggaggaagatggtctccacttagtgacaatgtccggagctaacggattcggaaatggaaaggtgcatacccgcagacggtgcaggaaccgattcgtcaaaaagaacggccagtgcaacatcgcctttgccaatatggacgagaagtctcagcgctacttggccgatatgttcaccacatgtgtggatataaggtggaggtacatgcttttaatttttagcctcgccttcctggctagctggctgctattcggcgtgattttttgggtcatagcagtggcacatggtgatctagagccggccgaagggcatggcaggaccccctgcgtcatgcaagtgcatgggttcatggccgctttcctctttagcattgagacacagacaaccattgggtacgggctgaggtgcgtcacagaggagtgcctggttgcggtattcatggtagtggcccagagcatcgtcggctgtatcattgactcttttatgattggggctatcatggctaagatggcacgccctaagaaacgggcccagaccctgctgttcagccacaacgctgtggtcgcattaagagacggcaagctctgtctgatgtggcgtgtgggtaatttgcggaaatcgcatatagtggaggcgcatgtgcgcgcccagttgattaaacctagggtcacggaggaaggagaatacattcccttggatcaaatcgacatcgatgtagggtttgacaaaggtctggacagaatcttcctcgtctcgcccatcacaatcctgcacgagatcgacgaggcttctcccctttttgggatttccagacaggaccttgagaccgatgatttcgagattgtcgtgatactcgaaggaatggttgaggcgaccgccatgaccacacaggcgagatcgtcctacctcgccaacgaaatcctttggggacaccggttcgagccagtactgtttgaagaaaagaatcagtacaagattgactacagccactttcacaagacatatgaggtcccaagcacacctaggtgttccgcaaaagatcttgttgagaataagttcctgctacccagcgcgaactccttctgttatgaaaacgaactggctttcctctcaagagatgaggaggacgaggcagatggggaccaagatggacgcagcagagacgggctttctccccaagctcgccacgacttcgatcgattgcaggccggaggcggagtgctcgaacagagaccgtatcgtcgtggctctgagatctag

SEQ ID NO: 49680 - DNA, 1875 bp, Artificial Sequence
  Description of Artificial Sequence: Synthetic coding sequence
atgcagaagagcagcacctgcagcttcatgtacggcgagctgaccgataagaaaaccatagaaaaagtacgacagaccttcgataattatgagtctaattgtttcgaagtgcttctgtacaaaaagaatagaacacctgtgtggttctacatgcagatagcccctattcggaatgagcacgagaaagtggtgctgtttctttgtacattcaaagatataactctatttaaacagcctatcgaagatgattccactaagggttggactaaattcgccaggttgacacgtgccctcactaacagccgcagcgtgctccagcagcttactcccatgaataagaccgaggttgtgcacaaacacagcaggctcgcagaggttctgcaattaggatcagatatcctgccccagtataagcaagaggctccgaaaactcccccccatatcatcctccactactgcgcttttaagaccacatgggattgggttatactaatcctgacattttatactgccataatggtgccttacaatgtgtccttcaagacaaaacaaaacaatattgcttggcttgtcctcgatagtgtcgtggacgtgatatttttggttgacattgtcctgaatttccacaccacatttgtcggcccaggaggcgaggtcatctcagatcctaaactgatccgtatgaactacttaaagacatggttcgtgatcgatctcctgtcttgtctaccatacgatatcattaatgcatttgagaacgttgatgagggcatcagttccctgttcagcagcttgaaggtggtgcggctattgcgcttaggaagggtggcgaggaaactcgaccattatttggaatacggcgccgccgtcctagtgttacttgtatgcgtgttcggattagtggctcactggctggcctgtatatggtactcaatcggcgattacgaggtgatcgacgaggttaccaacacaatccagatcgacagttggctgtaccaacttgccttaagcataggcactccctacagatataataccagcgccggtatatgggagggcgggccgtctaaagatagtctgtacgtttccagcctctatttcacgatgacaagcctcactaccattggattcggaaatattgcccctactaccgacgttgagaagatgtttagcgtagccatgatgatggttggatcgctcctgtacgcgaccatatttggcaatgtgacaacaatttttcagcagatgtacgctaacacgaacaggtaccacgagatgctcaacaacgtcagggacttccttaagttgtatcaggtgcccaaaggtctcagtgaacgagtgatggattacatagtgtccacatggtcaatgtctaaaggtattgacaccgagaaagtgttaagcatttgcccgaaagacatgcgggccgatatttgtgtgcacttgaacagaaaggtgtttaacgaacatccagcttttaggctggcttctgacggctgcctgagggccctcgcggttgagtttcagacaatccactgcgctcctggcgatttaatctaccacgccggagaatcagttgatgccctgtgtttcgtagtgagcggctccctcgaggtgatccaggacgacgaggtcgtggccattctcggcaagggggacgtgttcggcgatatcttttggaaggaaaccacacttgcgcatgcatgcgcaaatgttcgggcgcttacttactgcgaccttcacataataaagagggaagcactgctaaaagtgttggacttctatactgcatttgcgaatagtttctcacgtaatttgaccctcacatgtaatctgcggaagcgcgggtggttctccatggccaatgcgctgtag

SEQ ID NO: 49681 - DNA, 1836 bp, Artificial Sequence
  Description of Artificial Sequence: Synthetic coding sequence
atgcccggcggcaagcggggcctggtggccccccagaacaccttcctcgagaacattgttcgacgcagttcagagagctcttttctacttggtaacgcccagatcgtggactggcccgtcgtatattcaaacgacggcttttgtaagttaagcggatatcatcgggccgatgtgatgcaaaagtcttctacatgctccttcatgtacggggaactgactgataagaaaacaattgagaaggtgcgccagactttcgacaactacgagagcaattgcttcgaggttctgctctataagaaaaataggactcccgtttggttttatatgcagatcgcaccgatccgaaacgaacacgagaaagtggtgctctttctctgcacttttaaagacataaccctgtttaagcaacccattgaagacgacagcaccaaagggtggactaagttcgcacgccttactcgcgctctgaccaacagcaggtccgtgctccagcagttgacacccatgaacaaaaccgaggttgtgcacaaacactcccgacttgccgaagtgctgcagctgggcagcgatatcctgcctcagtataagcaggaggcccctaaaactcctcctcacataatcttacactactgcgccttcaaaactacctgggactgggtcatccttatcctaacattctatacagcgatcatggtgccatacaacgtgtctttcaaaacaaagcaaaacaacatcgcttggctggtcctggacagcgtcgtggacgtcatattccttgtagacattgtgctgaatttccacacaacctttgttgggcccggtggagaggtgataagcgatccgaagctaatcagaatgaactacctgaagacttggtttgtgatcgacctgttgtcctgcctcccctacgacattattaatgcattcgagaacgtggacgaagggatcagttctcttttcagcagcctgaaggttgtccgactcctgcgactgggtcgcgttgcccggaagctcgatcactatttggagtatggagccgctgtgttagtcttgctggtgtgcgtgtttggcctggtcgcccactggcttgcctgcatctggtactccatcggtgattatgaggtgattgatgaagttaccaataccatccagatcgactcctggttgtatcagttggccctgagcattgggaccccttacaggtataataccagtgccggtatttgggagggaggaccatctaaagacagcctgtatgtaagcagtttgtattttacaatgacctctctgaccactattggctttggcaatattgcacctacaacggatgttgaaaagatgttttccgttgctatgatgatggtcgggagtctgctatacgccaccatcttcggaaatgtgactacaatttttcagcaaatgtacgcgaataccaacagataccatgaaatgcttaacaatgtgcgggattttctgaagctgtatcaagtccccaagggactaagtgagagggttatggactatatcgtgagcacctggtccatgagcaagggcatcgatacggaaaaggtattgtcgatctgtccaaaggatatgcgggcagatatatgcgttcacctaaatagaaaggtgttcaatgagcatccagcttttcgcctagcatcggacggttgcctccgagcccttgctgtagagtttcagactattcactgcgcacctggagacctgatttatcacgccggggagagcgttgacgcgctgtgtttcgtcgtcagcgggagcctggaggttattcaggatgatgaggtggtggctatcttggatcacctcagttag

SEQ ID NO: 49682 - DNA, 1755 bp, Artificial Sequence
  Description of Artificial Sequence: Synthetic coding sequence
atggtggccgaggtgtgcagcatgcccaccgccagcaccgtgaagaaacctttcgacttgaggtcaaagatgggtaagtggtgtcaccatcggtttccttgttgtcggggatcagggaaatccaacatggggacctcgggagaccacgatgatagcttcatgaagatgctgagatctaagatgggaaaatgttgccgtcattgctttccatgctgccgagggagtggtacctctaacgtagggacttccggagaccacgaaaattcttttatgaaaatgctgagatccaagatgggtaagtggtgttgtcactgttttccgtgttgccgggggtctagcaagagcaacgtcggcgcatggggcgactatgaccatagcgccttcatggagccccgttatcacgtaagacgggaggatttggataagctgcaccgtgccgcctggtgggggaaggttcctagaaaagatctgatcgtgatgctccgtgacacagatatgaataagcgcgacaaagagaagaggaccgccctgcacctggcctcggccaatggaaattccgaggtcgtacagctgctcctcgaccgtcgctgtcagctgaatgtactggataacaagaagagaaccgccctcatcaaagccattcaatgtcaggaggacgaatgcgtcctcatgcttctggagcacggcgcagaccgaaatattcccgatgagtatggcaacacggccctgcactacgctatctacaacgaagataaactaatggccaaagctctgcttctgtacggtgcagacatcgagtcaaaaaataagtgtggtctcacccccctcttgctcggggtgcatgaacagaagcaacaggtggttaaatttctaattaaaaagaaggcaaacctgaatgtcttagataggtatgggagaaccgccctgattcttgccgtctgctgtgggagcgcctctatcgtgaacttattgctggagcagaacgtggatgtgtcaagtcaggacctgagcggccaaaccgcacgagagtatgctgtgagcagccaccaccatgtcatatgcgagctgctatcagactacaaggagaagcagatgctgaaaatcagcagtgaaaattcaaatcccgagcaggacttaaagctgacctcagaagaagaatcccagcgcttgaaagtgagcgagaatagccagccggagaaaatgagtcaagagccggagataaacaaggattgcgaccgggaagtcgaggaggagattaaaaaacacgggtctaatccggtggggctcccagagaacctgactaatggagcatcggctggaaacggtgacgatgggctcattcctcagagacgctcacgaaagccagagaatcagcagttccctgatacagagaatgaagagtaccacagcgatgaacaaaatgacacacgcaagcaactgtccgaggagcaaaacactgggatttcacaggatgaaatcctgactaacaaacagaaacagatcgaggttgctgagcaaaaaatgaatagtgagctatcactctctcacaagaaggaggaagacctgctacgggagaactcagtgcttcaggaagagattgccgtgttgcggctcgagctcgatgagactaaacatcaaaaccagttaagggagaacaagattctggaggaaatcgagagcgtaaaggagaaaacagacaaactgctgagagctatgcagcttaacgaggaggccctgaccaaaactaatatttag

SEQ ID NO: 49683 - DNA, 3228 bp, Artificial Sequence
  Description of Artificial Sequence: Synthetic coding sequence
atggtggtggaggtggacagcatgcccgccgccagcagcgtgaagaagccattcgggctgcgatcaaagatgggcaagtggtgctgcaggtgctttccatgctaccgtgagtcagggaagtcaaacgtagggacctcgggtgatcacgatgatagcgccatgaagacactccgatctaaaatgggtaaatggtgtcaccactgtttcccatgctgtcgtggcagtggcaagtcaaacgtgggagcaagtggcgatcatgatgacagcgctatgaaaacactgcgcaataagatgggaaagtggtgttgccactgcttcccttgttgcaggggctcaggtaagtcgaaagtgggagcttggggcgactacgatgactccgctttcatggagcccagataccacgttaggggggaggacttagacaaattgcatcgcgccgcttggtggggcaaggttcccaggaaagacctcatcgtgatgcttagggacactgacgtgaataagaaagataagcaaaaacgaaccgcacttcacctagcatcagctaatgggaatagtgaggtcgtgaagctacttctagacaggaggtgtcagttgaacgttctcgacaacaaaaaaaggacagccttaattaaagcagtgcagtgtcaggaagacgaatgtgccctcatgttgttagaacatggtacggaccccaatattcccgacgaatatggtaatacaacactgcactacgccatttataatgaggacaagctgatggccaaagccctgctcctgtatggcgccgatatagagtcgaaaaacaagcacggactgacccctttacttctcggggtgcacgaacagaaacagcaggtggtcaaatttctgattaagaaaaaagctaatctgaacgctctcgatcggtacggcagaaccgcgttaattctggccgtgtgttgtggttctgcttccatcgtgtccttgctcttggagcagaacatagatgtgtcgtcacaggacctcagtggccaaacagcccgagaatacgccgtaagctcccaccatcatgtaatctgccagctgctgagcgattataaagagaagcagatgctcaagattagctctgaaaatagcaatccagagcaggaactaaagctgaccagtgaggaggagtcgcaacgcttcaaggggtcagaaaattcacagccggaaaaaatgagtcaggaactggagataaataaggatggcgatcgggaggtagaggaagagatgaaaaagcacgagtccaataacgtaggcctgttggagaaccttaccaacggagtaactgcaggcaatggagacaatggacttatcccccagaggaaaagcaggaccccagagaaccagcagttccccgataacgaaagtgaggaataccacagaatttgtgaacttctcagcgactataaggaaaagcagatgccaaaatattcttcagaaaactcaaatccagagcaggatttgaaactcacttccgaagaggagtcacagaggctaaaaggatctgaaaatgggcaaccagagaagcgttcgcaggagccagaaataaacaaggatggcgaccgtgagctggaaaattttatggcgatagaagagatgaagaaacatggcagtacccacgtcgggttccccgagaaccttaccaatggggccaccgcaggaaatggcgatgacggcctgataccccctaggaagtcacgcacacctgaaagtcagcaatttcctgatactgaaaacgaagaatatcactcagacgagcaaaacgatactcagaagcagttttgcgaggagcagaacaccggcattcttcacgatgagatattaatccacgaagagaagcagattgaggtggtagagaagatgaacagcgagttgtccctgagctgcaagaaggaaaaggatgtgcttcacgaaaactccacactacgcgaagagattgccatgctgcggctggaattggacacgatgaaacaccagagccagctgcgggagaaaaagtatttggaggacattgagtcagtcaaaaagaaaaatgataacctactgaaagcgctacaattgaacgagttaacgatggacgatgacactgcggtgctcgtgatcgacaacggttccggcatgtgtaaggccgggttcgctggggatgacgctccccgcgcggtattcccaagtatcgtgggtaggcctcgccagcaggggatgatgggggggatgcatcaaaaggaatcctatgtggggaaagaggcccagagtaagcgtggaatcctcactctgaagtatccgatggagcatggtatcattacgaattgggacgatatggagaagatatggcaccatactttttataacgaactgagagtggcgccagaggaacatcccatcctgctgaccgaggcaccgctgaatcccaaagccaaccgagagaagatgacgcagatcatgttcgagacttttaatactccagcaatgtatgtggcaatccaggcagtgccctccctctataccagtggcaggaccactggaatagtgatggacagcggcgacggagtcacccacactgtgcccatctatgaggggaatgctctgccacatgccactttaaggttggacctagccggccgcgaacttcctgattacttgatgaaaattctcaccgagagagggtatcgatttaccaccatggctgagcgggaaatcgtgcgcgacatcaaagaaaagctgtgctatgtagctctggactttgagcaggagatggcaaccgccgccagcagctcctctcttgagaagtcctatgagctccctgatggccaggtcatcacaattggcaacgagcggtttcgctgtcctgaggctttatttcaaccctgttttttgggtatggagagctgcggaatacacgaaacgacgttcaacagcatcatgaagtctgacgtcgacattcggaaggacttatatactaacaccgtgctttcaggaggcaccaccatgtatccggggatggcacacagaatgcaaaaggagattgcagcgctggcaccctctatgatgaagattagaataatcgcccctcctaagaggaagtatagcgtttgggtcggaggttccatcctggcctccctctcaacgttccagcagatgtggatctctaagcaggagtatgacgagagcgggcctagtatcgtgcaccggaagtgcttctag

SEQ ID NO: 49684 - DNA, 1185 bp, Artificial Sequence
  Description of Artificial Sequence: Synthetic coding sequence
atggtggtggaggtggacagcatgcccgccgccagcagcgtgaagaagccgttcggactgagaagcaagatgggtaagtggtgctgccgatgtttcccgtgctatagagagtctggtaagagtaatgtgggtacgtccggggatcacgacgacagcgcgatgaaaactctgcggtcaaaaatgggaaaatggtgccaccactgcttcccatgctgtcgggggagtggcaaatctaacgtcggggcatccggggatcacgacgatagcgctatgaagactcttcgaaataagatggggaaatggtgctgccactgtttcccatgctgtagaggttctggcaaatccaaggtaggagcctggggcgattatgatgattctgcttttatggagccaaggtatcatgtacggggggaggacttggacaaacttcaccgggcggcatggtggggaaaagtgcctcgcaaggacctcatcgtcatgctgcgtgataccgatgtcaataagaaagataagcagaaaaggacggctttacacctggccagtgctaatgggaattctgaggtggtcaaactgctgctcgataggaggtgccagctgaatgtgttggataacaaaaagaggactgcactgatcaaagtctgctccagccaactctaccagcatgaagccgtgcagtgccaggaggatgagtgcgcccttatgctcctcgaacacgggactgaccccaatatccctgacgagtacggcaatactacattgcattacgctatttacaacgaagacaaacttatggccaaggcccttctgttgtacggtgcggacattgagagcaagaacaaacatgggctgacccctctcttgttaggtgtgcatgagcaaaaacagcaggtggttaaattccttattaaaaaaaaggcgaacctgaacgctctcgaccgatacgggcggactgccctcatccttgctgtttgctgcggctcggccagtattgtgagcctgctgctcgagcagaacatcgacgtctctagccaggacttgtcaggccaaacagcacgcgaatacgcggtgtctagccatcatcacgtcatttgtcagctcctgagcgattataaagagaaacagatgctgaaaatctccagcgagaactcaaacccggagaatgtatccagaacaaggaacaaatag

SEQ ID NO: 49685 - DNA, 1527 bp, Artificial Sequence
  Description of Artificial Sequence: Synthetic coding sequence
atggtggccgaggccggcagcatgcccgccgccagcagcgtgaagaagcctttcggcttaagaagcaagatgggtaagtggtgcagacactgcttcccctggtgccggggaagcgggaaaagtaacgtcggaacatccggagaccacgacgactccgccatgaagacactacggagtaaaatgggcaaatggtgtagacattgcttcccttggtgtcgcggtagtggaaagtccaacgtcggtacaagtggggatcacgatgacagcgctatgaaaactctgcgcagtaaaatgggaaaatggtgttgtcattgctttccgtgttgtcggggatccggcaaaagtaaagtcgggccatggggagactacgatgattctgccttcatggagccacgatatcatgtccgacgggaggaccttgataagctccaccgcgccgcctggtggggaaaggttccacgcaaggacttgattgtcatgctcaaggatacagacatgaacaagaaagataaacagaaacggacagccctccacctcgcgtctgccaacggcaactccgaagtggtgaagttactgctcgatcgtaggtgtcagctgaacatcctggacaacaagaaacgcaccgctcttacaaaagccgtgcagtgccaggaagacgaatgcgctttaatgctgctagagcacgggacggaccctaacattccagacgagtatggaaatactgccctgcactatgcaatctacaatgaggataaacttatggccaaggctcttctgttgtatggggccgacatcgagtcaaagaacaagcacggccttacaccactgcttttgggggttcatgaacagaagcaacaggtagtgaagttcctgatcaagaaaaaggctaatctcaacgcgctagaccgatacgggagaacagtgttaattttggctgtctgttgtggttcagcatctatcgtgtcgctacttcttgaacagaacatcgatgtgtctagtcaggacctgtccggacagacagccagagagtacgcagtgagttccaggcacaatgtgatctgccagctgctgtccgattacaaggagaaacagatcctcaaagtgtcgagcgaaaattccaatcccgagcaggacttaaaactgacctcagaagaagagtcccaacgactgaagggctcagagaactctcagcccgaagagatgagtcaagagcctgaaattaacaagggaggggatagaaaagtggaggaagagatgaagaagcatgggtccacccatatgggctttccagagaacctccctaacggcgccactgccgacaatggggatgacggcctgatccccccgcgaaaatcaaggacccccgagagccaacaattccccgataccgaaaacgagcagtatcacagcgatgagcagaacgatactcaaaaacagctgtcagaggagcagaataccggcatcctgcaggatgagatcctcatccatgaagagaaacaaatcgaggtggctgagaatgaattttag

SEQ ID NO: 49686 - DNA, 1629 bp, Artificial Sequence
  Description of Artificial Sequence: Synthetic coding sequence
atggtgaccgaggtgtgcagcatgcccgccgccagcgccgtgaagaagccttttgacctgcggagtaagatgggcaagtggttccaccaccgctttccctgctgtaagggctccggcaagtctaatatggggacgtctggagaccacgatgactccttcatgaagatgcttcgatctaaaatggggaagtgctgccatcattgcttcccatgttgcagaggttcggggacctcgaacgtcggtacttctggagatcatgacaattccttcatgaaaacgttgagaagcaagatgggtaaatggtgttgccattgctttccgtgttgcaggggctctgggaagtctaacgtcggggcttggggcgactatgatgactctgctttcatggagccaaggtatcatgtccgacgagaggatctggataagctgcacagggccgcttggtgggggaaggtccccaggaaagaccttatagtgatgttacgtgacacagacatgaacaagcgagacaaacagaagcggactgcactccatctggcatcagccaatgggaattccgaggtcgtccagttactcctggacagacgctgtcagctgaatgtgctggacaacaaaaaacggacggccctgatcaaggccgtgcaatgtcaagaggacgagtgcgttcttatgctgctggagcacggggccgaccaaaacattccggatgagtatggtaacaccaccctgcattatgcggtgcacaacgaagacaaactcatggcaaaagctttacttctgtacggtgcagacatcgagtccaaaaacaagtgcggtctgacccctcttctactgggtgtccacgagcaaaaacagcaggtagtcaaattcctgatcaagaagaaggcaaacctcaatgcgctggaccgctatggaaggactgcccttattcttgcagtttgctgtggttccgcatcaattgtgaacctgctgctggaacagaatgtcgatgtttccagtcaggacctgtccggtcagacagcccgggaatacgccgtgtcatcacatcatcacgtgatctgcgaacttctcagcgactacaaggagaagcagatgctgaaaatatccagcgagaattctaatccagaacaagatctgaaactgacctctgaagaggagagccaacgcctaaaggtatcagagaatagccaacctgaaaagatgtctcaggagcctgaaatcaacaaggactgcgaccgtgaggtagaagaagagataaagaagcacggaagtaatcccgtcgggttacccgaaaacctgacaaacggcgccagcgcagggaatggagacgatggccttatcccccagcgacggagccgcaagccggaaaaccaacagtttcccgacacagaaaacgaggaataccattccgacgagcagaatgatacccggaagcagctaagtgaagagcagaataccggcattagccaggacgaaattctgacaaacaagcagaaacagattgaggtcgcggagaaaaaaatgaattcagaactatctctgtcccataaaaaggaagaagacttgctgagagagaatagtatgctgcaggaagaaatcgctatgctcatcagcggcgactggaactag

SEQ ID NO: 49687 - DNA, 1146 bp, Artificial Sequence
  Description of Artificial Sequence: Synthetic coding sequence
atggtgaccgaggtgtgcagcatgcccgccgccagcgccgtgaagaaaccctttgatttgagaagcaaaatgggcaagtggttccatcaccgatttccttgctgcaaaggcagtggaaaaagtaatatggggactagcggcgatcacgatgattcctttatgaagatgctgaggagcaagatgggaaagtgctgccaccattgcttcccgtgttgcagaggctctgggacgagcaatgtcggaacaagtggggatcacgataacagcttcatgaaaaccctgcggtctaaaatgggaaaatggtgttgtcattgcttcccatgctgcagggggtcagggaaatctaacgtcggagcttggggtgactatgacgactccgcctttatggaacccaggtaccacgttcgccgcgaggatctcgataagctgcatagggccgcctggtggggaaaggtgccacgcaaggatctgattgttatgctccgtgacaccgatatgaacaagagggataagcagaagcgtaccgctctccatttagcgagtgccaacggcaactccgaggtcgtgcaactgctcctggataggcgttgtcaactgaacgttctggataataaaaagcggacagccttgatcaaagctgtacaatgccaggaggacgagtgcgtgcttatgctactggagcatggggccgaccagaatataccagacgagtatggcaataccacccttcactacgcagtgcataatgaagacaagttaatggcaaaagcacttctgctttacggcgccgacattgaatctaagaataagtgtggcctcacacctctcctgctcggtgtgcatgagcagaagcagcaggtggttaagttcctgataaaaaagaaagcaaacctcaacgctctcgatcgctatggacgaacggccctcattctggcagtttgttgtggcagcgcctctattgtcaaccttctcttagagcaaaatgttgacgtttcttcgcaggatctctctggccaaaccgcccgggaatatgcagtcagctcccatcaccatgtgatttgtgagctgctttccgattataaagaaaaacagatgctgaagataagttccgagaattctaatcctggtaaagaggcggaagagtag

SEQ ID NO: 49688 - DNA, 1527 bp, Artificial Sequence
  Description of Artificial Sequence: Synthetic coding sequence
atggtggccgaggccggcagcatgcccgccgccagcagcgtgaagaagccattcgggctacgctctaagatgggcaaatggtgccggcactgttttccatggtgtcgcggatccggtaaatctaacgtggggacctctggagatcacgatgactcagccatgaaaacactgcgaagcaaaatggggaagtggtgtaggcactgctttccttggtgcaggggctcaagcaagagcaacgtggggactagcggagatcacgatgattcagccatgaaaacgctcaggagtaagatgggcaaatggtgctgtcattgtttcccatgctgtcggggtagtggcaaatctaaggtgggaccatggggcgactacgacgacagcgcgtttatggagccacgctatcatgtaagaagggaagatctggataaactccatcgtgctgcctggtgggggaaggttccgcgcaaggatctgattgtcatgcttaaagacacagacatgaataagaaagataagcagaagagaaccgcattgcatctcgcttcagccaatggcaacagtgaggtggtcaagctgttacttgaccgacggtgtcagttgaacattttagataataaaaaaaggacagccttgactaaggcagttcagtgtcgagaagacgaatgcgcactcatgctcctggagcacggaaccgaccccaacataccagacgagtacgggaacaccgccctccactatgccatatacaacgaagataaacttatggctaaagcattactcttatacggagctgacatcgagtctaagaataagcatggactgactccacttctcctcggtgtccatgaacagaaacagcaggtcgttaaattcctgattaaaaagaaagcaaatcttaacgctttggacaggtacggcagaaccgctcttattctggcggtatgctgcggatccgcatcaatcgtttcacttttgctcgagcagaatattgacgttagcagccaggatctgagcggtcagactgctagagagtacgcggtctctagccatcataatgtaatctgccagctgctcagcgattacaaggagaagcagatgctcaaagtgagctcagagaatagcaatcccgagcaggacctgaagctcactagcgaggaggaaagccagagactaaagggctcagagaacagccagcccgaggaaatgagtcaagaacccgagatcaacaaaggaggcgatcggaaagtcgaagaggaaatgaagaaacatggctcaacacacatgggctttcccgaaaacctgcctaacggcgctaccgcggataacggggacgacggtttgatcccaccacggaaaagccggacccccgagagccagcagtttcccgataccgaaaacgaacagtatcattctgacgaacagaatgatacccaaaaacagttgagcgaagagcagaacaccggcattcttcaggacgaaattctgattcatgaggagaagcagatcgaagtggccgaaaatgagttttag

SEQ ID NO: 49689 - DNA, 1461 bp, Artificial Sequence
  Description of Artificial Sequence: Synthetic coding sequence
atggtggccgaggccggcagcatgcccgccgccagcagcgtgaagaagcccttcggtttgcgctcgaaaatgggaaagtggtgtagacactgcttcccttggtgtcggggtagtggaaaaagtaatgtcggaacctcaggagaccatgatgactcagcaatgaaaactcttcggtctaaaatggggaaatggtgtagacattgctttccttggtgccgcgggtcaggcaaaagcaacgttggcacgtcaggagatcacgatgacagtgcaatgaagaccctgcgctctaagatgggtaaatggtgttgccactgtttcccttgctgccgagggtctggaaagtccaaggtgggcccctggggggactatgatgacagtgcctttatggaaccacgatatcacgtgagacgcgaggatctggacaaactgcatcgagccgcctggtggggaaaggtgccaagaaaggatcttatagtgatgctcaaggatactgatatgaataagaaagataagcaaaaacgcactgccctgcacctggcaagtgccaacggcaatagcgaagttgttaaactactgttggatagacggtgtcaactgaacatccttgataacaagaagagaaccgctctcaccaaggctgtgcaatgtcaggaggatgagtgtgccttgatgcttctagaacacggcaccgatcccaatattccggacgagtacgggaatacggcactgcactacgcaatttacaacgaagataaactgatggccaaggccctgctgttgtatggagctgacatagaatctaagaacaagcacggcctgacccccctgctgttgggtgttcatgagcagaagcaacaggtggtgaaatttttgatcaaaaaaaaggccaacctcaacgccctagatcgctacggcagaaccgtcttgattctggctgtgtgttgcgggtcagcatccattgtttccctgttgctggagcagaatatcgacgtcagctctcaagacctgtcaggccagacggctcgtgaatatgccgtttcctctagacacaatgtcatatgccagctgctttcggactacaaggagaagcagattctgaaggtgtcctctgagaacagtaaccctgaacaggatttgaagctgacctctgaggaagaatcacagcggttgaagggcagcgagaattcccagcccgaggaaatgagtcaggagccggagatcaataaaggaggcgacaggaaggtagaagaggagatgaaaaagcacggctccacccatatgggttttcctgagaacttgccgaatggagccacagccgataatggagacgatggacttatccccccccggaagagcagaaccccggagtctcagcagttcccagacactgaaaacgagcaatatcatcgggattttagcggccacccaaatttcccaaccactttgccgatcaaacagtag

SEQ ID NO: 49690 - DNA, 1782 bp, Artificial Sequence
  Description of Artificial Sequence: Synthetic coding sequence
atggtggccgaggccggcagcatgcccgccgccagcagcgtgaagaagccttttggactgagaagcaagatgggcaagtggtgccggcactgcttcccttggtgcagaggcagcggcaagagcaacgtgggcacatcaggcgatcacgatgatagtgccatgaaaacactgagatccaagatgggaaaatggtgtagacattgcttcccctggtgtcgcgggtccgggaaaagcaacgtgggcacgagcggcgatcacgacgactcggcgatgaagactctccgcagtaagatggggaaatggtgttgccattgctttccctgttgcaggggctccgggaaaagcaaggttgggccttggggggattatgacgattccgcgtttatggaacctcggtatcacgtgcgccgcgaagacctggataagctccacagagcagcatggtggggcaaggttccccggaaggacctcattgtaatgctgaaagatacggacatgaacaagaaggataagcagaagcgcaccgccctccatctggcctccgctaatggaaatagcgaggtggtgaaactgctcttggaccggcggtgccaactgaatatcctcgacaataagaaaagaaccgctctcaccaaggctgtgcaatgccaggaggacgagtgcgctctcatgctgctggagcatggaacggatcctaatattcctgatgaatatggaaatactgcactgcattacgcaatctacaacgaagataaactgatggcaaaggccctgcttctgtatggggctgacatcgagtctaaaaacaaaatcgaaagtcacagtgtgagccaggcgggagtccaatggtgtgaccactcttccttacagcctagaccccctgaggcacagatggtcctgcagcctcagccccagttctttttcctctcttttttcttgttcctttttctgtttctgttctttttttcaagggatgaggtattcgctatgttcctgaggttggtgctgaacagttgggcacaggcaattcacccaccccaaccacctaaggtgctagggctacagcatggactgaccccacttctcctgggtgtacacgagcagaaacagcaggtggtcaaattcctgattaaaaaaaaggccaaccttaatgcgctggacagatacgggagaacagtgctgattctggctgtttgttgcggttctgcctcaatcgtctccttgctcctggaacagaacattgatgtttcttctcaggatctgtccggccagactgcaagggagtacgccgtaagcagccgtcataacgtgatttgtcagctcctctctgattacaaagagaaacagatcctaaaagtcagctccgagaactccaatcctgagcaagacttgaagctgacgtccgaagaggagtcccagaggcttaaagggtccgagaacagtcagcccgaggagatgagccaggagcctgaaatcaacaaagggggggataggaaggtcgaagaggagatgaagaagcacggctccacgcatatgggattcccagaaaacctgcccaatggagcaactgccgacaacggcgacgacggactcatacccccccggaagagtcgcactcccgaaagccaacagttcccagacaccgagaatgagcagtaccactccgatgagcaaaacgacacccagaagcaactctctgaggaacaaaacaccggaattttgcaggatgagatacttatccatgaagagaaacagatcgaggtcgcagaaaatgagttctag

SEQ ID NO: 49691 - DNA, 1080 bp, Artificial Sequence
  Description of Artificial Sequence: Synthetic coding sequence
atggccggccacctggccagcgacttcgccttcagccccccccccggaggcggcggggacgggccgtggggggccgaacctggatgggtggacccattaacttggcttagcttccagggccccccaggtggccctggcatcggacctggcgttggaccaggctctgaagtgtggggtatcccaccgtgtccacccccgtatgagctgtgcggtggcatggcatactgcggtccgcaggtgggggttggcctggtgcctcaaggcgggctcgagacaagccagccggaaagcgaagccggagtcggcgttgaatccaattcaaacggggcatctcctgagccctgcactgtgccccccggcgcggtgaagttggaaaaggaaaagctcgagcagaatcccgaaaagagccaggacataaaagctcttcagaaggagctggaacagttcgcaaagttactgaaacagaagagaattactctgggctacacccaggctgatgtaggtttgatcctgggcgtgctcttcggcaaagtatttagtcagaagacaatttgcagattcgaggctctgcagctgtcatttaagaacatgtgtaagctgagaccgttgctacaaaagtgggttgaagaagcggacaacaacgagaatctccaggagatatgcaaagctgaaaccttgatgcaagcccgcaaacggaagagaacttcgatcgagaaccgggtgcggggaaacctagaaaaccttttcttgcagtgtccaaagcctaccctgcagatatcccacattgcgcagcagctgggcctggagaaagatgtagttagagtgtggttttgtaatagaaggcagaagggtaagcggagttctagtgactatgctcaaagggaggattttgaagccgctggctcaccattttccggcggacccgtgtcgttcccccccgctcctggcccccattttggtacgccaggctacggtagccctcatttcacagctctgtattcctctgtgcccttccccgagggcgaggtctttccaccagtgagtgtgatcacccttggtagtccaatgcactcgaattag

SEQ ID NO: 49692 - DNA, 1080 bp, Artificial Sequence
  Description of Artificial Sequence: Synthetic coding sequence
atggccggccacctggccagcgacttcgccttcagccccccccccgggggagggggagacggcccctggggggctgagcctgggtgggtggacccactcacgtggctgtcgtttcaggggccacccggaggccctggcataggacccggtgtgggacctggttctgaagtttgggggatccctccttgcccaccgccctatgagctttgcggcggtatggcctactgtgggcctcaggtgggggtgggccttgtacctcaagggggcctggagacaagccagccagaatccgaagccggagtgggtgtggaatctaacagtaacggcgcttctcccgagccatgcactgtcccccccggcgccgtgaagcttgagaaagagaagctggagcagaatccggagaaatcgcaggacatcaaggctctgcagaaggaactggaacaattcgcaaagttactgaaacaaaaaaggattactctcgggtacacccaggcagacgtgggcttgattctcggggttctgttcggaaaggtgttctcacagaaaaccatctgtaggtttgaggctctccagttgtccttcaaaaatatgtgcaagctgcggccactgttgcaaaagtgggttgaggaggccgacaataatgaaaatctgcaggagatttgtaaggctgaaactctgatgcaggcgcgtaagcgcaaacggacctccattgagaatcgtgtgcggggtaaccttgaaaatctgttcctacaatgccccaagcccaccttgcagattagccacattgcacagcagctggggctagaaaaagacgtggtccgcgtgtggttttgcaacaggcgccagaaaggaaagcggtcctcttcagactatgcccagagggaggatttcgaggccgctggcagccccttctctggggggccagtgagttttcctcccgcaccaggtccccactttggcacccccgggtacggatcaccgcattttaccgctctgtactccagtgtacctttccctgagggcgaagtgttcccacctgtatccgttattacgctggggagtcccatgcactcaaattag

SEQ ID NO: 49693 - DNA, 987 bp, Artificial Sequence
  Description of Artificial Sequence: Synthetic coding sequence
atggccggccaccggcccagcaaccacttctgccccctgcccggctctggcggaggcgggcctaggggacctatgcccctacgtgtggacaccttgacatggctgagtacacaagcagctccgggccgtgtgatggtgtggcccgcagttaggccaggcatctgccccgggccagatgtctggaggatccccctgggcccactaccgcatgagttcagagggtggatcgccccctgccgcccaaggctcggggccagcgaagccggcgactggctgcgtcgaccgtctgaaggggctcttcctggcccctacatcgctcttcgtagcatacccaaactccctcctcccgaggacatcagtgggattttgaaggaattgcagcaactggccaaggagcttcgccagaagcgcctgtccctgggatactctcaggctgatgttgggatcgccgttggagccttgtttggtaaagtgctgtcccagactaccatctgtcggttcgaggcccagcagctgtctgttgcaaacatgtggaaactgcggcccttgctgaaaaagtggttaaaggaggttgaggccgaaaatctgctcgggctatgcaagatggagatgattctgcagcagtccgggaaatggcgccgggcctctcgcgaacgtaggataggtaactccctggagaagtttttccagcgatgccctaagcctacgccacagcagattagtcacattgcaggatgtcttcagctgcagaaggacgtagtgcgtgtctggttctacaataggagcaaaatgggatcacgaccaacaaacgacgccagcccccgcgagatcgttggtacagctggccccccctgccccggggcacctgtctgtttccatcttggactcgggttaccagtagacattccacattatactcgactgtatagtgcaggagtggcccatagttctgctccggcaactaccctgggcctcctccgcttttag

SEQ ID NO: 49694 - DNA, 2385 bp, Artificial Sequence
  Description of Artificial Sequence: Synthetic coding sequence
atgggccagagcggccggagccggcaccagaagcgggcccgggcccaggcacagctccgcaatctggaagcctatgcagccaatccacactccttcgtgtttacacgaggctgcactggccgcaatattcggcagctctccctcgacgttcgcagggtcatggagccactgactgccagccgcctacaggtccgcaagaagaactcactgaaggattgcgtggccgtggcggggccactgggtgtgactcatttcctgatcctatctaagaccgagacaaacgtgtactttaaactcatgagactgccaggcggccctactctgacttttcaagtgaaaaagtattccctcgtgcgcgacgtggtgagttcccttagacgccaccgaatgcacgaacagcagtttgcccacccaccactgctagtgctaaactcctttggtccccacgggatgcatgtgaagctcatggcaaccatgttccaaaatctgttccctagcataaacgtccacaaggtgaacctgaacactatcaagcgttgcttgctcatagattataacccagattcgcaggagctcgattttcgccactattccatcaaggttgtgcctgtgggggccagccgcggcatgaagaagctgcttcaagagaaatttcccaatatgtctcgcctccaggacattagcgaacttctggctacgggagcaggcctgtcagaaagcgaagccgagcctgacggcgaccacaacataacagagcttccgcaagctgtcgccggtaggggtaacatgagggcgcagcagtcagcagtgaggctgacagaaataggaccccggatgacactccagctcatcaaagtgcaggagggtgtgggagaaggcaaggttatgttccatagcttcgtgagtaaaacggaggaagaacttcaggccattttggaggctaaggagaagaaactgaggctcaaagcccagcgccaagctcaacaggcccagaatgtgcagcgcaaacaggaacagagagaagctcatcgtaaaaagagcctggagggtatgaagaaagcacgcgtaggcggctctgacgaagaggcgagcggaattccgtcacgcacagccagccttgaactgggtgaggatgacgacgagcaggaggacgatgatatcgaatatttctgtcaggccgtgggtgaggctccgtccgaggatctattccccgaagccaaacagaaaagactggctaagagcccaggccggaagaggaaaaggtgggagatggatcgcggcgctaagtcttgccccgccaactttctggcagccgctgacgataagctgtctggctttcagggtgactttctctggccaatcctggtggttgagttcctcgtggctgtggcgagcaatggcctggcactctatcggttttccattagaaagcagcgtccgtggcaccccgccgtggtgttctccgtgcagctcgcagtatcggacctgctctgcgcccttacactgcctcctttagcagcttacctgtaccccccgaagcactggagatatggggaggcagcttgcagactggagcgcttcctgtttacatgcaacctcctgggctccgtgatttttatcacctgcatctccctcaaccgctatctgggaattgtgcacccattcttcgcacgtagtcacctgagacctaaacacgcttgggccgttagcgcagccgggtgggtcctggctgccctgctggcaatgcctactctgtctttctcacaccttaaacgccctcagcaaggagcaggtaattgcagcgtggccagaccagaagcatgtattaagtgtctggggaccgccgatcacggcctcgccgcctacagggcttattcactggtcctggctggcctgggatgtggactaccactcctcctgactctcgctgcttacggggcgctaggccgtgccgtgctgcggagtcccggcatgactgtggcagaaaaactccgcgtggccgcactggttgcatctggtgtcgctttatatgctagtagctacgtgccatatcacattatgagagtgcttaacgttgacgcccgtaggagatggagcaccaggtgtccctcctttgcggatatcgctcaggctacggcagccctagagctaggcccttatgtgggctatcaggtaatgagaggcttgatgccccttgccttttgtgtgcacccccttctgtacatggctgccgtgccttcattgggctgttgctgcagacattgtcccggatatcgggattcgtggaatcccgaagatgctaagagcaccgggcaggcactacccctgaatgcaaccgctgctcccaagccatcagaaccacagagtagagagttgagccagtag

SEQ ID NO: 49695 - DNA, 1563 bp, Artificial Sequence
  Description of Artificial Sequence: Synthetic coding sequence
atgggccagagcggccggagccggcaccagaagcgggcccgggcccaagcccagctgagaaacctcgaagcctacgccgctaatccacatagctttgtgtttaccagaggatgcactgggagaaatatccgccagctaagtctcgatgtccgtcgggttatggagccactgacagccagccgcctccaggtgaggaaaaagaactccctgaaggactgtgtcgccgtggccggccccctcggagtaacccattttctaatcctgtccaaaacagagacgaatgtctacttcaagttaatgaggctgcctgggggccccactctaacctttcaagtaaagaaatacagcctcgtgcgagatgtagtatccagtcttcgacgccaccgcatgcatgaacagcagttcgcccatccgcctcttttggtgttgaactcttttgggccccacggcatgcatgttaaattaatggctacaatgttccagaatctgttcccatccattaacgtgcacaaggtgaacctgaacaccataaaacggtgcctcctgatcgattacaacccagattcccaggagctggattttagacattactcgataaaggtggtccccgtgggggcttcccgtggcatgaagaagctgttgcaagagaagtttcctaacatgtccagacttcaggatataagtgaactcctggctacgggagccggtttatccgagtccgaggcggagcctgatggagatcacaacatcaccgaactaccgcaggccgttgccggccgtggtaacatgcgggcccagcagtctgcagtcagattgactgagatcggacccaggatgaccctacagctgatcaaggtgcaagagggagtgggagaggggaaggtcatgttccactcctttgtgagtaaaaccgaggaagagttacaggcaatactcgaggctaaggagaagaaactgaggttgaaagcgcagcgacaagcccagcaggctcagaatgtccagcggaagcaggagcaacgcgaggcccacaggaaaaagtcactggaggggatgaaaaaagctagggtgggaggcagtgacgaggaagcctccgggatcccctcaaggacggcgagcttggagttaggggaggatgatgatgagcaagaggacgatgatatcgaatatttctgtcaggctgtgggagaggcccctagcgaggacctgttcccagaggccaaacagaagcgactcgccaaaagccctggccggaagcggaaacgatgggagatggatcgtgggcgggggagactgtgcgaccagaagtttcctaaaacaaaagataagagtcaaggcgcacaggtgcctagcccagccctccccaccagttggcagctacccaccacaaatagtgttgggagtagggggaccagttgtggaccatattggtggcttagctcctggtggccctggcctgctatggcatggccctgcactgcctctgcctccggcagttccgcccatggcacccctccttggtctagccttagctcatggcagtctgccacctgttccgccccgtag

SEQ ID NO: 49696 - DNA, 378 bp, Artificial Sequence
  Description of Artificial Sequence: Synthetic coding sequence
tgaagcctgcagtgcgtgaagctgggccgggccaccgcccggtggtggtgggtagtgaaggtcaagccacacgataaagatgcgaagatgaaatatcaggagtgcaataagattgtgaagcagaaggcattcgaacgcgctattgctggggacgagcataaacggagcgtggtggattccttggatatagagtccatgacaatcgagggcgaatatagtggacccaaactggaagatgataaggtaaccatcacatttatgaaaggcttgatgcagtggtataaggaccagaaaaaattacatcagaagtgtgcctaccaggactttcgacagaagtctggaataataactagccaagattgcgttcagaccacatag

SEQ ID NO: 49697 - DNA, 486 bp, Artificial Sequence
  Description of Artificial Sequence: Synthetic coding sequence
atgggcgccaaccagctggtggtgctgaacgtgtacgacatgtactggatgaatgaatacacgtcctcaataggaattggagtatttcactcggggatcgaggtgtacggcagggccgtggtactcggatccacagactttctcgaggatgatatcgaaaaaattgtagaggagctaggtaaagaatacaagggaaatgcatatcacttgatgcacaaaaattgtaatcatttctcatccgctctttcagagatcctttgtggcaaagagatcccccgctggatcaaccggttagcttacttctccagctgcatcccattcttgcagagctgtctgcccaaggaatggctgactccagcagcactgcagtctagcgtcagccaggaattacaagatgagctggaggaagcggaagatgccgctgcctctgctagtgtggccagtacagcggcgggctcaaggccaggtcgccatacaaagctgtag

SEQ ID NO: 49698 - DNA, 585 bp, Artificial Sequence
  Description of Artificial Sequence: Synthetic coding sequence
atgggcgccaaccagctggtggtgctgaacgtgtacgacatgtactggatgaatgagtacacttcctccattggcattggtgtgtttcattctggtattgaggtctacggccgcgaatttgcctacggcgggcacccatatccgtttagtggaatttttgagatctcccccggaaatgcttccgagttaggggaaactttcaagttcaaggaggcagttgtcttgggtagcaccgacttccttgaagacgatatcgaaaaaatcgtggaggagctcggaaaggagtacaaaggaaacgcttatcatcttatgcacaagaattgtaatcacttctcttccgcgctgtctgagattctctgtggcaaagagatacctcgctggattaatagacttgcttatttttctagctgcatccctttcttgcagagctgcctccccaaagagtggctgactcccgctgcacttcaaagttcagtgagtcaggagctacaagacgagctagaggaggctgaggacgcagccgcttccgcctctgttgctagtacggcggccggtagtcgtccagggcggcatacaaagctgtag

SEQ ID NO: 49699 - DNA, 306 bp, Artificial Sequence
  Description of Artificial Sequence: Synthetic coding sequence
atgcggctgaccttcctgaagaagatcgcccagctgaactacctggagatcctggtggtcctcctctcctatacacttaagaccacattccaatactggatgaatgaatataccagtagcatcggaatcggcgtgtttcattctgggattgaggtctatgggagagaattcgcctatggcggccatccatacccattcagcggaatattcgagataagtccagggaacgctagtgagttgggggagactttcaaatttaaggaggcagtggttctgggttcaacagactttctggaggacgattag

SEQ ID NO: 49700 - DNA, 3072 bp, Artificial Sequence
  Description of Artificial Sequence: Synthetic coding sequence
atgagcgcctacagcgtgcccagcaccttcgcccaggccagcctgcccgtacacaatcaagtgttgccttcgatcgagagcgtcgacgggtcagatcccctcgccaccctgcagaccccattagggagactggaggcgaaggaagaagaggacgaagacgaggacgaggatacggaggaagatgaggaagaggatggagaggacactgacctagacgattgggaacccgacccacctagacccttcgacccacacgatctgtggtgtgaggaatgcaacaacgcccatgccagtgtctgtccgaaacatggcccgctgcacccaattcctaatcgccctgttctgactcgcgcccgcgcgagtctgccgttggtcctgtacatcgatagatttctgggaggtgtcttttctaagcggcgcatccccaagaggacgcagttcgggcccgtagaaggcccacttgtcagggggagcgagctaaaagattgttacattcatctgaaggtcagcctggacaagggcgaccgcaaggagagggacctgcacgaggacctttggtttgagctgagcgatgaaacactgtgtaactggatgatgtttgttaggcctgcccaaaatcatctcgaacagaatctggtcgcgtaccagtatggccaccacgtgtactatacgactattaaaaacgtggaacctaagcaggagcttaaggtgtggtacgccgcctcttatgctgaattcgtgaaccagaagattcacgacatatcagaggaagagcggaaggtgctgcgggagcaggaaaagaactggccttgctacgaatgcaaccgaaggttcatttcatcagaacagttacagcaacatttgaactcccacgatgaaaagctggacgtgttctcccgcactagaggccgcgggcggggcagagggaaacggcggttcgggcccggccggagacccggacggccccctaaatttatacggctggagattacgtctgaaaatggggaaaaatctgacgacggcacacaggatttgctgcattttcctacaaaggagcaatttgacgaggccgaacccgccacccttaatggccttgaccaaccggagcagaccacaattcctatccctcagcttcctcaggaaacccagtcatcactcgaacatgagccggagacgcataccctgcaccttcagcctcagcatgaggagtcagtagtgcctacacagagtacactgaccgcagacgacatgcgccgtgctaaacggattagaaacgcagcccttcagcacctctttatacgaaaatcattccgtccctttaagtgcctgcagtgcggcaaagcttttagggagaaggataagcttgatcagcacttgaggttccacgggcgggagggtaactgccctcttacatgtgacctgtgcaacaaggggttcatctcttccacaagcctagagtcgcatatgaagcttcattccgaccagaagacatactcttgtatcttttgtcccgagagctttgatcgactggatctcttgaaagatcacgttgctattcacattaatgatggctactttacatgccccacctgcaagaaacggttccctgactttatacaggtgaagaaacatgttaggagttttcattcagagaagatctaccagtgtaccgaatgcgataaggcgttttgtagaccggacaaactgcgcttgcatatgctgcggcacagcgatagaaaggattttttatgtagcacctgtggcaagcagtttaagaggaaggataagctgcgagagcacatgcagcggatgcataatcccgaacgggaggccaaaaaggcagaccgtatctccaggagcaaaacgttcaagcccagaattacctccaccgactacgattcgtttacgttcaaatgcaggctgtgtatgatgggctttaggcgacggggtatgctggtgaatcatctgagcaaacgacaccctgacatgaagatagaagaagttcctgaacttactctgcctatcattaaacctaatcgagattatttttgccagtactgtgacaaggtgtataagtccgcctcaaagcgaaaggcccacatccttaaaaatcaccctggcgcggaattgcccccatctatcagaaaacttaggcccgctggaccaggcgagcctgatccgatgctgagtacacacacacaactcaccggaactattgcaacacctcccgtgtgctgcccccattgctccaaacagtatagcagcaaaaccaagatggtgcagcacatcagaaaaaagcaccctgagttcgctcagctgtccaataccatacacacacctctgactactgctgtgatctccgcaacccccgcagtgctcacaaccgacagtgccactggtgagaccgtggtcactacggacctcctcacacaggctatgacagagctctctcagacgctcaccaccgattacagaacgccgcaaggtgattaccagaggatccaatatatcccagtgtctcagagtgcatcaggactgcaacaaccacagcacattcaactccaggtcgtgcaagtcgctagcgtcagcggtcagccgttgtcaccctcagcccagcaggcccaacaggggctcagccctagccatatccagggaagcagttccacccaaggtcaggcgctccagcagcagcaacagcagcagcaaaactctagcgtgcagcacacatacctgccatcagcatggaactcatttcggggatacagcagtgaaattcagatgatgactctgcctcctggtcaattcgtcattaccgactctggtgtcgccacacccgtcaccactggacaggtgaaggccgtgacctccggacactacgtactgagtgagtcacagtctgagcttgaggagaagcagacctcggccctgagtggcggtgtccaggtggaacccccggcgcactccgattcattggatccacaaactaatagtcaacagcagacaactcaatatatcatcacaacaactacaaacggcaatggctcgtcggaggtacatatcaccaagccctag

SEQ ID NO: 49701 - DNA, 3483 bp, Artificial Sequence
  Description of Artificial Sequence: Synthetic coding sequence
atggacagcaaggacgagagcagccacgtgtggcccaccagcgccgagcatgagcagaacgctgctcaggttcacttcgtgccagacacagggaccgtggcccagatcgtctacacagacgaccaggtaaggccaccacaacaggtcgtgtacactgccgacggcgcttcttacaccagtgtggacggccctgaacatacactcgtgtatattcaccccgtcgaggcagcccagacactgtttactgacccagggcaagttgcttatgtgcagcaagatgctaccgcacagcaagcatccctccctgtacacaatcaggtgctcccttccattgagtcggttgatggcagcgacccactggcaacattgcagacaccattggggcgtctggaggctaaggaggaagaggatgaagacgaggacgaggacactgaagaagatgaagaagaggacggcgaagataccgacctggacgactgggagccagacccaccccgacccttcgatccccatgacttgtggtgtgaggaatgcaacaatgcgcacgcatccgtctgtccaaaacacggccctctccatcccattccgaaccggcctgtgttgacaagagcacgggcttccttgccactggtgctgtacattgatcgtttcctggggggagtgtttagtaagaggaggatcccaaaacgcactcagtttgggcctgttgagggtcctctggtccgcgggtccgaattaaaggattgctacatccacctcaaggtgagtttagataagggagatcgcaaagaacgagatcttcacgaggatctgtggttcgagctgtccgatgaaacactgtgcaactggatgatgttcgtgcgaccagcacagaaccacctggagcagaacctggtggcctatcagtatggccatcacgtctattatacaaccattaagaatgtggagcccaaacaagaactgaaggtctggtacgcggcgagctacgctgagttcgtcaaccagaaaatacacgatatcagtgaggaagagcgaaaggtgctgcgggaacaggagaagaactggccctgttacgaatgcaatcgccgttttatctccagtgagcaactgcagcagcatctaaactcacacgacgagaagcttgacgtcttttcaagaactagggggcgcggtcgagggcgggggaagagaaggttcggaccggggcggcgcccgggtcgaccccctaagttcatcagacttgaaatcacttcagagaacggcgaaaagagcgacgatggaacccaggatttgctgcatttcccaacgaaggagcagttcgatgaagctgagcctgcaactcttaacggtttggaccagcctgagcagacaaccattcctattccccaattaccccaagagacccaatcttcacttgaacatgaacccgaaactcacaccctccatctgcagcctcaacacgaagaatccgtggtaccaactcagagcacattaactgctgacgatatgaggagggctaagcggattcggctcgagctgcaaaatgcagccctgcaacatctgttcattaggaagagtttcaggccatttaaatgcctgcaatgcggcaaagcattccgggaaaaggacaagctggatcaacatctcaggttccatggcagagaggggaactgcccactgacctgtgacctctgcaacaagggattcataagctccacatccctggagagtcacatgaagctccactctgatcagaagacatacagctgcatcttctgtccggagtccttcgaccgccttgatctcctaaaggatcacgtggctatccacatcaacgacgggtactttacttgtcctacttgtaagaagcggttcccagactttattcaggtgaagaagcacgtgcgaagctttcactctgagaaaatataccagtgcaccgaatgcgacaaggctttctgtaggcccgacaagctcaggctccatatgcttagacattccgatcgcaaggactttctgtgcagcacctgcggcaaacaattcaaaagaaaggacaaactccgagagcatatgcagaggatgcacaatcctgaacgagaggccaaaaaggccgatagaatatcccgctcaaagacattcaagccccgcatcacttccactgattacgattctttcactttcaagtgccgactctgtatgatgggattccgcagacgcggaatgcttgtcaaccatttgtccaagcggcatccagacatgaagattgaggaagtgcccgaattaacacttcccatcataaagcccaaccgagattacttctgtcagtactgtgataaggtctacaagagtgcttctaaacgtaaggcccatattctcaaaaaccaccctggcgcagagttgccaccatccattcgcaaactccgacccgctgggcctggggagcccgaccccatgctgtccactcatactcaattgacgggcaccatcgccactcctccagtctgctgcccacattgttcaaagcagtactctagcaagactaagatggtccagcatatcaggaagaaacatccagagtttgcccagttgtcgaatacaatccacaccccccttaccacagccgtcattagcgccactccggccgtacttacaactgattctgccaccggcgagactgtagttactaccgatctcctcacacaggccatgaccgaactctcccagaccttgacgacagattatcgcacccctcagggggactaccagaggatacagtatattccagtttcccaatctgcgtctgggttgcagcagcctcaacatatccagctgcaggtcgtccaagtggcctcagccacatcacctcatcagtcccagcaatccactgtcgatgtgggccagctgcatgaccctcagccttatccacagcatgccatccaggtgcagcacattcaggtttctgaacccactgcctctgcgccttcttccgcccaggtgagtggccagcctctgtcgccctctgcgcagcaggctcagcagggtctatcccccagtcacattcagggtagcagttcaacacaagggcaggctctgcagcaacaacagcagcagcagcagaattcaagcgtacaacacacttacctccccagtgcctggaacagctttcgcggatatagtagcgaaatccaaatgatgacccttccccccgggcaattcgtcataaccgactccggagtggcgacaccggtgaccactggtcaggtgaaagctgttacttcgggtcattacgttctgagcgagtctcagtccgagttggaggagaaacagacgtcagccctgtctggcggcgtgcaggtcgagccacctgctcacagcgatagtctagacccccagaccaactcacagcagcagacaacacagtatattattacaaccactaccaacggcaacggatcaagcgaagtgcacatcaccaagccctag

SEQ ID NO: 49702 - DNA, 3471 bp, Artificial Sequence
  Description of Artificial Sequence: Synthetic coding sequence
atggacagcaaggacgagagcagccacgtgtggcccaccagcgccgagcatgagcagaacgctgcacaggtgcactttgtcccggataccgggactgtcgcacagatagtttacactgacgatcaggtgaggccacctcagcaggtggtgtacaccgcagacggcgccagttacactagtgtggatggccccgaacatacgctagtctacatccaccccgtggaggcagcccaaactctgttcactgaccccgggcaggtggcctacgtccagcaggacgctaccgcgcaacaagcctctctgccggtccacaatcaggttctgcctagtatcgagtctgtcgatggctcagatccgctcgctacactgcaaactcctctcggtcgattggaggccaaggaggaagaggacgaggacgaggatgaagacaccgaagaggacgaagaggaagatggcgaagatacggatcttgatgattgggagcccgacccacccagacccttcgacccacatgatctctggtgcgaagagtgcaataacgcccacgccagcgtttgccccaagcatggacctctccatcccataccgaaccggcctgtgctcactcgggcccgggctagcctgccattggttctgtatatcgacagatttctgggaggggtcttttcaaaaagacggatccccaagcgcacacagtttggcccagtcgaggggccactggtcagggggtccgaactgaaggactgttatatacacttaaaagtgtcccttgacaaaggcgacaggaaggagagagacctccacgaggatctctggtttgaactgagtgatgagacgctatgcaactggatgatgtttgtccgcccagcacaaaatcatcttgagcagaaccttgtcgcataccagtacgggcaccacgtctattacaccactatcaagaacgttgagcccaagcaggaactcaaagtgtggtacgcagcctcttatgccgaattcgtaaaccagaaaatccacgatattagcgaagaggagcgcaaagtgttgcgggagcaggagaagaattggccatgctacgaatgcaatagaaggttcatttctagcgagcaacttcagcagcacctgaactctcatgatgagaagttggatgtattcagtcggacacggggccgaggtcgcgggagaggcaaacggagatttggcccaggacgccgccccggacgccccccgaagttcattcgcctcgaaattacatctgagaacggcgagaagagtgatgacgggacacaggacttattgcactttcccaccaaagagcagtttgacgaagcagaaccagctactttaaatgggctggaccagcccgagcagacgacaatacccatccctcagttgccacaggagacccagagctcgcttgaacacgagccagagacccataccctgcatctgcagcctcaacatgaagagtcagtcgttcctactcaatcgacactcacagcggatgacatgcgaagagctaagaggattagaaatgcagctttgcagcatctgtttatcagaaagtctttccgccctttcaagtgtttgcagtgcggcaaggccttccgcgagaaagacaagctggatcagcacttaaggttccacgggcgcgaggggaactgccctcttacgtgcgacctttgcaacaagggctttataagctccacgtcgctggagagtcatatgaaattacacagtgaccaaaaaacttactcctgcatcttctgcccagagtctttcgatcggctggacctgcttaaggaccacgtggcaatccacataaatgatggttattttacctgtcctacttgtaaaaagcgctttccggacttcattcaggtgaagaagcatgtgaggtcatttcactccgaaaaaatatatcagtgcactgagtgtgacaaggccttctgccgccccgacaagctgcggctccacatgctgagacactccgacagaaaggactttctgtgttccacctgcggcaagcagttcaagagaaaagacaaactgcgggagcacatgcagcgaatgcataaccccgaaagagaggccaaaaaggccgataggatcagtagatctaaaaccttcaagccacgaatcacttccactgattatgatagctttacctttaaatgtcggctgtgtatgatggggtttcggcggaggggaatgctcgtgaaccatctcagtaagagacaccctgacatgaaaatcgaagaagtccccgagttaacactgccaatcatcaagcctaatcgagattacttctgtcagtactgcgacaaggtttataaaagtgcttctaagaggaaggcccatattctgaaaaatcatcccggcgccgagttgccaccgagcataaggaagctgaggccagccggcccaggggagcctgaccctatgctgtccacccacacacagttgaccggtacaatagcaaccccaccggtttgttgtccccactgctctaagcaatactcctccaaaactaaaatggtccaacatatccgcaaaaaacatcctgagtttgcacagttatcaaacacaatccacacaccgctgactactgccgtcataagcgcaacacccgccgtgttaaccaccgattccgccactggagagactgtcgttacaactgacctgctgacacaagccatgactgaattgtcacaaactctgacgactgattatcgtaccccgcaaggagactatcaaaggatccagtacattcctgtgagccagagcgcatctgggttgcagcaacctcagcatatccagttgcaggttgtgcaagtggcatcggccacctcacctcaccagtcacagcaaagcaccgttgacgttggtcagctccacgatccccaaccttacccccagcacgcaattcaggtccagcatatccaggtcagcgagcctaccgcctcagccccctcttccgcccaggtgagcgggcagccactgagccccagtgctcagcaggcccaacagggactgagtccctctcacattcaaggatcctcctctacacaaggacaagctctgcagcagcagcagcagcagcagcagaactcttctgtccagcacacatatcttccttctgcctggaattcattcagggggtatagctctgaaatccagatgatgaccctcccaccaggacagttcgtaattaccgatagtggtgtggccactccagtcacaaccggccaggttaaggctgttacatcgggacattacgtgctgagcgagtctcagagcgaactggaagagaaacagacaagcgcgttgtcaggaggagtgcaagtcgagccccctgcacacagcgacagcctggatccccaaactaactctcagcaacagacaacacagtatatcatcactaccaccaccaacgggaacgggtcctctgaggtccatataacaaagccctag

SEQ ID NO: 49703 - DNA, 3186 bp, Artificial Sequence
  Description of Artificial Sequence: Synthetic coding sequence
atgagcgcctacagcgtgcccagcaccttcgcccaggccagcctgcctgtccataaccaggttctcccttctatagagagcgttgacgggtctgatcccctggctacactacagacacctcttggcagactggaagctaaagaggaggaggacgaggacgaagatgaagacactgaggaagatgaggaagaggatggtgaggacactgatttagatgactgggaacctgaccctccacgcccttttgacccccatgacctctggtgcgaggaatgtaacaatgcacacgcaagtgtgtgtccaaaacacggacccctacaccctatccccaatcgccctgtgctgacacgcgccagggcatctctaccactggtcctgtacattgacagattcctgggcggggtcttttccaaaagacgcatacccaagcgtactcagttcggccccgtagagggtccgctggtccggggatccgagcttaaggactgctatattcacctcaaggtcagcctagataaaggcgacaggaaagagagagatcttcacgaggacctgtggtttgaactttctgatgaaacactatgtaactggatgatgtttgtgcgccctgctcagaaccatcttgagcagaacctagtagcttaccagtacggccaccacgtgtattacacaaccataaagaacgtagaaccaaaacaggagctcaaagtgtggtatgcagccagttacgccgagtttgtcaaccaaaagatccatgacatctcagaggaagaacggaaggtgctgagagagcaggagaaaaattggccatgttatgagtgcaatcggcgctttatatctagcgagcagttgcaacagcaccttaattctcatgatgagaagctggacgtattctctcggacaagaggacggggtcgcggtcgtggcaagcgccggttcgggccgggtcgcaggccaggaaggccccccaagttcatcagactcgagatcacctcagagaatggcgagaaatctgatgatggtactcaggacctgcttcactttccgacaaaggagcagtttgacgaggcagaacctgcaacattgaatggcctcgaccagccagagcagacaactatcccaattccgcagttgcctcaggaaactcagtcaagcctggaacacgaacccgagacccacaccctgcatctgcagccccagcatgaggagagcgtcgtgccaacacaaagcacactgactgccgatgatatgagacgggcaaaaaggatcagactggagttgcaaaatgccgcactgcagcacctcttcataaggaagtcctttaggccatttaaatgcctgcaatgtgggaaggctttccgtgaaaaggacaagctggaccagcacctgagatttcacggccgcgaagggaattgtcccctgacttgtgatctttgtaacaaggggtttatcagcagtacatctttagagagccatatgaaactgcattccgatcaaaagacatactcctgtatcttctgtcctgagagctttgacaggttggatctcctgaaggaccatgtcgccatacacatcaacgatggatacttcacgtgtccgacatgtaagaaacgattcccggattttattcaggtgaagaaacatgtgaggtcctttcacagcgagaaaatctatcaatgcactgagtgcgataaggccttctgccggcccgataaacttcggctgcacatgctaagacacagcgaccggaaggatttcctgtgctcaacctgtggcaagcagtttaagcggaaggacaagcttcgggaacacatgcagcgcatgcacaaccccgaaagggaggccaagaaagcggatagaataagccggagcaaaacttttaagcccaggatcaccagcacagactacgactcctttaccttcaagtgtcgactctgtatgatgggcttcaggcgtagaggcatgttagtgaatcacctgagcaagcgtcatcctgatatgaaaattgaggaagtgccagaattgaccctccccattatcaaaccgaaccgcgactatttctgtcagtactgcgacaaggtgtataagtcagcttcaaaacggaaggctcacatcctgaaaaaccaccccggcgcagaactgcccccttccatcagaaagctgcggcccgctggacccggtgagcctgacccaatgctgtctacccacacccagctcactggtaccatcgctacccctcccgtttgttgtccccattgttccaagcagtactccagcaaaacaaagatggtccagcacatcagaaaaaagcatcccgagtttgcccagctgtccaacaccattcacactccattaaccactgccgtgatatcagccacgcccgcggtactgacaactgatagcgcaacaggtgaaactgtggtgaccactgatctgctcactcaggcgatgacggaactgagtcagacccttacgacagactaccgcactcctcagggtgattaccagcgaatccagtacattcctgtcagccagtccgctagcggcctgcaacaaccacagcatatccaactccaagttgtccaggtcgcttccgccaccagtccccatcagtcccaacagagtacggttgacgtgggccagctgcatgatccccagccttatcctcagcacgccattcaggtgcagcacatccaggtgtcaggtcagcctttgagtcctagcgcacagcaggctcagcaagggctgtcccccagccatatacagggttccagttcaactcaaggtcaggccctgcaacagcagcagcagcaacagcaaaacagctctgtgcagcatacctatctgcccagcgcctggaactctttccgtggctacagctccgagatacaaatgatgacactacctccgggccagttcgttattacagactcaggggtggctactccagtgacaacaggccaggtgaaggctgtaacctccggccattacgttttgtccgagtcccaatctgagctggaggaaaaacagacttccgccctctctggcggcgtccaggtcgagccacctgcgcactctgactctctggacccccagacaaattcgcagcagcagacaacccagtacatcattaccactactacgaacggcaatggaagctcggaggtgcatattactaagccttag

SEQ ID NO: 49704 - DNA, 3225 bp, Artificial Sequence
  Description of Artificial Sequence: Synthetic coding sequence
atgagcgcctacagcgtgcccagcaccttcgcccaggccagcctgccagtgcacaatcaggtcctaccatcaattgagagtgttgacgggagtgatcccctcgccacgttgcagacgcctttgggcaggctggaggcaaaggaggaagaggatgaggacgaggacgaggatacggaggaagatgaggaggaggatggcgaagacacagatctggacgactgggaacccgaccccccaaggccattcgatccccatgacctgtggtgcgaggaatgcaataacgctcatgcgagcgtatgccccaagcacggtcccctacatccaatcccaaatagaccggtgttaacccgtgctcgggcgtcacttcccttggtgctctacattgaccgatttttgggcggagtgttctccaagcgtagaattcccaagaggacacagttcggccccgtcgaaggtccactggtgcgcggcagcgaactcaaggactgctatatccacctgaaggtgtccctggacaaaggagataggaaagagcgcgaccttcacgaagacttgtggttcgagctctctgacgaaactctgtgtaattggatgatgttcgtgagacccgctcaaaaccacttagaacagaacctcgtagcttatcagtacggacaccacgtttattacacgacaatcaagaacgttgagccgaagcaggaacttaaggtctggtatgctgcctcttacgcagagttcgtgaaccagaagatccacgacatcagtgaggaagaacgcaaagtgctacgcgaacaagagaaaaattggccctgctatgaatgcaatcgccggttcatctccagtgagcagctgcagcagcacctgaacagtcacgacgagaagctggacgttttcagtagaacaagaggtagaggcagagggcggggcaagagacgattcggccctggacgcaggccaggccggccccccaaattcattagactggagatcacatccgagaatggagaaaaaagcgacgatgggacccaggacctgctgcatttcccaaccaaagaacagttcgacgaggccgagcccgccactctcaacggactggaccaacccgagcaaacaacaatccccatccctcagcttccccaggaaacacagtcttcactcgagcacgagccagagacgcatacattacatttacagccacagcatgaagagtcggtcgttcccacccagtccactctgacagcagatgacatgcgccgcgccaaacggataagattagagctgcaaaatgcagccctacagcatctctttattaggaagtcattccggccattcaagtgcctgcagtgtgggaaagcattccgcgagaaggacaagttggaccagcacttaagattccacggtcgtgaggggaactgtccgctgacatgcgatctgtgtaacaagggcttcataagctccacatcccttgagtcgcacatgaagctgcatagtgaccagaaaacttatagctgcatcttctgccccgaatctttcgaccgcctggacctactcaaggatcatgtggctatccatattaatgatggttattttacttgcccaacttgcaagaaacgcttcccggacttcatacaggtgaagaagcatgtacggagctttcactctgaaaagatctaccaatgtaccgagtgtgacaaagccttctgtcggccagataagctgcgcctgcacatgttgagacactccgacaggaaggatttcctgtgttcaacctgcggaaaacagtttaagcggaaggacaagctgcgggagcacatgcagagaatgcacaaccctgagcgcgaggctaagaaagcagacagaatctcaagaagcaagaccttcaagccacgaattacttctaccgactacgactccttcactttcaagtgccgactttgcatgatgggcttccgtaggcgggggatgctagtcaaccacctttcgaagagacatcctgacatgaagattgaagaggttcctgaactaacgctgccaatcattaaaccgaaccgcgactatttctgccaatactgtgacaaagtctataaaagtgcctcgaagagaaaggcccacatattgaagaatcatccaggcgctgagctgcctccatctatacggaaattgaggcctgccggtcccggcgaacccgaccctatgctgagcactcacacccagctgacaggaacaattgcgacaccgcctgtctgctgtccccactgcagtaagcaatattccagcaaaacaaagatggtgcagcacatccgaaaaaaacaccccgagttcgcccaactgtctaacactatccacacccctttgactaccgccgtgatatcagccaccccggctgtgctgacaactgacagcgctacaggagaaacagtcgtcacaaccgacctgttgacacaggctatgacagagctgagtcagacgcttacgacagactataggactccccagggcgactaccagcggatacagtatatccccgtgtcccagtccgcatctggcctacaacagccccaacacatacaactacaggtcgtgcaggtggcctccgccactagcccacaccagtcacaacagtcaacggtcgatgtgggtcagttacacgacccccaaccgtacccacaacacgcgattcaagtgcagcacattcaggtaagtgagccaactgcctctgctccatctagcgcccaggtctcgggtcagccattatctccatcggcgcaacaggcccagcagggcctgtctccaagtcacatacagggcagtagctctacacagggccaagctctccagcagcagcaacagcaacagcagaactcctctgtgcagcatacttacttgcccagcgcgtggaattccttccgtggttatagctcggaaattcaaatgatgacactgcctccagggcaattcgtgatcaccgatagcggggtggctacccccgtcacaacgggacaggtgaaggctgtaacttctggccactacgtactatcagagagtcaatccgaactggaggagaaacaaacatcagccctttccggcggcgtgcaggttgaacccccagcacacagtgatagcctagacccccagactaattcacagcaacaaacaactcaatatatcataaccacgacaaccaatggcaacggatcaagtgaggtacacatcactaagccatag

SEQ ID NO: 49705 - DNA, 1536 bp, Artificial Sequence
  Description of Artificial Sequence: Synthetic coding sequence
atgctgaagatggccgagcccatcgccagcctgatgatcgtggagtgtagagcatgtttaagatgtagccctctgttcttataccagagggaaaaagataggatgacagagaacatgaaggaatgtctagcccagacaaacgcggctgtcggagacatggtgacagtcgtgaagacagaggtttgcagccctcttcgcgatcaggagtatggtcagccttgcagccggaggcctgattcctcagccatggaagtcgaacctaaaaagctgaaggggaagagagatctgatagtgcccaaatccttccagcaggtagacttttggttttgtgagagttgccaggagtacttcgtggatgaatgcccaaaccatggacccccagtgtttgtgtccgatactccggttccggtcggtatcccagaccgtgctgctttaacaataccacaaggtatggaagtggtgaaggataccagcggtgagtcagatgttcggtgcgtgaatgaagtcatcccaaaaggacacatttttggtccttatgaagggcagatttcaactcaggacaaaagtgcaggcttcttctcatggctgatcgtggataagaacaataggtataagagtattgatggatcagacgagacaaaagcgaactggatgcggtacgttgtcatctccagagaagaaagggaacaaaacctcttggccttccaacacagtgaaaggatctattttcgagcttgtagggatatacgccctggagaatggctgagagtgtggtacagtgaagactacatgaaaagactacatagcatgtcacaggagactattcaccggaacttagcacgcggagagaaaaggcttcagagagagaagtctgagcaggtgcttgacaatcccgaagatctcagagggcccatacacctaagcgtcctgcgacagggaaaaagtccttacaagcgcgggttcgatgagggcgatgttcatccacaggctaaaaagaaaaagatcgatttaattttcaaagatgttctcgaggcgagtcttgaatctgctaaggttgaggcccaccagctggccctttccaccagtctcgtcattaggaaggtgcccaagtaccaggacgacgcctacagccagtgcgccacaactatgacacacggagtccagaatattggtcagacccagggtgagggcgactggaaggtgcctcagggggtctcgaaggagcctggacaattggaggatgaggaagaggaacctagcagttttaaagcagatagtcctgcagaagcctctctcgcatcagacccacacgagcttcccaccacatcgttctgccccaactgcataaggctaaagaagaaggtaagagagctgcaggcagaactcgacatgctcaaatccggtaagctgccagagcctcctgtgttgcccccgcaggtgttggaacttccggaattttcagatccagctggcaagctggtctggatgagactgctcagcgaaggcagggttcgatcaggcctatgtggcggctag

SEQ ID NO: 49706 - DNA, 1536 bp, Artificial Sequence
  Description of Artificial Sequence: Synthetic coding sequence
atgctgaagatggccgagcccatcgccagcctgatgatcgtggagtgtcgcgcctgcctaaggtgcagccctctattcctgtatcaaagagaaaaggatagaatgactgaaaatatgaaagaatgccttgcacaaactaatgctgcagtgggggacatggtaacagttgtgaagacagaggtctgcagccccctgagagaccaggagtacggtcaaccctgttccagaagaccagacagttctgcgatggaagtagaacccaaaaaactcaagggcaagagagacctcattgtgccaaaatccttccaacaagtcgatttctggttttgcgagagttgtcaagagtacttcgtcgatgagtgccctaaccacgggccacctgtctttgtgtctgacacccccgtgccagtcggaattccagatagagcggccctgactatcccccagggtatggaagtagtgaaagacacaagcggcgaatcggatgtgcggtgcgtgaacgaagtcatcccaaaaggacacattttcggcccatatgaaggccagatttccacccaggacaagtctgctgggttcttctcatggcttatagtggacaagaataaccggtacaaatcgatcgacggcagcgatgagaccaaggctaactggatgagatatgtcgtcatttctagggaagagagagagcaaaacctgttggcattccagcacagtgagaggatctattttagagcatgtagggatatcagaccgggcgaatggctgcgggtgtggtattcagaagactacatgaaacggctacattcaatgagccaagagacgatccacagaaatctggccagaggtgaaaaacgacttcaaagagagaagagcgagcaggtgcttgataacccagaggatcttagaggacccatccacctctcagtgctccgtcagggaaaatccccatacaagcggggtttcgatgagggggacgtacatccccaagcaaagaaaaaaaagatagatctgatcttcaaagatgtgctggaggccagtctcgagagcgccaaagtggaggcccaccaacttgcactgtctacaagtctggttatccggaaagttcctaaataccaggacgacgcctactctcagtgcgcaaccaccatgacccatggtgtccagaacattggccagacccagggagagggggactggaaagtaccccagggggtcagcaaggaaccaggacagttggaagacgaagaggaagaaccgtcttctttcaaggccgacagtcctgcagaggctagcctggcaagtgacccccatgaactcccaaccacgagtttttgccccaactgcatcaggctgaagaagaaagtcagagaactgcaggccgagcttgatatgctaaagtccgggaaactacccgaaccgcccgtgctgcctccccaagtcttagagcttccagagttttccgatcccgcagggaagctggtgtggatgcggctcctttcagaggggcgcgtgagaagcgggctatgtggcgggtag

SEQ ID NO: 49707 - DNA, 1434 bp, Artificial Sequence
  Description of Artificial Sequence: Synthetic coding sequence
atgaccgagaacatgaaggagtgcctggcccagaccaacgccgccgttggggatatggtaactgtggtaaagaccgaagtatgctctcccttgcgggatcaggaatacggacaaccatgctctcgacggccagattcatctgccatggaggtcgaacctaaaaagctaaaggggaaacgcgatctcatcgtacctaaatctttccagcaggtggatttttggttttgcgagtcttgtcaggagtattttgtcgacgagtgtccgaaccatggcccacccgtctttgtgtctgatacaccagtacccgtcgggattccagatagagccgctttaaccatcccgcaggggatggaggtggtaaaggatacatcaggcgagtccgatgttcgatgtgtgaatgaggtgataccgaagggtcacatctttggaccttacgagggtcagatctctacacaggacaagagcgcagggtttttctcttggctgatcgttgacaaaaacaacagatataagagcatcgacggaagcgacgagactaaggcgaattggatgcgatacgtggtgataagccgggaagagcgggagcagaatctcttggcattccagcactctgaacgcatttatttcagggcttgcagagacattagacctggcgaatggctcagagtctggtattccgaggactatatgaagcgattgcactctatgagccaagaaactatccacaggaaccttgcacgtggtgagaagcgcctccagcgagagaagtcagagcaggtcttagacaaccctgaagatttgaggggacccattcatttatctgtcctgcgccaaggcaagtccccctataaacgtggcttcgatgagggcgatgtgcacccacaggccaagaaaaaaaaaatcgatttaatcttcaaggacgttttagaagcctctctggagagcgctaaggtggaagcgcatcagctcgcactgtcaaccagtctggtcatccgtaaggtgccaaaataccaagacgacgcttactctcagtgcgcaacaacaatgacacatggtgtgcagaacattgggcagactcagggagagggggattggaaggtgccccagggggtctcgaaggagccaggacagcttgaggacgaggaagaggaaccttcgtcgttcaaggccgatagtccagcagaagcctctctggcttccgaccctcacgaactgcctaccaccagtttctgtccgaactgcatccggctcaaaaagaaagtccgggagctgcaggcagagttagacatgctcaagtcggggaagttgccagagccaccagtgctcccaccacaggtgctcgagctgcccgagttcagtgaccctgctggcaagttggtgtggatgcgtctgttgagtgaagggagagtgagaagcggcctatgcggtggatag

SEQ ID NO: 49708 - DNA, 1425 bp, Artificial Sequence
  Description of Artificial Sequence: Synthetic coding sequence
atgagcatccaggcccccccccggctgctggagctggccggccagagcttgctgcgagatcaggcactctccatctcagcaatggaggaactcccacgtgtcctgtacctgccactatttatggaagcattctctcgccggcactttcagaccctgaccgtgatggtgcaggcatggccttttacttgcctgcccctggggagccttatgaagacattgcacttagagacactcaaggcactgctggagggtctgcacatgctgctcacccagaaggatcgcccccggagatggaagttgcaggtgttggatctgagagacgttgacgagaacttttgggccagatggcctggcgcctgggctctttcctgctttccagagactacttccaagagacaaacagcagaagactgcccccgcatgggggagcatcagcctctgaaggttttcatcgatatctgccttaaagagatccctcaggatgagtgcctccgctacctgtttcagtgggtgtatcagcgaagggggctggtgcacctgtgctgctctaaactcgtgaattaccttacacctatcaagtatctgcggaaatctctcaagattatctaccttaactctatccaagaactagaaatcagaaacatgtcctggcccagactgattagaaaactgaggtgctatctgaaggagatgaaaaacctccgaaaattggtcttttcccgttgtcaccactatacctcagataatgagctgcagggccggctggtcgccaagtttagttcagtctttttgagattagaacacttgcagctgctaaagatcaagctcataaccttcttttctggtcacctggaacagctcataagatgcctgcagaatcccttggagaacctggagcttacctacggatacctcctcgaagaggacatgaagtgcctgtcccaatacccgtcattgggttacctcaaacacttgaaccttagctatgtactcctattccggatatctctggagccacttggcgccctgttggaaaagatcgccgctagtttaaagaccctgattcttgagggttgccagatccactactcccagctgagcgccatattaccagccctttcccggtgttcccagctcacaactttttattttggacgaaattgcatgagcattgatgctcttaaggatctcttgcgacacacatctgggctctccaaactaagcctagaaacttaccctgcccctgaggagtcccttaactccctggtaagagttaactgggagatcttcactcctctgagggcagaactcatgtgcacccttagggaagtaagacagccgaaacgaattttcatcggtccaaccccctgtccttcatgcggctcttcccctagtgaggaactcgaactacacctgtgttgctag

SEQ ID NO: 49709 - DNA, 690 bp, Artificial Sequence
  Description of Artificial Sequence: Synthetic coding sequence
atgaagggcggcaaggcccaccagacctgccccttccacaaccggacatccgtgcttacggggcttgtgatcaccaatgaccccgtaagcgactctctctttgtgaaagggtgtttcgagctgcaggaacggtgtctacagaatccattggagaacctggaactgacctacggttacctcttagaagaggatatgaaatgtttgagccagtacccttctttaggatacttgaaacatttgaatttgtcttacgttctgctgtttcgcatttctttggaacccctcggggcactcctggaaaagatcgcagcatcccttaaaactttgatcctagagggttgccagattcactattctcaactgagtgccatcctgcctgcactatcccgatgctctcagctaactacattctacttcggacgaaactgtatgagcattgatgccctcaaggatttactgaggcacacttccgggttgagtaagctgtctcttgaaacataccccgccccagaggaatccttgaatagcctcgttagagtaaactgggaaattttcacgccactcagagctgaattgatgtgtacactgagagaggtgagacagcccaagcgtatattcatcggacctactccctgcccatcttgtggcagcagccccagcgaggagttggaactgcatctctgttgctag

SEQ ID NO: 49710 - DNA, 1425 bp, Artificial Sequence
  Description of Artificial Sequence: Synthetic coding sequence
atgagcctgcaggcccccagccggctgctggagctggccggccagtccctgcttcgaaatcagtttctgactatctttacactcgacgaactcccacgggaagtgtttcctttaatgttcatggaggcattctcaatgagacggtttgaggccctaaaattgatggttcaagcctggccattcctgagtcttccactgggcagtcttatgaagaccttacacctcgaaaccttgcaggcggtactccggggtttagacaccctcgtcgcccagaaagttcggcctagacgatggaagctgcaggtgcttgacttaagggacgtggacgaaaacttttggaccatctggtctggcgctcgtgtgctgtcttgttcccctgaggccatgtccaaacgccaaacagtggaggactgtcccagaatgggagagcatcagcccttaaaagtctttatcgacttgtgtctcaaagaatctaccctagacgagtgcttgagctatttattcggttggatacactataggcgcgggctcgtgcatctgtgttgcagcaaggtgcaaaattattccatgccaactagctcttttcggaatctgctggaaagaatttaccccgactctattcaggagctggaggtgtggaagaaatgttctctgaacaaaacgggtaaattcgccccttatttgtcccagatgagtaatttacgggagctgttcctcgcttttggctacgaacgagagctttatgtcagcgtgcagtggccttgcatcccagacctggattccccattcctgtgtctgtattatccgcagatgctctatataaagaagattagcaacatcaaggagcatctggaacacctattgcgatacctcaagaatcccctgggagcatttatcttttcagatgcttatctgacggatcgtgacatggagtgtttgtcccaatatcctagtctgagtcagcttaaggagctacgactgatacacatcctcatgtggactacccatctggaacctctgggggtgctgctagaaaaagtggctgctacactgaagaccctcgtgctgaaagattgccgtatccaggatccccaactgagagtgctgcttccggcattgagccattgctcccaacttacaacgttcaattttcacggcaacgagacttctatgaatgccctaaaggatctcctgcgccacaccgggggattgtccaaactgggattggagctgtacccagcccccctagaatcgctagactacaaggggcacgtgaattgggagatactcacgcctatccgggccgaattgatgagaacgctgagagaggtgcggcagccaaagaggatcttcttcggaccggtcccatgccctaactgcggcagttggccctctgaaaaagtggattttcacctgtgttcttag

SEQ ID NO: 49711 - DNA, 1434 bp, Artificial Sequence
  Description of Artificial Sequence: Synthetic coding sequence
atgaagatgagcatccggatccccccccggctgctggagctgggccgctcgcttctgagagatcaagccctggcagtctccacccttgaggaacttcctacggaactattcccaccacttttcatggaagcttttagcagaagacggtgcgaggccttgaaacttatggtgcaggcttggccatttcgaaggctgcccttgcggccactcattaagatgccctgtctggaggcctttcaggctgtcctcgacggcctagacgcactcctcacccagggcgtgcgccctaggaggtggaagctccaggtcctggacctgcaggatgtttgcgaaaatttttggatggtgtggtctgaagctatggctcacggctgtttcctgaacgccaaacgcaacaagacccccgtgcaggactgcccacgtatgcgagagcggcagccgctaaccgtatttgtcgaactttggcttaagaacaggacactggacgaatacttgacgtgtttacttctctgggtcaagcagaggcgcgacctgttacatctgtgttgcaagaagcttaagatcctggggatgcctttccgcaacatccgctccatactcaagatggttaacctggattgcatacaggaggtggaagtcaattgcaaatggatcctgccaatcttgacacaatttacaccctacttagggcatctcaggaacctccagaagctggtgctttcgcatatggacgtgtcccggtacgtgtctcccgaacaaaagaaggagatagtcacacagttcacaacacagttcctcaagctccgatgtctgcagaaattgtacatgaattcagtgtcttttctcgaggggcacctggatcagctcctttcgtgccttaaaacctctctgaaggtactgactattaccaactgtgtcctcctagagagcgaccttaaacacctgtctcaatgccccagcatcagccagctgaagacactagatctgtctgggatccgactgaccaactattcccttgtgccccttcagatcctgctcgagaaagttgctgcaactctggagtacctcgacttggacgactgcggcatcatcgacagtcaggtgaacgccattctaccagcgctttcgcgatgctttgagcttaacacatttagcttctgcggaaacccaatttgtatggcaaccctcgagaacctcttgtcgcataccattatcctcaagaacctttgcttggaattgtaccctgccccccaggagagttacggggcagatgggactctgtgttggagccgtttcgcacagatcagggcagagttgatgaagaaagtgaggcaccttcgacatcccaagcgcatcctgttttgcactgataactgcccagaccatggagatcggtccttttatgatctagaggccgaccagtactgctgttag

SEQ ID NO: 49712 - DNA, 1308 bp, Artificial Sequence
  Description of Artificial Sequence: Synthetic coding sequence
atggaggccttcagccggcggcggtgcgaggccctgaagctgatggtgcaggcctggccttttaggaggttacccctgaggcccctgatcaagatgccctgcttggaggccttccaagccgttttagacggcctagacgccttactaacccaaggggtcagaccccgccggtggaagcttcaggtactggatctgcaggacgtgtgtgaaaacttctggatggtctggagtgaggcaatggcacatggatgttttcttaatgctaaacggaacaaaacaccagttcaagactgtccgcgcatgcgggagagacaacctctcaccgtcttcgtggagttgtggctaaaaaatcgcactcttgatgagtaccttacttgtttgctcttatgggtgaagcagagacgggatctgcttcacctttgctgcaagaagttgaagattctggggatgcccttcaggaacatcaggagtattctgaaaatggttaatctggactgtatccaagaggtcgaggtaaattgtaaatggatcctgcccattctgacgcagttcaccccttatctgggtcacctccgtaacttacagaaactggtactttcacatatggatgtatccagatatgtgtctcccgaacagaaaaaggagattgtaactcagttcacaacacagtttctcaaactgcggtgtctgcaaaagctctatatgaatagtgtttctttcttggaaggccacctagaccaactgctgtcatgcctcaagacttccctcaaagtgctgaccataactaattgtgtgctcctggagagcgaccttaagcatttatcacagtgtccaagcattagtcagctgaagacccttgacctgtcagggatccgcctgactaattatagtctggtaccacttcaaatcctgctggaaaaagttgctgccactctcgaatatctggacctcgacgattgcggcattattgattcccaagtgaatgccatcctccccgccctatctaggtgtttcgaactaaatacgtttagtttttgcggcaatccaatctgcatggcaacgctggaaaacctgttgtctcacaccattatccttaagaacctctgcctggaactgtatcccgcccctcaggagtcatacggcgctgacgggaccctgtgttggtcgagattcgcacagatccgcgccgaattgatgaagaaggttcggcacctgcgccaccctaaaagaatcttgttctgtaccgataattgccctgatcatggtgatagatccttttacgatctcgaggctgaccagtattgctag

SEQ ID NO: 49713 - DNA, 1311 bp, Artificial Sequence
  Description of Artificial Sequence: Synthetic coding sequence
atggaggccttcagccggcggcggtgcgaggccctgaagctgatggttcaggcatggccgttcagacgtctgccactgcgccctcttatcaagatgccctgtttggaagctttccaagcagtcctagacgggctggacgcactcctgacacagggtgtgcgtccgcgccgctggaagctgcaggtgttagacctgcaggatgtctgtgagaatttctggatggtgtggagtgaagcaatggcacatgggtgcttcttgaatgctaagcgaaacaagacccccgtacaggattgcccgaggatgcgcgaaaggcagccccttaccgttttcgtggagctgtggctaaagaacagaaccctggacgagtacctgacttgcttgcttctatgggtaaagcagcggagggacctgctccacttatgttgcaagaagctgaagattctgggcatgcctttccgaaacattaggtcaattttgaaaatggtcaacctggattgcatccaagaggtggaagtgaactgtaagtggatcctccctatcctgactcagttcactccgtatcttggacatctgagaaacctccagaagctggttctctcccacatggacgtttctagatatgtttcacccgagcagaagaaagagatagtgactcaatttacaactcaatttctgaagctgaggtgtcttcagaagttgtacatgaactcagtctcctttttggaaggacaccttgatcaactgctgtcatgcttgaagacttcgttgaaggtcctaactatcacaaattgtgtcctgctggaaagcgatctgaaacacttgagccagtgcccatcaatttcccagctgaaaaccctggatctgtccggcattcggctgacaaactatagccttgtcccattgcaaatcttgctagaaaaggtggccgccacactggagtaccttgacctggacgattgcgggatcatcgactcccaggttaacgccatattaccggccctgtcacgttgctttgagttgaatacattcagcttttgcggaaacccaatctgcatggctacactggaaaatttactctcccacactattatactgaaaaatctgtgcctggagctatatcccgcaccccaagagagttacggcgccgatggtactctgtgctggtctcggttcgcgcaaatcagagccgagctgatgaaaaaggtgcgacatcttagacaccctaaacggatcctgttttgcacagataactgtcctgaccacggagacagatcattttacgatctcgaagccgaccagtactgctgctag

SEQ ID NO: 49714 - DNA, 1452 bp, Artificial Sequence
  Description of Artificial Sequence: Synthetic coding sequence
atgagcctgcaggcccccccccggctgctggagctggccgagcagtccctactgcgggaccgcgcactggccatccccacactcgaagaactgccccgggagctctttccacccctcttcatggaggccttcactaggcgctgttgtgagaccctgaccactatggttcaagcttggcccttcacctgccttccactcggcagcctgatgaagtcatgcaacctagagattttccgggccgtgctggagggcctcgacgctctccttgcacagaaggtgcgcccgagacgttggaagctgcaggtgctggacttgagaaacgttgatgagaatttttggggcatttggtctggtgcgtcagccttgagcccagaagcgctgagtaaaaggaggactgccggaaactgcccaaggccgggaggccagcagcccctcatggtgatcctggacctgtgtttcaaaaacggcatgctcgatgagtgtctgacccacttccttgagtggggcaaacaacgcaagggactccttcacgtttgctgtaaagagctgcagatctttgggattgccattcatcgtatcatcgaggtgctcaacacagtcgagcttgactgtatacaggaagtggaggtgtgctgtccttgggagctgagtattctaataagatttgctccctacctgggccagatgagaaatttgcggaagctggtgctgtttaatatccatgtctccgcatgcatccccctagaccgtaaagagcagtttgttattcagtttacctctcaatttctgaagctggattacttccaaaagctctacatgcattctgtgagcttcctagaaggacatctggatcagctgcttagatgtttacaggctcctcttgagacggtggtcatgaccgaatgtcttctgtccgagagcgatctgaaacacctctcttggtgcccctctatccggcaactcaaggaactcgacctgcgcgggataaccctgacacactttagcccagaaccattgagtgtgctcctagagcaggcggaagccaccttgcagactctggacctagaagactgtggtattgttgacagccagctgagtgcgatactgccagccctatcacgctgctcccagctcagcacgtttagtttctgtgggaatctgatcagcatggctgctttagaaaacctgctgagacatactgtagggctgtccaaattgtccttggaactttaccctgctccactggaatcttatgatgcccagggggccttgtgttggggtcgcttttctcagctcggcgccgagctcatgaaaacattgcgcgacctccgccagcctaaaattattgtgttctctacagttccctgcccccgatgtggcatcagagcctcatatgacttagaaccctcccactgtctgcttaatgcctgttgccaggggggattcatttag

SEQ ID NO: 49715 - DNA, 1425 bp, Artificial Sequence
  Description of Artificial Sequence: Synthetic coding sequence
atgagcatccaggcccccccccggctgctggagctggccggccagagtttgttgagggatcaggctttgagcatcagtgccatggaggagcttccccgcgttctgtacctgccgttgtttatggaagccttccgacggaggcactttcagaccctaaccgtcatggtgcaagcctggccatttacctgtctcccgctaggctccttgatgaagactttgcatctcgagaccctcaaggccttgctagaagggctgcatatgcttctaacccagaaggacagaccccgtaggtggaagctgcaggtgcttgacctgagggacgtcgatgagaacttctgggcacgctggcctggcgcatgggcgctgtcctgctttcctgagaccatgtccaagcggcagaccgcggaagattgcccccgcatgggagaacaccaaccattgaaagtctttatcgacatatgcctgaaggaaatcccccaagacgagtgcctccgatacttatttcagtgggtgtaccaaagacggggtttggtgcacctctgttgcagcaaactggtgaactacctgacacctatcaaacatttacgaaagagcctgaaaattatctatctgaattccattcagcagctggagatccgcaatatgtcctggccacgcctcatacgcaagctgcgatgctacctcaaggaaatgaaaaatctccgtaaattagtatttagccgatgccaccactctatgtccgacaacgagttggaaggacgcctcgttaccaaattctcatcagtgtttctgcggttggaacacttgcagctcctgaagatcaaacttattacctttttttcaggccacttggagcagcttattaggtgcttacagaacccacttgaaaatttggagttgacctatggttacttattagaagaagacatgaaatgtctgagccagtatcccagcctgggctatctgaaacacctgaacctttcttatgtcttgctcttccggattagcttggaaccactgggagcattattggagaagatcgcagcatccctcgagactctcatcttagagggatgtcagatccattactcacagctctcagcaattctgcccggcctcagtcactgtagccagctgaccactttctatttcggccgtaattgtatgtccatgggagctctcaaggatctactccgtcacacatctggactgagtaagttgtccctggagacatatcccgctccagaagagtccttgaacagcctggtgagagtagattgggagatctttgcactgctcagggctgagctgatgtgcaccttgcgcgaggtgagacagccaaaacggatttttattgggcccaccccttgcccatcttgcggatcgtcgccctccgaggaactcgagcttcacctgtgctgttag

SEQ ID NO: 49716 - DNA, 1425 bp, Artificial Sequence
  Description of Artificial Sequence: Synthetic coding sequence
atgagcatccaggcccccccccggctgctggagctggccggccagtcattgctgcgcgaccaggctctctcaatttctgcgatggaggagctaccccgggtgctttaccttcccctgttcatggaggccttccgtcgccgccacttccagacccttacagtgatggtacaggcctggcctttcacatgcctgcctctgggcagcctgatgaaaacactacacctcgagacactgaaagcactcctcgaaggcttgcatatgctcctgactcagaaagaccggcctcgccgttggaagcttcaagtgctggacttacgggacgtcgacgagaacttttgggctagatggcctggagcctgggccctgtcttgcttcccagaaaccatgagtaagcgacagaccgccgaggactgtcctagaatgggcgagcaccagccgctcaaggtcttcatcgacatctgccttaaggagatcccgcaagatgaatgcttacggtatctcttccagtgggtgtatcagcgccggggactggtgcatctctgttgctccaaactggtgaattatcttacccccattaaacaccttagaaagagccttaaaattatttatcttaactcgattcagcagctagaaattcgcaacatgtcctggccccgtctgatacggaaactgaggtgctatcttaaggaaatgaagaacctgcgtaaactggtgttctcccgctgtcatcattccatgtccgataatgaattagagggacggctcgtaaccaagttctccagtgtttttctgcgcctagaacatctacagcttctgaaaataaagttgataaccttcttctcaggccatctggagcagttaatccgctgcctccagaaccccctggagaacctggagctcacatacggctacttgcttgaggaggacatgaaatgtctttcacagtacccttccttaggatacctcaagcatttgaacctgtcttatgttctcttattcagaataagtttagagccgctgggtgcgctgctggaaaaaattgcggcttccctggaaaccctgatcctcgagggttgtcagattcactatagccagctgtcagccattttgcccggcctgtcacactgctcacagttgacaacgttctactttggtaggaattgtatgagtatgggagctttgaaggaccttctgtgccacacttctggcctctcgaaattgtctcttgaaacttaccctgcccccgaggaaagcctgaattctctggtacgagtggactgggagattttcgccttattacgtgctgaactcatgtgtactctgcgggaagtcaggcagccaaagcggatcttcattggcccaacgccttgtccctcctgtggttcatctccaagtgaggagttggaactgcatctgtgctgctag

SEQ ID NO: 49717 - DNA, 1281 bp, Artificial Sequence
  Description of Artificial Sequence: Synthetic coding sequence
atgagcatccaggcccccccccggctgctggagctggccggccagtccctgcttagagaccaggccctgagcattagcgccatggaggagctgccacgcgtactctacctccccctgtttatggaggcctttcgcaggcgccacttccagaccctgaccgtaatggtacaggcttggccattcacttgcctcccgctgggaagtctcatgaaaaccttgcacctggagaccctcaaagccttgttagagggacttcatatgcttctgactcaaaaggatcgccctcggcgatggaaattacaggtacttgatcttcgggatgtcgatgagaatttttgggccaggtggccaggcgcttgggccctttcctgtttccccgaaactatgtctaaacggcagaccgcagaagactgcccccggatgggggaacaccagccccttaaagtgttcatcgacatttgcctcaaggaaatccctcaggatgagtgtctgcgatacttatttcagtgggtgtatcagagaagaggactggtgcatctgtgttgcagcaaactcgttaactatttaacccctatcaaacatctgcgtaaaagtctcaaaatcatttacctgaacagcatccaacagcttgagataaggaacatgtcctggccccgactgatccggaagctgagatgctatctcaaggagatgaaaaacctgcggaaactcgtgttttcaaggtgcctccagaatccactggaaaatctcgaattaacttacggctaccttctggaggaggacatgaaatgtctaagccaatacccctccctgggttacctgaagcatttgaacctatcttatgtgctcctattcagaatctcgctggagccactcggagctctgctggaaaagatcgccgcctctctcgaaacactcattctcgaagggtgtcagattcactattctcaattatcagcaattctgccaggcctaagccattgcagtcagctgactaccttttactttggccgaaactgcatgagcatgggagccttaaaagatctcctatgccacacaagtggcctgtctaagctatcgctagaaacataccccgccccggaggagagcttaaactccctcgtgcgagtggattgggagatattcgccctcctccgcgctgagctgatgtgtaccctccgcgaggttagacagcctaagaggattttcatcggtccgaccccttgtccctcgtgtggtagctcaccttcagaggagctcgagctgcacttatgctgttag

SEQ ID NO: 49718 - DNA, 1437 bp, Artificial Sequence
  Description of Artificial Sequence: Synthetic coding sequence
atgaagatgagcatccggacccccccccggctgctggagctggccggacggtcactcctgagggaccaggcgctggcaatgtcaacactggaggagctacctaccgagctgttccctccactatttatggaggctttctcgcgaagacgctgcgaggccctgaaactaatggttcaggcatggccatttcggcgcctgccacttaggcctctgataaagatgccttgtctggaggcattccaggcagttctggacggtctggacgcactattaacacagggcgtgcgaccccgcagatggaagctgcaggtgcttgatctccaagacgtgtgtgaaaacttctggatggtctggagcgaggccatggcgcatggttgcttcctgaacgctaaacgtaataagaagcctgttcaggattgcccacgcatgagggggcgccaaccattgacagtcttcgttgagctgtggctgaagaaccgcactctagacgagtatcttacgtatctgttgctctgggttaagcaaaggaaggatctgctccatctctgttgcaaaaagctgaaaattctcgggatgcccttccgaaacatccgcagtatcctgaaaatggtgaaccttgattgtattcaggaggtggaggttaactgcaagtgggtgctgcccatccttacacagtttaccccttaccttgggcacatgaggaacttgcagaaactggtcttgagccatatggatgtgagtaggtacgttagccctgaacagaaaaaggaaatcgttacacagttcacgacccagtttctgaaactgaggtgcctgcaaaagctgtacatgaatagcgtcagcttcctagaagggcatttggaccagcttctgtcctgcctaaaaacttcccttaaagtgctcacgattacaaactgtgtcctccttgaatcagacttgaagcatctctcccaatgtccaagcatctcccagctcaaaactctcgatcttagcggcataaggcttacaaattactctctggtgcctctgcagatccttttggaaaaggtggccgctaccttggagtacttggacctggatgactgtgggatcatagactcacaggtgaacgcaatccttcctgccctctccagatgttttgagttaaataccttctccttttgtggaaacccaatttgcatggctaccttggagaatttattatcacatacaataatcctgaaaaatctgtgcgtcgaactgtatcccgcgccgagggagtcttatggggccgacggtaccctttgttggtctcgcttcgctcagatcagggccgagttgatgaaccgagtgcgcgacctccgtcacccaaagagaattctgttctgcacagactattgccctgattgtggtaatagatccttttatgaccttgaggccgatcagtattgttgctag

SEQ ID NO: 49719 - DNA, 1437 bp, Artificial Sequence
  Description of Artificial Sequence: Synthetic coding sequence
atgaagatgagcatccggacccccccccggctgctggagctggccgggcggagccttcttcgcgaccaggcactggccatgtccacgctggaagagctgccaactgaactgttccctcctttgttcatggaggcattttcccgtaggcggtgcgaagcactgaagctgatggtgcaggcatggcctttccgaaggcttccgctgaggcccctgataaagatgccctgtctggaagccttccaggccgtgctcgacggtctggatgccctgcttacccagggcgtgagaccccgacgctggaaactgcaggttctggacctgcaggacgtgtgcgaaaacttttggatggtctggtcagaggcgatggcacacgggtgctttcttaatgccaagcgcaataaaaaaccagtgcaggactgcccacgcatgcgcgggcggcagcccctgacagtgtttgtagagctttggctgaagaacaggaccctggatgagtacctgacctacctgctcctatgggtgaagcagcgcaaggacctgctgcacctgtgctgcaagaaactgaagattcttggcatgccttttaggaacattaggtccattctgaagatggttaatctggattgcattcaggaggtggaagtgaattgtaagtgggtgttgcctatacttacacagttcactccctacctcggccacatgagaaacctgcagaagctcgtgctgagtcacatggatgtgtccagatacgtttcacctgaacagaagaaggagattgttactcagttcacgacacagttcctgaaactgcggtgcctgcagaagctctacatgaattctgtcagctttcttgaggggcatctcgatcaattactgagttgcctgaagacctcgctgaaagtcttgactatcaccaattgtgtcttgctagagagtgacttaaagcaccttagtcagtgccctagcatctcccagctcaagactctggacctgtcgggaatccgactgaccaattattctctcgtgccattgcagattttgcttgaaaaagtcgccgccacactcgagtatctcgacttggacgactgcggaatcattgactctcaagtgaatgcaatacttcctgctttgagcagatgttttgagttaaatacattctcgttttgcgggaatcctatctgtatggcaactttggaaaacctcttatcccacaccattatactaaagaatttgtgcgtcgaactgtaccctgctccacgggagtcctacggggcagacggaactctttgttggtcacgcttcgcgcagattcgcgctgaactgatgaaccgcgtgagggacctccgacaccccaagcggatacttttctgcaccgactattgccccgactgcggcaataggagtttctatgacctggaagctgaccagtattgttgttag

SEQ ID NO: 49720 - DNA, 1425 bp, Artificial Sequence
  Description of Artificial Sequence: Synthetic coding sequence
atgagcctgcagagccccagccggctgctggagctggccggccagagccttctgcgaaatcagttcttaaccatctttattcttgacgaactgccgagagaagtgttccctctaatgtttatggaagcttctagtatgagacactttgaagccttgaagctcatggtgcaggcttggcccttcctgagacttccattggggtctctaatgaaaactccacacttggaaacgttacaggcagtactcaaggggctagatacgctgctggcccaaaaattgaggccgagacgctggaagctgcaggtgctcgacctccgtgacgtggatggaaatttctggaccatctggagcggagcgcgcgccttatcttgttcacctgaagcaatgaggaaacgacagaccgttgaagactatccccgcacaggcgagcatcagccactgaaggtatttattgatctgtgccagaaggagtctaccttggacgagtgcctgagctacctgtgtcgctggatccattacaggagagggctggtccacctgtgctgcaataaggtacaaaattacagtatgcctacaagctcattccgaaaccttttaaagcgcgtttatccagactccatccaggaattggagattaaaaggaagtgctctctgaacaaaaccggcaagttcgccccgtacctcagccaaatgtctaatctgagaaaactgttcctggcttttgggtacgatgatgaactgtacgtttcggggcaacagcaatttgtacccgacctggactgtcctttcctgtgtttgtattatccccagatgctgtatatacgaaaaattagtaacattaaagaacaccttgagcacctgctcagatgccttaaaaaccccctcggaacgttcatcttttgtcacgcctatcttgccgaccaagatatggaatgtctttctcaatacccgtcactgagtcagctgaaagaactgcacctgattcacatattgatgtggactactaatctggagcccttgggagccctgttagagaaagtggcggctacgctggaaattcttacactgaaagactgtcaaattcaggactctcagctccgggtgctactgcccgcgctgtcacgatgctctcagttgacgaccttttatttccgcgggaacgaaacttccaccaatgctctgaaagacctgctatgccataccggcggactgagcaagctgggcctggaactgtaccccgctccacttgaatgtttggacaacagggggcatgttaactgggagattttagcacccatccgtgcagaattaatgtgtactctgagggaggtgcgccagccgaaaagaattttctttggacccatcccttgcccctcatgcggttcttggcctagcgagaaggtggatttccacttatgttcctag

SEQ ID NO: 49721 - DNA, 1425 bp, Artificial Sequence
  Description of Artificial Sequence: Synthetic coding sequence
atgagcctgcagagccccagccggctgctggagctggccggccagtccctgctgaggaaccagttcctgacgatatttatattagacgaattgccaagggaggtatttccactcatgttcatggaagcaagttccatgagacactttgaagcgcttaaactgatggtgcaggcttggccatttcttcggctgccgcttggctctctgatgaaaactccccacctggaaaccctgcaggcggtgctgaaagggttagatacactactagctcaaaagcttagaccgcgccgttggaaattacaggtcttggatctgcgggacgtagatgggaatttttggactatctggtctggcgcaagagcactgtcctgttctcccgaggccatgagcaagagacagacagtggaagactaccctcggacaggggagcaccagcccctgaaagtgttcattgatctctgtcagaaggagagcacactggacgagtgcctgagttacctgtgtcgctggatccactataggagggggctggtgcacctgtgctgtaacaaagtgcagaactacagcatgccgacatcgtccttccgcaatctcctgaagcgcgtgtaccccgattcaatccaggaactggaaataaaacgtaaatgcagtttaaacaagacaggtaaattcgctccgtacctttctcagatgagcaatctccgcaagttgtttctggcgtttggctatgacgacgagctttacgtctccggccagcagcagttcgtgcccgacctagactgcccctttttatgcctttactatcctcagatgctgtacataaggaagatttccaacattaaagaacacctcgagcaccttctgcgatgtctcaaaaaccctctgggcacattcatattttgtcacgcttacctggcagaccaagacatggagtgcctaagtcaatacccttccctgagccaactgaaggagctccatcttattcacattcttatgtggacaaccaatcttgaacccctgggcgctttactcgaaaaggtcgctgccacactcgagattcttacactgaaggattgccagatccaggatagccaactgagggtgctgttacctgccctgagtagatgttctcagctgacgactttttattttcggggcaacgaaacatccacaaacgcgctgaaagacctcctgtgtcacacaggggggctttcaaaacttggcctggagctatatccagcccccttagagtgtcttgacaacagaggtcatgttaattgggaaatccttgcccccattcgcgctgagttgatgtgcaccttaagggaggttcgccagccgaagcgcatctttttcggcccgatcccgtgcccttcatgcgggtcttggcctagcgaaaaagtggatttccatctctgctcatag

SEQ ID NO: 49722 - DNA, 1440 bp, Artificial Sequence
  Description of Artificial Sequence: Synthetic coding sequence
atgagcttccaggccccccggcggctgctggagctggccggccagtctcttcttagggatcaggcccttgcgatttcagtcctggatgagctcccccgagaactgtttccacggttgttcgtagaagctttcacatccagacgttgcgaggtactaaaggtgatggtgcaggcttggcctttcccttgtctaccactgggctctctgatgaaaacacccgatctcgaaattcttcattatgtcgtagacggcattgattgcttattggcccaaaaggtgcggccacgcaggtggaagctacaggtgcttgagatgagagacgtcgacgagaatttctggacaatctggagcggtgcgcggcccctttcatgctctccggaagccatgtcaaaacggcagactgtcgaagactgtcccagaaccggtgagaagcagcctctcaaggtgtttatggatgtctgccttaaggagaaaagtgtggatgaggatctgagtttcttctctggttgggtgcaacaccgacggagatctgtacacttatgttgtactaaggtcgtcaactattcgatgaatattttgaattttaggaacatcctggaaaccgtgtatcccgatagtattcaagtgttagagatttggaatatgtgttggccatgcatggtagcagaggtgagtcgctatctgtctcaaatgaagaacctgcgtaagctcttcatttcggacggatgcggctatctgccttcattcgagagtcaaggacagctggttgccgagttctcctctgtattcctccggctggaatacctgcagatgctctacatgaggcgcatccgctttttcgaaggatatctagatcagttgatcagatgcctgaaatcccctcttgagactctggccctgacttatggcagcctggacgaggaggatctcaagtgtctgccctggtacccaagtctctcacagctgaagcagctcaatttaagccacggcacactgagattcattaggctggaaccattgcgagctcttctcgaaaaagtggcggccaccttacagaccttattcctggtggactgcggcataggcgacagcaagttacgcgttatcttgccggccctctccagatgtagcaatttaacgacattctgcttccacggcaatgacacttctatggatggactgaaggatctgttacgacacacagggcgtttaagcaacctatctcttgaaacttacccagctccccgggaaagcttggataatcgcgggagggtgatctcggagctacttacaccattacaggctgagctgatgcgaatcctgcgcgaagtgcgagaacccaaccgcatcttcttcggccctgtgtcttgcccctgttgcggtatgtcgcccactgaacaattagagtttaatttctgcttgagggggcgaccggcttag

SEQ ID NO: 49723 - DNA, 1233 bp, Artificial Sequence
  Description of Artificial Sequence: Synthetic coding sequence
atgaagacccccgacctggagatcctgcactacgtggtggacggcatagactgtttgttggcacagaaggttcgtccccgtcgctggaaactccaggtgctggagatgcgggatgtggacgaaaacttctggactatatggtccggggcgagacccctgagctgcagtcccgaggccatgtctaagcgtcaaacggttgaggactgtccacgcactggggagaagcagcccttaaaagtgttcatggacgtgtgcctgaaggaaaaaagtgtagatgaggatctctctttcttctctggctgggttcaacatcggcgacgcagcgttcacctctgttgtactaaagtggtgaactattcaatgaacatccttaattttagaaatattctggaaacagtctacccagactctatacaggtcttagagatctggaatatgtgctggccttgtatggtggccgaggtgtccagatatctctcacagatgaagaatttaaggaaattattcatttctgacggctgcgggtacctcccatctttcgagtctcaggggcaactggttgcggagttctcaagcgtcttcctgcgtctagagtatctgcaaatgctgtatatgagacgtattcggttttttgaaggttatctggatcaactgatccgatgcctcaaatcaccactggaaaccctggcattaacctacggatccctggatgaagaggatttgaagtgcctcccatggtacccctccctctcacaactaaagcagctcaacttatcgcacggcacgctccgctttattaggctcgaaccattgagggccctgctcgaaaaggtcgccgctacactgcagacactatttctggtggactgcggcattggctattctaagctgcgggtgattctacccgccctgtctaggtgcagtaatctaacaacattctgctttcatggaaacgacacatctatggacggactgaaggacctgctccggcatacagggcgcttgagcaatctgtccctggagacttatccggcacctagagagtcattagataacagagggagagttatcagtgagctcctaactcccctgcaagccgagttgatgaggatccttagggaagttcgcgagcccaacaggattttctttgggcctgtgagctgtccttgttgcgggatgtcaccaaccgagcaactagaattcaatttctgccttcggggcagacctgcatag

SEQ ID NO: 49724 - DNA, 1440 bp, Artificial Sequence
  Description of Artificial Sequence: Synthetic coding sequence
atgagcttccaggccccccggcggctgctggagctggccggccagtccctgctcagagaccaagccttagccatcagtgtactggatgaactgcccagagagctatttccaagattgttcgtggaagcttttacctcaagacgatgtgaggtgctgaaagtcatggtccaggcttggccttttccttgtcttccgctgggcagcctgatgaaaaccccagatctcgagatcttgcactacgttgtcgatgggatcgactgtctcctcgcacagaaagtccgccctcgacggtggaagctgcaggttctagagatgagggatgtggatgaaaacttttggaccatttggtccggggcacggccacttagctgcagtccggaagccatgtccaagagacagacggtggaagactgtccacgaacaggcgagaagcagccgctgaaggtctttatggatgtctgcctgaaggagaagtcagtggacgaagacctatctttcttcagcggatgggttcaacatcggaggaggagcgtgcacctttgctgtacaaaggtggttaattatagcatgaacatcctgaattttagaaacatactcgaaacggtgtatcccgactccatccaggtcctggaaatttggaatatgtgttggccctgtatggtggccgaggtgtcccggtacctgtcacagatgaaaaacctccggaaactgttcatttctgacggctgcggatacctcccttcattcgagtcccaaggccagctggttgctgagtttagctcagtttttttgcggctcgaatacttgcaaatgctgtatatgcggcggatacggttttttgaaggttacttggaccagttgattagatgcctgaagagcccgctcgaaacactggcgctcacatacgggagccttgatgaggaagatctcaaatgtctgccctggtacccttccttgtcgcagctgaaacagctgaatctcagtcacgggaccctgaggttcattagactggagccacttcgcgccctgctggagaaagtcgcagccactctgcagacactctttctggtggactgcggtatcgggtatagcaagctcagagtgattcttcccgccctgagccgctgtagcaacctcacaacattctgcttccacggaaacgatacctcaatggacggcctaaaagatctgctccgccacaccggcagacttagcaatctaagcctcgaaacttacccggctccacgggagtcccttgacaaccgggggcgagtgatctcagagctcctgacgccattgcaagccgagctcatgcgcattctgcgagaggtgagagaacctaacaggatctttttcggccccgtctcctgcccctgttgcggcatgtctccaacagagcagttggagtttaacttttgccttagaggccgccccgcatag

SEQ ID NO: 49725 - DNA, 1425 bp, Artificial Sequence
  Description of Artificial Sequence: Synthetic coding sequence
atgagcatccaggcccccccccggctgctggagctggccggccagtcgctcctcagagaccaggccctgagcatttctgctatggaagagctgcccagggtgctataccttcctctctttcgtgaggccttctctcgacggcactttcaaacgctgacagtcatggtccaggcctggccatttacttgcctccctttagtgtcactaatgaaaacccttcatttggagcccttgaaagctctgctggaggggctgcacatgttattgactcagaaagatcgtcctcgccgctggaaactccaggttcttgacctgcgagacgtcgatgagaatttctgggctcgctggccaggagcatgggccctgagctgtttccctgaagctatgtccaagagacaaacagcagaagactgtccccgtaccggagaacatcagccattaaaagtgttcattgatatttgcctcaaagaaatcccgcaggatgagtgcctccgctatctgtttcagtgggtatatcagcgacgtggactagttcatctatgctgtagcaagctggtaaactatcttacgccaatcaaatatctcagaaaatcacttaagattatatacattaactccattggagagcttgagatccacaatacctgctggcctcatttaatcagaaagctatactgctaccttaaggaaatgaagactctatgcaagctggtgttctcccgctgccaccactacacaagtgacaacgagctggagggctggcttgtgacccggttcacaagcgtgtttttgcggctcgagcatttgcagctactgaaaattaaattaattaccttcttctccggacaccttgagcaattgattaggtgtcttcagaaccccctggagaatctggagttgacttgcgggaacctgttagaagaggatctcaagtgcctcagtcaattcccttcccttggctacctgaaacacctaaacctctcctacgtgctcctgttcaggatatcattggaaccgcttggcgcactcctggagaagatcgccgcttctttagaaaccttagtgctggagggctgccagattcattatagccagctgtcagcaatcttgcccggactttcatgctgttcacagttgaccacgttctatttcgggtcaaattgcatgtccatcgatgccctgaaagacctcctcaggcataccagcggccttagtaagttgtccctggagacatatcccgctccagaagagtcactcaatagtctggtacgcgtcaattgggagatattcacaccattaagggctgagctgatgtgcactctccgcgagtttcggcaacctaaaaggatttttataggacctacaccctgtccctcttgtggaagctcgcctagcgaggaactggagctgcacttgtgttgttag

SEQ ID NO: 49726 - DNA, 1428 bp, Artificial Sequence
  Description of Artificial Sequence: Synthetic coding sequence
atgagcatccggacccccccccggctgctggagctggccggccggtcacttctgagagacgaggcactggcaatcagcacgctcgaggagctgccaaccgagctgttcccccccctctttatggaagctttcagcagacgccactgtgaggctctaaaattaatggtgcaggcctggcccttccttcgcctacctctgggaagtctgatgaaaagaccgtgtcctgagacattccaagctgttctggacggtctcgatgccctgctgactcatagagtgagactcagacgatggaagctgcaagtccttgatctccaggatgtgagtgagaacttttggatggtgtggagcgaagctatggcccggaggtgtcttcccaatgccatgatgaaccgaaagccagtgcaggattgccctcgcatgcgggggcagcagcccttaacagtattcattgacctatgcctgaagaaccgcacgctggacgagtacttcacctgcctgttcctgtgggtcaagcagcgcgaaggcctggtccatctgtgttgtaaaaaactcaagatgctggggatgctattccacaatatcagaaacattttgaagacggtgaacttggactgtatacaggaagtggaagttaattgtaattggacacttccagtgctagcggaatttaccccttacttgggtcagatgcgaaatctcagaaaacttgtgctctctgacatcgatagtcgatacattagccctgagcaaaaaaaggaattcgttacccagttcactacccagttcctcaagctccgatgtcttcagaagttgtacatgaatagtgttagtttcttggaggggcacctggatcaaatgctgtcctgtcttaagacgtctctgaacattctcgcaatcaccaactgcgtgttattggaaagcgacctgaaacaccttagtaagtacccctccattggccagctgaaaacattagatctctctggcacacgcctcgccaatttctcattagtacctttacaagttctccttgaaaaggtagcggcgacactggagtatctcgatctcgacgattgcggtatcgtcgacagtcaggtcaacgccattctacctgctctgtctcgatgttttgaactcacaacattctctttcaggggtaatcctatttcaactgccaccttagagaatctgctttgccacacgatccggttgaataatctgtgcctggagctatatccggcaccacgcgagagttatgacgtgcgcggcatcgtgtgtcggagtcggttcgctcagctcggcgcagaactgatgggcagggttagagctctgagggagcccgagaggattctcttttgcaccgactattgccctcagtgtggtaaccggtcactgtatgacctcgaggtcgatcgctgttgttgttag

SEQ ID NO: 49727 - DNA, 1428 bp, Artificial Sequence
  Description of Artificial Sequence: Synthetic coding sequence
atgagcatccggacccccccccggctgctggagctggccggccggtctctcttgcgcgacgaagcattagctatcagcacactcgaggaactgcccactgagctgttcccacctctgttcatggaggctttctccagaaggcattgcgaagcactaaagttgatggtgcaggcgtggccctttctccggctgccacttggcagcctgatgaaacgaccctgtccagaaacatttcaggctgtgctcgatggactcgacgcccttttaacccatagagtgcggctgcgcaggtggaaactccaggtccttgatttgcaagatgtctcagagaacttttggatggtgtggagtgaagccatggctcggcgatgcctccctaatgccatgatgaatcgtaaacccgtccaagactgtcctaggatgcggggtcagcagccgctgactgtgttcatagacctgtgtctcaaaaacagaactctcgacgaatattttacctgtctgtttctgtgggtgaagcagagggaaggtttggttcatctgtgctgtaagaaactcaagatgctaggcatgctgttccacaacatccgtaacatactgaagaccgtgaatctcgattgcatccaggaagtggaagttaactgtaactggaccctcccagtactggcagagtttaccccatatctgggacaaatgcgtaacctgaggaaactcgtgctgtctgacatcgatagcagatatataagtcctgaacagaaaaaggaatttgtgacgcagttcactacacaattcctcaagctgcggtgcctccaaaagttgtacatgaatagcgtgagttttcttgagggccacctggatcaaatgttgtcctgtctgaagacttcactgaacattcttgccatcactaactgcgtcttactggaatctgatcttaaacacttgagtaagtatccttctatcggccagctcaagacccttgacttatccggaacacgcctggctaatttcagtctcgttcccctgcaggtccttctggaaaaagtggccgccactctcgagtatctggacctggacgactgcggcatcgtcgattcacaggtcaatgctatcctgccagctttgagcaggtgttttgagcttaccactttctcttttcgggggaacccaatatcgacagcgactctcgaaaacctgctctgtcacaccataagattgaataatctgtgtttggagctgtacccggccccccgcgagtcatatgacgtgaggggcatagtctgtcgttcgcgctttgcacaactaggcgcggagctgatgggccgggttcgggctctgcgcgagcccgagagaattctcttctgtaccgattattgtcctcagtgtggcaatcgaagcctctatgacctggaggttgatagatgctgctgctag

SEQ ID NO: 49728 - DNA, 1428 bp, Artificial Sequence
  Description of Artificial Sequence: Synthetic coding sequence
atgagcatccggacccccccccggctgctggagctggccggccggtctcttctccgcgatgaagcactggctatcagcactctagaagaactccctacggagctgttcccgcccttgttcatggaagcattctcgcgccgacattgcgaggctttgaagctgatggtgcaagcatggccgtttctgcggcttcccctcggttcactcatgaagagaccctgcccagagaccttccaagccgtactcgatggactggacgcactgctgacacaccgggtacgcctgcgccggtggaagttgcaggtgctggacctccaggacgtaagcgaaaatttctggatggtgtggagcgaagcgatggcccgaaggtgtttgcctaacgcaatgatgaatcgcaaaccggtgcaggactgtcctcggatgcggggacagcagcccctcacggtatttatagacctctgtcttaaaaaccgcaccctcgatgaatattttacctgtctcttcctatgggtgaaacagcgagaggggctggtgcatctatgctgcaaaaagttgaaaatgctcgggatgcttttccacaatattcgaaacatcctcaaaaccgtcaatctggattgtatccaggaagtggaggtgaactgtaactggacactccctgtcctggctgagtttacaccgtacctgggccagatgaggaatttgcgcaaacttgtgctcagtgacatcgacagtcgctacataagtcccgagcagaagaaggagtttgtaactcagttcacgacccagttcctgaagctgaggtgcctgcagaaactgtacatgaacagtgtgtccttcttagagggccatttggatcagatgctgtcctgcctgaagacctcacttaatatcctagccatcacgaactgcgtcctgctggaatctgatctcaaacacctctcgaaatacccgagcatcgggcagctgaagactttggatctatcaggaactcggctggctaacttcagcctggtaccactccaggtgctgttggagaaagtggcagcgaccctggagtacctcgatttggacgactgcggcattgtcgattctcaggtgaatgccatactgcctgccttatctagatgctttgaactcactaccttttcctttcgggggaacccgatttctactgcaacattagagaatctcctctgccacacaattaggttgaacaatctttgccttgagctgtaccctgctccaagagaatcatacgatgtgcgcggtattgtctgccggagtcgatttgcccagctgggggctgagcttatgggccgcgtgcgcgctctgcgagagcctgagaggatcctgttttgcactgactattgcccgcagtgcggaaataggagtctgtacgatctggaggtggacagatgctgttgctag

SEQ ID NO: 49729 - DNA, 1446 bp, Artificial Sequence
  Description of Artificial Sequence: Synthetic coding sequence
atgcggatgagcctgcaggccccccggcggctgctggagctggccggccagtccctgctaggcgatcaggctctggcgatctccatcctcgacgagctgccaagagaattattcccaccacttttcgtggaggcgttcacatcacgccggtgcgaagtgctgaaagtaatggtgcaggcctggccctttccctgcttgcccttgggtagtctcatgaagactccagacctggaaattctgcattacgttgtagacggaattgattgccttttggcccagaaggtgcgaccaagacgctggaaactccaggtgctcgaactgagggacgtggatgagaacttttggaccatctggagcggcgcccggccactgagctgcagtccagaggcgatgtcaaagagacagacagtggaggattgcccccggaccggagagaagcaacccttaaaagtgtttatggacgtttgtcttaaggaaaaattcatggatgaagacttgagtttcttttccggatgggtacagcaccggcgggggagcgttcatttatgctgcacgaaagttgtgaactattcaatgagtattctgaactttcgcaacatcttggagactgtgtatccagacagcatccaggtgctggagatatggaatatgtgctggccctgcatgatcgtcgagttctcaagatacctatctcaaatgcgcaacctgcgcaagctattcatcagcgacgggtgcagatatttattgagtagcgatagccaggagcagctcgttgcggaattctccagtgtgctgctcaggttggagtatctacagatgttgtacgtgcggagagtttgcttctttcggggccatctcgatcaactgattcgttgcctgagatcacctctggagacattggccctgacttatggtttcctggaaaaggtcgatcttaaatgcctgcctagatatccctccctgtctcagctgaagcagctaaacctgtctcacggcgctttgcgattcataagattggagcctttgcgcgcgcttttggagaaggtcgccgctaccctgcagaccctgtttctcgtggattgtggtatcagggattcaaaattgcgagtaatcctcccggcgctgagctgctgttcaaatctgactacattctgttttcacggaaatgatacctctatggacgggctgaaagacctcctgagacacactgggaggctgtccaatctctccctggaaacgtatccggctccgagggaatcgcttgatgatcggggacgtgttataagtgaactgctcaccccactacaggccgagttgatgaggatattgcgggaggtcagggagcctaagaggatcttctttgggcctgtgagctgtccatgctgcggcacatcgcccacagaacagcttgagtttaatttttgtctttggggccgacctgcgtag

SEQ ID NO: 49730 - DNA, 1440 bp, Artificial Sequence
  Description of Artificial Sequence: Synthetic coding sequence
atgagcctgcaggccccccggcggctgctggagctggccggccagagcttacttggcgatcaggccctggctatttccattctggatgagcttccccgggaactcttcccgcccctgtttgtcgaggctttcacttccagacggtgtgaggtcctgaaggtcatggtgcaggcctggccgttcccttgcctgcctttagggtctttaatgaagacccccgacctggagatacttcattatgtggtggacggcattgattgtctgctggcccagaaggtgagaccccgaagaaggaagctgcaggtgttagagcttcgcgacgttgatgagaacttctggacaatctggtctggcgcaaggcccctctcttgttcacccgaagctatgagcaaacggcagactgtcgaggactgtccacgaaccggggagaagcaacccctgaaagtcttcatggatgtctgcctcaaggaaaaatttatggacgaggatttgagtttcttcagcggctgggtgcaacaccgccggggctctgttcacctgtgttgtacaaaggtcgttaactattccatgagcatcttaaattttagaaacatcctagagaccgtctatcctgattccatacaggtgctggaaatatggaacatgtgctggccctgcatgatcgtcgagttcattcgatatctgtctcagatgcgaaacttacgaaagctcttcatatctgacggctgcaggtaccttctcagcagcgattcacaggagcagctggtggcagagtttagctccgtactgctgaggctcgaatacttgcaaatgctttatgtaagaagagtatgcttcttcaggggccacctggaccagctgatacgctgtctccggtccccactggagaccttggcgctcacctacggctttctagagaaggtcgatctgaaatgcttgcctcggtatccatccctctcccaacttaagcagctgaacctttcgcatggcgctttgcgcttcattagactagaacccctgagagccttgcttgaaaaagtcgccgccacactccaaacactgttcttggtcgactgtggtattcgggactcgaagctgagggtgattttgcctgcgctaagttgctgtagcaatctcacaaccttttgcttccatggcaatgacacctctatggatgggctcaaggatttgttgagacacaccggccgcctttctaacctgtcactggagacatatcctgctccgcgggaatcactcgacgacagagggcgggtgatcagcgaactgctcacgccactacaggccgaactgatgagaattttgcgtgaggtgagagagccgaagcggattttcttcgggcccgtctcttgtccttgctgcggtacgtcccctaccgagcagttggagtttaatttttgtctatggggaaggcccgcatag

SEQ ID NO: 49731 - DNA, 1446 bp, Artificial Sequence
  Description of Artificial Sequence: Synthetic coding sequence
atgcggatgagcctgcaggccccccggcggctgctggagctggccggccagagtttgctcggcgaccaagctctggctattagcatcctggatgagctcccgcgagagctgtttcctccactgttcgtcgaagcattcactagcagacgctgcgaggtactgaaggttatggtgcaggcttggcctttcccatgtttaccgctgggatctttaatgaaaaccccagacctagagatcttgcactacgtcgtcgatggcattgattgcctactcgctcaaaaagtaagaccaagaaggaggaagctacaggttctggagctgagggatgtcgacgaaaatttttggaccatctggtcaggggcacgccccttaagctgttcccccgaagccatgagtaagagacagacagttgaagactgtcccaggacaggcgagaaacagccacttaaggtgttcatggatgtgtgtctaaaggagaagtttatggatgaagatctttcttttttttcggggtgggtgcagcaccggcgcgggagtgtacacttatgctgcaccaaggttgttaactacagtatgagcattttgaatttcagaaacatcctcgagacagtgtaccccgactcgatccaggtgctggagatatggaatatgtgctggccttgtatgatcgttgagttcatacgctatctgtctcagatgcggaatctccggaagctgtttatctctgatgggtgtaggtacctgctgtcatccgactcacaggagcaacttgtagccgagtttagctcagttcttctcagactggagtacttgcaaatgttatacgtcaggcgcgtttgtttcttccgcggccacctggaccagctgatcagatgcctgcgctcccccctggaaacactggcactgacctatggttttctggagaaggtggaccttaagtgtcttcctagatacccatccctgtctcagctaaagcaactgaatttatcccacggcgcgttgcgcttcatccgcttggaaccactcagggcattgctcgagaaagttgccgcgacactgcagactctgttcctggtcgactgcggaatccgcgactctaaactcagggtgattttgcccgcattgtcctgttgttcaaatctgactacgttctgttttcacggcaatgatacaagcatggatggccttaaggacttactgcgccacactggacggttgagcaacctgtctttagagacttaccctgctccacgagagtccttagacgaccgggggagggtaatcagcgagttgctgacccccctccaggctgaactcatgcggattctgagggaggtccgcgaacccaagagaatcttcttcggcccagtttcctgcccatgctgcggtactagtcctacagagcagctcgagttcaacttctgtctctgggggcgccccgcctag

SEQ ID NO: 49732 - DNA, 1437 bp, Artificial Sequence
  Description of Artificial Sequence: Synthetic coding sequence
atgaagatgagcatctggacccccccccggctgctggagctggccggtaggagtctgcttcgggaccaggcccttgctatgtccactctggaagagctgccaaccgagctcttccctcccttgttcatggaggcattcagtcggcgaagatgcgaggcactgaagctgatggtccagagctggccatttagaagactgccactacggcctctgatcaaaatgccatgtctcgaggcctttcaggctgttctcgacggactcgatgcgctgctcaatctcggggttagaccacggcgctggaagctgcaggtgctggaccttcaggatgtctgcgagaacttctggatggtgtggagcgaagctatggctcatggatgttttcttaacgcgaagaggaataagaaaccagtcgaggattgcccccggatgcgcggcaggcagcctctgaccgtgttcgtcgagctttggctcaagaatcggacccttgatgaatatctgacctgcctgttattatgggtgaagcagcggaaggatttgctccatctttgctgtaagaaactcaaaatcttgggaatgccattccgcaatatacgttcaatactcaagatggtgaacctggactgcattcaggaggtggaagtgaactgcaagtgggtgctgcctattctcacacagtttactccatacctaggacacatgcggaacttgcagaagcttatcttgtctcatatggatgtgagtaggtatgtgtcaccagaacagaagaaggagatcgtgacccagtttacgactcagttcctaaagcttcggtgcttgcagaaactgtatatgaactctgtgagcttcctcgagggccatctggatcagttactctcttgtctaaagactagcctgaaattcctgaccattaccaactgcgtactgctcgagtctgaccttaaacaccttagccaatgcccaagtatttcccagctgaaaaccctagacctgagcggaatcaggctcacaaattactctctcgtccctctgcagattcttctggaaaaggtggccgccacactggagtatttggacctagatgactgcgggattatcgactcccaggtgaacgcgattttacccgccctgtctcggtgtttcgagctgaataccttctctttctgcggcaaccccatttgcatggcgacattagagaatctgctttcacatacaatcatcctgaaaaacctgtgcgtcgaactctatccagctcctcgcgagagttacggagctgatggaacgctctgttggtcgagattcgcccagatcagagcagaacttatgaatcgcgtcagggatctacggcaccctaagcggatcttgttttgcactgattactgccctgactgtggcaatcggagtttttatgaccttgaggcggatcagtactgttgttag

SEQ ID NO: 49733 - DNA, 1431 bp, Artificial Sequence
  Description of Artificial Sequence: Synthetic coding sequence
atgagcatccggacccccccccggctgctggagctggccggccggagtctgctgagagaccaggccttagcaatgagcactctggaggagctgcccactgagctttttcctccactttttatggaagcctttagtaggcgtcgctgcgaagccttgaaactcatggtacaagcttggccattccggcgattgcccttgagaccacttataaagatgccttgccttgaagccttccaggccgtcctggacgggctagacgccctcctcacccagggcgtccacccgagaagatggaaattgcaggtattggaccttcaagatgtatgtgaaaatttctggatggtgtggagtgaggccatggcccacggctgtttccttaatgcaaaaaggaataaaaagcctgtgcaagattgtccacggatgaggggtcagcagcccctcactgtgttcgtggagctctggctgaaaaatcgaaccctcgatgagtaccttacctgtctgctgctgtgggttaaacagagaaaggacctgctccatctctgctgtaagaagctgaagatcctcggtatgccttttcggaacattcgctctatcttgaagatggtcaatttagattgcattcaggaggttgaggtgaactgtaaatgggtactgccgattttaacccagtttactccatacctggggcatatgcggaaccttcagaaattggtgctctctcacatggacgttagcaggtatgtttctcctgagcaaaaaaaagagatagtgacccaattcaccacacagtttctgaagctgtgctgcctgcagaaacttagtatgaacagcgtttcatttctggaaggccacctggaccagctattgagttgcctcaaaacctccttaaaagtattgacaatcactaactgtgtgctgttagagtccgacctaaagcacctctctcagtgtcctagtatctcacagctgaagacgcttgatttgagcggtatccggctaactaattattctctggtgccgctgcagattctgctagagaaggtggccgctacactcgaatacctggatctcgacgattgtggcattattgatagccaggtcaatgcaatccttcccgcactgtcaaggtgcttcgaattgaacactttcagtttctgtggaaatccaatcagcatggccaccttagagaatctcctgtcacataccatcatcctcaagaatctgtgcgtggaactataccctgcacctagagagtcatatgatgccgacggtacactgtgttggtcccggttcgctcagattcgtgccgagctcatgaagcgagtccgggatctacgacatccgaagaggattctattctgtaccgattgttgcccagactgcggcaaccggagcttttacgacctcgaagctgaccagtgctgttgttag

SEQ ID NO: 49734 - DNA, 1431 bp, Artificial Sequence
  Description of Artificial Sequence: Synthetic coding sequence
atgagcatccggacccccccccggctgctggagctggccggccggtctctgcttcgggaccaggcgctcgccatgtcaacattggaggagctgccaaccgagctttttccaccactcttcatggaagcgtttagtcgtcgccgctgtgaggccctcaaactaatggtgcaggcatggcccttcaggaggttgcctctcaggcctcttatcaaaatgccttgtctggaggcctttcaggccgtactcgatggattggacgcactgctgacacaaggcgtgcatcccaggcgatggaagttacaagtgctggatctgcaagatgtatgtgaaaatttctggatggtctggtctgaagcgatggcccggggctgttttctgaacgctaagaggaacaaaaccccggtacaggattgcccaaggatgaggggccaacagccattgactgtgtttgtagaactttggcttaagaaccgaactctggacgaatacctgacgtgtctgctgctctgggtcaaacagagaaaggacctcttgcacctgtgttgcaagaaactcaaaatcttgggcatgcccttccgcaacatcagaagtattttaaaaatggtaaacctagactgcatccaagaggtggaggttaattgtaaatgggtcctccccatcctgacacagtttaccccatacctgggacacatgcggaaccttcagaaactggttctgtcccacatggacgtgtcccggtatgtttctccagagcagaagaaagagatagtcactcagtttaccacccagttcctgaagctctgctgtctgcaaaaactctctatgaattccgtgagttttttagaaggccatctggatcagctcctgagctgcctgaaaacttcattaaaggtgctcaccatcacaaactgcgttttactcgagtccgacctcaaacacttgtctcagtgcccctcaatcagccagctgaaaacactggacctgtccggcataagactgactaattattccttagttccattgcaaatccttcttgagaaagttgcagccactctcgagtatctcgatctggacgactgtggcatcatcgattctcaggttaacgctatactccccgctctgagtcggtgcttcgagttgaacacttttagcttctgcggaaatcctatcagcatggcgaccttagagaatctgttgagccataccattattctcaaaaatctgtgtgttgaactgtacccggctcccagggaatcttacgacgcggacgggactctgtgctggagcaggtttgcccagatcagagccgaactgatgaagcgggtgcgagatctgcgccatccaaagagaatcctcttctgcaccgactgctgccccgattgtggcaacagatcgttctacgatctcgaggctgatcaatgttgttgttag

SEQ ID NO: 49735 - DNA, 1431 bp, Artificial Sequence
  Description of Artificial Sequence: Synthetic coding sequence
atgagcatccggacccccccccggctgctggagctggccggccggtccctccttagagaccaagcacttgctatgagcacactggaagaactgcctaccgagctcttcccccctctgttcatggaggcctttagcaggagacgatgcgaggcattgaaactgatggttcaggcttggcccttccgcagacttcctctccgtcccctgatcaagatgccgtgcttagaggctttccaggctgtgctcgatgggttggatgcgttactcacacagggggtgcaccctcggcggtggaagctccaggtattggatttgcaggacgtctgcgagaatttctggatggtgtggagcgaggcaatggcccacggctgcttcttaaatgcgaagcggaataaaaagcccgttcaggattgtccgcgtatgcggggccagcaacccttaaccgtgttcgtagaactgtggctgaaaaatcggacactcgatgaatacctcacctgcctgctgttatgggtaaagcaacgcaaggaccttctacacctgtgttgcaagaaattgaaaatcctggggatgccgtttcgcaatatccgtagcatcttaaagatggttaacttggactgtatccaggaagtggaggtgaattgcaaatgggtcctccctatactcactcagtttaccccttaccttggtcacatgaggaatctgcagaaactggttctctctcacatggacgtatcacggtacgttagtccggagcagaaaaaagagatcgttactcagtttacaacacaattcctcaagttatgctgcttacagaagctgtccatgaattctgtttcctttctcgagggacacctggaccagctcctgagttgcctgaaaacatcactcaaagttttaaccataacaaactgcgtgttgctagagtctgacctaaaacacttatcacagtgcccaagcatttctcagctgaagaccttggatttatctggtatcagacttactaactacagcctcgtccccctacagatccttctcgagaaggtggccgccactcttgagtatttagatttagatgattgtggcatcatcgattctcaggtaaatgccatcctccctgcccttagctgttgctttgagctgaacaccttctcgttctgtggcaatcccattagcatggccaccttggagaatctcctgtcccacacaatcatcctcaagaatttgtgtgtggaactgtatcctgctcctcgtgaaagctacgacgctgacgggactttgtgttggagccgctttccccaaattcgagcggagttaatgaagcgggtgagggacctcaggcacccgaagaggatcctgttctgcacagactgctgcccagactgtgggaatcgcagcttttacgatctcgaggctgaccagtgttgttgctag

SEQ ID NO: 49736 - DNA, 1431 bp, Artificial Sequence
  Description of Artificial Sequence: Synthetic coding sequence
atgagcatccggacccccccccggctgctggagctggccggccggtctctgttgcgcgaccaggccctggcgatgtccactctagaggagctgccaacagagctgttccctccactgtttatggaggcctttagcaggcgcagatgcgaggccttaaagctcatggtacaagcttggccctttcgccgtctgccactgcgacctctgatcaagatgccttgcttagaagcctttcaggcggtgctcgacgggctcgatgctctacttacccagggggtccatccccgccgctggaagctgcaggtgctcgacctgcaagatgtatgcgagaacttttggatggtctggtccgaggccatggctcggggctgctttctcaacgccaagcgcaacaagactcctgtgcaagattgccctaggatgcggggacagcagcctttgaccgtatttgtcgaactgtggctgaagaaccggacactggatgagtatttaacctgtctgctgctctgggtgaaacaaaggaaggacttactgcatctgtgctgcaaaaaactcaagatcctgggcatgccattcaggaacataaggagcatcttaaaaatggtaaacctcgattgcattcaggaggtggaggtgaactgtaagtgggtactgccaattctaacacagttcaccccatacctaggccacatgaggaatctacagaagctggttctatctcatatggacgtgtctagatacgtgagtcccgagcagaagaaggaaattgttactcagttcaccacacagttcttaaaactgtgttgtctacaaaaattgagtatgaacagcgtaagcttccttgagggacacctcgaccagctgctgagttgcctgaaaacaagcctgaaagtgcttaccattacaaattgcgtcttgctcgaaagtgatttgaaacatctttcccagtgccctagcataagccagttgaaaacccttgacttatctggtatccgactgacaaactacagccttgttcctctgcagatcctgctggagaaagtggccgcaaccctggagtatctggaccttgacgactgtggaatcattgatagccaggtaaacgcaattctccccgcactgtctcggtgttttgagctgaacacgttctctttttgcggaaaccctattagcatggcgaccctggaaaatcttctgtcccacaccattatcctgaagaatctgtgcgtagagctgtatccagccccgagggaatcctatgacgcggacggcaccctgtgttggtcacggtttgcgcagatcagggctgagctcatgaaaagggtgcgggacctcagacaccccaaaaggattctgttttgtaccgactgctgccccgattgtggaaaccggagcttttacgatctggaagcggatcagtgttgttgctag

SEQ ID NO: 49737 - DNA, 1431 bp, Artificial Sequence
  Description of Artificial Sequence: Synthetic coding sequence
atgagcatccggacccccccccggctgctggagctggccggccggagtctgctaagagaccaagctctggcaatgagcacactcgaggagttgcctacggaactctttccacccttgttcatggaggccttcagcagaagaaggtgtgaggccctgaaactgatggtacaagcctggccatttcgccgacttcccctccgacccctgatcaagatgccttgcctcgaagcttttcaagctgtgctggacgggctggacgcactgctcacccagggagtgcatccgagaagatggaagctgcaggtactggaccttcaggatgtgtgtgagaacttctggatggtgtggtcggaagcgatggcccacgggtgtttcctgaacgccaaacggaataagaaaccagtccaggactgcccacgcatgcgcgggcagcaacccttgacagtcttcgtcgaactttggcttaagaacaggacgcttgacgaatacctgacttgtttgcttctgtgggtcaaacagcgtaaggacttgctccacctgtgttgcaaaaagctgaagatcctcggaatgccctttcgaaacatccggtctatccttaaaatggtcaatctcgactgcatacaggaggtggaagtgaactgtaagtgggtcctgcccatcttaacccaatttaccccctatcttggccacatgcgcaaccttcagaaactggtgctgtcgcatatggatgtctcaagatatgtgtccccagagcaaaagaaggaaatcgtgacccagttcaccacgcagtttctgaagctttgttgccttcaaaagctttccatgaactcagtgtctttcctcgaaggccatctagaccagctcctgtcttgtttaaagactagcctaaaggttctgaccatcaccaattgtgtcctcttagagtctgaccttaagcatctgtcacaatgtccatcaatttcccagctgaagaccctggacttgtccggtatacgcctgacaaattactctctagtccccttacagatactgctggagaaggtggccgctaccctcgagtacctggatctggacgactgcggaataatcgactcacaggtgaacgctattctccctgccctttccagatgcttcgaactcaacacgttctcattttgcggaaacccaatttcaatggccacccttgagaacttactcagtcatacaatcattctgaaaaatttgtgtgtggagttataccccgccccacgggagtcatatgacgccgacggaacactgtgttggagtcggtttgctcagatcagagcggaactcatgaagagggtcagggatctgagacaccctaagaggatcctgttttgcaccgactgttgtcccgattgcggcaatcggagcttttatgacttggaagctgaccagtgctgttgctag

SEQ ID NO: 49738 - DNA, 1431 bp, Artificial Sequence
  Description of Artificial Sequence: Synthetic coding sequence
atgagcatccggacccccccccggctgctggagctggccggccggtcactcctcagagaccaagcactagcaatgagtacgctagaagagttgcctaccgagctgttccctccactgttcatggaagcgttttcacggcggcgttgcgaggctctcaaactgatggtacaagcctggcccttccgaagattgcctttgaggccactgatcaaaatgccctgcctggaggcgttccaagcagtgctcgatggcctggacgccttgctcactcagggcgtgcaccctaggaggtggaaactccaagttctcgacctccaagatgtgtgcgaaaatttttggatggtgtggtcagaggcaatggcccatggctgcttcctaaacgctaaaaggaataaaaaacccgtacaggattgcccccggatgcggggtcagcagccactgacagttttcgtggagctgtggctgaagaacagaaccctcgatgagtatctgacatgtcttttgctgtgggtcaaacaaaggaaagacctgctgcacttatgctgcaagaagctgaagatccttggaatgcccttcagaaatatacgatctatcttgaagatggttaatcttgattgcatccaggaggttgaagtcaactgcaagtgggtattgccaatattaacgcagttcaccccatacttagggcatatgagaaatctccagaagctggtcctctctcacatggatgtcagccgctacgtgagtccagaacagaaaaaagagatcgtgacgcagttcacgacacagtttctcaagctgtgttgtctgcaaaaactgagcatgaactcagtgagttttcttgagggacatctcgatcagctcttgagttgcttgaaaaccagcctgaaggtactcaccattacgaattgtgtgcttctggaatctgatctgaagcacctgagccagtgcccttccatctctcagcttaaaacactggacctttccgggatccgtctgactaactacagcctggtgcctctacagattctgttagagaaagtcgccgctaccttagaatatctggatctggacgactgcggcatcatcgactcacaggtgaatgctatccttccggccctctcctgctgcttcgaactgaatactttttcattttgtggcaaccctatcagcatggccacattagaaaatctgctatctcatactatcattttgaaaaatctgtgcgtggagctgtacccagcaccaagagaatcatatgatgcagatggtacactgtgctggtctcgatttccacagattagagcagagttgatgaaacgcgtccgcgacctccgacatcctaagcggattctgttctgtacagattgttgccccgactgtggtaatcgatcattttatgacctcgaagctgaccagtgctgttgttag

SEQ ID NO: 49739 - DNA, 1431 bp, Artificial Sequence
  Description of Artificial Sequence: Synthetic coding sequence
atgagcatccggacccccccccggctgctggagctggccggccggagcctgcttcgcgaccaggccttggccatgtctacccttgaggagctccccaccgagctgttcccccctcttttcatggaggcattcagccgtaggagatgcgaggccctcaaactgatggtccaagcctggcctttcaggcgactcccattgagacctctgatcaagatgccctgcctggaagcattccaggccgtccttgatggcctcgacgctttactgacccagggagtacatccccgcaggtggaagctacaggttctggatctccaggacgtgtgcgagaatttctggatggtttggagtgaggcaatggcccgcgggtgcttcctgaatgcgaaacgcaacaagacgcctgtccaggactgcccgagaatgcgtggacagcagccactaaccgtctttgtggagctatggttgaagaaccgcacacttgacgagtacttgacttgcttgctgttatgggtcaagcagcggaaggatctgctacacctctgctgcaagaagcttaaaattctgggtatgccgttccgtaatataagaagcatcttaaaaatggtaaacctcgactgcatccaggaggttgaggtgaactgcaaatgggtcttgccaattctcacacagtttacgccctacttgggacacatgcgcaacttgcagaaactggtgctgtcgcacatggatgtatcacggtacgtgtcgccagagcagaagaaagagatcgtgacccagtttactacccaatttctgaagctgtgttgccttcagaaattgagtatgaactcagtttccttcctagagggtcatttagatcagcttctaagctgtcttaagacttcgctgaaggtcctgacaattactaattgcgttctgctcgagtcggatctcaagcatctctctcagtgtcccagcatcagccagctgaagaccctcgacctgtccgggatccggctcactaactatagtctggtcccactccagattttgctggaaaaagttgcggccaccctggagtatttggatctcgacgactgcggaataattgactcacaggtcaatgcgattttacccgccctctcgcggtgcttcgagctgaataccttctctttctgcggaaatccgattagcatggcaactctggagaatctcctttcacacaccattattcttaagaatctctgtgtcgagctgtatccagcccctcgtgagtcctatgacgcagacggcaccttgtgttggtccagattcgctcagatacgcgccgagctcatgaagagggtgagggacttgcgccatcccaaaagaatcttgttctgcaccgactgctgtcctgactgtggcaatagatccttctatgatctggaggctgaccagtgctgctgctag

SEQ ID NO: 49740 - DNA, 1425 bp, Artificial Sequence
  Description of Artificial Sequence: Synthetic coding sequence
atgagcatccgggcccccccccggctgctggagctggcccggcagaggttgttgagagaccaggccctggccattagcactatggaggaactcccaagggagttattccccaccctgtttatggaggctttttcccgacgtcgctgtgagaccttaaaaactatggtccaagcatggcccttcaccaggctgcctctgggttcactcatgaaatctccacatctagagagcctcaagtcggtcctggagggcgtggatgtgctactgacccaggaagtcagaccccgccagagcaaattgcaggttctggaccttaggaatgtcgatgagaatttttgcgatatttttagcggcgccactgcctccttccccgaggccctgagtcagaaacagaccgcagataactgcccaggaaccggaaggcagcagccattcatggtgtttattgatctctgtctgaagaatcgtaccctcgacgaatgcctgacacacctgttggaatggggcaaacagcgtaagggcttgttgcacgtctgctgtaaggagctccaggtgttcgggatgcccatacacagcatcatcgaggtactaaacatggtcgagcttgattgcattcaggaggtcgaggtttgctgcccatgggagttgagcaccctagtcaaatttgccccatacctcggacaaatgcgtaatctgcgcaagttggtgctctttaatattagggcgtccgcatgcataccaccagacaacaagggtcagtttatcgccagattcactagtcagtttctgaagctggattatttccagaacctatcaatgcatagcgtgtcgtttctggagggccatttagatcagctcctgcgctgtctgcaggcctcactggaaatggtcgtgatgactgattgtctactatcggaaagcgacttgaaacacctgtcctggtgcccatcgatccgacagctgaaagagcttgacctgcgcggagtgactctcacgcacttcagtccagagcccctaaccgggctattagagcaggtggtcgcaaccctacagaccctggacttggaagactgcggcattatggacagccagctaagtgccattctgccggtactgtctagatgtagccagttatccaccttctccttctgtggaaacctcattagcatggcagccctggagaaccttctgcgacataccgtgggcctgtctaagctttccctggaactgtacccagcccccctggaaagttatgacacacagggggccctgtgctgggggcggttcgccgaactgggcgcagagctgatgaaaacaccaagggacctgcggcagcccaagattattgtcttctgtacagtaccctgtcctagatgcggtatacgggctagctatgacctggaaccatcccactgcctgtgctag

SEQ ID NO: 49741 - DNA, 1425 bp, Artificial Sequence
  Description of Artificial Sequence: Synthetic coding sequence
atgagcatccgggcccccccccggctgctggagctggcccggcagcgtcttctgcgggaccaagccctggcaatctctaccatggaagaacttcctcgcgaactgttccctactttattcatggaggcttttagtcggcggcgttgtgaaactctgaaaaccatggtccaggcatggccttttacccgacttcctctgggtagcctgatgaaaagcccacatctcgagagcctgaagtcggtgctagaaggggtggatgtgctcctgactcaggaggtgagaccgaggcaatccaagttacaagtcttagatttaaggaacgttgacgaaaacttttgtgatattttttctggggccacagcaagtttccccgaagccttatctcagaaacagacggcggacaattgccccgggactggaaggcagcaaccctttatggttttcattgacctctgcttgaaaaaccggaccctggatgagtgcctgacccatctgctcgagtggggtaaacaaagaaaaggcttgttacatgtgtgttgtaaggagctacaagtattcggcatgccgattcattcaattatcgaggtccttaacatggttgagctggattgtatacaggaagttgaagtttgctgtccttgggagctctcaaccctagtgaagtttgccccataccttggccagatgcgcaacctgagaaagctcgtacttttcaacattagggcttccgcttgtataccccccgacaacaaaggccaattcatcgctcgttttacctcgcagtttcttaaacttgattacttccagaacctgagtatgcatagcgtctcattcttggagggccaccttgaccaactgctgcggtgtcttcaggccagcttggagatggtcgtcatgactgactgtttgctgtcagaatctgacctgaaacacctatcctggtgtccttctataaggcagttaaaggaattggacctccgcggtgttaccttgacccacttctctcctgagcctcttacaggtctcttggagcaagtcgtagcaacgttacagacccttgatttggaggattgtggtataatggatagccaactatccgccatactgcctgttctttcccggtgcagtcagctgtctacatttagtttctgcgggaatctcattagtatggccgcccttgagaacctcctgaggcacactgtagggctctcaaaactcagcctcgagctgtatccagctcccctggagtcctatgatacccagggggccctgtgttggggacgcttcgccgagctgggcgccgagcttatgaaaacccctcgggacctcaggcagccaaagataatcgtattttgcactgtcccctgtcccaggtgcggaatacgggcttcctatgatcttgagcccagccactgcctctgttag

SEQ ID NO: 49742 - DNA, 1425 bp, Artificial Sequence
  Description of Artificial Sequence: Synthetic coding sequence
atgagcatccgggcccccccccggctgctggagctggcccggcagcgacttctcagagaccaggcactagcaatcagtacgatggaagagctgcctcgggaacttttcccaacactgtttatggaggcctttagtagacgccggtgcgaaaccctcaaaacaatggtgcaggcctggccgttcacccgtctgccactcggctcgcttatgaagtctcctcacctcgaatcactaaaatctgtcctggaaggtgtagatgtgctgttgacacaggaggtccgccctagacagagtaaactgcaagtcctggatttgaggaacgttgacgagaatttctgcgacattttttcaggagcaaccgccagctttcccgaggccctatcccagaagcagacagctgacaactgtccaggtacaggtagacagcagcccttcatggtgtttattgatctgtgcttgaaaaataggacactcgatgagtgcttgacgcacttactcgaatgggggaagcaaaggaagggcctgctgcatgtctgttgccaggaattgcaggtgttcggtatgcctattcacagcatcattgaagtcttgaatatggtggagcttgactgcattcaggaggtcgaggtatgctgtccatgggagttgagtacattagtaaaattcgctccctatttggggcagatgcggaacttacggaaactggtgctcttcaatatacgggctagtgcttgcattcctccagataacaagggacagttcatcgccaggttcacttcccagttcctgaaactcgattatttccagaatctgagcatgcacagtgtttcattcctagagggccatctggaccagctgctccggtgcctgcaggcctctctggagatggtggtgatgactgactgcctcctaagtgaaagcgacctgaagcacctgagctggtgcccatccattagacaactgaaggaactcgatttgcgcggcgtgacactgacccattttagccccgaaccactcaccggactcctggagcaagttgtggccacacttcagacactagacctggaggattgcggtattatggactctcagctgagcgccattcttccagtcctgtcaagatgcagccaactcagtacattttctttttgcggtaacctgatcagcatggcagcactggaaaacctgcttcggcatacagtcggcctcagtaaattgagtcttgagctatacccggcaccccttgaaagctatgatacccagggggctctgtgctggggtagatttgcagagctcggtgccgagttaatgaagacattacgggacctccgtcagcctaagataattgttttctgcaccgtgccctgccccagatgtggaattagagcttcctacgacttggagccttctcattgtctgtgctag

SEQ ID NO: 49743 - DNA, 1437 bp, Artificial Sequence
  Description of Artificial Sequence: Synthetic coding sequence
atgaagatgagcatccggacccccccccggctgctggagctggccggcaggtctttgctcagggatcaggccctggccatgtcaaccctggaggagctgccaactgagttatttcctccattgttcatggaagccttcagcaggcggcggtgcgaagccctgaagctgatggttcaggcctggcccttccggaggctgcccctgcgtccgctcattaagatgccctgtctggaagccttccaggctgtgctggatggcttggacgcactcctgacacagggcgttcgtccgcggaggtggaagctgcaggtacttgatcttcaggatgtctgcgagaacttctggatggtatggagcgaggcgatggcgcacggttgctttctgaacgctaagcggaacaaaaagcctgtgcaggattgccccaggatgcggggaaggcagccgctgactgtcttcgttgagctgtggctaaagaatcgcacactggacgagtatctcacctacctgctgctctgggtcaagcagcgtaaagatctgcttcatctgtgttgtaagaaactaaagatcttgggtatgcccttcagaaacattcgctctatcctgaagatggttaatctcgactgtattcaggaagtagaggtgaattgcaagtgggtgctccccattctgactcagttcactccatacttggggcatatgcgcaacctacagaagctcgtgctatcacatatggacgtgtctaggtacgtctcacccgaacagaagaaggagatagtgacacaattcacaacacagttcttgaagctacgctgtctgcagaagctttacatgaattcagtcagctttctcgaaggacatttggatcagcttcttagctgcttaaagacgagcctcaaagtcctgaccatcactaattgcgtcctcctggagagcgatttaaaacatctcagtcaatgcccatccattagccagcttaagactttggacttatcaggtattagattaaccaactacagtctggtccctctacagatcctgcttgagaaggtagctgcaacactcgagtacttggatctggacgactgcggaatcattgacagccaggtgaatgccatcttaccagccctgagcaggtgtttcgaactgaatactttctctttttgcggcaatccgatttgcatggccacacttgagaacttgctgtcccacaccatcattcttaagaacctttgtgtagagttatacccggcccctcgggaatcttatggagccgatggcaccctatgctggtcccggttcgcccagatccgtgcggagctgatgaaccgcgtcagagacctgcgccacccaaaacggatcctgttttgtaccgactattgtcccgactgtgggaatcgcagcttttacgacctggaagccgaccagtattgctgttag

SEQ ID NO: 49744 - DNA, 522 bp, Artificial Sequence
  Description of Artificial Sequence: Synthetic coding sequence
atgttcgcccggggcagccggcggcggcggagcggccgggccccccctgaagccgaggaccctgacagagggcagccctgcaactcttgtagggaacaatgccccgggttcctgctacacggttggcgcaaaatctgccaacactgcaaatgccctcgagaggagcacgccgtgcacgcggtgccagtcgatctggagaggatcatgtgcaggctgatttctgacttccagcggcactccatatctgacgatgacagtggatgtgcttcagaggaatacgcctgggtcccccccgggctcaagcccgaacaggtgtaccagtttttctcctgtctgccagaggataaggtcccatacgtgaactcccccggtgagaagtacaggatcaaacagctccttcaccagcttccccctcatgattcagaagttaggcgagaaaagacagggcgcgcctgtcaagcccagcatacagcttgggcaaatgccggacagggacagcgacgcaaaggggagctaatatag

SEQ ID NO: 49745 - DNA, 1848 bp, Artificial Sequence
  Description of Artificial Sequence: Synthetic coding sequence
atgttcgcccggggcagccggcggcggcggagcggccgggccccccctgaagccgaagaccccgaccgcggccagccatgtaactcttgccgagagcagtgccccgggttcctgctgcatgggtggcggaaaatttgccaacactgcaaatgtcctagagaggagcatgcagttcatgccgtgcccgtggacctggagaggattatgtgcaggctcatttctgacttccagcgccattccatctccgacgacgactcgggctgtgcatccgaggaatacgcgtgggttccccctggcctgaaacctgaacaggtctatcagttcttctcctgccttccggaagataaggtcccatacgtgaattcgcctggggagaagtacaggattaagcagttgctacatcagctgccaccccacgactctgaagcacagtattgcaccgctctggaggaggaagagaagaaagagctcagagccttttcacagcagcgcaagagggaaaacttggggaggggcattgtgcgaattttcccagtaactattactggcgcgatctgcgaggaatgcggtaagcagattgggggcggcgatattgcagtgttcgcaagcagggccgggctcggagcatgctggcaccctcagtgttttgtgtgcacaacctgccaggagctactggtggaccttatatatttctaccacgttggcaaagtgtactgtggaagacatcacgcggaatgcttgcgaccgaggtgccaagcttgtgatgagataattttctcccccgaatgtactgaggcggaaggccggcactggcatatggaccatttctgctgttttgagtgcgaagcatcactaggcgggcagagatacgtgatgagacaaagcaggccacattgctgtgcgtgttatgaggctagacatgccgagtactgcgacggctgcggggagcacataggtctcgaccagggtcagatggcctatgagggccagcactggcatgcctccgatagatgtttctgttgtagtagatgcgggcgggcattactgggacggcccttcctgccgcgtcgaggtctgatcttctgcagtcgcgcctgctcattaggcagcgagcctacagccccaggacccagtcgccggtcttggagtgcggggcctgtcacagcccccctggcggcgagtactgccagcttttcagccgttaaaggggccagcgagacaacaacaaagggtacatctactgaactggctcccgctacaggacctgaagagccttcccggtttttgcggggagcgccccacagacattcaatgcctgaacttgggctgaggtctgtgccagagccccctccagaatcccccgggcagcccaatcttagacccgatgattccgcttttggtcgccagtctactccacgagtgtcgtttagagaccccctggtgtcagaaggcggaccaaggagaaccttgagcgctccgcctgcgcagcggcggagacccaggtcgccgccaccgagggctccatctcgaagaagacaccaccatcacaatcaccatcaccaccacaatcgacatccaagcaggagacggcattaccagtgtgacgctggctctggcagtgactctgaaagttgctctagctcaccctcaagcagcagctcggagtccagcgaggacgacgggtttttcttgggtgagaggatccctctgccaccacacctgtgcaggccaatgcccgcccaggacaccgcaatggagactttcaactccccctcattaagcctgccgcgggattcgcgggccggtatgccaagacaagcccgtgataaaaattgtattgtggcctag

SEQ ID NO: 49746 - DNA, 453 bp, Artificial Sequence
  Description of Artificial Sequence: Synthetic coding sequence
atgttcgcccggggcagccggcggcggcggagcggccgggccccccccgaggcagaggatcctgaccgcggccagccctgtaactcctgtagggagcaatgtccaggatttctcttacacggctggcgcaaaatttgccagcactgtaagtgccccagagaggagcacgccgtgcacgctgtgcctgtcgacttagaacggattatgtgccggctcatatctgacttccagaggcattcaatctctgacgacgactctggttgtgcttcggaggagtacgcttgggtgcctcctggactcaaacccgaacaggttacacgtggacagccgagcactcttgccgttcagtgggtgcataccaacgcccatactcacacacatacccaggtggggacttacttttgggggtatgccagagtgtgctcacagaccgaagggcctagcgggccctag

SEQ ID NO: 49747 - DNA, 996 bp, Artificial Sequence
  Description of Artificial Sequence: Synthetic coding sequence
tgaccccccctgccccggctgtgccccgcccccccccacagcggccggtgcccatctctgccctcagcagcgcagcccccagaggccgaagatcccgatagaggccagccttgcaactcctgtcgtgagcagtgtcccggatttttgcttcatggatggcggaagatatgccagcactgcaaatgcccgcgggaagagcatgctgtgcacgcagtgcccgtcgacctggagcgcataatgtgtaggctgatctccgattttcagcgacattctatttctgacgacgacagtggatgtgctagcgaagaatatgcctgggtgccccccggattaaaaccagagcaggtgtatcagttcttttcttgcctgccagaggacaaggtcccttatgttaactcccccggggagaaatataggattaagcagctgctgcaccagctgcccccccacgattccgaagcccagtattgtactgctttggaagaagaggagaaaaaagaactgcgagcctttagccagcaacgcaagcgcgagaacctgggaaggggtattgttcgaattttccctgtgacaatcaccggcgcaatctgtgaagagtgcggaaagcagatcgggggtggggacatcgccgtgtttgcaagcagagcaggtcttggagcttgctggcaccctcagtgttttgtgtgtaccacttgtcaagaactgctggtagacctcatatacttctaccatgttggcaaggtgtactgcggacggcaccacgcggaatgcctccgccctcgatgccaggcttgcgatgagataatattcagccctgagtgcaccgaggcagaaggccgccactggcatatggaccatttctgctgttttgaatgcgaagcttctctcgggggtcagagatatgtgatgcggcagtcccgcccacattgctgtgcctgttacgaggctagacatgccgaatactgcgatggctgcggagagcatatcgggggatag

SEQ ID NO: 49748 - DNA, 1887 bp, Artificial Sequence
  Description of Artificial Sequence: Synthetic coding sequence
tgagtggagggccgggccctgaccagccccagcctgctgccccggcttaccaggccctgcatttgcccaaggcctctccaacccccagaggccgaagaccctgatcgtggacagccatgcaatagttgccgagaacagtgccctggcttccttctccacggctggcgcaagatttgccagcactgtaaatgtccgagagaagaacatgccgtgcacgcagttcccgtcgacctggagaggatcatgtgcaggctgatcagcgactttcagcggcacagcatttccgacgacgattccggatgtgctagcgaggaatacgcatgggttccccccggcctgaaacctgagcaagtgtatcagtttttttcttgcctgcctgaggacaaggtcccttatgtgaattcacctggggagaagtacaggatcaaacagctcttgcaccagctgccaccccatgacagcgaagctcaatattgcaccgccctggaagaagaagagaagaaagagctccgtgcattcagtcagcagagaaaaagagaaaatctcggacgcggaatcgtgagaatcttcccagttaccattaccggggcgatctgtgaggaatgtgggaagcagattggggggggggacattgccgtgtttgcatcacgcgcaggtttgggcgcctgttggcacccccagtgcttcgtttgtacaacatgtcaggagctgctcgtagatctgatatatttttatcacgtggggaaggtgtattgtgggcggcaccacgctgagtgcctgcgcccaaggtgccaagcttgcgacgagatcatcttctcaccagaatgtactgaggccgaaggacgccattggcatatggaccacttctgctgtttcgagtgtgaagctagtctgggtggtcaacgctacgtgatgaggcagtcaagaccacattgttgtgcctgttacgaggcccgtcacgcagagtactgcgacggatgcggtgaacacatcggcttggatcaaggccagatggcgtacgagggccagcactggcatgcaagtgaccggtgcttttgctgctcaagatgcggcagagctttactcggcagaccatttcttccacgccgcggccttatattttgctcaagagcatgtagtttgggttccgagcccacggcccccggccctagtaggcggtcgtggagcgcaggccccgtgactgccccattagctgcatctactgcctcattttcagccgttaagggggcctccgagaccaccacgaaagggacaagtactgaactcgctccagcgacagggccggaggaaccgtctagattcctccgtggcgctccccataggcactcaatgcctgagttgggcctgagatctgtgccagaaccaccaccagagtctccaggtcaaccgaatcttcgccctgacgactctgccttcggaaggcaatctacaccacgcgtgtctttccgagatcccttagtgagcgaagggggcccaagacggactctatccgcccctccggcccaacggcggcgacccagatctccaccaccgagggctccgtcacgcaggcggcaccaccatcacaatcaccatcatcaccacaataggcatccctctaggaggcggcactaccaatgtgatgcaggtagtggaagtgacagcgagtcctgttctagttctccatcttctagtagtagtgagagttccgaggatgatggattctttctcggggaacgcattcctctgcccccccacctgtgcagaccaatgccagcccaagacactgcgatggagacatttaactctccttcactgtccctgcctagagactcccgggctgggatgcctaggcaggcaagagacaagaattgtatcgtcgcctag

SEQ ID NO: 49749 - DNA, 1605 bp, Artificial Sequence
  Description of Artificial Sequence: Synthetic coding sequence
atgtgccggctgatcagcgacttccagcggcacagcatcagcgacgacgactctggctgcgcaagcgaggaatatgcttgggtcccccccggcttgaagcccgaacaggtgacaagaggccaacccagtacccttgccgtgcagtgggtccacactaatgctcacacacacacacacacccaggcccagtattgtaccgctctggaggaagaggagaagaaggagctcagggcattttcccagcagcgcaaaagagaaaacctgggaagaggcatcgttcgaattttccccgtgaccatcaccggagccatttgcgaggagtgtgggaaacaaatcggtggtggagacatcgccgtatttgcgagccgtgcaggcctcggtgcttgctggcaccctcagtgttttgtctgcacaacgtgtcaggaactactggtagatttgatctatttttaccatgttggcaaggtgtactgtggtaggcaccatgcggagtgcctgcggcctcgatgtcaggcttgcgatgagattatcttctcaccagaatgtacggaagcagaaggcagacactggcacatggaccacttctgttgtttcgagtgcgaggccagcctgggtggacagcgatacgtcatgaggcagtcacgcccgcactgttgcgcttgttatgaggcccgccatgctgaatactgcgacggctgcggtgagcacatcggtcttgaccagggccagatggcctatgaagggcagcactggcatgctagcgatcgatgcttctgttgtagcaggtgtggacgcgccctcctgggacggccctttctcccccggcgcggactgatcttttgtagtcgtgcctgcagcctggggagtgaacccacagctcccggaccaagccgcaggtcatggtctgccggacccgtgaccgcccctctggcggcgtctacggcctccttctctgctgtgaaaggggcatctgagacaaccacaaaaggcacttccactgaactggctccagccaccgggcccgaggaacccagccgattccttaggggagctcctcacagacactccatgcccgaactcggtttgagatctgtccccgaacctcctcctgagtcacccggccaaccaaacctccggccggacgatagcgcatttggacggcagtctactccgcgcgtgtcttttcgggacccacttgtctccgagggtggcccccggcgcactcttagcgctccccccgcacagcgccgaagacctaggtctcctcccccaagagctcccagccggcggcgacatcaccaccacaaccaccatcaccatcacaaccgacatccttcccgccggaggcactaccagtgcgacgctggctcaggctctgactcagagtcctgttcctcttcaccctcatcttccagtagcgagagtagtgaggatgatggtttctttctgggagagaggatacctctgcctccccacctgtgcaggcctatgcctgcccaagatactgctatggaaacttttaattcgccatccctgagcttaccaagagacagtagggcagggatgcccagacaggcacgggacaagaattgcatcgtcgcttag

SEQ ID NO: 49750 - DNA, 1320 bp, Artificial Sequence
  Description of Artificial Sequence: Synthetic coding sequence
atgttcgcccggggcagccggcggcggcggagcggccgggccccccctgaggccgaggatcctgatagaggtcagccctgtaatagctgtcgcgaacagtgcccaggctttttgctgcatggctggaggaagatttgtcaacattgcaaatgccctagggaggagcacgccgtgcacgctgtgccagtggacttagagcggattatgtgtcggctcatctccgacttccagcgacactctatttctgatgacgactctggatgtgcctctgaggagtacgcttgggtcccacccggactgaaacctgagcaggtgacgcgaggtcagccctccaccctcgcagttcagtgggtccatacaaatgctcacacccacacccacacacaggcccaatattgtacagctctcgaagaagaagagaaaaaggagcttagagccttcagtcagcagcgaaagagggagaatctcggccgcgggatcgtgaggattttccccgtgactataacaggcgcaatctgcgaggagtgtggcaagcagataggcggtggcgacattgccgtgttcgccagccgagcaggcctgggagcttgttggcacccacaatgcttcgtgtgcacaacctgccaggaactcttggtcgatttgatttacttttaccacgtggggaaagtgtattgcggcagacaccacgccgagtgcttgaggcccaggtgtcaagcttgcgatgaaatcattttcagccccgagtgtacgccgggaccccgcccaggaccagaggagccttcaaggttcctcaggggcgctccccatcgacatagcatgccagagctgggcctgagaagtgtccccgagcccccgcccgagagccccggccaacccaatctgaggcccgatgattctgccttcggtcgacagtccaccccgcgcgtttcatttcgggatcccttagtgtctgaaggtgggccccgaaggacactatcagccccacccgcccagcggaggagacgccatcaccatcataatcaccaccatcatcataatcggcatccctcccgcaggagacactatcagtgcgacgccggcagtggttcagactctgaatcttgttcgagtagtcctagctccagcagttctgaatctagcgaagacgacgggttttttttgggggagaggattccactcccgccccacctctgccgaccgatgcctgcacaggataccgccatggagacatttaactcaccttcccttagtctgcccagagatagtcgagccggaatgccccgtcaggcaagagacaagaattgcatcgtagcttag

SEQ ID NO: 49751 - DNA, 1644 bp, Artificial Sequence
  Description of Artificial Sequence: Synthetic coding sequence
atgtgccggctgatcagcgacttccagcggcacagcatcagcgacgacgattccggttgcgcttccgaagagtatgcatgggttccccccggactaaagccagagcaagtgtaccagttcttttcatgtctccctgaggacaaagtcccttacgtgaactcccccggggagaaatacaggatcaagcagttgctgcaccagcttcccccacatgactccgaagcccagtattgcactgcacttgaagaagaggagaaaaaggagctcagagcgttctcccagcaaagaaagcgggagaaccttggccggggcatagtaagaatatttccagtgacaatcaccggggctatctgtgaagagtgcggcaaacaaatcggtggaggggacatcgccgtgttcgcttcgcgggctggactgggagcgtgttggcacccccaatgttttgtgtgcacgacttgtcaggaattgcttgttgatctcatctatttctaccacgtgggaaaagtgtactgtggacgacatcatgcagagtgtctgaggccccgctgtcaggcttgtgacgagatcatcttttccccagagtgcaccgaggcggaggggagacactggcacatggaccacttttgttgcttcgaatgtgaggcaagtctgggaggccagcggtacgtgatgaggcagtccagacctcattgctgcgcctgctacgaggcaagacatgccgagtactgcgatggctgcggggaacacatcggtctggatcagggccagatggcctatgagggccagcattggcacgccagtgacagatgtttctgttgttcccgctgtgggcgggcactgctcggacggccgtttctgccgcggagggggctgattttttgttcccgcgcctgctcgcttggctccgagcctacggccccgggcccttcacgccgatcctggagcgcagggcccgtgactgcccctctggcagcaagcacggcctcttttagtgccgtcaagggggcttccgagacaacaactaaggggacatccaccgagctcgcccccgccaccggccctgaggagccatccaggttcctgaggggtgccccacaccggcacagcatgcctgagctcggactgagaagcgtccccgaaccaccccccgagtcacccggccagcccaaccttcgacccgacgatagcgcctttggcagacagtcaacaccgcgcgtttcattccgcgaccccttggtctccgagggcggccctagacgcaccctgtcggccccacccgcacaaagacgtcggccgagatctcctcctcctcgagctcccagtaggagaagacaccaccaccacaatcaccatcaccaccacaacaggcacccctccaggcggcgccattaccagtgtgacgctggctccggctcggattcagaatcctgttcctcctcaccaagcagttcctcctccgagtcatcagaagacgatgggtttttcctgggcgagcggattcccctcccacctcatctctgccggccgatgccggcccaggataccgcaatggagacgttcaacagccctagccttagcctcccacgtgacagcagagcgggcatgcctcggcaggctagagacaagaactgtatagtcgcctag

SEQ ID NO: 49752 - DNA, 1665 bp, Artificial Sequence
  Description of Artificial Sequence: Synthetic coding sequence
atgcacatcaacttccaccggccccccgccaagcccaagccccagaaagtgaaagaaatcgagtaccagaatctccgcttcccggtggacctgagcaaccccttcgctgttgcaactgtgctgaatcaagagcctggcaaactgaaaattaaggaactgcgtgaggtactggaccaagggaccgagatctctaagacaaggcagatgaaagaagctttgtttgagcagaaggtgcgacaggatattcatgaagaaatggaaaatcacctgaagtggcaggttcacctgggcaaagatcctatgtctttcaagctcaaaaaagagctgaccgaggagtggcagaaggcttgtgccaagtataaactggaccgcggagacccgattctcgacgaggagttccagcgtcttaaaactgaagtgtctcacaagcgggttgtgcggaaccaggaggaaaaaatcaaggagttccatcctacttttgatccgctcatcaataacacctggctatcacgcagtcgggcacagaagcgcttccagcaggtggcacggaaagtaatgattcaggggcgtctcttcaatatgctgtccgccgtgagggagatggataaggaaagcatcctgagaaaaattggtcaggccaaacagtccatagcacaggaggccaatttttttaagtttttcctgaggaggattagtcaagacgactacacttcacgattctccgtatcccccaaagaggtccttccttttgccttccccgattgctcccctcctcaggacagcaatgaactggcgcctgatgggctcggacttgttcctataaagagctctgaagtgcaaattaagcagagctacagctttttcaacttgcaggtgcctcagctctacaagattaagcggtaccagcccttctcggttcacaaatccagcacatcatatcgtccacagaaactcgcccgggcccttaaacagggggctgaggacgaagtgaccactattactgccttgccgaagcaggattccactacccagctatccggtaagacaagcgtgctgagcatgaagccacccgaggctctggcaatgtcactggattatgacccattatacgtttttaatccaaatcccggcctctttgcagttatgcacccactaacatatgcggagacactgattgactaccatctctgttcccatccaaaatacaagtttaccaaagagtctcgacacggctcctctatcccggtaacccagaagcaattcctgcatcacacagatatcatcccaggaatcatgcactggaagagctttcagtctctggtgctaagttcactgcctgatccctctaagatggagacaaccaaatcctgcgattcattcaattcattcatgctcccgattgatgtaccggccatactagatgctttgcccgaagaagatcgcctggagactgtcgaacgcgagctgtgcgaacagaacgtggaagttatgctcactcccgagatgatcaaagttgaatttccgatgttaaactacaaggatatcagaaaagaaaaggaagtcaaggaccaggcccagcccgccgaaaaagctggagaaaagctgttggaggagatgagaaatcttcgcggaaaagcattgaacacatacctaattttagagtag

SEQ ID NO: 49753 - DNA, 2523 bp, Artificial Sequence
  Description of Artificial Sequence: Synthetic coding sequence
atggccgtggtgaagacccccagccggggcctgaagaacgccaaggaaccttttaacaatgcctcacctcacctgctgaaaaacctcgtggaagaaccaaagaaacgaaaggaggtccctaatcatctgctggaaagcaaggtgtacgccaaactggtgaataataaggtcattcaagccagacccgggattatccattttggcggatatcaggtggagaaacagcatcagcagatcctgcatctggtcaatgtgagcaatgaagatactagggtacacatactgccccctcaaacaaagtattttgagataaactacgtacgtaaggagcaccacctggttcctgggctctccctgactgtaaccgttacgttcagccccgatgagtggcgatactactacgactgcatccgggtgcactgtaagggggacgacacgcttctggtaccaatccacgcatatccagtcatgaactctctggattttccgtcgttcattaaccttagtaacgtgctgctaggagaaagcaaaacctacgtgatccccctgcagtgtagttgccccgtagacttcgaattttatatcacgctgatccagagccaccaggcgttcgcaatagagcctacttctggtattatcccggcgaatgggaagatgacagtcactattaaatttactcccttccagtatggcaccgcccaaataaaaatgcagctctggatctcccagtttaattcacaaccgtacgagtgcgtcttcacaggcacctgttatcctaacatggctctccccctggaggagttcgaaaggttaaatacccttagcaagaaggtcaatgttccaccagaaaaagccatgatgcatattaattttcatcggccccccgctaagccaaagccccagaaggtcaaggaaatcgagtaccagaacctaagattccctgttgaccttagcaaccccttcgccgtggccaccgtgctcaaccaggaaccagggaaactcaagataaaggagttaagggaggtgcttgatcagggcaccgaaatcagcaagacccgccaaatgaaggaagccctattcgaacagaaagtaaggcaggatattcacgaggaaatggagaaccacctcaagtggcaggtccatcttgggaaggaccctatgtcttttaaactgaagaaagagctgacagaggaatggcagaaggcatgtgccaaatataagttggaccgaggggacccaatcctcgacgaggagtttcagcgactcaagacggaagtaagtcacaagagagttgtgaggaaccaagaggagaaaattaaggaattccatcccacgttcgaccctctgatcaataatacatggttgtctagatctcgcgcgcagaaacgcttccagcaggtggcaagaaaagtgatgatccaaggccggttgttcaatatgctctctgcggtcagagagatggacaaggaatctattttgcggaagattggacaagccaagcagtctattgcacaagaagcaaacttttttaagttcttcctgcgtaggatttctcaggatgactacacctcaagattctcagtgagtccgaaagaagtccttccttttgccttccccgattgttcaccccctcaggacagcaacgagttagccccggatggcttgggccttgtgcctatcaagtcctctgaagtgcagatcaagcaatcctacagctttttcaacctgcaagttccgcagctatacaaaatcaagagatatcaacccttttccgtgcacaagagcagcacttcctaccgacctcagaagctggctagagcattaaagcagggagctgaggatgaagtgactactattaccgccttgccaaaacaggatagcactacacagctcagcgggaaaactagcgtcctcagcatgaagcctccagaggccctcgccatgtccctcgattacgatcccctgtatgtgttcaaccccaatccaggactgttcgcggtgatgcaccctcttacctatgcggagacgctcattgattatcacctgtgttctcacccaaaatacaagtttaccaaggaatcccggcatggctcgtctatccctgtgacccaaaaacaattcttacatcacacagacatcatccctggcatcatgcattggaaatcctttcagagcctggtgttgtcaagtctccctgacccctcaaaaatggaaaccacaaaaagttgtgattccttcaactcttttatgctccctatcgatgttcccgcaatcctggatgcgctgccagaagaagaccggctggaaaccgtagaacgcgagctgtgcgaacaaaacgtcgaggtgatgctgacccctgaaatgatcaaagtggagttcccaatgttgaattataaggacatacggaaggaaaaagaagttaaagatcaagcgcagccagcggaaaaggcaggagagaaactcctggaggaaatgcggaacctgcgcgggaaggctcttaatacctatctcattctggagtag

SEQ ID NO: 49754 - DNA, 564 bp, Artificial Sequence
  Description of Artificial Sequence: Synthetic coding sequence
atggccgtggtgaagacccccagccggggcctgaagaacgccaaggagccattcaacaacgcgtcgccacatttactgaaaaatctggtcgaggagccgaaaaaacgaaaggaggtgccaaatcatttactggagagtaaggtgtatgccaaattagtgaataacaaggttattcaagccaggcctggcataattcatttcggcggctaccaagtggagaaacagcaccaacagatcttgcatctggttaacgtttctaatgaggatactcgggtgcatatcctgcccccccagacaaagtatttcgagatcaactacgtacgaaaagaacatcaccttgtgcctgggttgagcctgactgtgacagtgaccttcagccctgatgaatggagatattactacgattgcataagggtgcattgtaagggtgacgacactctcttagtgcctatacacgcctatccagtgatgaattccctggatttcccttcatttatcaatctgtcaaatgttttgctgggtgaaagcctccccaacagtgtctttctcgtgccagacaattag

SEQ ID NO: 49755 - DNA, 1200 bp, Artificial Sequence
  Description of Artificial Sequence: Synthetic coding sequence
tgacaccccaccttcgaccccctgatcaacaacacctggctgagccgcagccgggcacaaaagcgatttcaacaggtggccagaaaagtaatgatccagggtcgcctgttcaatatgctgagcgccgtaagggaaatggacaaagagagtatcctaaggaaaataggccaggccaaacaatccatagcccaggaggccaatttttttaagttctttctcaggagaatttcccaggacgactacacctctcgtttttccgtgtctcccaaggaagttctgccattcgcctttccagactgcagcccaccccaggacagcaacgagttagcgcccgacggacttggcctggtcccaatcaagtcttccgaagttcagattaaacaatcgtactcctttttcaacctgcaggttccacagctgtacaagattaaaagatatcagccattcagtgttcacaagagtagcacctcctatcggcctcagaagcttgcacgcgcattaaagcagggtgctgaggacgaggtgacaacaatcaccgccttgccaaaacaggactcgaccacgcagctatctggaaagacatctgtgctttcaatgaagcctccagaagcattggcaatgagtttagactacgaccccctatatgtcttcaacccaaatcctgggttgttcgctgtcatgcaccccctcacgtacgccgaaactcttatagattatcacctctgctcccatcccaagtataaattcaccaaggagtctagacacgggtcttccattcctgtgacacagaagcagttcttgcatcatacggacataattcccggaatcatgcactggaaaagcttccagtccctcgtgctgagctccctgccagacccctctaaaatggaaactaccaagtcatgcgatagcttcaacagctttatgctgcccatcgatgtccctgcaatcctggacgctctgccagaagaggaccgattagagactgtagagagagagctgtgtgagcagaatgtcgaagtcatgcttacgccggagatgattaaagttgaattccctatgttgaactacaaggatattaggaaagaaaaggaagtgaaagaccaggcccagcctgcggaaaaagccggtgaaaaacttctcgaagagatgagaaacttaagagggaaggcattaaatacatacctgattctggaatag

SEQ ID NO: 49756 - DNA, 1665 bp, Artificial Sequence
  Description of Artificial Sequence: Synthetic coding sequence
atgcacatcaacttccaccggccccccgccaagcccaagccccagaaagtgaaagaaatagagtaccaaaacttgcgctttcccgttgacctgagcaatcccttcgccgtggccactgttctgaatcaggagcccggtaagctgaagattaaagaactgagagaagtgctcgaccagggcactgagatcagcaagacccgtcagatgaaagaggcactcttcgaacagaaggtaagacaagacatccacgaagagatggaaaaccatctgaagtggcaggtgcacctgggcaaagacccgatgagtttcaaactgaaaaaggagttgaccgaggaatggcagaaggcctgtgccaagtataaattagacaggggcgatcccatcctcgatgaggagtttcagcgattgaagacggaggtaagccataagcgagtagtacggaaccaggaagaaaaaatcaaggagtttcaccccacctttgacccgctcatcaacaacacctggctcagccggtcacgcgctcaaaaaagatttcagcaagttgcgcgtaaagtgatgatacaggggcgactgtttaacatgctgtcagccgtgagagagatggacaaggagtctatccttcggaaaattgggcaagccaagcagtctatcgcccaagaggcaaactttttcaaattcttcctgagacgtatttcgcaggacgattacacatccaggtttagtgtgtctcccaaagaggttctgccattcgccttcccagactgttcccccccgcaggatagcaacgagctggccccggatggcttgggacttgtgcctataaaatccagcgaggttcagatcaaacagtcctattcattcttcaatctgcaggtcccacaactgtacaagatcaaacgttaccaaccgttttcggtgcataagagttcaacgagttaccggccacagaaactcgccagagcactgaaacagggagccgaggatgaggttaccacgattactgccctgcccaagcaggacagtacaacccagctgagcgggaagacaagcgtgttgtctatgaaaccacccgaggcgcttgccatgtctcttgattatgaccctctctacgtcttcaacccaaatccaggattattcgccgttatgcaccctttgacatacgccgagactctgatagactatcatctgtgctcacatcccaaatataagtttactaaagagtcccgccacggcagcagcatcccggtgacccagaagcagttccttcatcacacagacattattccaggcatcatgcattggaagtctttccaatccctggtactctcatccttacccgacccaagtaagatggaaacaactaagagttgtgactcctttaatagtttcatgctgccaatagatgttcctgcgattctggacgccctgcccgaagaggacagactggagacagtggagcgcgagctctgcgaacagaacgtagaggtgatgttgaccccagaaatgattaaagtcgagtttccaatgttgaactacaaggacattcggaaggaaaaggaagtcaaagatcaggcacaacccgccgagaaagccggcgagaagttactcgaggagatgaggaatcttaggggcaaggcactgaatacctatctcatcctggaatag

SEQ ID NO: 49757 - DNA, 555 bp, Artificial Sequence
  Description of Artificial Sequence: Synthetic coding sequence
atggccagccccgccgccagcagcgtgcggcccccccggcccaagaaggaaccccaaacccttgttatcccaaagaacgccgctgaggaacagaagctcaaactggaaaggctcatgaaaaatccggataaagccgtgcctattccagagaagatgagtgagtgggcgccacgtccccccccagagttcgtgcgtgatgtgatgggctccagtgccggggcaggcagtggcgagtttcacgtgtatagacaccttaggcgacgtgagtaccagcgccaggattacatggatgcaatggcagaaaaacagaagttggacgcagagttccagaaacggctggagaagaataaaatcgctgccgaagaacagactgccaagaggaggaagaagcggcaaaaattaaaagagaaaaagttattggcaaaaaaaatgaagctcgaacaaaagaaacaggaaggacccggtcagcctaaggagcaggggtccagctcatcagcagaggcgagcggaaccgaagaagaagaggaggtgccaagcttcaccatgggccgttag

SEQ ID NO: 49758 - DNA, 786 bp, Artificial Sequence
  Description of Artificial Sequence: Synthetic coding sequence
atggcccagaacctgaaggacctggccggccggctgcccgccggcccccgggggatgggcactgcgctgaagctgctcttaggagcaggggccgtcgcatacggcgtccgtgagtcagtgtttaccgtggaggggggtcatagagcgatctttttcaataggatcggcggggtccagcaggatacaatcctcgcggaagggctgcacttcagaatcccttggtttcagtatcctattatctatgacattcgcgctcgccccagaaagatttctagcccaaccggcagcaaggatttgcagatggtcaatatttccttgcgagttctgagccgaccgaatgcacaggagctgccttccatgtaccaacgtctaggcctcgattacgaagaacgagtcctgcccagtatagtgaacgaggtgctgaagagcgtggtcgctaagttcaacgcctcccaactgatcacccaacgcgcccaggtttctctgcttattcggcgagagctgaccgagagggcgaaagatttctcgctgatcttggacgacgtcgccatcactgaactgtccttttcccgtgagtacacagccgccgtcgaggccaagcaagttgctctctcaaagaatcctggttatatcaagcttagaaagatacgtgccgcacagaatatcagcaaaacaatagccacatcccagaaccgcatctatctcaccgccgacaatcttgtattgaatttgcaggacgagtcgttcactcgtggttccgactccttgattaagggcaaaaagtag

SEQ ID NO: 49759 - DNA, 2769 bp, Artificial Sequence
  Description of Artificial Sequence: Synthetic coding sequence
atggacaagaagagcttcgagatggtgctggacgagatccggaaggttgtggacctgttgcggtatttttcctgggccgagccccaactaaaggcgatgaaggccctacagcataagatggtcgccgtccagccgactgaggttgtgaatatcttgaactgttttactttctcaaaagacaagctggtcgctctcgaattgctggccagcaatattatcgatgcccaaaactcacggccaattgaggatttgttcagggtcaatatgtcagaaaagaagagatgtaagcggattttggaacaggcattcaagggcggctgtaaagcaccccatgcgatgatctcgtcttgtggcactatacccggaaatccatacccaaaaggtcgaccctcaaggataaatggcatctttcctggcactcccctaaagaaggacggcgaggagtgtactaacgagggaaaaggcattgcggctagaatcttggggccttccaagcctccccccagcacgtacaacccacataagcccgtgccttaccctatcccgccttgcaggcctcatgcgactatcgctccatcagcctacaacaatgcagggctcgttcctttggccaatgtgatcgcccccccgcctcctccatacactcctaatcctgttgggactgagaatgaggatttgtccaatccctctaaacctatccagaaccaaaccttctccaccccagcctcacaactgttcagcccgcacgggtcgaacccatcgaccccagccgcgacacccgtaccaaccgccagtcccgtgaaagccattaatcaccccagtgcttctgctgctgcgactgtcagtggaatgaacctgctgaacacggtcctgccggtctttcctggacaggtgagttcagctgtgcacacaccacagccgagtattcccaaccccacagtgatacggactcccagcctgcccacagcccctgttacatctatccactccaccaccaccaccccagtgccctcgattttcagcggcctcgtgtcgctgccgggaccaagcgcaactccaacagctgctactcctacccccggtccgacaccacggtccacgctgggtagcagtgaggcattcgcatcaacgtcggccccattcacctcgttaccctttagcacttcaagctccgcagcttccacctcaaatcccaattctgcaagcttatcatccgtattcgccggactgcccttgccacttccccctacatcccagggactctccaacccaacccccgtgattgcaggcgggagtacaccctccgtcgctggaccccttggagtcaactcccctcttctctcagcccttaaagggttccttaccagcaatgacaccaatttgattaacagtagcgcattaagcagcgcagtcacgagtggcctggctagcctcagttctctgactctccagaacagcgacagctcagcctccgcccccaataaatgctacgcgccgtcagctataccaaccccacagcggacctctacgccaggtctggccctttttcccggcctgccttctcctgtcgctaattccactagtacacccctcactttgcctgtacagtctcccttagcaacagctgcaagcgcttccacctccgtcccagtgtcttgcggcagcagcgcaagtctgctgcgcgggccacaccctgggacttccgatctgcacataagttccacaccagcagccaccactttgcctgtcatgattaaaacagaacctacaagtccaactccctccgcattcaaaggtccaagtcacagtggcaatccatcgcacggtacactggggctttctgggaccctgggacgagcttacacatccacttctgtgcctatatcactaagtgcttgcctcaaccctgcactgtcaggtctgagctcactgagcacccctctgaatggatccaatcccctaagcagcataagcctgcctccccacggcagttctaccccaattgccccagtttttactgccctccctagctttaccagtcttaccaataatttcccgctgaccggcaatccctcattgaacccgagcgtgtctttaccgggatcccttattgctacctctagcacagctgccaccagtacatccctgccccatccttccagtaccgctgctgtgctgagtggtctaagcgcctctgccccggtgagtgcagcaccttttcctttaaatctgtcgactgcagtaccttcactgtttagcgtcacgcaaggcccattgtctagtagcaacccttcttatccaggcttctctgtcagtaataccccaagcgtgactcctgcacttcccagtttcccaggtctgcaggcaccctcaaccgtggccgctgtcaccccgctccctgtggccgcaactgcaccttctcccgcccccgtccttcccggttttgcctccgcgtttagcagcaatttcaattcagccctggtggcccaagcaggcctgtcgagcggcctccaagccgctgggtcctccgtgttccccggcctgctgtccctccctgggattcctggattcccacagaaccccagccaaagcagcctccaagagttacagcacaacgcagcagcacagtcagcgcttcttcagcaggtgcattctgcctcagccttggaaagttatcctgcacagccggatgggtttccttcctacccttccgctccaggaaccccattcagtttgcaacccagtcttagtcagtcaggctggcagtag

SEQ ID NO: 49760 - DNA, 2835 bp, Artificial Sequence
  Description of Artificial Sequence: Synthetic coding sequence
atggacaagaagagcttcgagatggtgctggacgagatccggaaggctgtgctcaccgaatacaagctaaaggcaattgagtatgttcacggctatttttcctcagagcaggtggtggatctcctgcggtacttcagctgggcagagcctcagctgaaagcaatgaaggctctccagcataagatggttgcagttcagccaacagaggtggtgaatatcctgaactgtttcaccttctcgaaagacaaactggtggccctagaactgctcgccagcaacatcattgacgctcagaattccaggcctatcgaagatctctttagggtgaacatgtctgaaaagaaaaggtgcaaaaggatcctggaacaggccttcaaaggaggctgcaaagccccgcatgcaatgatatcctcttgcggaacgatcccaggcaatccataccctaagggaaggccttccagaattaatggcattttcccagggactccactgaaaaaagatggcgaggagtgcacgaacgaaggcaaaggcatagcagccaggattcttggacctagcaagccgccgccttccacctacaacccgcataagcccgtgccctatcccattccaccatgcaggccacacgccaccattgcaccctctgcctacaataatgccggcctggtaccattggcaaacgtgatcgctcctcctccccccccttacaccccaaatccagtgggcactgagaacgaagatcttagcaatccttccaagccaatccagaaccagactttctccactcctgcttcgcagcttttctcaccgcacggctcaaacccgtccaccccagcagctaccccagtacctaccgccagccctgtaaaggcaatcaaccatccatcagcaagtgctgccgccacagtgtccgggatgaatctgctgaataccgttcttccggtttttcctgggcaggtttcttctgccgtgcacaccccccagcctagtattcccaaccccaccgtgatcagaacacccagccttcctaccgcccctgtaacttctatacacagcactaccaccacacccgtcccgtcgatattttctggattggtcagcctgcctgggcccagcgcaactcctaccgccgcgacccccacgcctggccccacacccaggtccactctgggctcctctgaagcatttgcctctaccagcgcccctttcacaagcctccccttcagtaccagctcgagtgccgcatccacgagcaaccctaatagtgcatcattgtcctccgtttttgccgggcttcccctccccctcccacctacaagccagggcctgtctaaccctacacccgttatcgcaggaggaagcacacctagcgtggctggccctcttggagttaatagcccccttcttagcgccttgaagggatttctgaccagtaatgacacaaatctcatcaatagcagcgcgctgtcctcggcagtcacatctgggctggctagtttgtctagtctcacgttacaaaactccgatagcagcgcatctgcacctaataagtgttatgctccctcagctatccccaccccgcagaggaccagtacaccgggccttgctctctttcccggcttgccatccccagtcgcgaacagcactagtacgcctctgacgctgcccgtgcagagccctctggccaccgccgccagtgcctctacctctgtgcctgtttcctgtgggagctcagcttccttgctgcgcggacctcacccagggacaagtgatttgcatatttcttcaactcccgctgccacgacccttcccgtaatgatcaaaacagaacctaccagccccaccccatcagcatttaaaggtcctagccatagcgggaacccctcacacggcacactggggctttctggtaccctgggcagggcgtacacctctactagcgtcccaatcagcctgtccgcctgcctcaaccccgcacttagcggcctgtctagcctgagcactccgctgaacgggagcaatcctcttagttctataagtcttcctccacacggctcctcaacacccattgcgccagtgttcaccgcattgccatccttcacctctttgactaacaatttcccattgactggaaacccttccctaaatccttcggtttccctcccaggctctctgatcgcgacgagtagcactgcagccacaagtactagcttgccccatccatccagcactgccgccgtgctgagtggactgtctgcttcagcgcctgttagcgccgcgccattcccattgaatctaagtaccgccgtgccaagccttttctctgttacgcaggggcccctcagttcatccaaccctagctaccctggattttccgtcagtaataccccaagcgttaccccggcgctgccctcctttccaggcctacaggcgccttcgaccgtggcagcagtcacgccattgccagtcgcagctacagccccttctcctgcccccgtgcttccaggattcgcaagtgcattctcatctaactttaacagtgccctggtggctcaggccggcctgagctccggccttcaggccgccgggagcagcgtgtttccaggactgcttagtcttccagggatccctggttttccacagaacccatcccagtcttcactgcaggaattgcagcacaacgcagcagcccagagcgccctccttcagcaggtacactctgcaagcgccctggaatcgtatccagcccagcccgacggtttcccaagttacccgtccgctccgggtacccctttcagtctgcaaccatcactgagtcagtcaggttggcaatag

SEQ ID NO: 49761 - DNA, 3123 bp, Artificial Sequence
  Description of Artificial Sequence: Synthetic coding sequence
atggccgccgccgtgctgagcggccccagcgccggcagcgccgccggtgttccaggcgggacaggtggtctttccgctgtgagctcgggccctaggctgaggcttttactgcttgagagcgtgagcggactactgcaaccccgtactgggtccgcagtggccccggtacaccctccaaaccgcagtgcccctcacctcccaggactgatgtgccttcttagactgcacgggtctgtgggcggagcccagaatctctctgccctcggcgctctcgtatccctgagtaatgctagactgtctagcatcaaaactcgctttgaaggactctgtctcctgagcctcctggttggtgaatcacctaccgagttgttccagcagcactgcgtgtcttggcttcgctcaatccagcaggtcctacaaacgcaggatccgccagccacgatggaattggcagtcgctgtcctgcgcgacctgctccgctacgcagcccagttaccggctctgtttcgtgacatctctatgaatcatctgccaggtttattgacctccctgctcggcttgagacctgagtgcgaacagagcgcgctggaaggaatgaaagcctgtatgacatattttcctcgcgcatgtgggagtctcaaggggaagttggcctcattcttcctatcccgcgtcgacgccctatccccacaactgcagcaactcgcctgcgagtgctatagtagattgcccagcctaggcgcaggctttagccaggggttaaagcacacggaaagttgggagcaggaactgcactcactactcgcctcactgcacacactcctgggagccttatacgaaggagctgaaacggcaccagtgcaaaacgagggaccaggagtcgaaatgcttctgtcgagcgaagatggagatgcccatgtgctgctccagctgcgccagcgattttcggggctggccaggtgcttgggactcatgctgagcagtgagtttggagcacctgtctccgtcccagttcaggagattctggatttcatatgccgtaccctttcagtaagtagtaaaaacatcagcctccacggagacccttgcgggtgctgctgctgtccactgagtaccctcgctttggacctgttatccgccctgatcttagcctgtggctcccgcttgcttcgattcggcattttaatcgggagactgcttcctcaggtgctcaactcctggagcataggtcgcgatagcctatctccaggacaagaaaggccctatagtaccgtgagaaccaaagtatacgctatccttgaactttgggtacaagtttgcggggctagcgccggaatgttacaaggaggtgcaagcggggaggctctgctgactcacctgctgtcagacatctccccccctgccgacgcccttaagttacggtcgcccagggggagccccgatgggtcactccaaaccgggaaaccttcagcgcccaagaagcttaaacttgacgtcggcgaagctatggctcccccttcacatcggcttctgccggtgccatgcaaacccagtcctagtgcttcagagaagattgccctgcgcagtcccctctgttcagaagctctcgtgacctgtgctgcactgacacatcctcgggtgccgcccctccagcccatggggcctacttgtccaactccggccccggtcccgctcaggccccacaggccttctggcccccatcggagtatcctccgagctccatgtccccagtgggccccttgtcctcagcaggccccgtgcagcgcaggtcccatgccatctgcaggcccggtgccatccgctagacccggccctcccaccacagctaaccatctggggttatcagtcccgggtctcgtaagtgtaccccctcggctactcccggggcccgagaaccacagggcggggtccaatgaggatccaatcctggctccctccggaactccccctcctacgatcccacccgatgagaccttcggagggcgcgtgccacggcctgcctttgtccattacgacaaagaggaggcaagcgacgtagaaatctcattagaatcggattcggacgacagcgtggtgatcgtgcccgaaggattgccaccgcttccacctcctccccctagcggagcaacccccccaccaatcgctcctaccggtccacctaccgcttcacctccagtgccagcgaaggaggagcccgaggaattacccgcagcgcctgggcccctgccaccaccaccacctcctcctcctcctgtaccaggtcctgtcacactgcccccccctcagctggttcccgagggcacaccagggggggggggcccccctgcactggaagaggacttgactgtcatcaacattaatagctcagacgaagaggaagaggaggaggaggaagaggaggaagaggaagaagaagaagaggaggaggaggaggattttgaggaggaggaggaagatgaagaagagtacttcgaagaggaagaggaggaggaggaagaatttgaggaagaattcgaggaggaagagggtgaactggaggaagaagaggaggaagaggacgaagaggaggaagaagagctcgaggaagtggaggacctcgaatttggcacagccggaggtgaagttgaagagggagcgccgccaccccccacgttgcctcccgcgctgccgcctcctgagtccccacccaaagtgcaacccgagccggagcctgaacctgggctgctactcgaggtggaggaaccaggcactgaggaggaaaggggtgccgacaccgcccccacactggctccagaggccctaccttcacagggcgaggtagaacgcgaaggagaatctccggctgcagggccaccacctcaagaactggtcgaggaggagcccagtgcccctccgacgctgcttgaggaggagaccgaggatgggagtgataaggtgcagccccctcctgagactcccgccgaggaggagatggagacagaaaccgaggccgaagcccttcaagagaaagaacaagacgacacagctgctatgctcgctgacttcatcgattgtcctcccgatgatgaaaaaccacctccgcccacagaacctgattcttag

SEQ ID NO: 49762 - DNA, 3825 bp, Artificial Sequence
  Description of Artificial Sequence: Synthetic coding sequence
atggccgccgccgtgctgagcggccccagcgccggcagcgccgccggtgtccccgggggcactggcgggctttcagctgtgtcatctggacctaggctgagactgctcctgcttgaaagtgtatctggactgttgcaacctcgcaccggatccgcagtagcccctgtccaccctcccaaccggtctgcacctcatctgcccggcctgatgtgccttcttagactgcacggcagcgtggggggagctcagaacctgagtgccctgggtgcgttagtgtccttgtccaacgctagactgtcttctattaagacaaggtttgagggcctgtgtctgctgagtcttctggtcggcgaaagtcccacggaactgttccagcagcactgcgtgtcctggttaaggagcattcagcaggtgctgcagacgcaggacccacctgcaacgatggaattggctgtcgctgtgctgcgggatcttctccggtatgcagcacaactgcccgccctgttccgagatatcagtatgaaccatctgccaggcctgctaacatctctgctgggactcaggcccgaatgtgaacagagtgccctcgagggaatgaaagcctgcatgacgtactttcctcgcgcgtgcgggtcattgaaggggaagttggcgtccttcttcctttcacgtgtcgacgccctaagtcctcagcttcagcaacttgcatgtgagtgctattcgcggctgccctctctgggagctggcttttcacagggtcttaaacacaccgagagttgggagcaggagctccactcgttgctcgcctcgctccacaccttactgggagctctttacgaaggagccgagactgctcctgtgcagaacgagggccccggtgttgagatgctcctgagctcagaggacggcgacgcacatgtgcttttgcagctccgacagcgttttagtggcttggcccgatgcctgggcctcatgctgtcatcggaatttggcgcacccgtctccgtaccagtgcaagagatcttggattttatatgcaggacactctcagtttcctcaaagaatatcgtatctgggatctgccatcttttccgggctctagctcaagatactcggcagccgggcaaatactggggccccgagagcccgcaaacagtctcctcctggtcgcgtcctcgagaattacctaccttcgtgcaaatcactagccttccaatgtgccgcgataccggagcccagtgccaaagcgtggccaacgcatcactcggagaaggcgaatttggggatgcagagtcactcctgagaggacctgccattttgctcacttttcatcccggcagcattttggaggatagaggtttaattctgttgggagagctccgctccggcgtcggctttctcacctacgtttacatctgtaagtggtcctttcccgtgagcgtttctctttggctgtccttgtctagctctacactttacctgtgcccttttttcctgcagtctttgcacggagatgggccgctgcggttgctacttctccctagtatccacctcgaagccttggacttgctgagtgctcttatcctggcctgtggcagccgcctcctgagatttggcatcctgatcggcagactgctgccccaagttctgaactcctggagcattggccgcgatagcctctccccgggccaagaacggccctatagcaccgttcgtactaaagtgtatgctatcctggagctgtgggtgcaggtatgtggcgcatctgcgggtatgcttcagggcggcgccagtggggaggccttgctgacccatttgctttcagacatatctccccctgccgatgccctcaaactgaggtctccgaggggtagtcccgatgggtctctccagaccggaaagccatccgctccaaaaaagttgaagctggacgtgggggaggctatggcaccacccagccatagaaaaggcgattctaatgccaattctgatgtctgcgccgccgcattgagaggtctgtcccgcaccatactgatgtgtggcccgctgatcaaagaggaaacacacaggcggctacacgatctcgtgctgcccctagtgatgggagtgcagcagggcgaggtcctaggttccagcccctacactagctcacgatgccgaagagaactatattgtcttctgctagctttgctgcttgcgccctcgcccaggtgtcctccccccctcgcatgtgcactgcaagcattctctctgggacaacgggaagacagcctggaggtgtccagtttctgttccgaagctctggtcacctgcgcagcattgactcaccctcgtgtaccccccctacagccaatgggacctacctgtcctacaccagctccagtgccgcctccagaagcgccctccccttttagagcgcctccatttcaccctccaggacccatgccgtccgtaggtagcatgccgtcagcaggacctatgccttccgcaggtcccatgccttcagcagggcccgtgccttccgcgagaccaggccctcccactactgccaaccatctcggattatcagtccctggactagtctcggtgccgccaagactgctgcctggtcccgagaaccaccgagcaggcagtaacgaagaccctatactcgcgccatctggaactcctccccccactatacctcctgacgaaacattcggaggacgcgtcccacgcccggcatttgtgcattacgataaagaagaggcaagtgatgtggagatcagtctggagtctgactccgacgatagcgtggtgatcgtgcccgaaggcctgccccccctcccaccgccaccacctagcggagccacaccacctcccatcgctcccaccgggccaccgaccgcttctcctccagtccctgctaaagaggagcccgaggaactgcctgcagcaccaggtcctctgccccctccacctcccccacctccgcctgtcccaggacccgtgaccctgccaccccctcaactggtgccggaggggacacctggaggcggcggaccgcccgctctggaggaggatctcacggtgatcaacattaacagctcagacgaggaagaagaagaggaggaggaagaggaagaggaggaggaggaggaggaggaggaggaggaggatttcgaggaggaggaggaggatgaagaagagtacttcgaggaggaagaagaagaggaggaagagttcgaggaggaattcgaagaggaagagggcgaactggaagaggaagaagaggaggaagatgaggaggaggaagaggaattggaggaggttgaagatctagaattcggaacagccggtggggaggtggaggagggggcccccccgccaccgacattgccccctgcgctaccgccccctgaatccccaccaaaagtgcagcccgagcccgagccagagcccggcctactgttggaggtcgaagagccgggcaccgaagaagagagaggtgccgatacagcccccactctggcccccgaggcgttgccttcccagggggaagtcgaaagagagggggaaagccccgctgcggggcctccacctcaggagctggttgaggaagaaccttcggcaccacctaccctcttggaggaggagactgaagacggctcagacaaagtgcagcctcctccagagactcctgccgaagaagaaatggaaaccgaaacagaggccgaagcactacaggagaaggaacaagacgataccgccgctatgttggccgacttcatcgattgcccaccggatgacgaaaaaccccccccacctaccgagcctgatagttag

SEQ ID NO: 49763 - DNA, 2721 bp, Artificial Sequence
  Description of Artificial Sequence: Synthetic coding sequence
atggagctggccgtggccgtgctgcgggacctgctgcggtacgccgctcagctccctgccctctttcgcgatatatcgatgaaccacttgccaggactgctgactagcttactcggattgcgacccgaatgcgaacagagcgcgctggaggggatgaaggcctgtatgacctacttccccagagcctgcgggagcctgaagggtaagctggcatcattttttcttagtcgggtcgatgctctcagcccgcaactccaacagctggcctgcgagtgttactctcgcctaccctctctcggagcaggatttagccagggcctaaagcacacagagagctgggaacaagaactgcattccctgctggcaagtttacacacgctccttggcgcactgtacgagggagccgaaacagcgccagtgcagaacgaaggccctggggtggagatgttgttatcttccgaggatggcgatgcccacgttctgcttcaactgcgtcaaagattctccggcctcgccaggtgtctgggactgatgctgtcctcggagttcggagccccggtgtccgtgccagtgcaagagatcctggatttcatctgcagaacattgagcgtgtccagtaagaacatcagtttgcacggggacggaccactccggttgttactgttgccatcaattcatctggaagctctggacctattatctgctctcattttggcatgcggctccaggttgttgcggtttggaatcctgatcggacgcctgctgccacaggtcctgaacagttggtctataggacgggattcactatcaccgggccaggagaggccatactctaccgttagaacgaaggtgtacgcaattctcgaactttgggtgcaggtttgcggggctagcgctggaatgcttcaaggaggcgccagtggcgaagctctcctgacccacctgctgagcgacatttccccccccgcggatgctcttaagctccgtagtccacgggggagccccgacggttccctgcagacaggtaaaccaagtgctcctaaaaagctgaaactagacgtcggtgaagccatggcccctccctcgcaccgcaagggagattcaaacgctaactccgatgtttgcgcagcagcccttcgcgggttgagccgaactatcctgatgtgtgggcccctcatcaaggaagagacgcaccggagactgcatgacctagtgttgcctctggttatgggcgttcagcagggagaggtacttgggtcctccccatataccagctctcggtgccggcgggagttatactgcctgttgttggccttacttctcgctccctcaccaagatgcccacctcctttagcctgcgctctccaggccttttcgttgggccaaagggaggactccctcgaggtctcgtccttttgctcagaggctctggtgacgtgcgctgcactgacacaccccagggtgcccccactccaacctatgggccctacctgtccgacaccagcaccagtgcctccccctgaggctccatctccctttcgagcaccaccattccacccccccggcccaatgccatctgtggggagtatgccatcagccggccccatgccgagcgcaggtccgatgccctctgctggccctgttccatcggcacgcccaggcccacctacaaccgccaatcatttagggctgtcagtgcccggcctggtgtcagtgcctccaagactcctgcccggccctgagaatcaccgggcgggcagcaacgaggatcccattttagcacctagtggcactccaccgccaaccatcccccccgatgagactttcgggggacgggtgccccgcccagcctttgtccactacgacaaagaggaagctagcgacgtagaaattagtctagaaagtgacagcgacgattccgtcgtgatcgtgcccgagggtctgcctccactgcctcctccccctccctccggggccacgccccctccgattgcacctacaggcccacccaccgcaagtccgcccgtgccggccaaagaggagcccgaagaattacccgccgcgcctggtccactgcctccccccccgcccccccctccacccgtcccgggcccagttacgctcccacccccccagctggtgcccgagggaacccctgggggcggcggcccccccgctctggaggaggacttgacagtgattaatattaatagctcagatgaggaagaggaggaagaagaagaggaggaggaggaagaggaggaagaggaggaggaggaagaggacttcgaggaagaggaggaggatgaggaggagtacttcgaggaagaagaggaagaagaggaggaatttgaagaagagttcgaggaggaagagggcgagctggaggaagaagaagaagaggaggacgaggaagaggaggaggaactggaagaagtggagcgggagggggaaagccctgctgcggggccccctccccaagagctggtggaggaggagccctcagctccacctacactacttgaggaggaaacagaggacggaagcgataaggtccagcccccacccgagactcccgcagaggaagagatggagaccgaaaccgaggctgaagctttgcaggaaaaggaacaggacgatactgctgctatgttggccgacttcatcgactgtccgccggatgacgagaaaccaccacctcctacagagccagactcctag

SEQ ID NO: 49764 - DNA, 3543 bp, Artificial Sequence
  Description of Artificial Sequence: Synthetic coding sequence
atgctgctgcccagcctgagcccccgggtgcagcccgccttcacccagtgcgccaggcctcaaccgccaccccatgcacccagtcctgttgggggcagaagaggggtgtttgcgtcctcccgccatgcgacaacagggacacgtggaaagatggccgctgccgtgcttagtggaccgagtgctggatcggcagccggtgtacctgggggcactggaggattgtctgccgtgagttccgggcccaggctgcgcctattactactggagagcgtctcgggcctcctgcagccaaggaccggctccgccgtggctcccgtccaccctccaaacagatccgcccctcacctgcctggccttatgtgcctcttgcgtctgcatggctctgtaggcggggctcagaacctttccgccctgggggcgctcgtttctttgtcaaatgcccggctatccagcatcaagactcggttcgagggcctgtgcctgctgagcttgctggtgggtgagtctcctacagaactgttccagcagcactgtgtgagctggctcagaagcattcaacaggtgttgcagacccaggatcctccggccaccatggagctggccgtggccgttttgcgggaccttctccgatatgctgcccagttgccagctcttttccgagacattagtatgaatcacctgcccggcctgcttacttctctgctaggtctaagaccagagtgcgaacagagcgcactcgaaggcatgaaagcttgtatgacgtacttcccaagagcttgtgggtcactcaaggggaagctggcttcctttttcctatccagagtggatgccctctctccgcagctgcagcagctcgcctgtgagtgttacagccgactcccctccctgggggcaggatttagtcagggccttaaacatacagagtcttgggaacaggagctgcacagcctgctggctagccttcataccttgctcggagcactatacgaaggagctgagactgcaccagttcagaacgaaggtcccggcgtggagatgctactgtcctctgaggacggagacgctcacgttctgctgcagctgagacaaaggttctcgggactggccagatgcctggggctgatgttatcgtcagagtttggggccccagtcagtgtcccggttcaggagattctggatttcatttgcaggaccctgtctgtgagctccaagaacatctccctccatggagacggacctttaaggcttctgctgctgccatctattcatttggaggccctggacttactgtctgcactgatacttgcctgtggatccaggttgttgagattcggtattctgatcggacgattgctgcctcaggtcctgaactcttggtccattggacgggactctttgtcgcccggccaggagcgcccgtacagcacagttaggactaaggtttacgcaatcctggaactgtgggtgcaggtgtgcggcgccagcgcagggatgcttcagggcggggcgagcggtgaagctctattaacacatttactgagtgatatttctccgccagcggacgctctgaagctgagaagccctcgaggctctccggatggatcgctgcagaccggcaagcccagtgcacccaaaaaactgaagctcgacgtgggggaggcgatggccccgccctcacatcgcaagggcgatagcaacgcaaattcggatgtctgtgccgctgcgctgagagggctgagtaggacgatcctcatgtgcgggccacttatcaaagaggagactcacaggcggctccatgacctggtcctgcctctggtaatgggggtgcaacagggcgaagtcctggggagctcaccctatacttcatctcgatgccggagggaattgtactgtctcctgctggcactcctgctagcgcctagcccccgatgtcctcctcccctcgcgtgtgccctgcaagcgtttagcttgggtcagagggaagattctcttgaggtgagctcattttgttccgaggccctggtgacgtgcgctgccttaactcacccaagagtccctcccctgcagcccatggggcccacatgtccaaccccggcgcctgttcctccccccgaggccccttccccatttagggcccctccgttccaccctcctgggcctatgccctcagtgggttcaatgcccagcgccggcccaatgccctcagcgggccctatgccaagcgctggacctgtgcccagcgcccgccccggtccccccacaacagctaaccatctgggcttgtcagttccagggctagtctccgtcccccctcggctcctgccggggccggagaaccatcgcgccggtagcaatgaggatccgatactggccccttccggcacgcctcctcctactatccccccagatgagaccttcggcggaagggtgccccggcctgcctttgtgcattacgataaagaagaagcaagcgacgtggagatctccctagaaagcgactcagacgacagcgtggttatcgtccctgaaggtttgccacccctcccccccccccctcccagcggtgccacacctcctccaatcgccccgacggggccaccaaccgcaagcccgccagtcccagcaaaggaagaaccagaggaactgccagctgcacccgggccactgccgcctcctccccccccacctcccccggtaccgggccctgttacgctcccccctccacagctggtgcctgaaggaaccccggggggcgggggcccacccgcacttgaagaagacctgacagtgatcaacataaattccagcgacgaggaggaagaagaggaggaggaggaggaggaggaggaggaagaagaagaggaggaggaggaagactttgaagaagaagaagaggacgaagaggaatattttgaggaggaggaagaggaggaagaagaatttgaagaggagttcgaggaggaggaaggcgaactggaggaggaagaggaggaggaggacgaggaagaagaggaggagcttgaggaagtggaggacctcgagtttggcacagccgggggagaagtggaggagggggcacccccacccccaacccttccacccgcactacctccacccgagtcccccccgaaggtgcagcccgagccagaaccagaacctggtctgttgctggaggtggaagaaccgggcactgaagaagaacgcggcgccgacactgctcccacactggcccctgaggcgctgccgtcccagggcgaggtggagagggaaggagagagcccagcagctggtcctccccctcaggaattagtggaagaagagccgtccgcgcccccaacattgctcgaggaggagacggaagatggatccgacaaagtgcagccgcctcccgaaacacccgcggaagaggagatggagaccgagacggaagcagaggcgctgcaggagaaagagcaggatgacactgccgccatgctagctgatttcatagactgccccccagatgatgagaagccgcccccccctactgaaccagatagctag

SEQ ID NO: 49765 - DNA, 1083 bp, Artificial Sequence
  Description of Artificial Sequence: Synthetic coding sequence
atgcccaagttcaagcagcggcggcggaagctgaaggccaaggccgagcgcttatttaaaaaaaaggaggcgagtcactttcaatctaagttaattacacctcctccccctccaccctcccctgagcgtgtgggcatctcctctatcgatatatcccaatctcggtcttggctgacctcctcatggaacttcaatttccctaatattcgagacgccattaagctgtggacaaaccgggtttggtccatctatagttggtgtcagaactgtattacccagagcttggaagtgttaaaggacacaatctttccttcccggatttgtcatcgagagctctatagtgtgaaacagcagttttgtatactggagtccaagttgtgtaagctccaggaagctcttaaaactatatctgagagctcatcctgtccctcctgcggacagacctgccacatgagcggcaaactaacaaatgttccagcttgtgtactaatcacccccggcgacagtaaagcggtgcttccacctaccctgccacagcctgcttctcatttcccaccaccaccccccccacccccattacccccacccccacctcccttggctcccgttcttctgcgtaagccatctctggccaaagccttgcaagcgggaccgttaaaaaaggatggtcccatgcagattactgtcaaagacctgctcactgtgaagttaaaaaagactcaaagccttgacgagaaacggaagctgattcctagccccaaagctcggaacccactcgttaccgtcagtgacctccaacacgtgacactgaaacccaattccaaggtgttgtcgaccagagttacaaatgttttgatcacccccggcaagtcacagatggacttaaggaagctgctgcgaaaggtagacgtggagcgatctcctggcgggaccccattaactaacaaagagaacatggagacagggaccggattgactccagtgatgacacaggctctgagacgtaagtttcaacttgcgcaccccaggagccccaccccaaccctccctctttctacaagttcatttgacgagcagaattag

SEQ ID NO: 49766 - DNA, 3651 bp, Artificial Sequence
  Description of Artificial Sequence: Synthetic coding sequence
atggagcagctgcccggcgtgccccccggccccccccaccccgtgagacctcctccccctaatcctccccccccgatgccactgcaactcgaggcgcatctgaggtcacatggcctggagccagccgcgccttctccaaggttaaggcccgaggagagtcttgatccaccaggggctatgcaggagcttttaggggccctggagccattaccccctgccccaggagacactggtgtggggcctcccaacagtgaggggaaggatcccgcaggcgcttatcggagtccatcaccccaaggcacaaaagctcccagattcgtgcctctgacgtctatttgttttcccgatagccttctgcaggacgaggagcgctcattcttcccaacgatggaagagatgtttggcgggggcgcggccgacgactacggtaaggccggcccccctgaggatgagggagaccccaaagccggagctggaccccctcccggcccaccagcctacgatccttatggtccatactgtccagggcgggctagcggagccggtcctgagactcccggtctaggtctcgaccccaataaacctccagagttaccaagtacggtcaatgccgaacccctcggcctaattcagtccggtccacatcaggcagcacctccacctccaccgcctccccctcctcctcctgccccagccagtgagcccaaaggaggacttacatccccaattttctgctccaccaaacctaaaaagttgctcaagacctctagcttccacctcctcagacgcagggacccacctttccagactcctaagaagctgtatgcccaggagtatgagtttgaggcagatgaagacaaggccgacgtgcctgctgacatccggttgaatccccgccgcttgccagatctcgtaagtagctgtagatcacggcctgcgctttcacctttgggagacatagacttctgtcccccaaatccaggacctgatggccctaggcgacgaggcaggaaacctaccaaggccaaacgagacgggcctccacgcccccgtgggcgacccaggatacgacccctcgaagtgccaacaactgccggccccgcctctgcctccacgccaaccgacggggctaagaaaccgagagggagggggcgcggcagagggcgaaaggctgaagaggctggggggacgcgtttagaaccactcaaacctttaaagatcaagctctccgtgccgaaggctggcgagggactgggcacctcctctggagacgccatctctggcaccgatcataatagccttgattctagtttgacgcgcgaaaaaattgaagcaaagataaaggaagtggaagagaagcagcccgagatgaagagcggcttcatggcctctttcctcgactttctgaagtctgggaagcgacacccccccctgtatcaggccggattaactccacccctaagcccacctaagagcgttcctccctcagtgcccgcgcggggcctccagccacaaccgccagcaaccccggccgtcccccatcctcccccttcgggcgcatttggtctcgggggggccctggaggcagccgaaagtgaaggcctcggattgggatgtccatcaccttgtaaaagacttgatgaggagctcaaacggaacctcgaaacgcttcctagtttctcaagcgatgaagaggacagtgtagctaaaaaccgcgatctgcaagagtcaataagctccgccatcagcgcccttgatgacccaccattagcaggcccaaaggacacaagcacccctgatggcccacccctcgctccagcagcagctgtccctggaccgccaccattacctggccttccaagcgccaatagcaatggtactccagagcccccattactcgaagagaaaccaccaccgacacccccacccgcacccacaccccaaccccagcccccccctccccccccaccaccgcaacctgccttgcccagccccccgcctcttgttgccccaactccttcaagccccccaccacctcctcttccccctcctccccccccagccatgccaagcccacctccacctccaccaccagccgccgccccgctggcagcaccgccggaggagcccgcagctcctagccctgaggatcccgaactgcctgacactcggcctcttcacctggcaaaaaagcaggaaaccgctgccgtgtgtggcgaaaccgatgaagaagctggggaatcaggtggcgaggggattttcagagaaagggatgaattcgtgatcagggctgaagacattccgtccctcaagctggctttacagactggaagagagccccctcctatctggcgcgtgcaaaaggcactccttcagaagttcacacccgagatcaaggatggccaaaggcagttttgcgccacttctaattacctgggctacttcggagatgccaagaacaggtaccagaggttatatgtgaagttcctcgagaacgttaacaagaaggattatgtgcgagtttgcgctagaaagccttggcacagaccccctgtgcccgtccgtcggagcgggcaggcaaaaaaccccgtcagcgccggcggatcctccgcacccccccccaaggcccccgccccccctcctaagcccgaaacacccgagaagacaaccagcgagaagcctcccgagcagacaccagagacagctatgcctgagcccccagcacccgaaaaacccagcctgttacgacctgtggaaaaggagaaagagaaagagaaggtcacacggggcgaaaggcctcttcggggagagagagcgacatccgggcgccagactcggccagagaggtctctcgcgaccgggcagcccgctacctctcgactgcctaaggctagaccaacaaaagtcaaagcggagcctccaccaaagaaacggaagaaatggctgaaggaagcgggcggaaacgccacagctggaggaggacctcctggctcttcctcagattctgaatcatcacccggggcccctagtgaagacgagcgagccgtccctggtcggctcctgaagacacgcgctatgcgagagatgtaccggtcatatgtcgagatgctggtatctactgccctcgatccagacatgatacaggctcttgaagacactcacgatgagctgtacctgccgcctatgaggaaaattgatggactgctgaacgagcataaaaagaaagtgctcaaacgcttgtcactctctcccgcactccaggatgctctgcacacgttcccccagttacaggtggaacagtctggagaagggtcacccgaggaaggcgccgtaagattaagacctgctggggaaccttacaaccgaaagaccctgagcaagcttaagagaagcgtggtgagagctcaggaattcaaagtggaacttgagaagagcgggtactacactctctatcatagcttgcaccattacaagtatcacacgttcctgagatgtcgtgatcaaacgctagcaatcgagggcggagccgaagaccttggtcaagaggaagtggtccagcagtgtatgaggaaccagccatggttggaacaactgttcgactccttttccgatctcctggcgcaggcacaggcacattcccgctgcggttag

SEQ ID NO: 49767 - DNA, 3435 bp, Artificial Sequence
  Description of Artificial Sequence: Synthetic coding sequence
atggagcagctgcccggcgtgccccccggccccccccaccccgtgagaccccccccacctaatccccctcctcccatgccactgcagctcgaagctcacctgagaagtcatgggctggaacctgctgcccccagtccccggctgcgtcccgaggaatcattagatcctccaggcgcgatgcaagaactgctgggtgcattggagcccctgccgccagccccaggagacaccggggtgggacctcccaacagcgaggggaaagacccagctggggcctacagaagccccagcccccaaggcactaaggcacctagattcgtgccattaacctcgatttgctttccagactccttgctccaggatgaggaacggagcttctttcctacaatggaggagatgtttggaggaggcgccgcagatgattatggcaaggcggggcccccggaggacgaaggcgaccctaaggctggcgcgggtccgccaccaggacctcctgcttacgacccttacgggccctactgcccgggaagagcatctggagccgggccggagactcctgggctcggcctggatccaaataagccccctgagctgcctagcactgtgaatgcagaacccctgggactcatccagtcaggcccgcaccaggctgcccctcctccccctccgcccccacctccgcctccggcgcccgcctccgaaccaaagggaggtcttacatctcccatattctgttccaccaagccaaagaaattactaaagacctcttcctttcatctgctgaggcgacgcgatcctcccttccagactcctaagaaactttacgctcaggagtacgaatttgaagcagacgaggacaaggccgatgtgcctgcggacattagattgaatccaagacgcctccccgacctggtgagctcttgtcgctcgcggccagcactgtcccctttgggtgatatcgatttctgccccccaaaccctggtcccgacggcccccggcggagaggtagaaagcctacaaaagctaagagggacggcccccctcgacctcgtggccgtcctcgaatccggccccttgaggttcccacaacagctgggcccgcctctgccagcacacccactgatggggccaagaagcctcgcgggagagggcggggtaggggcagaaaggcggaagaagctggtggtacacggttggagcctcttaagcccctcaagataaagcttagtgttccgaaggccggggaggggctcggaacttcatctggcgacgctatcagcggcaccgaccacaactcactggactcaagcctcacgcgggagaagatagaagccaaaattaaggaagtggaagaaaagcaacctgagatgaagtctggatttatggcctcatttttagacttcctcaaatctggtaaacgacatccgccactttatcaggcaggcctgacacctccgctttcgccacccaagagtgtgcctccctcggtgcccgcccgcggcctccagccgcagcctcctgcaactcccgccgtccctcatcccccaccaagtggcgctttcggactcgggggcgctctggaagccgcagagagcgagggtctcgggctggggtgcccctctccgtgcaaaaggctcgacgaagaacttaaaaggaatctcgagaccctgccttccttttcctccgacgaagaagacagcgtagctaaaaatagggatctgcaagagagcatctccagtgcaattagtgcactggatgatccccctctggctgggccgaaagacacgagcaccccagacggccctcccctggcgcctgcggcggccgtgcccgggccacctcctctgcccggcttaccatccgccaattcgaacgggacaccagaacctccactattggaggagaagccacctccaacccctccaccagctcctaccccgcaaccacagcccccgcctcctcccccaccaccccaaccagccctcccgtctcccccgccattggtcgccccaacgccttcctccccacctccacccccactgcccccaccaccgcctccagctatgcctagtcctcccccccctccacccccagcagcggcccctttagccgccccccctgaagagccggcagccccctcaccagaagacccagaactccccgatactagacccctgcacctcgccaaaaaacaggaaactgcagccgtctgtggtgagactgatgaggaagccggcgaaagcggcggcgaaggtatcttcagagagagagatgaatttgtgatcagggctgaagatattccctccctcaagctcgccttgcaaactggcagagagcccccccctatctggcgggtacagaaggctctgctccaaaaatttactccagagatcaaggatggacagaggcagttttgtgctacgagtaattatttaggatacttcggggacgctaaaaatagatatcaaagactatacgtaaaattcctcgagaatgtgaataagaaagactacgtgcgtgtatgtgcccgcaaaccctggcacagaccgcccgtgcctgtccggagatccggccaggccaagaacccagtttctgcaggggggagttctgccccacctcccaaagccccggcgccaccccctaaacccgaaacacctgagaagactaccagcgaaaagcctcctgaacagacaccagagacagcaatgccagagccacctgcgccagagaagcctagcctcctcaggccagttgaaaaggaaaaggagaaagaaaaagttactcgcggtgagcgtccgctccggggcgagcgtgctacgagcggaaggcagacgcgacctgagagaagcctcgctactggtcagccggccacaagccggctgccgaaggctaggccgacgaaggtgaaggccgaacccccaccaaaaaagcggaagaaatggctcaaagaagctgggggaaacgccacagccggtggtggccccccaggaagctccagcgactctgaaagctctccaggggccccatccgaagatgaaagagccgttccggggcgattgcttaagacccgtgctatgagggagatgtacaggagctacgtggagatgttagtgtctaccgctctggaccccgatatgatccaggctctggaggacactcacgagctgaaaagatctgtcgtcagggcccaggagtttaaggtggaacttgagaagagcgggtactacacgctctatcactcacttcaccactataaataccacacatttttacgatgtcgcgaccagactctggccatcgagggtggggccgaagaccttgggcaggaagaagtagtgcaacagtgcatgcggaaccagccctggttggagcagctgtttgattccttttccgaccttctcgctcaggcacaagcgcatagcaggtgcggctag

SEQ ID NO: 49768 - DNA, 6111 bp, Artificial Sequence
  Description of Artificial Sequence: Synthetic coding sequence
atggaccggaactaccccagcgccggcttcggcgaccccctgggcgctggggcaggctggtcctatgagcggagtgccaaggcatccctggtctatggaagcagtcgtacatctcaccccgaaaccgacattctgcatagacaggcctatgctgctccacatccacttcaaagttacgctaccaatcaccatccagccggtctgtcaggtctcttcgatactggcttacatcacgctggctccgctggaccggatgccagtgttatgaatctcatttctgctttagagtccagaggccctcagccgggtccaagtgcctcttctctgctctcccagttccgcagtccctcctggcagacagccatgcacactcccggtcccaccgaattgtttatttctggcgccctgcccggtagcagcacgtttccatcatccagcgctctgtccgcttatcagcatcctgcgtccttcggatcacgcccctttcccgttccgagctcactgagcctgcaggaccccccatttagcccccctgctaacgggcttctgtcacctcatgacgttcttcacctcaagccctcccaggccccaacagtcccttcttccctggggttcgagcgactggcaggtggtggggtactcggaccagcgggcctgggtcccgcccagacccctccttacaggcccggccccccggatcccccacctcccccacggcacttgccaacgcaatttaatttgctggcatcaagttcagccgcagccgccgcagcggagcagagttctcctcagctgtataatttctccggagctgcacccggccccccaccacccgagagagctctaccccgccaagacacggtgattaaacactaccagagacccgccagcgcccagccaccgccgccccccccacctgctcatgccttgcagcattacctgagctgcggcggatcatacccaagtatgggacaccgagctaatctcgcttgctctcctctgggtggcggcgagcccagtcctggggcaggagaaccaagcaaggctggaccttcaggagccacagccggcgcctcagggagagctactgggcccgaggctgctggagggggcggagcaggggggggcggaggcggctaccgacccatcatccaaagtcctgggtacaaaacgggtaaaggggggtacggtgcagccgccggcggtgccactcgaccgccacccccccgttctaccgcaacccctaagtgccagtctctagggggccctgcagctgcctatgcgacgggaaaagctagcggagcagggggtgctggcggacaggcctattctccaggtcaaccgcagggcctattggggccacaggcttacgggcagggctttggcgggggacaggcccaggatctcagtaaggcaccttcctattcaggcggtcctccacaaccaccgagcggaccaccccccccaggactggccacatgtcaatcctattcacccgaccagctccaggggcaactgtacggcgtgcagggtgaaccatatccaggtccagcggctcattcccaggggctcccgactgcatccccctctttgtcctacagcacaggccactcccctgcgctgtccggacacggaggtgggtgggggccctcctctcttgggggcggaggcgaggcttcgccctcccacattattcggccattgcaaagccccccagccaccggccgaccgccgggcgttgggtctcccggcgccccaggcaagtatctctcatcagtcttagcctccgccccatttctggccccgcccggcgcaggatcctatgcggcaggcgcaggcgggtacaaaggtaagggcgacgggtcggagctcctcgctggacctgggggcccacccgctgaaagaactgaagatgaggaatttctgatccagcatctcctgcaggctccttcaccacctaggacatctggggccgacgggttggtgggcgaggacggcgctgcagacgcctccaaggggctggggggctctggcggtgccggtgggcccccagggactccatatgagcttgccaaagaggacccacagaggtaccacctccaatccgtgatccggacctcagcctctctggacgaaggagctactgccgccctggaactggggctggggagattaaaagaaaagaagaagggtccagagcgcggcggggaaactcctgagggtctagccacaagtgttgttcactatggggccggcgctaaggagctcggggctttcctacagaagtcccctcctccaccccctcccacagctcaaagcacacaaccaacccctcatgggctgttgttggaggcgggggggcctgatctgccactggtcctgcctcctccacccccccaactccttccctcagttctgtcacacgcaccgtctccttccccatcggcaagtaaggttggggtgcacttgttggaaccagcaactagagatggcgccccacaacctccgccccccccccctccaccgcccccgcctatgcccctccaactggaggcccacctgcgcagccacgggctggagccagcagcccccagcccgcgactgaggcccgaagagtcattggatcctcctggggccatgcaggagttgctgggtgcacttgagcctttaccgccagcccccggggatactggcgttgggcctccaaacagtgagggcaaggaccccgctggcgcataccgatccccctcccctcaaggcacaaaggccccgagattcgtgcctctgacgtcgatctgcttccctgactccttgctccaggacgaagagagatcattcttccctacaatggaagaaatgttcggaggaggtgcggctgacgattatgggaaggcgggccctccagaggatgaaggtgatcccaaggccggcgcaggccccccccccggaccgcctgcatatgacccttacggaccctactgccctggacgcgccagcggcgctggccctgagactccggggctaggcctggatcctaacaagcctcccgagctaccaagtacggtgaatgcggaacccctggggttgatccagtctggccctcatcaagctgcccctcctccccctccccccccacccccccctccagctccagccagtgagccgaagggtgggctaacctcccccatcttctgttccactaagcctaagaagctgctcaaaacctcctccttccaccttcttagacggcgcgacccaccttttcagaccccaaagaagctctacgcgcaggaatatgaatttgaggctgatgaggataaggcggatgtccccgcggatatcaggcttaaccctaggaggttgccagacttagtgtcatcatgcaggagcagacccgccctcagcccgctgggggatatagacttttgtccccccaaccctggcccggatggaccgcggagaagagggcggaaaccaaccaaagccaaaagagacggaccccccaggcctcgtggccggcctagaatccgccctctggaagtaccaaccaccgccggacctgcatcagcctccactcctacagatggcgccaaaaaaccccgaggcagggggcgggggcgagggaggaaggcagaagaggctgggggcactcgtctcgaaccacttaagcctttaaagataaaactgtccgtgcccaaggccggagagggactgggcacttcatctggcgacgccatttctggaactgatcacaatagcctggactctagcctaacgcgggagaagattgaggccaagattaaagaagtggaggagaaacagcctgagatgaaaagcggattcatggcaagcttcctggatttccttaagagtggcaagagacatccacctttatatcaggcaggtctgactcctccactgagcccaccaaagtcggtgccacccagtgtccccgcacgcggcctccagccacaacccccagctaccccagctgtcccgcaccctcctccaagcggagcctttgggctgggaggtgctctggaggcagctgagtctgaggggctgggcctcgggtgtccgtccccatgtaaaagactggatgaggaactgaagcgaaatctggagacgctgccttcctttagctcggatgaagaagacagcgttgccaagaatcgggacctgcaggagagcatttctagcgcgatatccgctctcgacgatccacctctcgccgggccaaaggacacatctactccggacggcccacccttagctcccgcagctgccgtgccaggacctccgccactacctggattacctagcgcaaatagtaacgggacaccagaacctcctctgctggaggagaaaccgccgcccacccccccaccagcacccacacctcagccccaaccacccccaccccctccaccacctcagccggcccttcccagcccccccccactagtggccccgacaccttcatctccacctccaccaccactgcctccaccccctccaccagctatgcccagtccccccccgccacctcccccagctgcagccccgttggccgccccccctgaagaacctgccgcaccaagcccagaagatcccgagctaccagatacgcgtcctctccatctggcgaagaagcaggagacagctgctgtttgtggcgagactgacgaggaggccggggaatcaggtggggagggcatcttcagagaacgagacgaattcgtcatccgggcagaagacattcccagcctcaaactcgcactgcagacaggacgtgagccccccccaatttggcgtgtacagaaagcattgctgcaaaagtttacgccagaaattaaggacggccagcgccagttttgcgcgacctcgaactacctaggctacttcggggacgccaagaaccgttaccagcggctctacgtaaagtttctagagaacgtaaataaaaaagactatgtgcgcgtgtgcgcaagaaagccctggcaccggccccctgtgccagtgaggaggtcgggtcaggccaagaatcctgttagtgcaggggggtctagtgcacctcctcccaaagccccagccccacctcctaagcctgagacaccggagaagacaacaagcgaaaagccaccagagcagactccagaaaccgccatgcctgaaccccctgcccctgagaagccctcgttgctgcgaccagtagaaaaggaaaaggagaaagagaaagtaacccgcggggagagacccctccgcggcgaaagggctactagcgggcggcagacaagacctgaacgatccctcgcgacagggcaaccggctacctcccgcctccccaaggcacgacccaccaaggtgaaagcagaacctcctcccaaaaagagaaagaaatggcttaaggaggctgggggaaacgcaaccgccggggggggtccgcctggttcttcgtccgattctgagagcagcccaggggcaccaagcgaggacgaaagagctgtccccgggagactcctcaaaacacgcgcaatgcgcgaaatgtacaggagttatgtggagatgctcgtgagcaccgccttggacccggacatgattcaggctctcgaggacacgcacgatgagctgtacctgccaccaatgagaaagattgacggtctccttaatgaacataaaaagaaagtgctcaaaagacttagcctctccccggccctgcaggacgccctgcacactttcccgcagctgcaggtggagcagagcggagaagggagtcccgaggagggcgctgtgcgtttgcggcccgcaggagaaccctacaaccgcaagaccctgtcaaagctcaagagatccgtcgtgcgcgcacaggagtttaaggtcgagcttgagaagagcgggtattacacattgtaccacagcctgcaccattataagtaccacactttcctacggtgtcgtgatcagacactggccatcgaggggggagccgaggacctgggccaagaggaagtagtacaacagtgtatgagaaaccaaccttggttggaacagctgtttgacagtttcagcgatctcttagctcaggcccaagcccattcacgatgcggctag

SEQ ID NO: 49769 - DNA, 1677 bp, Artificial Sequence
  Description of Artificial Sequence: Synthetic coding sequence
ggccggcccctgggcggcgacgcccggcgggagggcgccagcgtgggcggcacctctagggactggagtgaggaaggcatctgcctgacagtggacccttggggctctacattgtcctccgaaatgctgcagctcggtccgccattgagcgagcggagcttcgcagctttgaagcttacgggcgaaggtaaagctagtccagggagacaggccggttggtcctcccaggcacggcccccggaccctctttgtctgtgtcgagaaccattgagccgcatccataggactagcagcactttgagacggagatcacggacaactcccggaccagaagaggggccctcacagaaagtggaccgcgctccccaaccgacattagtagtcatgttggaggacattgcctccccgcgaccgccagctgaaggattcattgacgaaacccccaatttcatcatcccggcccagagggccgagcccatgaggatcgtgagacaacctacccctcctccgggcgatttggagccaccgttccagccttctgcactccccgccgacccactcgagtccccccccacagcccccgatcccgcccttgaacttccctccaccccgcccccttctagtctgctccggccgagacttagcccctggggtcttgctccactgttccgaagcgtgcgaagcaagctggagtcattcgccgacatcttccttacaccaaacaaaaccccccagccacctcctccgtcgcctccgatgaagctcgagcttaagattgctatctctgaggcagaacagtcaggagccgcagagggtaccgcctccgtgtctccgaggcccccaatacggcagtggaggacgcaggatcacaatacccctgccctgctgcctaagccatcgctcggtcgcagctatagttgcccagacctcgggccacccgggcctggcacatgtacttggcctccagcccctccccagccgtctcggccccggccccggcgtcacactgtgggcggcggtgaaatggctagggcacccccaccacccaggccctgcctgcggaaggaggtgttcccactgggcggcgtgggagcctcgccgtcgttaaccacttcttgttccagcactgccagtacctcattctccgagcccgctgagcctaggctgggatctaccaaggggaaggagccaagagctagtaaagaccaagtcctgagcgaacctgagacaaaaaccatgggcaaagtctcccggttccgaatcagacggacccctgctcgaccacagctgaacctgacccctatgggactccctcgcccaattcggctgaataaaaaggaattctcgctcgaagagatttataccaataaaaactatcagagtccaacaactcgtcgaacatttgagaccatatttgaggagccgcgtgagagaaatggtaccctaatatttacctcttcaaggaagctgcggcgtgctgtggaatttagagattcaagcctgccaaggagcagacgtccatcaagaggagtgcgggcggcaggaggccgcactgtgccccccaatgtagccccttccccagacgtaggtccactgctccagcaacgcttggaggagcttgatgcactcttgctcgaggaggaaactgtagatcgggagcagcctcactggacatag

SEQ ID NO: 49770 - DNA, 1758 bp, Artificial Sequence
  Description of Artificial Sequence: Synthetic coding sequence
atggacctgcccggcgacagcagcccccccggccagccccggctgtgtcgacagcctcttacacgcgcgctgtggggtgctagatctcctaagcggcccaggctgcagttacccggagccccttcacctctggaaaaagctagtagaagggtgctcgcggtggtcctagaagacgtaatggctgtgcacatggtgcccgtcgtgcctagcaagcaaacaagcattccccagcatcattcctatcaccaggatccggtgcaccggcagcccccagcctctccaccacgccaggcggggtggagctctcaggcccgacctcctgatcccctctgtctgtgtcgcgaaccactctcccggatccaccgtacctcctcaaccctgcgtaggaggagtagaactacaccaggcccagaggaggggccctcacagaaagtcgacagggctccacagcccacactcgtggtgatgctggaagatatcgctagcccacggccccctgctgaagggtttatcgacgagactcctaattttatcatccctgcccaacgagcagagcccatgagaatcgtcaggcaacctacccccccgccaggggatctagaacctccattccagccgtctgctctgcccgctgatccacttgagtcgccccccaccgcaccagatcccgccctggaattaccaagcacaccccctccttctagcctgctccgcccgaggctcagcccttggggcctggcacctctgtttcggagcgtcagatctaagctggagagcttcgcagatatattcttgacccccaacaaaaccccccaaccaccccctccaagcccacctatgaagctcgaactgaagatcgcaatctccgaggccgagcagtcaggggccgcagagggcacagcttccgtgagtcctcggcctcccattcgacagtggcggactcaggaccacaatacaccggctctcctcccgaaaccgagtctgggaaggtcctactcctgtccggacctgggcccccccggacccggaacttgcacgtggccccctgcccccccacagccatcccgccccaggccacggcggcacacagtgggaggaggcgaaatggcaagggctccacctcctccacggccctgccttcgtaaagaggtgttccccctcggcggcgtcggtgctagccctagcctgacaacaagttgcagcagtactgcgtccacgagcttttcagagcctgccgagcctagactgggttctacaaaggggaaggagccaagagcaagtaaagaccaggtgctgtcagaacctgagactaagaccatgggcaaggtctccagattcagaatacgtcggacaccggcccgaccgcagctcaaccttacacccatgggcctccccagacccatcagactcaacaaaaaggagttctcattagaggagatctatacgaacaaaaactatcagtcaccaaccactcggcgaacctttgaaactatttttgaagaaccgcgtgagcgcaacggaacgctgattttcacttcctctcgcaaattgcggagggccgttgaatttcgagattcttctctccctcgatcccggcggccatctcgcggggtccgcgccgcgggaggtcggacagtgccccctaatgtggccccatcccctgacgtcgggcccttgctccagcaaagattggaagaactggatgccctgctgctggaggaagagaccgtggaccgagaacagccacattggacatag

SEQ ID NO: 49771 - DNA, 1758 bp, Artificial Sequence
  Description of Artificial Sequence: Synthetic coding sequence
atggacctgcccggcgacagcagcccccccggccagccccggctgtgtcgtcagccactcactcgagctctctggggagcccgttctcctaagagaccgcgactgcagctgcccggagcgccatcacctctggaaaaagctagtcggcgagtgctggctgtggtgctggaggatgtgatggccgtgcacatggtgccggtggtcccctccaagcagacaagcatccctcagcaccatagttaccatcaggatccagtgcatcgtcaaccccccgcttcgcccccgaggcaggccggatggtcctcccaggctagacccccggatcccctctgcttgtgccgcgagccattatcacgcatacaccgaacatccagtaccctaaggaggcgcagccggaccacgcctggccctgaggaagggccaagccagaaggttgaccgagcccctcagccgactctggtggtaatgcttgaggatatagcctccccaagaccgccagcagagggctttattgatgagactccaaactttattattccggctcagcgcgctgaacctatgcgcattgtgcggcagccaacccctccccccggggatctggagccgccgttccagccgtcggcccttccggctgatcccctggagtcaccacccaccgccccggatcctgccctggagttgcctagcacacccccaccgtcaagtttgctgcgcccgcggctgtccccctggggcctcgcaccattgtttaggagtgtaaggtccaagttggagtccttcgcagacatcttcctgacaccaaataagacaccccagccacccccaccatcacctcctatgaagctggaattgaagattgccatttccgaagcggagcagtctggagcagcagaggggacagcttctgtgtcgccaaggccgcccatccgccagtggcggacccaggatcacaatacgccagcattgctgccaaaacctagtttggggcgaagctacagttgtccagatctgggacctcctgggcccggaacctgtacttggccccccgctcccccccagcctagtcgtcctagacctagacggcacacagttggcgggggggaaatggcgcgtgctcctccaccgcctaggccctgcttacgcaaagaggtcttccctctaggcggcgtcggtgcctctccctcgttgacgacttcatgttcctcaactgcaagtactagtttttcagaacctgcggaacctaggcttggctcgaccaagggcaaagagcctagggcctcaaaagaccaagtgctctccgaacctgaaaccaagacaatgggcaaagtttccaggtttaggattcggagaaccccagcccgcccgcaactgaaccttacacccatgggtcttcctcgccccattcggctcaacaagaaagaattttctctagaagagatctacactaacaaaaactatcagagcccgacaactcggcggacctttgagaccatctttgaggagcctagggaaaggaatggtaccctcatattcacaagctcccgaaagctgaggcgggcagtggagttcagagactccagtctgcctcgttctcgaagaccctctagaggagtgagagccgcgggcggacggacagttccaccaaacgtcgctccgagcccagacgtgggacccttgctgcagcaacgtctggaagagctcgacgcacttctcctagaggaagagacagtcgacagagagcagcctcattggacatag

SEQ ID NO: 49772 - DNA, 6450 bp, Artificial Sequence
  Description of Artificial Sequence: Synthetic coding sequence
atgctgagcagcggcgtggagacccagcccgtgcccctggacagctccatgagtgctgtggtacaggaactgtacagcgagttgccagtctctgttagcagggagttgcacgcagatccagagcctagcgtcattcctgacgtcaagcccggcgcaagcagcagtttgctgtctcagaaccgagcattaccccttgagctgcagcgcactcacgtggaatcctgttgcgaagagacgtatgagacactggaccacggatcagagccagggaggtgtgggctggtcgattctaccgcgggagggagcgtggccagtggtatcctcgaccgcgccaagcgatcagagagcatggaacctaaggtgttcagggatcctggcggacaagctggaatcatccgtgaaccaagcgaaggggcaaaggaggatccgcatcagcattctacagctgctgaagagaagacctctccctcgcaggaagatctgctgatgcagagctctaaggaactcagtcatgtcgacctgcccgaggactttctccggtccaaggaggggaacgtccagatcactgctgagactttgttgaagtctgcggaggtgcaaggcatgaaggtgaacggaacaaagacagacaataatgagggacacaaaaatggcaatgtctcaaaagacctgtctgcgggatgcggggagttccaggaggtggacaagatcatgacctcagatgaggtttctgagacatcaaccttagttactccagaaccgcttacctttgtcgatccggtactcaccgaggctaccccgaaggaaaaggaatgtgaagagctcaagtcctgcccgtggctgtctctccctggcaattctgctataagcaacgtagataatgggaaggaagaattatgcaagcccaatttagtttgcgaagccgacgacaaccatcagcagctccatgggcatcacaatgagcaaccctcctcaactcacgatagcccaaccgccacaagccccctgaaggagaattccgaggtgtcttgttttacatccgacctatccggccctgaaagccgcacaatttccctcgaaaactgtgggttcgaaggtggaggactgctgaagcgcagcgcagaaaaaacagactcctcttatttttatagaggcgacgaccaggggaaaaacctggccagcagagaggagaacgaggaacgattgctgataccgaggtccgagcggggcggcccttttctgttcaacgcgagggaacctgagaaggagatatccggccgctgtagcggcgaaaaggagccggtggtgagtccgaaggagaacatccacaataactgtatccaggattccctccatacagggaatagtagctctctcatgcctaacagttttactgaggcaaccgaggtgatgctcaacaagaacgacctcaaaataactgtccacgtccaggggaacctgactaatccagaagaccataaagagacattcacaaacatgtcacaccctggtggccattcagaggaatctagtttctctagtctcatgcagatagaagaagctggtcagaccactccggtcgagcccaacatcctctcaaaaagcttttacaccaaggattgcaatagtctggttagtattcaacggaacctggaggggaacacccagctcaacgaggcgtcctgtaatgatttcctgttcgagcgtaaaagtatcgtgtccctgatgccggaggaccagataagccccgttagcgaggtcttgaaacctaaacagggaacagctcttcttctacctagtccggaatttgactatcggcccgagtccgagaaggtcatccagacatcccacgacgacatccccctgcttgacgagcagtctatcgcgtgtgaaatgaacgaactatcttgcaccaatgagctggtggtgaataaagtcgaatctgaatgcgtcctcaatcaacaggtcagcctgaactctcaagagcacgccaacctccccaccgattctctgctgcacctgaacaaggagatgcccttggccacaggccgggacgcccaccaatcccaccacccccccctggagggacgagccgatgtgatagccgacatccaaacaatcccaatccagacaaagatcaaagatatctcgccaccaggaaatcagacatgcggggcgtcttctaactgtcccacactgaacattaagccagtctctctcgagagaaagaaggagatggctgacagcgggaccaaggcattgcatagccgtttgcggagtaataaaagggaggcagctggattcccccaggtcgtgtcagtgatagaatgtcacagtgtgcaatcacaggacatctcttcttgtcatcgggtcagaaagaatgtctcacaagagaacatgtgttcagcctcagcggctttcaagagcagcaagatctcacttcaggtggataattccctcataacaaagtacgagaatgcgttccagcacagagaccactgttgtcagggcacaggccactccgtggagaagagctcctgtaaagtgtcctacacgtcccaggagcgtgagctggacgggaaagaaaccaatggctcattgccaggggacaaaattaggaataagatggtcgctggtcttctgaatagtggtatttctaataaaactatccacacgtcaagctctatcaaactgtcagaggagggcttggagggcaaagagcaggatgtttccaaggagacagtgttctgcaaatacaacatctctgaccatgccattcaggagctgaaccagactgtcaacattcccggtcctgagaaggtcctcgaccagtccccaacggttatgttttcttctttcaagaacgtgaaatcagtggagactttagatcagaaagccgacgaggtgttagattgtcagtccaaccagaaccggcccgacgagtgtaaatcagagggccagagtgccaaggagatgctctcctccgaccagagagagaccgtgaccgagccacacggggaggtgaaccacaatcagaaagacctcttagtgagtagcggatcaaacaattccctaccctgcgggagtcctaaaaagtgcaacctgaaaggcgcatttgtgaaaatgtcaggctgcgacgagtctaccgaaggcatggtggacatcgtttacacagattgtagtaacaaattagcagagggggtactggacgtgaaagctagtaacttgctcgattgcggcgcgcggcaagagaaactcgcctttcaggaagattcacgctccactctctcacggagggaattagatgcagcccacacaggcaccacaggccaggacagcgattttcccgttaccgctgcatcaactgtggatttcctgaaaattaaaaagtcctgcgaggagaatgtttgccgcagtctgaaggactgtgagatggaaaaatgccctgactcatgtgcacacgagatggagagtgtggccgaccatgagccgaacaaaaggatcttaggccgggtgaatcttagtcttaatgattcacattacggccagcaggacaaaggcaccagccttcgcgagacgcaggagatgacagagggcagtcgattggaaccaaactccgaattcggtaaggagagcacattcggcatcagctctaaggagtcaatgagctgtcatgatgaaagcagcgtctctctgcgtagtcttaaatcaattgagataatgccaagtcaggagaattccgagacgaacgtcaactccgaagagaccgacctgaagaatctgtgcaaacctaaggatggcgagatgctctgcgagaatgtgaaagactgcacagtgctccctgaaatgaaggagattgtttctagggattggagcaattcaagcgatagagattcagtttgtacctgcgtggagaagaacgcctgtaaagcctgccatccccacgagaacagcagtgatagacacctgcctctgaccgtgaaaaccgatataaaagtcaagggcgaagaaacagaagagcaccaaaggggaaggctgggctatctgacggtcggagaacaaagcgaagagctggtcactcgggagaccggagatggcgacccggtgagcaacatttctcagacacactttaaatgccgaggcattcttaaccatgctgaaaaacagcagagtcctgaagtactggactacatgcttcagaaagaagaaaaatacatccgccagcaaaaagcccacactattagccagcaatgcatttcctcctccctgttgttggacgacgcccagaaccagaatcagccaaaagcagacaaggatgagagcaccatgattaacgaaataactctggccaaacttgcaaaagattccattgtggcccagactcagaagctggaagatcagaaggaggaacgcctacaccaccccctcaggaaagacaccgagtcttgcaccagtccctgccttctcggagcccccagaaaggctcaagacccctcctccgcagggtgtgaccagattcatggagccttcgcaaagaaaggcgttctgcctctgaaaaagcagccccatcgtacttgtaaaaaagtatcttaccaggaacagataatcgtgggaagaaaaattggtaagattagatcatccgcctttctaaagtcttcctctaacccaattcccaccaaggcgcatcggctcttgtcgctgtgtaccttgagcgctccaactcgtctggaaccagagacagccccaaccaagtcgctggtgtcacatattcccaagcagatgtcaaccccttgtcaccctcttcggagcctcaatttccggaagaccaccaaagagtccgccctgcttaataaactcagcattctagcttctaagctggccccggcgatgaagactcagaaactgcggtaccgtcgatgttccagtgaactcttgccaatggccaagtcatacaagagattgcggtataagagactgctcgatggcttcagtagcagtacagagcaactcaatccttacctggcagcttctggctgggacaagaggcctaatagcaagccgatggccttatatagtctggaatccattaagatgacttttatagatcttagtaataaaatgccatctctactgtttggcagtgagatatttcccgttagttttcatgttaaatcatcaagcagtgactgtacgaccgaatctagcagaacattccccgaacactgcgctcccgctaggctcgcccttggtgaggccctgcaatgtcccagtcaaccccctaaatggacgttttctttctttctgtcccacgggtgccccgggatggcgactttcagggaggacaccggtgtacactcacaaactcacacacaggctccccctcagccccctgctcctctgcaggactatggggggactgccatcgtccagacacgcgccgactgctccgtgctgggattacacactcttttggccctgtgttctccaggttgttaccgcatatggaccaagaagcggagcttttctagccatatgcccactatgcagcgccttttcatgacacagttcacacaggggctgaaaggcctcaggtctcctgcatctattgctgacaaggtgttttgcagtctgccatactcggtgggaagagtactctctatctggtcacagcacggtccatccgtctgctccttcgaaatatcttctctccatagcccacactgtaagagacagccttcactgggaacaacgagctcccacacaatgctaccatatgtccccttacccggaatggaagctacttataatacatccggaagtcagacgagactcgaacctccgtttccagccctggtgcctaagagttgcctggtggctgagagcgccgtgtctaaactgctgttgagcgcctccgaattccaggttagaggtctggatgagttagatggcgtgaaagctgcctgcccgtgtccccagtcgtctccaccggagcagaaggaagctgagcccgaaaagcgtccaaaaaaggtcagccaaattcgaatccggaaaactataccccgaccagacccaaacctgacgcccatgggcctccctcgccccaaaaggttgaagaaaaaggagttctctctagaggagatttacacaaataaaaactataaatcccctcccgctaacagggatctggactcatcttgtccctctaccgacagcgaaacaggtcatttcctagtgtttggttacgcacagagacaggcccagccccatcctttactagcctccagacgccttatcgggtgcagttctcccgaaggaaggggccatcctcgcagctatccctactggagacgcctgctggtgctgtgttggtaccttcccggctggagggcaggccgagtgacttggctacgcctggcgacttgggcagggagaggggattcttctctttag

SEQ ID NO: 49773 - DNA, 6021 bp, Artificial Sequence
  Description of Artificial Sequence: Synthetic coding sequence
atgctgagcagcggcgtggagacccagcccgtgcccctggacagcagcatgtcagccgtcgtgcaggagctttatagtgagctgccagtaagcgtaagcagagagctgcatgcagatcctgagccttcggtgattcctgatgttaaacctggggctagttcaagtttattgtcccaaaaccgcgcacttccacttgaattgcagaggactcatgtcgagtcctgttgtgaggagacgtatgagacgttggatcacgggagtgagcctggaaggtgcggcctcgttgacagtacggccggaggaagcgttgcgagcgggattttggaccgcgccaagaggtcggagagcatggagcctaaggtctttagagaccctgggggccaggcagggatcatcagagagccgagtgagggcgccaaagaggacccacaccagcactccaccgccgcagaggaaaaaacaagcccgtcccaagaggacctcttgatgcagagctccaaagagctcagccacgtggatctccctgaggacttcctgcggagcaaagaggggaatgtgcaaatcactgctgagaccctcctgaagtcagcagaagttcaaggtatgaaggtgaacggcaccaagaccgataacaatgaaggacataaaaacggtaatgtgagcaaggatttatctgcgggctgtggggagtttcaggaagtcgacaagatcatgacctccgacgaagtgagtgaaacgtcaactctcgtcactcccgagcctcttactttcgtcgacccagttctcacggaggccacgcccaaggagaaggagtgcgaagagttgaagtcctgtccttggcttagcctccccggcaactccgccatctccaacgttgataacggcaaggaggagctctgtaagcctaatctggtctgtgaagccgacgataaccaccaacagctccacggccaccataacgagcagccgtcgagcacacacgacagccccaccgccacttccccattgaaggaaaactcggaggtgtcatgctttacctcagacctgagtgggcccgagtcccgcaccatcagcctggagaactgcggtttcgaaggaggcggtctgctcaagcgcagtgccgagaagacagacagctcctatttttaccgcggggacgatcaggggaagaacttagcctctagggaggagaatgaggagcgcctcttgatcccccggtccgagagaggggggcccttcctattcaatgcaagagagcccgagaaggaaatcagtggtcggtgctccggtgagaaggaaccagtcgtcagccccaaagaaaatattcacaacaactgcatccaggatagtctacacacaggcaacagttcttccctgatgcccaactcgtttactgaggccactgaggttatgctgaacaaaaatgacctaaagatcactgttcatgtccaagggaatttgacaaatcctgaggaccataaggaaacattcaccaatatgagccatccgggcggtcatagtgaagagtcatcctttagtagtttgatgcagattgaagaggctggtcagaccacccccgtggaaccaaatatcctttctaagtctttttacactaaggattgcaactcactggtctccatccagaggaacttagagggaaatacccagttgaacgaggctagctgcaacgatttcttgtttgaacggaaatctatcgtgagtctgatgcccgaggaccagattagccctgtcagcgaggtgctgaagccgaagcaggggacggctctgcttttaccgtcacctgaattcgattatcgccccgaatcagaaaaggtgatacagaccagtcatgacgacataccgctgctggatgaacagagtattgcttgcgagatgaacgagctgtcctgcacaaacgagctggtagttaacaaggtggagagtgaatgcgttctgaaccaacaggtgagcttgaactctcaggaacatgcaaatcttccgaccgattcactgctccacctgaataaagagatgcccctggccacaggccgagacgcacaccagtcccaccatcctccactggaagggagagccgacgtgatcgcagacatacagactattccgatccaaaccaagataaaagacatatccccccccgggaaccagacatgcggggcatcatctaactgtccgaccctaaatatcaagcccgtgtcattggaacggaaaaaggaaatggcagactccggaaccaaggcccttcattcccggttgcggtcaaataaacgcgaggcggctggattcccacaggtagtgtctgtaattgagtgccattctgtgcagagccaggacatctctagctgccaccgggtacgtaaaaatgtatcccaggagaatatgtgtagtgctagcgccgcatttaaaagtagcaagatcagtctgcaggtggacaatagtctaatcaccaaatacgagaatgctttccagcacagagaccactgctgtcaaggtacaggccattccgtagaaaaatcatcatgcaaggttagctatacctctcaggaaagggagctggacggcaaggaaaccaacgggtctctgcccggcgacaaaatcagaaacaagatggtcgccggtcttctcaactcgggcatctcaaataagaccatccacacctcctccagtattaaattgagcgaggaaggactggagggcaaggagcaggacgtcagtaaggagaccgtgttctgtaagtacaacatttccgaccacgcaatccaagagctcaatcagaccgtaaacatccccggcccggaaaaagtcctcgaccagagtcctactgtgatgttctcaagcttcaagaacgtaaagagcgttgagacactggatcagaaagccgacgaggtccttgactgtcagtccaatcagaatcggccagacgagtgcaagtccgaaggccagtccgcaaaggaaatgctctccagcgaccaacgggaaacagtgactgagcctcatggcgaagtgaaccacaatcagaaggatctccttgtctcatccggaagcaataacagcctgccatgcggttcaccgaaaaagtgcaacctcaagggggcttttgtcaaaatgtcaggctgcgatgaaagtaccgagggaatggtggacattgtctacaccgactgttccaacaagctggctgaaggtgtactggatgtcaaggccagtaatcttcttgattgtggggctcgccaggaaaaactggcatttcaggaggacagtagatcaactctgtcccggagggaactggatgctgcccacactgggacaaccgggcaggacagcgactttcccgttacagctgccagtaccgtggattttctaaagattaagaaaagctgtgaggaaaatgtgtgtagatcactgaaggattgcgagatggagaagtgtccggattcctgtgcccatgagatggaaagcgtggccgaccatgaacccaataagcggatactggggcgcgtcaatctctctctgaatgactcacactacggtcaacaggataaaggcaccagtctgcgggagacacaggagatgaccgaggggagcagactcgagcccaacagcgagttcggcaaagagtctaccttcggaattagttccaaggaatctatgagctgtcatgacgaaagcagcgtgtctctgcgtagcctgaagtcaattgagatcatgccctcccaggagaactcggaaacaaatgtcaactccgaggagaccgacctgaagaatctatgtaagccaaaagacggtgaaatgctgtgtgagaacgtcaaagactgtaccgtcctccctgagatgaaggaaatcgtgtctcgggactggagcaactctagtgaccgggatagcgtctgcacgtgcgtagaaaagaacgcatgcaaggcttgtcacccccatgagaacagcagtgaccgccatctgccactcaccgtgaagaccgacatcaaggtcaaaggcgaagagaccgaagagcaccagcgcggcagactcgggtacctgacagtgggagagcaaagcgaagagctggtcacacgcgagacaggagatggagaccccgtgtcgaatatctctcagacacactttaagtgtcgaggcatacttaatcatgccgaaaagcagcagagcccagaagttctagattacatgctgcagaaggaggagaagtacatcagacaacaaaaggcgcacacaatcagccagcaatgcattagcagtagcttgttattagatgacgctcagaaccagaatcagcctaaggcagacaaagatgaaagcaccatgattaatgagattaccttggctaaattggctaaagactcaatagtggcgcagacccagaaactggaagaccagaaggaggaacgcctgcaccaccctttacggaaagataccgagagttgtacctctccatgtctactcggagcacccaggaaggcacaagacccaagctccgcgggctgcgatcagatccacggggcctttgcaaaaaaaggagtgctgcccctcaagaagcagccccacaggacctgcaagaaggtgtcttaccaggaacagattatcgtgggacgcaagatcggcaaaatcaggtctagtgcatttctgaagtctagctccaaccctattccgacaaaagcccatagactcctctctctgtgcacattaagcgcacccacgcgcctcgaaccggaaaccgccccaacgaaatcgctggtctcacatattcccaagcagatgtctactccttgccaccctttgaggagccttaatttcagaaagacaactaaagagagtgctctgctgaacaagctgagcatcctagcttctaagttggcacctgccatgaaaacgcagaaattaagatatcggcggtgctcatctgagttgcttcccatggcaaaatcatacaaaaggctgaggtataagcgccttctagatggctttagctcaagtaccgagcaactcaatccatatttagcagcctcaggctgggacaaacggcctaactcaaaacctatggcgctctatagcctggagagcatcaagatgactttcatcgatctctctaacaagatgccatccctgctgttcgggtcagagatctttcccgtatctttccacgtcaaaagctcatcaagtgactgcacgacggagtcctccagaaccttccccgagcactgcgctcccgcacggctggctctgggggaagccctgcagtgtccctcacagcctcccaagtggacattctcattcttcctctctcacggatgcccgggaatggccacatttagagaggataccggcgttcacagtcagacacacactcaggctcccccacagccacccgctccacttcaggattatggcggaacagccatcgtgcagacacgggcagactgttccgtcctgggtctgcacacactgctggcactttgttcacctggatgttaccgtatttggacaaaaaaaaggtccttcagttcgcacatgcccacaatgcagcggttatttatgacccagtttactcagggcctgaaaggactccggtcgcccgcgagtatcgcagataaagtgttttgttcgctcccatactcggtcggtcgggttttgagtatatggtcacagcacggcccctcagtgtgtagtttcgaaattagctcgcttcacagtcctcattgtaagcggcaacctagccttggaacgacgtcctcacacaccatgctcccgtacgtgcctctcccaggaatggaggctacttataacacaagcggctcccagactcggctcgagcccccattccccgctttggtgcctaaatcctgcctggtcgcagaatccgctgtctcaaagctcctgctgtctgcttccgaatttcaagtaaggggccttgacgaactggacggagtcaaagccgcttgtccatgcccccagtccagcccacccgagcagaaggaggtgaaggaagaaggcgtttag

SEQ ID NO: 49774 - DNA, 6456 bp, Artificial Sequence
  Description of Artificial Sequence: Synthetic coding sequence
atgctgagcagcggcgtggagacccagcccgtgcccctggacagcagtatgtccgccgtggtccaggagctgtacagcgagctccccgtctctgtctcccgcgagctccacgctgatcccgagccatcagtgattccagacgtgaagcctggggctagttcatctctcctttctcagaatagggcactgcccctcgagttgcagcgcactcacgtggaaagttgttgtgaggaaacctatgagactttggatcacggctctgagccggggcgttgcggactcgttgactccaccgcaggaggtagtgtcgcttctggaatactggatcgtgcaaaaagatctgagtctatggagcccaaggtgtttagagatcctgggggccaagccgggattatcagagagccatctgagggtgccaaagaggatcctcaccagcattcaactgccgcggaagaaaaaacctctccatctcaggaagatcttttgatgcagtctagtaaagagctctctcacgtggacctgccagaggattttcttagaagtaaggagggaaatgtccaaattaccgccgaaaccctcctcaagagcgctgaggttcagggaatgaaggtgaatggtacaaagaccgataataacgaaggtcacaaaaacggcaacgtgagcaaggatttaagtgcaggctgtggtgaattccaggaagttgacaagataatgacaagcgatgaagtaagtgagacttccacccttgtaacacctgagccactcacttttgtggatccagtgctaacagaggccacccctaaagaaaaagaatgcgaagagctgaagagctgtccttggctgagccttcccggcaatagtgctatctctaatgtggataatggcaaagaggaattatgcaagcccaacttggtgtgcgaggccgatgacaaccaccaacagcttcacggccatcataacgaacaacctagctctactcatgattctccaacagcaacatcccccctgaaggaaaactccgaggtgagttgctttacctcggatctgtccggccccgaaagtaggacgattagccttgagaattgtggattcgaggggggcgggctcctaaagcggagtgccgaaaaaaccgactctagctacttctacagaggcgatgaccagggtaagaacctggctagtcgcgaagagaacgaagagagactcttaatcccacggagcgaacgaggggggcccttcctgtttaatgcccgagagccggagaaagagatctctgggaggtgctccggcgagaaggaacctgtcgtgagccccaaagaaaatatccataataattgcatacaggattctcttcatacgggcaacagtagctcactgatgcctaacagctttacagaagcgacagaggtgatgctgaataaaaacgacctcaagataaccgttcacgtgcagggaaatctgacaaatcccgaggaccataaagagacgtttacaaatatgagccatccaggaggtcactccgaggagagttcatttagctctctaatgcagatcgaggaggccggccagacaacgccagtggaacctaacatactttctaagagtttttacactaaggactgtaactctcttgtgtcgatccagcgtaacctcgaagggaatactcagctgaacgaggcctcctgcaacgatttcctgttcgaaagaaagtcaatcgtaagccttatgcccgaagaccagatctcccccgtgtctgaggtccttaaaccaaaacaaggcacagctctcctcctcccttcaccagagttcgactaccggcctgagtccgagaaggtgatccagactagtcatgacgatatccctctactcgatgaacagtccatcgcttgtgagatgaatgagctgtcgtgtactaatgaacttgtagtaaataaggtggagtccgagtgcgtgcttaaccagcaggtgagccttaacagtcaggaacatgcaaacctgccgaccgattccttgctgcatctgaataaagagatgccgctggccacagggagggacgcgcaccaaagccatcatccacctctggagggcagagctgacgtgatcgccgatattcaaaccatacccattcaaactaagataaaggacatttcacctcccgggaaccaaacatgcggtgcctccagcaattgtcccacactcaacattaagccagtgtcactggagcgcaaaaaggaaatggcggacagcggtacaaaggccctgcactcccgcctgaggagtaataaaagagaagctgctggcttcccacaagtggtgtctgtaattgaatgtcattctgtgcaatcccaagacatttcctcttgtcacagagttcgaaagaatgtgagtcaggagaatatgtgttccgcatctgcagccttcaagtccagtaaaatcagtctgcaggtggataatagtttaataaccaaatatgagaatgcctttcagcaccgcgaccactgctgccagggaactggccactccgtcgaaaaaagctcttgtaaggtgtcgtatacatcccaggaacgggagcttgacggtaaggagaccaacgggagtctaccaggcgacaagatcagaaacaagatggttgccggattgctgaacagtggaatttccaataaaactattcacacctcctccagcatcaagctctctgaggaaggtctggagggaaaggagcaggatgtgagtaaagagaccgtgttttgcaagtacaacatctcggaccacgctattcaagagctcaaccagaccgtgaacatacccgggcccgagaaagtgctggatcagagcccaaccgtgatgttctcaagtttcaagaatgtgaagagcgtggagactctggaccagaaagctgacgaggtcctggattgccagagtaatcagaacaggccagacgagtgtaagtctgagggacaatcagctaaggaaatgctgagctcggatcaaagagaaaccgtcacagaacctcatggtgaagtgaatcataaccagaaagatctccttgtgtccagtgggtcaaataactccctgccctgcggcagtcccaaaaaatgcaacctgaagggggcttttgtgaagatgtccggttgtgatgagtcgacagagggcatggttgacatagtgtacactgattgcagcaataaactggctgaaggtgtgctcgacgtgaaggcaagtaatttactggactgcggagcccgacaggagaagctagccttccaagaggacagcaggagcacactgtctagaagagaactggatgcagcccataccggaacaacgggccaagattctgacttccctgtgaccgctgcatccacggtcgacttcctaaagatcaaaaagtcctgcgaggagaacgtgtgcaggtcgctgaaagactgcgagatggagaagtgccccgactcctgtgcacatgaaatggaatccgttgcggaccacgaacccaataagcggatcctggggagggtgaatctgagcttgaatgattctcattacgggcagcaggacaagggcacatcgttgagagaaacacaggaaatgactgagggtagcagactcgagcccaactcggagtttggcaaggagtctaccttcggcatcagctccaaggaaagcatgagttgtcacgacgaaagttccgtcagtctccggtcgctgaagagcatcgagatcatgcctagccaggaaaatagtgaaacaaatgtcaatagtgaagaaaccgatttgaaaaacttatgtaaaccaaaagacggagaaatgctctgtgagaacgtgaaggactgtacagtgctacctgagatgaaggagatcgtcagccgcgactggtcaaatagctcagaccgggactccgtgtgtacctgcgtggagaaaaatgcatgcaaagcttgccacccccacgagaattcgtcggaccgccacctccccctcactgtcaagaccgacattaaagtaaaaggcgaagaaactgaagagcaccaacgtggccgcctcgggtacctcaccgtcggagagcagtctgaagaacttgtcaccagagaaactggggatggagatcccgtttctaatatttcacagacccattttaagtgtagagggatcctgaatcacgcagagaaacagcaatccccggaggttctcgattacatgctccagaaggaggagaagtacattagacagcagaaagcgcatactatttcccaacagtgtatcagtagtagtttgctgctggatgatgcacagaatcagaaccagcccaaggcagacaaggatgaatccaccatgattaatgaaattacgctggcgaaactggcgaaagatagcatcgtagctcagactcagaaattagaggatcagaaagaggaaaggctgcatcaccctctgagaaaggacaccgagagttgcactagcccttgcttattgggagcacctaggaaagcgcaggatccgtccagtgccgggtgcgatcagatccatggcgctttcgccaaaaaaggcgtgctgcctctgaagaagcagccccaccgcacctgcaagaaggtctcttaccaggaacaaattatcgtgggacgtaagataggcaagatccggagcagtgcgttcttgaagtcgtcatcaaatcctatacccacaaaagctcatagactgctgtcactgtgcactttaagcgcccctacacgcctcgagcccgagactgcgcccacaaagtccttagtgtcacatataccaaagcaaatgtccaccccatgtcaccctctgcgcagcctgaatttccggaagactaccaaagagtcagctctgctgaataagctcagcatcctagccagcaaattagctccagccatgaagacgcaaaagctgcggtacaggagatgcagcagcgaactcctgcccatggctaaatcgtataaaaggctgcgttataagaggctcttagatggtttctcctcctcaacagagcagctcaatccctacctcgcggctagcgggtgggataagagacccaactccaaaccgatggccctctatagcctggaatccattaaaatgacttttattgacctaagcaataagatgcccagccttctgtttggcagcgagatatttccagtgagctttcatgtgaagagcagcagcagtgattgcactacagaatctagtaggacgttccccgaacattgtgccccagctaggctcgcactgggagaggccctgcagtgtcccagtcagcctcctaagtggactttcagcttcttcctcagtcatggctgccccggcatggctaccttcagggaggacactggagtacactcccagacccacacacaggccccccctcagcccccagctccactgcaagactatggggggactgctattgtgcaaacaagggcagactgtagcgtgctcggccttcacacgctgctcgctctctgctcacccggctgttatcgaatctggacaaagaagcgctctttttcctcacacatgcccacgatgcagcgtctgttcatgactcagttcacacagggacttaaaggactgcggtcacccgcctccatcgccgacaaggtgttctgttcgctcccttactccgtaggacgcgtactctccatttggtcacagcacggccccagcgtatgctcctttgagattagctccctccattcaccgcattgcaaacgtcagccgtcgctgggcaccacaagtagccatacaatgcttccatatgtgccactgccaggtatggaggctacatacaacacctcgggctcacagactcgcctcgaaccgccatttcctgctcttgttcccaaatcatgccttgtggccgaaagcgccgtgagcaagttgctgctctctgcttccgagttccaggtgcgcggccttgatgaacttgatggggtgaaagcagcttgcccatgtcctcagagtagtcctccggagcagaaagaagctgagccggaaaagaggcctaaaaaagtcagtcagatcaggatccggaaaactatcccacggccggaccccaatctgacccctatgggactgccccggcccaagcgtctgaaaaagaaagagtttagcttagaggagatatacactaacaaaaactataagtctcctccggcgaatcgatgccttgaaactatattcgaggaacctaaagagcgcaatggcacactcatatccatcagccagcagaaacggaagcgcgtgttggaatttcaggatttcaccgtccctcggaagaggagagcccggggcaaagtaaaagtggccgggtccttcacccgggcccagaaagccgccgttcagagccgagagctggacgccctgttaatccagaaactcatggagctcgagacattcttcgcgaaggaggaagagcaggagcaatcatcgggatgctag

SEQ ID NO: 49775 - DNA, 390 bp, Artificial Sequence
  Description of Artificial Sequence: Synthetic coding sequence
atggccgacagcggcgacgccggcagcagcggcccctggtggaagtcacttactaactcgaggaaaaaaagcaaggaagctgcggtaggcgtgcctccacctgcacagccagccccgggcgaacctactccccccgcaccaccgtcacccgactggacaagcagtagtcgagaaaaccagcaccccaatctcctgggcggcgcgggagaacccccaaaaccagataagctgtacggcgataagagcggctcttcaaggcgtaacctgaagatctctcggtctggaagatttaaagagaaaagaaaggtgagggccacgctcctcccagaggctggcaggagtccggaggaagccggatttcctggtgaccctcacgaagacaaacaatag

SEQ ID NO: 49776 - DNA, 57 bp, Artificial Sequence
  Description of Artificial Sequence: Synthetic coding sequence
atggccgacagcggcgacgccggcagcagcggcccctggtggaagtccctgacctag

SEQ ID NO: 49777 - DNA, 312 bp, Artificial Sequence
  Description of Artificial Sequence: Synthetic coding sequence
atgaccaccgagatcggctggtggaagctgaccttcctgcggaagaagaaatcgacgccgaaggtactctacgaaattcccgacacctatgcccagactgaaggcgatgccgaacctcccagaccggatgcaggcggacccaatagcgatttcaatacaaggctggagaaaatagttgataagtccacgaaaggcaagcacgtgaaagtgagtaactccggacggtttaaggaaaagaagaaggttcgcgccacacttgctgagaatcctaatctgtttgatgaccatgaggagggtcgaagttctaagtag

SEQ ID NO: 49778 - DNA, 846 bp, Artificial Sequence
  Description of Artificial Sequence: Synthetic coding sequence
atggcccagagcggcctgaccgccaccagcgccagccaggtgcaggccatcctgctcccccaaccggcttccgtccgccactacgcatgggtcgtggaccagatagatacactgaccagcgatctgcagctggaagatgaaatgaccgactccagtaagactgacactctgaactctagctcgagcggtacaaccgccagctcccttgagaaaataaaagtgcaggccaatgctcccctgataaaacccccagcccacccatctgccatcctgacggttctgcggaaacctaatccacccccgcctcccccccgcctgacaccggtcaaatgcgaggaccccaaaagggtggttccaacagccaaccccgtgaagacaaatgggacgttgcttaggaatggaggcttaccgggtggccctaacaagatacccaacggggatatctgctgcattcctaactccaacttggataaggcacccgtgcagctgctgatgcacagaccagagaaggatagatgtccgcaagcaggacctcgagagcgcgttaggttcaacgagaaggtacagtaccacggctactgccctgactgcgatactcgctacaacatcaaaaacagagaagtccacctgcactccgagcctgtccatccccctggtaaaattccccatcagggaccccccctgcccccaactccccatctacccccttttcctctggagaatggcggaatgggcatttctcattccaattcttttccaccaataaggcccgctaccgtgcctccccctacagcacccaagccacagaagactatactaaggaagtctactactacaactgtgtag

SEQ ID NO: 49779 - DNA, 915 bp, Artificial Sequence
  Description of Artificial Sequence: Synthetic coding sequence
atgagcgccaagagcaagggcaaccccagcagcagctgccccgccgaaggacctcccgctgcctctaagactaaagtgaaggagcagattaaaattattgtggaggacctagaactagtcctgggcgatctcaaggatgtcgctaaggaactgaaggaggttgttgaccagattgatactctcactagcgacctccagttagaggatgaaatgactgattccagtaagaccgacactctaaacagctcatcaagtggtactactgcctctagtctcgagaagataaaagtgcaggccaatgccccactcatcaagccacccgctcaccctagcgcaatcttaactgttctccggaaaccaaaccccccaccccccccacctaggctgacacccgtgaaatgcgaggatccgaaaagggttgtacccactgctaatccggtcaagactaatggtactctgctacggaatggaggacttccggggggcccgaacaagattcccaacggcgacatttgctgcattccaaattccaatctggacaaagctccagtgcagctactgatgcacaggcccgagaaagacagatgccctcaggctggccccagagaaagggtgcggttcaatgagaaagtgcagtaccatggctactgccctgactgcgacacgaggtacaatatcaagaatcgagaggtgcaccttcacagcgagccagtccatccccctggtaaaattcctcatcagggtccaccacttcctccaacccctcatctgccgccttttcctctggagaacgggggtatggggatctctcacagtaactccttcccgcctataaggcccgctacggtgccccccccaaccgctcctaagcctcaaaaaaccatcttacggaaatccaccacaactacagtctag

SEQ ID NO: 49780 - DNA, 705 bp, Artificial Sequence
  Description of Artificial Sequence: Synthetic coding sequence
atgaccgacagcagcaagaccgacaccctgaacagcagcagcagcgggacaacggctagcagcctggaaaaaatcaaagtgcaagccaatgcgccactgattaagcccccggctcatccctcggctatactgacagtactgcgcaaacccaacccgcctccacccccaccccgactgacacctgttaagtgcgaggaccctaaaagggtcgtccccaccgccaaccctgtgaagaccaatggcaccctgctccgtaacggtggacttcccggcggccctaacaagatccccaatggcgatatctgctgtatacccaatagcaacctcgataaggcccccgtccagctgttgatgcatagaccagagaaagaccgatgtccacaggccgggccccgggagcgcgttcgtttcaatgagaaggtccagtaccatggctattgtcctgactgtgataccagatacaatattaaaaatcgcgaagtgcatttgcactctgagcctgttcaccccccaggaaaaattccccatcagggaccacctcttcctcctacaccgcatttgccgccctttccactcgagaacggcgggatgggcatcagtcactccaatagttttccacctatccggccggctacagtcccacctccaaccgccccaaaaccacagaaaacaattctcaggaaaagcactaccactaccgtgtag

SEQ ID NO: 49781 - DNA, 705 bp, Artificial Sequence
  Description of Artificial Sequence: Synthetic coding sequence
atgaccgacagcagcaagaccgacaccctgaacagcagcagcagcggaacaacggcctcatctcttgagaagatcaaagtgcaagcaaacgcccctctgataaaaccgcccgctcacccgagtgcaattctgaccgtgcttcgtaaacccaacccaccacccccaccccccagactgacacccgttaaatgtgaggatcccaagagagtggtgccaacagccaatcccgtgaagacaaatggcacactgcttcgcaacgggggcttacccggaggaccaaataaaataccgaatggagatatttgctgtatccccaattcgaacctcgacaaggccccagtgcagctgctgatgcataggcctgagaaagatcgttgtcctcaggctggtcctcgagagagggtccgctttaacgaaaaagtccagtaccacggctactgccctgattgcgacacacggtataacattaagaatcgagaagttcacttacattccgagcctgttcacccacctggcaagattcctcaccaggggcctcctctgcccccaacgccccatctaccaccattccctctcgagaatgggggaatgggcatatcgcactccaactccttcccacctatccgccccgccactgtgccgccccccacagcccccaaaccacagaagactattctccggaagtccacgaccaccaccgtttag

SEQ ID NO: 49782 - DNA, 429 bp, Artificial Sequence
  Description of Artificial Sequence: Synthetic coding sequence
atgaccgacagcagcaagaccgacaccctgaacagcagcagcagcggcacaactgcaagctcactagaaaaaatcaaggtgcaggctaacgcaccccttatcaagccccctgcacatccctctgccatcctgacagtgctaaggaaacccaatcctcccccacccccccctaggctcaccccagtcaagtgcgaggacccaaaacgggtcgtgcccactgcaaaccctgttaagacaaatgggacactgcttcgcaatgggggcctccctggcggacctaacaaaattccaaatggcgacatctgttgcatccccaattctaacctggacaaggctcccgtgcaattgctcatgcaccgccctgagaaggaccgttgtcctcaggccggtccccgagagagagtgcggttcaacgagaaggttcagtag

SEQ ID NO: 49783 - DNA, 1071 bp, Artificial Sequence
  Description of Artificial Sequence: Synthetic coding sequence
atggacacccagggccccgtgagccagcccttccagcagcccgagaagcctgggcgcgttcggcgccgcaaaacccggcgtgagcgaaataaggcactggtgggatcccggcgccccctcgcacaccacgacccccctgtagctattcgcgatccacctgtcgtgccaacagcctccaaactggtggtgattacccagggcagactgtccagggagcacagaggcctcttcaaccacgaggtcaagtcactggatgtggcccgcttgttgtctagcggcacgctagtgccggggtctccaacgctccccgccaagccaagtccatcacccggcagggcccaagaacctgcgcccagaagcagggacaaagaaaatcaggtcccaggcggaagcggcccaggacctccaagcagcccagaactgagtggcgtaggacagctactcgctgaactccagtgtcagctttccctgccccaggcatttccccggcgtaacctcatccaggatgcgagggacgcaattgttcataccctgcaggcttgtcacgggtgcgtgccggacctagccctggtcctgcggggttgtcagccacctcttccaggtgccaagccaggggtaagtgaacgaaagatgacgcccttttggatcaactcacccgatcaggtgcctgagcaggagcgccaacggaaacagcaaggtacgaaagaatttaccttcccaatgccgtataccagctccatgcccacagcgcaccgcggttccctcgcgcctccgcgggggccttggcctccgtatttcccatcacttagttccccaagcggcaccgcctggggcccccctacggcgtttgaccttctgaagtcaatatggctcgtggccacccctcccccccctcgcccctggggcgttggtttgccacaacctctgccccagccaagcagcccgctgcttccccggaccagcgtgttggactggagccccagcccaccgtcgcctctcccctccctgtcctgggttgtggctcagtccagtccagaagcttggtcctttcccccgatgcggttatattag

SEQ ID NO: 49784 - DNA, 1071 bp, Artificial Sequence
  Description of Artificial Sequence: Synthetic coding sequence
atggacacccagggccccgtgagccagcccttccagcagcccgagaaaccaggcagggtccggcggagaaaaacccggcgggagcgaaacaaagcattggtgggaagtcgtcgccccctcgcacaccacgaccctcccgtggccattagggatcccccggtggtgcccactgcaagcaagctggtggttatcacccagggacgcctgtcaagggagcaccgagggctgtttaaccatgaagtgaagtccctggatgtcgcacgcttactcagttcaggaacactggtccccggctctcccaccctccctgcgaaaccaagcccatctcctgggagagcccaggagcctgctccccgaagcagggacaaggaaaatcaggtgcccgggggcagcgggcccggacctccgtcatcacccgaactgagcggagttggccagcttctggccgagctccagtgccaactatccctgccccaagcctttcctaggaggaatctcattcaggatgcccgagacgcgattgtgcacaccctgcaggcttgccacggttgtgtgcccgacctggctctggtcctacgagggtgccagcctcctctgccaggggcaaagccaggggtgagtgaacgaaaaatgacccctttctggatcaattcgcctgaccaggtacctgagcaggaacgtcaacgaaaacagcaggggacaaaggaattcacgtttccgatgccatatacctcatctatgccaaccgcacatcgtggatccctcgctcctccaagaggaccatggcctccatactttccaagtctttcttccccttccgggaccgcttggggacctcccaccgcatttgacctgctcaagagcatctggctggtcgcgacgccacctcccccccgcccctggggcgttgggttaccacagccactcccccagccttcatcccctttactacccaggacatccgtcctagactggtctcctagtccaccctcgccacttccttccctctcttgggtggtcgcccagagctctcccgaagcatggagctttccaccaatgcgcctctactag

SEQ ID NO: 49785 - DNA, 666 bp, Artificial Sequence
  Description of Artificial Sequence: Synthetic coding sequence
atggaggagccccggcccagcaagcggctgcggagcatggcccccaaccaggcctccggggggccaccaccagaaccggggtgctgtgtagcggaccctgagggatccgttgaagcagatggtccagctcaaccagctcagccagccaaaccgatcgcctacgttaagccttttaggcggcagccccccgcgcggccagaaagtccaccccccgccgagaggggccgccgacgaggcggcagtagacgacctggtagaggcaggggaagacgagctgggccccgaggcgatgctgggcagcggcagggagcagaaggcttaatggctcctgacgttcatattcagctggaccaccatggcgagccggggcaccagggcgaacctgagatcactgaaacagcggctttttctttaagcgagaccggccctccccctggaactgttcaggaggggcctgggcctgacgtggcccagcccgaactagggttccaggagccccctgcagctcccgggcctcaggccgtggattggcaacctgtgttgaccttgtacccctgtataggtttccgcgcgctcggcgatagtgccgtccttcaggtgatccaaacaccacagggcacctacgtgcaaggagtccccgtgttcctgaccgatattgcatactag

SEQ ID NO: 49786 - DNA, 666 bp, Artificial Sequence
  Description of Artificial Sequence: Synthetic coding sequence
atggaggagccccggcccagcaagcggctgcggagcatggcccccaaccaagctagcggcggacctccgccagagccgggatgttgtgttgctgatccagaggggagtgtggaagccgatggccctgcccagccagcccagcctgctaaaccgattgcctacgtgaaacccttcagacgccagcccccggctcggcccgagtctcctccaccagccgagagagggcgccgccgcggcggaagtagacgtccgggccgcggtcgaggacgtcgggctggacctcggggcgacgccgggcaaaggcagggagcggagggacttatggcacccgacgtgcacatccagctggaccaccatggagaaccaggccaccaaggagagcccgagatcactgaaaccgccgcattctccctgagtgaaaccggtcctccgcccgggacggtccaggaaggacccgggcctgacgtggctcagcctgagctcgggtttcaggaaccaccagccgctcccggaccacaggccgttgactggcagcccgtcctcaccttgtatccatgtatcggttttcgggctctgggcgactctgccgttctccaggttatccagacgccgcaggggacctacgtgcagggcgtgcccgttttcctgaccgatatcgcttattag

SEQ ID NO: 49787 - DNA, 666 bp, Artificial Sequence
  Description of Artificial Sequence: Synthetic coding sequence
atggaggagccccggcccagcaagcggctgcggagcatggcccccaatcaagcgtcgggcggaccccctcctgagccaggctgttgcgttgccgaccctgaggggagcgttgaagctgatggtccagcccagcccgcccagcctgccaagcccattgcatacgtgaaaccctttcggcgacagcctccagctagacctgagtcccccccgccagcagagcgtggcagacgacgcggcgggtccaggaggccgggtagggggagggggagacgggcgggtcctaggggtgatgcaggccagagacagggagctgagggcctcatggcgcctgatgtgcacatacagttggaccaccatggggaacccggtcatcagggggagcctgagattaccgaaactgccgcattcagtctcagcgaaacaggcccacccccgggcaccgtgcaggaggggccgggcccagatgtggcccaacccgaattgggctttcaggaaccaccggcagctcccggcccgcaagccgtggactggcagcccgtgctgactttatacccttgcatcgggtttagggccctgggggatagtgccgtgctccaagtaatacagaccccccagggaacatatgtgcaaggcgtcccagttttcctgacagatattgcctattag

SEQ ID NO: 49788 - DNA, 666 bp, Artificial Sequence
  Description of Artificial Sequence: Synthetic coding sequence
atggaggagccccggcccagcaagcggctgcggagcatggcccccaatcaggccagtgggggcccacccccggaaccagggtgctgcgtggctgatcctgagggctccgtcgaggctgacggacctgcccaacccgctcagcccgctaaacccattgcttacgtgaaaccgttccggaggcaacctccagctcgcccagagtccccacccccggctgaacgaggtagacgtcggggggggagcaggcggcctgggcggggacgcggacgacgggcgggaccaaggggcgatgccgggcaacggcaaggagccgaaggtctaatggctcccgacgtgcatattcaactcgatcatcacggggaaccaggtcatcagggagagcccgaaataacagagactgctgcattctcattgtctgaaacaggtcctccgcctgggactgtgcaggaaggacccgggccggatgtggctcagcctgagctgggattccaggaacctcctgccgcaccaggtccgcaggcagtggactggcagcccgtgctcaccctatacccttgcattggcttccgggctctgggcgactctgccgtgctgcaggtgatccagacccctcaagggacttatgtgcaaggtgtacccgtgtttctaacagacatcgcatattag

SEQ ID NO: 49789 - DNA, 666 bp, Artificial Sequence
  Description of Artificial Sequence: Synthetic coding sequence
atggaggagccccggcccagcaagcggctgcggagcatggcccccaatcaggcaagcggcggacctccaccggaaccaggatgctgtgtcgccgatccagagggttcagtcgaagccgacggccctgcccagcctgcccaaccagcaaaacctattgcgtacgtcaaaccattcaggcggcagccacctgctcgccccgagtcaccgccacccgccgagcgaggcagaagaagaggcggaagcagacggccaggcagggggcgcggtcggcgggccggcccacgcggagatgcagggcaaagacagggagccgaggggcttatggccccagacgttcatatccaattagaccaccatggagagccagggcaccagggtgaaccagaaatcaccgagacagcggcgtttagcttgagcgagaccggtcctccacccggaacagtgcaggaggggcccggccccgatgtggctcagcctgaactgggattccaggagcctcccgccgcgcctgggccccaggcggttgattggcagcccgtcctgactctgtatccctgcattggtttccgagccctgggggattccgccgtgctacaagttattcagacaccccagggaacatatgtgcagggcgttcccgtgttcctcacagacattgcttattag

SEQ ID NO: 49790 - DNA, 666 bp, Artificial Sequence
  Description of Artificial Sequence: Synthetic coding sequence
atggaggagccccggcccagcaagcggctgcggagcatggcccccaatcaggcctctggtggaccaccccctgagccaggatgctgtgtggccgacccagagggctccgtcgaggctgacggccctgctcaacccgctcagcccgccaaaccaattgcctacgtaaaaccatttcggcgccagccgccggcccgccccgagagcccccctcctgccgaacgaggcagaagacggggggggtcccgccgcccaggccgaggccgcggccgccgggccggaccacgcggagacgccggtcagcgccagggcgcagaaggccttatggcccctgatgtgcacatccagttggaccatcacggggaacccggccatcagggagaaccagagatcaccgagacagcggccttttccctatctgaaacagggcctccaccaggaacagtgcaagaggggccagggcctgatgtcgcccaaccagagttagggttccaggaaccccccgccgcccctggccctcaggccgtcgactggcagccagtactcacgttgtacccttgtattgggttccgagccttaggtgacagcgcagttctgcaggtgattcagaccccgcagggcacttacgttcagggcgtgcccgtatttctgaccgatatcgcatattag

SEQ ID NO: 49791 - DNA, 666 bp, Artificial Sequence
  Description of Artificial Sequence: Synthetic coding sequence
atggaggagccccggcccagcaagcggctgcggagcatggcccccaaccaagcaagtggcgggccaccaccggagcctggttgttgtgtggcggacccagagggctctgtggaagctgacggccctgcacagcccgcccagccagctaagcccattgcttacgttaagccatttcggcgccagccacccgcacgtccggaatctcctcctcctgcggaacgcggaaggcgcaggggtgggtctcggcgccctgggcggggacggggccgccgggcagggcctaggggagatgctgggcagcggcagggtgcggaggggttgatggcccccgacgttcatattcagttagatcatcacggcgaaccaggtcatcaaggcgagcccgagattacagagactgccgcattttccttgagcgagaccgggccaccccccggcaccgtgcaggaaggccccggccccgacgtggcacagccagagctgggtttccaggagccaccagcggctcccggaccccaggccgtggactggcagccggtgctcaccctttacccttgtatcggatttagagccttgggtgactcagccgtgctccaggtgattcagactcctcagggaacctacgttcagggagtccccgtctttttaaccgatattgcctactag

SEQ ID NO: 49792 - DNA, 666 bp, Artificial Sequence
  Description of Artificial Sequence: Synthetic coding sequence
atggaggagccccggcccagcaagcggctgcggagcatggcccccaaccaggccagtggaggccctccgccagagccaggatgttgcgtggcagacccagaaggctctgttgaagccgacggtcccgcacagccagctcagccggcaaaaccaattgcgtatgtcaaaccattccggcggcagcctccggcaagaccagagtcccctcccccagccgagagaggtcgaagacgcggtggcagccggagaccaggacggggcagggggagacgagccggcccacgcggggatgccgggcagcgccagggtgccgagggcctaatggcgcctgacgtacacatccagttagatcaccacggcgagcctggtcaccagggagagcccgaaatcactgaaaccgccgcctttagtttaagtgaaaccggacctccgcctggtacggtacaggagggcccaggtcccgatgtagcccagcccgaactggggttccaggagcctcccgctgcccccgggccacaggcagttgactggcagccagtgctcacgctttatccttgcatcggcttccgagcactgggggattctgcggtgctccaggtgatacaaaccccacaggggacatatgtccagggcgtgccagtgttccttaccgacattgcttattag

SEQ ID NO: 49793 - DNA, 666 bp, Artificial Sequence
  Description of Artificial Sequence: Synthetic coding sequence
atggaggagccccggcccagcaagcggctgcggagcatggcccccaaccaggccagtggcggtcctcctcccgagccaggatgctgcgtagccgacccagaaggctctgtcgaagccgacggccccgcccagcccgctcagccagctaaacccatcgcatatgtgaagcccttccgacggcaaccaccggccagaccagaaagccccccccccgccgaaaggggacgccgtcgtggcggatcgagacgtcccgggagaggccggggcagaagggcaggccctagaggagatgccggccaaagacaaggtgccgagggtctcatggcccccgacgtgcacattcagttggaccaccatggggagccgggacaccagggagaacccgagatcacggaaacggccgccttctctctgagtgagaccggaccgcctcctggtacggttcaggaaggcccaggccccgacgtggcccagccagagctgggttttcaggaaccaccagcggcacctggcccccaggcagtcgactggcaacctgtgttgactctttacccttgcataggattcagagccctgggtgacagcgccgtgctacaggtaatccagacacctcagggcacctatgttcagggggtgcccgtgtttcttactgatatcgcctactag

SEQ ID NO: 49794 - DNA, 1170 bp, Artificial Sequence
  Description of Artificial Sequence: Synthetic coding sequence
atgcacgcctgcagcagcaccgccctgcacccccggcccttcatccacgggtttagtttcacaacgttcttgcaacaactgtttccccatgggtccagcactgcgctccacccatggccattcatacacggctcctcccccatggctttgcaccctcgtctgttcactcacggccccagcagtacggctctccatccgtgtcctttcacacatggatcctctccaatgagcttacatccacgcctgtttacacactcaccatcctctatgcccctccacccccgccccttcgtacacgcttcatcccccactgccctgcgaccatgtcttttcacccatggaccttccagcatgcccctacacccccggccttttgtgcacgccagtagccctaccgccctccccccatgcctcttcactcacggccccagctcgatgcccctgcacccgcggccattcttgcacgcttcctccccaaccgctcttcctccctgtctgtttacccacgggccctcatcaatgcctttacatcctcgcccgtttgttcacgcttcaagccctactgccctaagaccctgcctgtttacccacggaccgagctcaatgcctcttcacccacgcccattcgtgcacgcatctagcccaaccgcgcttccaccttgcctcttcactcacgggccgtcatccatgccgctgcacccccggcctttcgttcacgcttctagccccactgccctcagaccctgtctctttactcatgggccttcaagtatgccactgcatccaaggccctttctccacgctagctccccaaccgccctccgtccgtgcctgtttacacatggcccatcctctatgccattacatccacggccttttgttcacgcaagttcccccactgcactgaggccgtgtcttttcacccatggacccagctcaatgccgctgcatcccagaccattcgtgcatgccagttcctccacttcgctccatccgcggccgtttatccacgcgtcatcttctaagagcctgcacttgcgcctgttctcccactcgagctgtcttgtcggttttagccaacaggggaacgtcctgctcttgtccgcaagggccaccttcaacacatgcttgctagtttctaacatgtacttcctgatcatctcatactag

SEQ ID NO: 49795 - DNA, 1170 bp, Artificial Sequence
  Description of Artificial Sequence: Synthetic coding sequence
atgcacgcctgcagcagcaccgccctgcacccccggcccttcatccatgggttcagctttactactttcctgcaacaactgtttcctcatggctctagtacagctctgcacccatggccattcatacacgggtctagcccaatggcccttcaccccaggctgtttacccacgggccatcgtctacggcactgcacccatgcccatttacgcacgggtctagtccgatgtccttgcacccgaggttgttcactcactctccctcttcgatgccgctccatccgagaccgttcgtgcacgcatccagccctacggcgcttaggccctgtctgttcacccatggaccatctagcatgcctttgcaccccagaccatttgttcatgcttcatccccaaccgcactgcccccgtgtctgttcacccatggtccaagcagtatgcctctgcatcccagaccttttctacatgcaagtagtccgactgccttgccaccatgtctgtttactcacgggccgagttccatgcccctgcaccctaggccgttcgtacatgcgtcgtctcccactgccctcaggccttgtctgttcactcacggaccctcgtcaatgccactccacccaagacccttcgtccatgcatcctcccccactgccctgcccccatgtctgtttacccacgggcccagttcaatgccactgcacccccggcccttcgttcatgcttcctccccaactgccctgaggccttgtctcttcacccacggaccttcaagcatgccactgcacccccgaccttttcttcacgcttctagcccaacggctctgaggccctgtctttttacgcacggcccttcatctatgccactgcaccccaggccatttgtgcacgcgagttcgcctaccgctctccggccttgtttgttcacccatggtccctcgtccatgcctctccaccctcgcccttttgttcatgcttcttcgtcaacgtctctgcacccgaggcccttcattcatgcctcaagctccaaaagcttacatcttcgactcttctcccattcttcatgcttagtcgggttctcacaacaagggaatgtgctgctgctcagcgcccgggccacattcaatacttgccttctcgtgagcaatatgtacttcctcattattagttactag

SEQ ID NO: 49796 - DNA, 1269 bp, Artificial Sequence
  Description of Artificial Sequence: Synthetic coding sequence
atgcagcaccccaagcccttctgcgcccccgccgccccccaggagggcttcagtccccagtccttggaaggggccgaagttctgggcaatcagcctgcccccacatgtgcagagcccccaccagccatggggtccttgaatctctatcatccacccgatccggagaaggaggtattcccggccccacctgccgggttccaaatggcaccatgtgggtgtttctttgacccacgaatctaccggatcgagtggacaactcctgatcttggccagtcagcattgtataagctggcagcctcatctggggggcccgccggagtcccatccgctccaggatcctatttgctggagccccaaccgtaccttaaggcaccgggactgccgccatatccccattaccagcaggcccccggcggacctcaatttctcctgccttactttccaccagaggggccagggccggaggcactgggctttgtgggagacgccggcccagccgcatttgtggaacttcccctgcctccgctggaggaaggtccagctcccctgcctcctccaccacctaaggaaaacaagccccctcctgtattaataaccctgcctgctgaacctaccctgccacccgatgcctattcgcacctccagggccaccttggacacttccccggcccggagcctctggccttcccagtaaaagaactgcaggggtccggcgcccgtcccggggtaccgctgtatccccccggactgtccgagctgaaggttgctgaggtgaaagagggggcgttactgggcgcgggaaaggctaaagctcccaaaacagcacgggctctggccctaccagataaagtcttgctggaagatgccatgaaattgtttgattgcctccccggagcctctgagcctgaaggaacactgtgcgaggtgcccggtcctgcccttcccgactcttcaggaggcaatagtgccgatgacattcgtagcctgtgtttgcctgaggagctgttgagcttcgactattctgtgcccgaaatactagataccgtgtctaacgttgactacttcttcaattttaaagcactcgacgaagaacagccccctcacccagggcctcctgcaaccaatactcccgcccccatcctgtcagggaagcgcaaggctagcacagccaaaaagggaaagccaggtaggaaggcgcgacagcccgcgggcccggcttcagcaactccacctggcccaagggaggatctgggcgctaccccacattag

SEQ ID NO: 49797 - DNA, 801 bp, Artificial Sequence
  Description of Artificial Sequence: Synthetic coding sequence
atgggcagccggccccggagccccagcgccttccccgccccctggtggggtcagcagcccggtggcccggggcccgctaagaggctccggcttgaggagcccgcgggacctgaaccccgcgtggccccatccctggaggatcctgctggcacccccgccgtcggagctctgacaagtattgtggttctcgcagccggctgcgccctgcgcgtcccactcgacgatgtcgatctggtgctcgaactgccaccaacttccatccttagagtaagtctggacggccatacactgattctcatcccggaggtgctgttgagctcagtggatgaaaggagcggcgcacaggacgattcatcagccgggctagaggtcgatgtgttcttaggggcgctccgggaggacgttgttgtcgagcaggaggtgttttgcgcatcagtgcctgagatcgccgcccaggaggaggcatatgaggaagatgccgacccagagttcccagagttgcagatggattcggcagctggctcggcggcaggcctctactcctccgcccgatccatgtttagcccttacagagagggtcccatcccagagccttgcgcactggccccaaatccctctagtgaaggccactcgccaggacccttcttcgatcccgaattccgcttgctcgaaccagtgccatccagcccgctccaacccttgccccctagccctcgggtgggttccccaggaccacacgcacatccaccgctgccaaaaaggcctccttgcaaggcgcgcaggcgactgtttcaggagtag

SEQ ID NO: 49798 - DNA, 798 bp, Artificial Sequence
  Description of Artificial Sequence: Synthetic coding sequence
atggtgagccggccccggagccccagcgccttccccgccccctggtggggtcagcagccaggcggcccaggtcccgccaaacgattgagacttgaggagccagccggccctgagcccagagccgcgcccagtctggaggacccagccggcgatccagctgtggatgctctaacgagcatcgtcgtgctggcagctgggtgtgcgctacgggttcctctggatgatgtggacttggtcttggagccagcccctacttccatattgagggtaagcctggggggtcatactctgatcctcatacccgaagtattactgtcgagcgtcgatgagaggtcaggggcgcagcatgactcttccgctggcctcgaggtggatgtgtttcttggtgctgtaagagaagacgtagtcgtggaactggaattttgtgcatcagtccccgaaatcgcagcccaggaggaggcttacgaggaagacgctgatcctgagtttccagaactacggatggattccccaactgggtctgctgcaggcctgtatcccagttcacgctcaatgttcattccttacagggaggggccaatcccagagccatgcgctctggcccccaatccttcgagtgaacggcgctcgcctcgacccattttcgacttagaattcagactcttggaacctgtgccttccagtcccttgcaaccactccctccatcaccatgtgtcgggagtccaggtcctcacgctcgcagccccctgccagaaagacccccttgtaaggcgaggaggcgcctctttcaggcctag

SEQ ID NO: 49799 - DNA, 789 bp, Artificial Sequence
  Description of Artificial Sequence: Synthetic coding sequence
atgggcagccggccctgcagccccagcgcctgcctggccccctggtgggggcagcagcctgggggaccaggtccggcaaaacgaagtaggctggaggagcccgctggccccgaatctagggcagcaccatcccctgaagacccggccggcactccggccgtggatgcactcacatccatggtggtcctggacgcaggatgtgctctgcgtgtgccactggaagacgtcgacttggtgctcgaacttgcgccgatgtctgtactgcgagtctccctaggtggtcacaccctgatagtgattcctgaggtgttgctgagtagtgtggacgagtgttcgggcgcccagggtgactggagcgctggtctcgaagttgatgtatttctgggtgctcacggtgaagacgtcgtggttgagcaagaagtgtgtgcttccgtgcccgagattgctgcagaggaggaggcgtatgaggaggacgcggattctgaattccccgaactttggatggacagtgccgctggaagcgcagctggtctctacccttctgcacggagcatgttctcaccataccgtgaggggccaattagaggaccatgcgcccttgcgcctaacccgagcagcgagcgaagaagccctcgtcctattttcgatctcgagttccacttgttggaaccagtgccttctagccctctgcagccccttcccccctcccccagtccaggtccccacgccagacctgagctccctgagcgccctccctgcaaggttcgccgccggctgttccaagagtag

SEQ ID NO: 49800 - DNA, 789 bp, Artificial Sequence
  Description of Artificial Sequence: Synthetic coding sequence
atgggcagccggccctgcagccccagcgcctgcctggccccctggtggggacaacaacctggcggacctggccccgccaaacggtcccgactcgaggagcctgccgggcccgaatcccgcgccgcacccagtccagaggaccccgccggaacacccgccgtggacgccttaaccagtatggtggtcctggacgctgggtgtgcactgagagtccccctagaagacgtggaccttgtgctggaacttgctcccatgagcgtactccgcgtgtcccttggtgggcataccctcatcgtgatccctgaagtgctgttatcttcggtggatgaatgctctggggcacagggggattggtccgctggattggaagtcgacgtgtttctgggcgcacatggagaagacgtagttgtcgaacaggaagtgtgtgcgtctgtccccgagatcgccgccgaggaggaggcttacgaggaggatgcggactctgagtttcctgaattatggatggacagtgcagccggatcagccgcagggctgtaccctagcgctcggagcatgttcagcccttaccgcgagggccctatcagaggcccctgcgctctcgcacccaatcctagttctgaacgcaggtccccaaggcccatattcgatctggaattccacctgctcgaacctgtgccctcctcgccccttcaaccacttccaccaagtccttcaccaggccctcatgctagacccgagctacctgaaagacccccctgtaaagtcagaagaagactgtttcaagaatag

SEQ ID NO: 49801 - DNA, 429 bp, Artificial Sequence
  Description of Artificial Sequence: Synthetic coding sequence
atgcggggcaccagctgcgtgggcggcggcgccgagagccccggcggtgccggcctgagtgaaggccctcgaggaaggtggctccggcttgctccagtgtgtgcttatttcttgtgtgtgagcttggcggcggtgctcctcgcggtatactacggtctgatctgggtaccaacacggagcccggccgctcctgccggaccccagccttcagctcctagccctccttgcgctgcacggccaggcgttccaccagtgcctgccccagcagcagcatctttatcctgtcttcttggggttcccggcgggcccagaccacaacttcaactccctctctcccgcaggcgcagatactctgacccagaccgcaggccgtcccgccaaacaccgagggagactcctgaagctgctgaaggccgccgacccgggtag

SEQ ID NO: 49802 - DNA, 1209 bp, Artificial Sequence
  Description of Artificial Sequence: Synthetic coding sequence
atggcccggaccgaccagaagcccccctgccggggcggctgctggggacagccagggcatcccaacaccggaggcgcggcagcccatcccacctatcatcctatgggccacaggccacgaacctgtattctgttgcggggggatcaaacaacggggggccaggcgccgtcacgggagatctcactaggaccttgggccgccggcacacattttctggccatctcaacaacaccatgggggcggaagacaccagcctgtatctcggaattgccaacctcaagcggaacagcacagcctttggcgaatgcggtgtgcgaggtacaaaccgtgcccggtcccggcttgcgcccgcaaggcactccagccatgagggctccgtcccacaaaggcacccctcctaccccgaatccctggggcccggagcagcctcagaaccggcataagcaccctaagaaaggggtaacaggcggccccagccctcctccacctgccgcaagcaggtacggccagacccctggccgcgagcctcgggtacaggctcccgggctgggcccttgcggtagacctgcttctggcagacttctgtccttgcaccttgagaagggagacggtaagggaacgcgccagcggattcccttgactgacgcggcagtaggaggggaccgtaccgacatcccttcagccatagccgccgggcccgccagaacaccagaccgccacggtcttccaattccgggcagcaccccgacccctatggtgggaagcggccggctgggtgcgcctgttggtagaagcggcgggggagcctcggcccggtccagtagacccagctgtgccaatgtccttcttcgagccgatgcttctctgggcacagtactttccgtgctgtggacaggccagctgtccagaggctgggcccttcttcctccaggagatgccgggcggcacttagaaacatctgtaatatctgccggcgtggccgctgggatctggttggtagagcctggcgaggcagcccaggacccggccacacgccgcacggctccacctagacgtacagcctcgcccgaacctcccgcccccggtgcccctctgcccgcttgccccggacgcatcccaggggccgcccgctttggaccgcggtcttgcccactcgggtcgccagctgtattggcagtgaccacgggctggagccatcggagtgtgtag

SEQ ID NO: 49803 - DNA, 351 bp, Artificial Sequence
  Description of Artificial Sequence: Synthetic coding sequence
atgagcttcagcgagcagcagtgcaagcagccctgcgtgccccccccttgcctgcccaaaacccaagaacagtgccaagccaaggccgaggaagtgtgcctgcccacctgtcagcatccctgtcaggacaagtgcttggtgcaggcacaggaagtgtgcctgtcacagtgtcaggagtcaagccaagagaagtgtccacagcagggccaagagccgtatcttcctccctgccaggatcagtgcccaccccagtgtgcggagccctgccaagaactgtttcagaccaagtgtgtcgaagtgtgcccccagaaagtgcaggaaaagtgttcgtcccccggaaaaggtaagtag

SEQ ID NO: 49804 - DNA, 657 bp, Artificial Sequence
  Description of Artificial Sequence: Synthetic coding sequence
atgggccgggtgttcctgaccggcgagaaggccaacagcatcctgaaaaggtatccccgggccaatggtttctttgaggagatccgccagggaaacattgaacgagaatgtaaagaagagttttgtacattcgaagaagccagagaggctttcgagaacaatgaaaaaactaaggaattttggagcacatatacaaaggctcagcaaggtgagtccaaccgcgggtctgactggtttcagttttacttaacctttccccttattttcggcctgttcattatcctgctggttattttcctaatctggcggtgtttcctgaggaataagacacggcgccagacggtgaccgaggggcacatcccctttccacagcacctgaatattatcacaccgcccccacctcccgatgaagtgttcgactccagcgggctctcacccggtttcttgggttatgttgtgggcagaagcgacagcgtgtcgacaaggttgtctaattgcgaccccccccccacttacgaggaagccacaggccaagtcaatctccagcggtcagagaccgagcctcatctggacccgcctcccgagtacgaagatatcgtgaactccaacagtgcttctgccattcctatggtacctgtggttacaacgatcaagtag

SEQ ID NO: 49805 - DNA, 657 bp, Artificial Sequence
  Description of Artificial Sequence: Synthetic coding sequence
atgggccgggtgttcctgaccggcgagaaggccaacagcatcctgaagcggtatcctagagcaaatggtttcttcgaggagatacggcagggaaatattgaacgcgaatgcaaggaggagttctgcacctttgaagaggcccgtgaggcgttcgaaaataacgagaagaccaaggaattctggtcaacatacactaaggctcagcaaggcgagtctaaccgaggatccgactggtttcaattctacttgacatttcctttgatcttcggcctcttcatcattctgctggtaatctttcttatctggaggtgctttctgcggaataagactcgtaggcagacggtgaccgagggccatattccttttccacagcacctaaatattattacccctcctcctccacccgacgaggtcttcgattcttcgggtcttagccctggattcttgggttatgtcgtcggcagatcggattcggtgagcacacgcttatcaaactgtgatcccccgccaacttatgaagaggctaccggacaggtaaatctccagagaagtgaaaccgaacctcacctggaccctcctcccgagtacgaggatatcgtcaacagtaattcagcctctgctattcccatggttccagtggttaccaccatcaagtag

SEQ ID NO: 49806 - DNA, 657 bp, Artificial Sequence
  Description of Artificial Sequence: Synthetic coding sequence
atgggccgggtgttcctgaccggcgagaaggccaacagcatcctgaagaggtatcctcgcgccaacgggtttttcgaggagattcgacagggtaatatcgaacgggaatgcaaggaggagttctgcacgtttgaggaggctcgtgaagccttcgagaataacgaaaaaaccaaagagttctggtcaacctatacaaaggcccaacagggggaaagcaaccgaggatctgactggttccagttctacttaactttcccattgatttttggattgttcattattctgctcgtcatattcctaatatggagatgctttttaagaaacaagacacgccggcagacagttacggagggacacatccccttcccccagcacctgaatatcattactccaccacccccccccgacgaggtgtttgatagcagcgggctttctcctggcttccttgggtatgtggtcggtaggtccgatagcgtaagcactcgactgtcaaactgtgatccacccccaacgtacgaggaggccaccggtcaggtcaatctccagagatctgagacggagccccatctcgacccacctccagaatatgaagacatcgttaacagtaattcagcctcagctatcccaatggtgccagtcgtgaccacgatcaagtag

SEQ ID NO: 49807 - DNA, 657 bp, Artificial Sequence
  Description of Artificial Sequence: Synthetic coding sequence
atgggccgggtgttcctgaccggcgagaaggccaacagcatcctgaagaggtacccaagagcgaatggcttcttcgaagaaatccgacagggaaacatcgagagagaatgcaaggaagaattctgtacctttgaagaggcaagggaggcatttgagaacaatgagaaaaccaaggagttttggtcaacctacaccaaagctcagcagggggagtctaaccggggtagtgattggtttcagttctacctcacatttccgttgattttcggcctcttcataattctgctcgtcatcttcctcatatggcgctgcttcttgagaaataagactaggaggcagactgtgaccgaaggtcatatacccttcccccagcatctgaatattattacaccacccccacctccagacgaggtgttcgacagctctggcctgtcacctgggttcctcggctatgtggtcggtcggagcgatagcgtctccacacgcctttccaactgtgatccaccaccaacgtatgaggaggcgacaggtcaggtgaatcttcaacgcagcgagacagaacctcatctagaccctccacccgagtatgaggatattgtcaacagcaacagcgcatctgccatcccaatggtcccagtcgtaaccaccatcaaatag

SEQ ID NO: 49808 - DNA, 249 bp, Artificial Sequence
  Description of Artificial Sequence: Synthetic coding sequence
atggaccccggccccaagggccactgccactgcggcggccacggccatccacccggccattgcgggcccccacctggtcacgggcctgggccttgcggaccccctccccaccatggcccgggcccttgtgggccgccacctggacacgggcctggcccctgcggcccaccaccacaccatggacctggcccctgcgggccacctcctgggcatggccccgggcatcccccccccgggccccaccactag

SEQ ID NO: 49809 - DNA, 246 bp, Artificial Sequence
  Description of Artificial Sequence: Synthetic coding sequence
atggaccccggcaagggccactgccactgcggcggccacggccaccctccagggcactgcggccccccccctggccacggacccggaccatgtggcccgcctcctcaccatgggcccgggccatgtgggcctcctcctggtcacggcccgggtccttgtgggcctccgccgcaccacggacctgggccctgtggacctcccccgggccatgggccgggccacccgccaccaggccctcatcactag

SEQ ID NO: 49810 - DNA, 537 bp, Artificial Sequence
  Description of Artificial Sequence: Synthetic coding sequence
tgacggagccaggtgtacatgcaccccagcctgagcccccccagcacaatgatcttgagtgggggtacggctctcaagcctccctacagtgccttccccggtatgcaacccctcgaaatggtcaaaccacagagtggttctccataccaacccatgagtggaaatcaggccctagtgtatgagggacaactctcccaagcagccggactgggggctagtcagatgctcgactcacagctgccccaactgacgatgccactgccccgctacggatctggccagcaaccgctaattttgccccaaagcattcagctgccgcctggtcaatcattgtcagtgggcgccccccgacgcattcctcccccggggagtcagcctcctgtgctgaacacatccagagagccttctcagatggagatgaaggggttccactttgccgattctaagcagaacgtgcctagcggtggccctgtgccctctcctcaaacatacaggcaaaataacgaatggatgcggaatccagcctgggagccgtag

SEQ ID NO: 49811 - DNA, 6690 bp, Artificial Sequence
  Description of Artificial Sequence: Synthetic coding sequence
atgagcgaccggctgggccagatcaccaagggcaaggacggcaagagcaagtacagcaccctctctcttttcgataaatacaaggggaagtccgttgatgccatcaggagtagcgtaattcctaggcacggattacaaagtctcggaaaagtcgccgctgcccgcaggatgcctcctccagcaaacctaccatcattgaaaagcgagaacaaaggcaacgacccaaatatcgttatcgtgcccaaagacggcactgggtgggccaataaacaggaccaacaggacccaaaaagcagcagtgccaccgcgtcgcagccccctgagagcctgccacagccaggactccagaaatcagtcagcaaccttcagaagcccacccaatctatttcacaagaaaatacaaacagtgttcccggcggacccaagtcctgggcacagctgaatggtaagcctgttggccacgagggcgggctgagggggtcatcccgtctgctgtcattctcaccagaggagtttcccacactcaaggcagcgggcggccaagataaggccggcaaggagaaaggtgtactggatctctcttacggcccgggaccatccttacgaccacagaacgtaacatcctggagggagggagggggcagacacatcatctcagccacttccctgagcacctcacccaccgagttaggctcgcgcaactctagtaccggtgatggtgctccctccagcgcctgcactagtgacagcaaggacccctctctgcgccctgcgcaacccgtccggaagggtgctagtcagttcatgggcaacgtttaccaccctccaacttatcacgatatgctgcctgccttcatgtgctcacccaaatcctctgaaaaccagggaacagtggagagaggtagttttccgctcccgcagttgagacttgagccccgcgtaccattcagacagtttcagatgaatgatcaggacggaaaggagaatcgactgggacttagccgtccattgcgcccccttaggcagctggtcgaacgcgcaccgcgccctaccataatcaatgctgagaatttaaaggggttggatgaccttgatgctgacgctgatgacgggtgggcggggctgcacgaggaagtagactacagcgagaaattgaaattttccgacgacgaggaggaggaggaagttgtgaaagacggacgtccaaaatggaactcctgggacccccgacggcagcggcagctgtccatgagtagtgctgactccgctgacgctaagcgtacaagagaggagggtaaggattgggcggaagctgtgggggctagcagggtagttagaaaagcccctgacccccagccacctccccgcaagctgcatggatgggctcctgggcctgactatcagaaatccagcatgggcagcatgttccgtcagcagagcatcgaagacaaagaggataaaccaccccctcgacagaaatttatacaatccgaaatgtcagaggctgtggaaagagctaggaaacgtcgcgaagaggaagagcgtcgcgctcgtgaagagcggctggccgcctgtgcagcaaagctcaagcagttggaccagaagtgcaaacaagctagaaaggcaggtgaggctaggaagcaggccgagaaagaggtgccttggagcccaagcgctgagaaggcaagcccgcaagaaaatggaccagctgtgcacaaaggttctcccgaattccctgcacaagaaactccaacgacattccctgaagaggcccccaccgtcagtccggcagtggctcagagtaacagttccgaggaggaagcgagggaggcaggttcccccgcgcaagagtttaaataccagaagagtcttcctccccgctttcagcgccagcagcaacagcagcagcaggaacagttatataagatgcagcactggcaacccgtgtacccgcccccaagccatccgcagcggacgttttacccgcatcacccccagatgctggggtttgaccctcgctggatgatgatgcccagttacatggacccacgtataactcctacacgcactccggtggatttttacccatcagccctccatccctctggactcatgaagccaatgatgcctcaagaatcgctgaatggcaccggctgccgctctgaggatcagaactgcgtgcctccccttcaggaacggaaagtgacgcccatcgacagccctcctgtttggtcgcctgaaggatatatggccctacagagcaagggatatcccttaccccatcccaaatctagtgatacactggcgatggacatgcgcgtgcgaaacgagagcagcttcagtgcatcattggggagagcagggggggtcagcgcacagagggacttattcgaagagcggggcgaggagtacttgtcagcttttgacaaaaaggctcaggccgacttcgattcctgtattagctcccagagaatcggtcaagagttactgttcccacctcaggaaaatgtccaagacgccggcgcccctggcggccatacgcaaaacctgaggtgttcccccctggagcctgattttgttcccgacgagaagaaacctgagtgtggctcatgggatgtcagtcaccagcctgagaccgctgatacagcacatggagtagagcgcgaaacgcccagagagggcactgcattcaacatttctagttgggataagaacggctctccaaataaacagccctcctctgagccagaatggactcctgaacctcggtcctcttctagccagcatccagaacagaccggaaggaccagacgctctggacctatcaagaagcctgttttgaaggccctgaaagtggaggacaaggagaaggaactagagaaaatcaagcaagaactcggtgaagagtctacccgcctggctaaggagaaagaacaaagtccaactgccgagaaagacgaagacgaggaaaatgatgcctctttagcaaacagttcaactacaactctggaggacaaaggtcccggacacgcaactttcgggagagaggccactaaattcgaagaggaagagaaaccggacaaagcctgggaggctcgacccccacgggaatcctcagacgtcccgccaatgaagcgcaataattggatattcatcgatgaagaacaggctttcggggtgcgaggacaagctcggggcagagggcgggggttccgcgagtttacattccgcggtaggccggccggcggaaacggtagtgggttatgcggggggggcgtgctcggcgctaggtctatctattgctcatcccagaggtcaggccgcggccgtgggcttagggagttcgctcgaccagaggactgtcctagagctaagccacgacggagggtggccagtgagacccattctgagggatctgaatacgaagaactgcccaagcgtaggcggcagaggggatcggagaacgggaacgaaggatccctcctcgagcgagaggagtccactttgaagaaaggggactgtcgagattcatggcgatcgaacaagggctgttctgaagaccacagtggtttagacgccaagtctcgggggccccgggcattcggacgtgctctgccaccgcggctgagcaattgtggatatggccggcgcacatttgtgtccaaggaatcaccccactggcagtccaaaagtcccggctctagctggcaggaatacggaccctctgatacttgcggcagccgtaggcctacggatagggactacgtgcccgattcatatcgccaccccgatgcatttggggggaggggcttcgaggacagccgcgccgaggataagcgttccttcttccaggacgagcatgtggcagactccgaaaatgcggagaatagaccgttcaggaggaggaggcctccaagacaagataaacctccccgcttccgcaggcttaggcaggaacgcgaatctcttggcctgtgggggcctgaggaagagccgcatttactggccggacagtggccaggccgacccaaactgtgttcaggggataaaagcggcactgtaggccgccggagcccggaactttcatatcagaactcctcagaccacgcaaacgaagagtgggaaactgcgtctgaatcctctgacttcagcgagagacgtgaacgaagggagggcccaggcagcgaaccagattctcaggtggacggaggcctatctggagcttcactgggggagaagaaggaacttgctaagaggtccttcagtagtcagcggcctgttgtggatagacaaagccgaaagctggagcccggaggatttggggaaaagcccgtgaggcctggcgggggagacacttcgcctcgttatgagtcccaacagaacggaactcctcttaaagtgaagagatcccccgacgaggccctgcccggcggtctgtctggttgcagcagtgggagcggccactcaccatacgccctggagagagctgcccatgccagcgccgatcttcctgaggccagttcaaagaaagctgaaaaggaagccaaacttgccgcccccagggccggggaacaaggagaagctatgaaacagttcgacctcaactacgggtctgcaataatcgagaattgcggctcttccccaggagaggagtcagaagttggtagtatggtcggcgaggggttcatagaagtcctgactaaaaagcaacgccggcttttagaggaagagagacgaaagaaagagcaggccgtccaagtgcctgttaaaggaaggggtttgtcgtcaaggatccccccacgcttcgccaagaaacagaataacctctgtctcgaacagggtgacgtgaccgtgccaggatcctccctcggaacagaaatctgggagagctcatctcaagccctgccagtccaggctcccgcaaacgattcctggagaaaggctgtgacagctttttcgtcaacagaaacgggctctgccgaacaaggcttcaagagttctcagggcgattcaggagtggatctctcggcagagagcagagagtcctcagcaacatcctcccaacgctcgagtccatacggcaccttaaaacccgaggaaatgagtgggcctggtctcgcggagcccaaagccgactctcacaaggaacaggcacctaagccgtccgaacagaaggatagcgagcaaggctccggccagtctaaggagcatcggcccggacccatcggtaacgagagatccctgaaaaacagaaaaggatctgagggtgccgaaaggctgcaaggcgctgtcgtgcctcccgtgaacggagttgaaatccatgtcgattccgtgctgccagtcccacccatagagttcggagtcagtcccaaggacagtgactttagtcttccgccaggatctgcctctggaccgacgggtagccctgtggtgaagttgcaggacgctcttgcaagcaacgctggtttgacacagtcgatcccaatcctccgtcgcgatcatcacatccagcgggccattggcctctctcctatgtccttccctactgccgatttgacgctgaagatggagtctgcccgcaaggcctgggagaacagcccctccctgcctgagcagtcctcacccggcggtgctggcagcggaattcaaccaccttcctctgtcggggcgtcttcaggcgtcaattacagctcgttcggaggcgtgagtatgccacctatgcctgtagcttccgtggcacccagtgcatccatgcctggatcccacctgccccctttgtacctggatggccatgtgttcgcctcacagccgagactggtaccacagacaataccgcagcagcagagctatcaacaggctgccgctgcgcagcaaataccaattagccttcacaccagcctccaggcccaggcacagctgggcttgcgaggcggcctccccgttagtcagagccaggagatcttcagcagcctgcaacctttcaggagtcaggtatacatgcatccctccctcagtccaccttccacaatgatcctcagcgggggcaccgctttgaagccaccatacagtgcctttccaggtatgcagccactggagatggtcaaaccccagagtggctcgccctatcagcccatgtccggcaatcaggcgctcgtgtatgaaggtcagttgtcccaagctgcaggactgggagccagccagatgttggacagccagctgcctcaactgactatgccactgcctcggtacggaagcggacagcagccactaatcctgcctcaatccatccagcttccgcccggtcagagcctgagcgtcggggctcccagacgaatcccacccccaggctctcaaccccctgtactgaacacgagtcgcgaaccaagtcaaatggaaatgaaggggtttcactttgctgattctaagcagaacgtgccgtcaggcgggcccgtgccctctcctcagacctataggccttcatccgcgtcgccctcaggcaaaccctctgggtccgctgtgaatatgggatctgttcagggccattacgtgcagcaagcaaagcagcgcgttgacgaaaaaccgagtctcggcgctgtcaaactccaggaagcacccagcgcagcatcacaaatgaaacgaacgggagccataaaacctcgggccgtgaaggtggaagagagcaaagcttag

SEQ ID NO: 49812 - DNA, 807 bp, Artificial Sequence
  Description of Artificial Sequence: Synthetic coding sequence
atgccccccatgcccgtggccagcgtggcccccagcgccagcatgccaggaagccacttaccccctctctatctggacggccacgtcttcgcgtcacagcctaggctggtgcctcagaccattccccagcagcagagctatcaacaggcagccgctgcccaacagattccaatatctttgcacacaagtctgcaggcccaggctcagctggggcttcgcgggggcctccctgtgagccagagtcaagagatcttttcgtctctgcagccattccggtcacaagtgtatatgcacccctcactgtctcctccttctacgatgattctgtccggaggaactgctctaaaaccgccatacagtgcctttccaggtatgcagccattggagatggtgaaaccccagagcggaagcccttaccagccaatgtcaggaaatcaagctctagtgtatgagggacagttaagtcaggccgctggtctgggcgcatcccaaatgttggactcccagctgccccagctaacaatgccactgcccagatatggttcggggcagcagccactgattttgccccagtccatacagctcccaccgggccagtctctttctgttggagctccacggagaattccccctcccggtagtcagccacctgtgctgaatacctccagggagccaagccagatggaaatgaagggctttcacttcgctgacagtaaacagaacgtgccaagcggtggacccgtcccatcaccgcagacctatcgacagaacaatgagtggatgaggaacccggcctgggagccatag

SEQ ID NO: 49813 - DNA, 4608 bp, Artificial Sequence
  Description of Artificial Sequence: Synthetic coding sequence
atgagcgaccggctgggccagatcaccaagggcaaggacggcaagtccaaatactcaacactgagtttatttgataagtataaaggcaagtccgttgatgccattcggagctccgtgatccctcgccatggactgcaaagcttagggaaggtagctgcggcacgacgcatgcctcctcctgccaacttaccttctctcaagtctgaaaataagggaaacgatccgaacatcgtgatcgtcccgaaggatggaaccgggtgggcaaacaagcaggaccaacaggaccctaagtcctcatctgctacagccagccaacccccagagagcctgccccagccaggcctacagaaatctgtgtccaatttacagaaacctacccagagcatctcgcaggagaataccaacagcgtgccgggcgggcctaagagctgggcccaactgaacggtaaaccagtgggccacgagggaggactcagagggtctagcaggctcctttctttttctcctgaggagtttcccaccctaaaggcagccggtggccaggacaaagccggaaaggaaaaaggcgtacttgatctgagctacgggccaggcccgagcctccgtcctcaaaatgtcacctcctggagagaaggtgggggaaggcacataattagcgccactagtttgtccacgtcaccgacagagttaggatcccggaattcgagcactggcgatggcgcaccctcaagcgcttgcacatcggacagcaaagacccctcgctgaggccagcacagccagtcaggaagggcgcatctcaattcatgggaaacgtataccatcctcccacttaccacgacatgttgccagcatttatgtgtagcccgaagagtagtgagaatcagggcactgtggagcgaggttcattcccgttaccccaattgagactcgagcctagggtgccatttcgtcagttccagatgaacgaccaggacggcaaggagaatagattgggccttagcagacccctccggccactcagacagcttgtggaacgggctcctcggccgacaattatcaacgccgagaaccttaaaggcctggacgacctggacgctgatgcggacgatggctgggccggcctccacgaagaggtggattactcagagaaactgaagttttctgacgacgaggaggaagaggaagtggtaaaggacggcaggccgaaatggaatagttgggacccccgccgccagaggcagttgtcaatgtcatctgcagattccgctgatgcgaaaaggacccgcgaagaagggaaggactgggccgaggctgttggtgcttccagagtggtacgcaaggcccccgatcctcaaccacccccgcggaagcttcacggctgggctccagggccagactatcaaaaatcctcaatgggttccatgttccgtcagcagtcaatcgaagataaggaggataaaccgcccccccgccagaagttcatccaatccgagatgagcgaggcggtggagcgggctagaaaaaggcgcgaagaagaggagcggcgggcgagggaggagcgactggcggcctgcgccgcaaaattaaagcagctggaccagaaatgcaaacaggcacggaaggcgggagaggctaggaagcaggccgagaaagaagttccctggtcaccatcagctgaaaaggcttcgccccaggagaacgggcccgcagtgcataaggggtcccctgagtttccagcgcaggagactcccactacattcccagaagaagctccgacggtgagtccagccgttgctcaaagcaattcctctgaggaagaggcccgtgaagccggcagtcctgcgcaagagttcaaatatcagaagtcactgccccctaggtttcagagacagcagcagcagcagcagcaggaacagctctacaaaatgcaacactggcagcctgtgtatccccctccaagccacccccaacggaccttctatccccaccatcctcagatgctgggatttgatcctaggtggatgatgatgccgagctatatggatcctaggattactcccacacgcaccccagtggatttttacccatctgcgctgcacccttccgggttgatgaagcccatgatgcctcaagaaagtctcaacggaactggctgcaggtccgaggatcaaaactgcgttcctcccctccaagagagaaaagtcactccaatcgactctcctcccgtttggtcgcccgaaggttacatggctttgcagtccaaaggttatcctctcccacatcccaagtctagcgacactctcgcgatggatatgcgcgtgcgctctcccgacgaagcactacccggcgggctaagtggatgtagcagcggcagtgggcattccccatatgcactggaaagggccgcccacgcctcagccgacctcccagaagctagctccaagaaggctgaaaaagaagccaagttggcggccccacgcgcaggagagcaaggagaggcaatgaagcagttcgatctaaattacggttccgcgatcatagagaattgtgggtcaagtccaggtgaggaaagtgaggttggatccatggttggcgaaggcttcattgaagtgctaacgaaaaaacaacgtcgccttctggaggaggaacgaagaaagaaagaacaagctgtacaggttccagtcaagggtagggggctgtccagtaggatacctccgcgtttcgccaaaaagcaaaacaacctgtgtctcgaacagggcgacgtaacagtcccaggatcatctttaggaacagaaatatgggagtctagctctcaggcattacctgtccaagcaccggccaacgatagctggcgcaaagccgtaaccgccttctcctcaaccgagaccggaagtgcagagcagggattcaaaagctcacagggggatagcggcgtggacctcagcgctgagtccagagagtccagtgccacatccagtcagaggtcctctccctacgggacactgaaaccagaggagatgtctggtcccggccttgctgaaccaaaggccgattcccataaagaacaggctcccaagccctcagagcagaaggactcagaacagggatccgggcagtctaaagagcaccggcccggcccaattggtaacgaaagaagcttgaaaaatcgcaagggaagtgaaggggcggagcggttgcagggtgctgtggtgcccccagtgaacggtgtggagatccatgtggactcagtgttacctgttccgcccatagagtttggtgtcagccctaaagacagcgactttagcctgccacccggaagcgcctccggccccaccggcagtccagtggttaagcttcaggacgcactcgcctccaacgcagggctgacccaatctatccccattctgagaagagaccatcacatacaacgtgctattggcctgtccccaatgtcctttccaacggcagatttaacgctaaagatggaatctgcacgcaaagcctgggagaattccccctcactcccggagcaatccagtccgggaggggctggcagtggtattcagcccccctcctctgtgggggcatcctccggcgttaactacagcagctttggtggagtttccatgccgcctatgcctgtagcctccgtagcaccctccgccagtatgccaggtagccatctgcctccactctatctggatggccacgtgtttgctagtcagcctcggttggtgccacagacaattccccaacagcagtcctatcagcaagcagctgccgcccagcagatccctattagcctgcacacctccctgcaggcccaggcccaactgggcctgcgcggagggctgccggtatcccagagtcaagaaatattctcatctttgcaacccttcagatctcaagtttacatgcacccttcgctgtccccaccgtctaccatgattctcagtgggggcacggccctgaagcctccatactcagctttccctggtatgcagcctctggaaatggtgaaaccccagtccggctctccttaccagcccatgtccggaaaccaggccttagtgtacgaggggcagctgtcgcaggctgccggactgggggctagtcagatgctagacagccaactaccccagctcacaatgcctctcccaaggtacgggtccggacagcagcctctcatcttaccacagagtattcaactgccaccagggcagagtctcagcgtgggagctccaaggaggattcctccacccggatctcagcctcccgtcttgaatacctcacgggaaccttctcaaatggagatgaaaggctttcacttcgccgatagtaagcagaacgtcccatctggtgggccagtgccgtcacctcagacataccgaccgtcatccgctagtccatctggcaagcccagcgggtcagccgtcaacatgggctcagtccagggacattacgtacagcaggccaagcagcgcgtggatgaaaaaccatcactcggggccgtaaaactccaggaggccccgagtgcagcctcgcagatgaagcgcaccggcgctattaagccccgggctgtaaaggtggaggagtccaaagcctag

SEQ ID NO: 49814 - DNA, 2391 bp, Artificial Sequence
  Description of Artificial Sequence: Synthetic coding sequence
atgaagcccatgatgccccaggagagcctgaacggcaccggctgcagaagcgaagatcagaactgtgtccctccactgcaggaaaggaaagtgacccccattgactcgccgcccgtttggtcgcccgaaggctatatggccctccagtctaaagggtaccctctcccacaccctaagtcatctgatacactggctatggacatgcgcgttcgcaacgaatcaagtttcagcgccagtcttggtagagccggaggcgtctcggctcaacgcgatttgttcgaggagcgtggtgaggagtatctgtcagcttttgataagaaggctcaagctgacttcgacagctgcattagtagccagcgcatcggccaagaactactattcccacctcaggaaaacgtccaggatgccggggcccccggtgggcatacgcagaacctgcgttgtagccctcttgagcccgatttcgttcctgatgagaagaagcctgagtgtggatcctgggacgtgagccatcagcctgaaactgcagataccgcccacggagttgaaagagagaccccaagggagggcacagcattcaacatcagctcttgggataaaaatggatccccgaacaagcagccttcctccgagcccgaatggactcctgagccacgcagcagctcatctcagcaccctgagcagacaggccggacacgaagaagtgggcctatcaagaaaccagtcctcaaggcactgaaagtcgaggataaagagaaggaactggaaaaaatcaagcaggagctgggggaggagtccacaagacttgctaaggaaaaggaacagtcaccgacagcagagaaagatgaggatgaggagaacgacgcctccctcgccaattccagtacaacaaccctggaggacaagggtccggggcacgcaacttttggcagggaagccactaagtttgaagaggaggaaaagcctgacaaagcctgggaggcaagacctcccagggaatcttcagacgtgcctccaatgaagcgcaacaactggattttcatcgatgaggagcaggcgttcggcgttagaggacaagcccgcgggcgcggtcgcggatttagggagttcaccttcagggggcgcccggcaggcggaaacggctctgggctgtgcggtggaggcgttctcggcgcgcggtcaatctactgctctagccagaggagtggacggggcagaggactacgtgagtttgccaggcccgaggattgtccaagagccaaaccccgccggcgcgttgccagcgaaacccactccgaggggagcgaatatgaggagttgccaaagcgtcgacgacagaggggcagcgagaatgggaatgaggggtccctcctagagcgagaagagtccactctgaagaagggcgactgtcgggattcctggcgtagcaataagggatgttccgaagatcacagcggccttgatgctaagagccgaggccctagggctttcggtcgcgccctcccgccgaggctgtccaactgtggatatggacggagaacatttgttagtaaggaaagtccccattggcaatcaaagtcgccggggagctcgtggcaggagtacggcccctccgatacttgtggctctcgccgccccacggacagggactacgtgcctgacagttaccggcatcccgacgcattcgggggtcgggggtttgaagattcccgagccgaagacaagcgcagttttttccaggacgaacatgttgcagacagcgagaatgccgagaatcggccgttccgccggcgcagacctccaagacaggacaaaccacccagatttcgtcggctgagacaagagcgggagtctctcggcctgtggggccctgaagaggaacctcatctgttggcaggccagtggcccggacgccccaagctctgttcaggagacaagagtggcaccgtcgggcgacggtcccctgagctctcataccagaatagctctgatcatgcaaacgaggagtgggaaaccgcatctgagtcctcggacttctcagagagacgcgaacgacgggagggaccaggcagtgaacctgatagccaggtggatggtggactgtccggggcatcactgggagaaaagaaggagctcgccaaacgctcatttagcagccagaggcccgtggtagacaggcagtccagaaagctcgagccaggcggttttggcgaaaagccggtgcgaccgggaggtggagacacaagccctaggtacgagagccagcaaaacggaacaccactgaaggtcaaacgttccccagacgaggcgctgcctgggggtttaagtggttgctcctcgggctccggccattctccctgtccaggcgccggcagcccctgccaatgctag

SEQ ID NO: 49815 - DNA, 537 bp, Artificial Sequence
  Description of Artificial Sequence: Synthetic coding sequence
tgcgagggccggcaggccaaggtgaagagcagcatgggcagcatgtttcgtcagcagtccattgaagataaggaggacaaaccacccccaagacagaaattcattcagagcgagatgagtgaagcagtcgagagagcacggaaaaggcgggaagaggaagagcgacgcgcccgcgaagagcgtctggccgcatgtgctgccaaactgaaacagctcgaccagaagtgtaaacaggcaaggaaggccggagaggctaggaagcaggccgagaaagaggtgccctggagccctagcgctgaaaaagccagcccccaggagaatggccccgctgtgcacaaaggaagtccagagtttccggcccaagaaacacctacgacttttccagaggaggctccaacagtgagtccagcagtggcccagagtaattctagtgaagaagaggcccgtgaggccggatcacccgcgcaggaatttaagtaccagaagtccttaccccctcggttccagcgacagcagcagcagcaacaacaagaatag

SEQ ID NO: 49816 - DNA, 1767 bp, Artificial Sequence
  Description of Artificial Sequence: Synthetic coding sequence
tgaggccggggcttcgaggacagccgggccgaggacaagcggagcttttttcaggatgaacacgttgccgatagcgagaatgccgagaatcgaccatttcgccgccgtaggcctcctcggcaggacaagccccccaggttccggcgactgagacaggagcgtgaatctctgggcctgtggggacccgaggaagagccccatttgctggcaggccagtggccaggccgcccaaaattatgcagtggagataagtcaggaacagttggtagacggtctcctgagctgagttatcaaaactcatccgaccatgccaacgaagaatgggaaacagcctccgagagctcggatttctcagagcgaagggaaaggcgcgaaggacctggcagcgaacccgattcccaggtggatggcggactgagtggagccagtctgggggaaaaaaaggagttggcaaaacggtctttctcaagccagcgacctgttgtcgatcgccagtccaggaagctcgagcctgggggtttcggggaaaagcccgtgcgaccaggcggaggtgatactagcccccgctatgagagccaacagaatgggaccccgctgaaagtaaaacgtagccccgacgaggcactcccagggggtctgtctggatgttcctctggatctgggcattccccttacgcgttggaacgagctgcgcacgctagtgccgatctgccagaggcctcctccaagaaggccgaaaaagaagccaaacttgctgcccctagggccggcgaacaaggcgaggccatgaaacaatttgacttaaactatggcagtgcgatcatcgaaaactgtggatcatcccccggtgaagagtcagaagtcggatccatggtcggcgagggattcatagaggtgcttacaaaaaagcagcggcggctgttggaggaagagcgccgcaagaaggagcaagcagtgcaagtgccagtaaagggccgcggcttgtcaagccgaatcccaccaaggttcgcaaaaaagcagaacaacctgtgtctggaacagggcgacgttaccgtgcctggcagctccctgggaacagagatctgggagtcctcctcccaggccttgccagtacaggctcctgccaacgactcttggcgcaaagccgtgacagcgtttagctctaccgaaaccgggagtgccgaaggctttaagtccagtcagggggacagtggggtagacctctcggcagaatctcgcgagagctccgccacctcaagccaaagaagttccccttacgggactctcaagcctgaggagatgagtggacctgggctggctgagcctaaagctgacagccacaaagaacaagcgcccaaaccctcggagcagaaggacagcgagcagggttcaggtcagtccaaagagcatcgaccaggacccattggcaacgagcgctccctgaaaaaccgcaaggggagcgagggggcggaacggctccagggggccgtggtgccgcccgtcaatggtgtggagatccacgtggacagcgtgctgcctgtgccacccatcgagttcggcgtgtctcccaaagatagtgacttttctttgccccctgggagcgcaagcggaccaacaggatcacctgtggtgaagcttcaagacgctctggcgagcaatgccggcctgacgcaaagcatccccatcctgaggagggaccaccacattcagcgagctatcggtctctcccctatgtcgttccctaccgctgacttgacgcttaagtag

SEQ ID NO: 49817 - DNA, 528 bp, Artificial Sequence
  Description of Artificial Sequence: Synthetic coding sequence
gagcggaaggtgacccccatcgacagcccccccgtgtggagccccgagggatatatggcccttcagtcgaaggggtacccgctgccccacccgaaaagtagcgacaccctggccatggatatgagagttcgtaacgaatcctcctttagcgcctcactaggccgtgctggcggcgtcagcgcccaacgcgacctctttgaagagaggggcgaagaatatctgagtgcattcgacaagaaagcacaggccgacttcgactcttgcatatctagtcaaagaatcggtcaggagctgttatttcctcctcaggagaacgtgcaggacgctggcgcccccggggggcatacgcagaatctccggtgtagcccactggaacctgactttgtacccgatgagaaaaaaccagagtgtggttcttgggacgtgagtcaccagcccgagaccgccgatacagctcacggggttgagcgcgagactccccgggaaggcaccgccttcaacatttcaagttgggacaaaaatggatag

SEQ ID NO: 49818 - DNA, 4608 bp, Artificial Sequence
  Description of Artificial Sequence: Synthetic coding sequence
atgagcgaccggctgggccagatcaccaagggcaaggacggcaagtctaagtatagcaccctgtctttgttcgacaagtacaaggggaaatcagttgatgccatacgaagttccgtgatccctcgccatggacttcaatcactgggcaaggtggcggccgcaagacggatgccaccaccagcaaaccttccttcgctgaaatcagagaataagggcaacgatccgaatattgtaattgtgcctaaggatggcacgggatgggctaataagcaagaccagcaggaccctaagtctagttccgctacagcctcacagcccccggagtccctgccccaacctgggctgcagaaaagcgtctctaatcttcagaagccgactcaatctatttcacaggagaatactaactccgtcccagggggtcctaaaagttgggcccagctgaatgggaaacctgtgggccacgaaggagggctgaggggatctagccgtctgctgagcttttcacctgaggagtttccgactctgaaagccgctgggggacaggataaggcgggaaaagaaaaaggtgtgcttgatttaagctatggacccggtcccagcctgcggccccagaacgtgacgtcctggcgcgaggggggcggacggcacatcattagcgcaacttctttgtctacaagtccaacagagttgggcagcagaaactcatccacaggagatggcgcgccaagcagcgcatgcaccagcgactccaaagatccttcactccgacccgcccagccagtccgtaagggtgccagccagtttatgggaaatgtgtaccacccaccaacttatcacgacatgctcccagccttcatgtgcagtcccaagtctagtgaaaaccaaggcaccgttgagagaggaagcttcccattacctcaactaagactggagccaagggtcccttttcgccagttccaaatgaacgatcaggacggcaaggagaacagattgggactttcccgccctctcaggcctctgagacagctggtggagagggcgccgaggcctacaatcatcaatgctgagaaccttaagggcctcgatgacctggatgctgatgcagacgatggctgggccggcttacacgaggaagtcgactactcggaaaagcttaagttttcagacgacgaagaggaggaggaggtcgtgaaagacggcaggcccaaatggaactcctgggaccctcgtaggcagaggcaattatcaatgtcttccgcggattccgccgatgcaaagcggactcgggaggagggaaaagactgggctgaggcagtcggtgccagccgcgtcgttcgaaaggcccccgatccacagcctccaccccggaaactccacgggtgggccccagggccagactatcagaaatcaagtatggggtcaatgtttcgccagcaaagcatagaggacaaagaggataaacccccgcctagacagaaatttatccagtccgaaatgagtgaagccgtggagagggctaggaaacggagggaggaggaagaacgaagggcaagggaagaacgtctggctgcttgcgcagctaagctgaagcaactggaccagaaatgcaaacaggcccgcaaggctggggaagcgaggaaacaagcagaaaaggaggtcccatggagtccttcagcggagaaagcctcaccccaagagaatggaccggccgtgcacaagggaagccccgagttccctgctcaggagacacccacgacctttcctgaagaagctcctacagtctcccctgccgtcgcccagagcaattccagcgaagaggaagcccgggaagccggatcccctgctcaagaattcaagtaccaaaaatcactgccgcctaggttccagaggcagcagcaacagcagcaacaggagcagttgtacaaaatgcagcattggcaacctgtgtacccccctcctagccatccacagaggaccttctaccctcaccatcctcagatgttgggttttgacccacgctggatgatgatgccctcctatatggacccaaggataacaccaacaagaactccagttgacttttatcctagcgcgctgcacccctctgggctgatgaagccaatgatgccgcaggagagccttaatgggacaggctgtcggagcgaagaccagaactgcgtcccccccttgcaggagcggaaagtgactcctattgattccccccccgtttggagtccagaggggtacatggccctccagtctaaaggatatcctcttccccatccaaagagttcagatacattagccatggatatgcgcgtgaggagccctgatgaagctctgcctggaggcctgagcggctgttcatccggctcaggccactcaccctatgctctcgagagagccgcacacgcaagtgccgatcttccagaggcatccagtaaaaaagctgaaaaggaagctaagttggctgcaccaagagcgggggaacagggcgaagcaatgaagcaatttgacctaaactatggcagtgcaattatcgagaactgtgggagttcaccaggggaagaaagcgaggtcgggtcaatggtgggcgaaggcttcatcgaggttcttaccaagaagcagcgacgattgctggaagaggagcggagaaagaaggagcaggcagttcaggttcccgtgaagggacgaggactgtcttccagaatcccaccgagattcgctaagaagcaaaacaatctgtgcctggagcaaggcgacgtcactgttccgggctcaagtttgggaacggagatctgggaaagtagcagtcaggcattacccgtgcaagcgcccgccaatgactcatggcggaaggccgtgaccgcctttagctcaactgagacaggatccgccgagcagggatttaaatcctctcaaggagatagcggagtggacctgtccgcggaatcacgtgaatcctccgccacctcatctcaaaggagcagtccatatggaaccctcaagcctgaagagatgtcagggcccggattagctgagcctaaggccgactcccataaggagcaggccccgaagcccagcgaacaaaaggatagcgaacagggcagtggtcagtccaaggaacaccggccaggcccgataggtaatgagcgaagccttaagaaccgaaagggatcggagggcgccgagagactgcaaggagccgtggtgcctcctgtgaatggcgtggagattcacgtagatagcgtgttgccagttccccccattgagttcggagtgagccccaaagattctgacttcagtcttccgccaggcagtgctagtggacctaccggcagccctgtggttaaattacaagacgcactggccagcaatgcaggcttgacacagagcattcccattttgcgacgcgatcatcacatccaacgggctattgggctatcccccatgtcattccctactgccgatctgactcttaaaatggagtccgcgcggaaggcctgggaaaactcacctagcctgccagaacagtcgtcaccggggggagctggcagcggcattcagcctccctcttccgtgggagcctcctctggtgtcaattactcatccttcgggggcgtcagcatgccacctatgcccgttgcgagtgtggcaccttcggcatcaatgccgggcagccatttgccccccctctacctggacggtcatgtgttcgcttctcagccgcgactcgtgcctcagacaatcccccaacagcaatcttatcagcaggccgccgccgcccagcagattcccatcagcctgcatacttctctgcaggcgcaagctcaacttgggttgcgcgggggcctccctgtcagccagagccaagaaattttctcatctctccaaccattcaggagccaagtgtacatgcaccccagtctcagtccacccagcaccatgatactatcgggtggtaccgctttgaagcccccctacagcgcctttcctgggatgcagcctttggaaatggtgaagccgcaatctgggtccccttaccagcccatgtccggcaaccaagccctagtctacgaagggcagctgtcgcaggccgcagggctgggcgcgtctcagatgctggactcccagctgcctcagttgacaatgccactgccaaggtatggttctgggcagcagcccctgatcctgcctcaatccattcagctcccacctgggcaaagtctttctgtgggcgctcctagacggattccaccaccaggtagccagccgccggtcttgaataccagccgtgaacccagccagatggaaatgaagggcttccattttgccgacagtaagcaaaacgtgccttctggcggtccggtgccatctccgcagacctacaggccatcatcagcatctccatccggaaagcccagcgggtcggcggttaacatgggttcagtgcagggacactacgtgcagcaggcaaagcagagggtcgatgagaaaccttcactcggcgctgttaagctgcaggaggcaccatcggccgcttctcagatgaagcggacaggcgccatcaagccgagggccgttaaggtggaggaatccaaggcttag

SEQ ID NO: 49819 - DNA, 981 bp, Artificial Sequence
  Description of Artificial Sequence: Synthetic coding sequence
atgagcgaccggctgggccagatcaccaagggcaaggacggcaagtcaaaatattccacactatccttatttgacaaatacaagggcaagtccgtggatgcaatcagatcctccgttatcccacgccacggcctacagtcactgggaaaagttgcagccgcgcgacgcatgccccctccagcaaacctgccctcactcaagagtgaaaataaggggaacgaccctaacatcgttattgtgcccaaggatggcaccggctgggcaaacaagcaggaccagcaggaccctaagagtagctctgccaccgcttcacagccgccagaatccctgccccagcccggcctacagaagtccgtctccaatctgcagaagcctacccaatccatttctcaagagaataccaactccgtgcccggaggccccaaatcctgggcccagctgaatgggaagcccgtaggtcatgaaggggggctgcgaggcagttcccggctcctgtccttttcccctgaggagttccccacacttaaggctgccggcggacaggacaaggctggcaaagagaagggggttctggatttgtcatacggaccaggtccatcactgaggccacaaaacgtcaccagctggcgggagggcggcggccgccacattatctcagccactagtctgtctacaagccccaccgagttgggctcgcggaatagcagcacaggagacggtgctccttcctccgcatgtacaagtgacagtaaggacccttcgctgaggcctgcccagcctgtgcgcaaaggtgcctcgcagttcatggggaacgtatatcaccctccgacctaccacgatatgctacccgctttcatgtgttctcccaagtcaagcgaaaaccaaggcacagtggagaggggaagcttccccctgccacagctgcggctcgaaccccgggttccatttaggcaatttcaaatgaacgaccaagacggttag

SEQ ID NO: 49820 - DNA, 8454 bp, Artificial Sequence
  Description of Artificial Sequence: Synthetic coding sequence
atgagcgagaagagcggccagagcaccaaggccaaggacggcaagaagtatgcaacactatctctctttaacacatacaagggcaagagcttggaaacacagaagaccacagccaggcacggactacaaagtctgggtaaagtcggaattagtcgacgcatgcccccacctgccaatctcccctcattgaaagctgagaacaagggaaatgatccaaatgtcaacattgtacccaaggacggaacaggctgggcctcaaaacaggaacaacacgaggaagaaaagaccccggaggtcccaccagcgcagcctaagccgggggtagctgcccctcccgaggttgctccagctccaaaaagctgggccagtaacaaacagggcggacagggagacgggatccaagttaattcacagtttcagcaggaatttcccagccttcaggctgcgggtgaccaggaaaagaaggagaaggagaccaacgatgataactatggaccggggccctcattgaggcccccaaacgtggcctgttggcgggacggaggcaaggctgccgggagtccttcatcaagcgaccaagatgagaagttgccaggacaagacgaatctacagcaggaacgtctgaacaaaatgatattttaaaggtcgtggagaaacgtatcgcctgtggtccccctcaggcaaaactaaacggccagcaagctgcactggcctctcagtaccgcgcaatgatgcctccttacatgttccaacagtatcccaggatgacttatccccccctccatggtcctatgcgattccccccctcgctgtcagagaccaacaaaggccttcggggtagagggccaccaccctcttgggcaagtgagcccgaaagacccagcattcttagcgcgtccgaattgaaagagttagataaatttgataatttggacgcagaagcggacgagggctgggccggtgcccagatggaggtcgattacacagagcagctgaatttctctgacgatgacgaacagggctcaaacagccctaaggagaacaactcagaggaccagggtagcaaggccagcgagaataatgagaacaaaaaagagacagatgaggtgtccaacaccaaaagctcctcccaaataccagcgcaaccatctgtagccaaagtcccgtacgggaagggccctagctttaaccaggagcgcgggaccagttcacatctccctccaccacctaaattgttggcgcagcagcaccctccacctgatagacaggccgtgcctgggcgtcccggccctttccccagcaaacagcaggtggcagacgaagacgaaatctggaagcagcgccggcggcagcagagcgagatttctgccgcagtagagcgggcccgcaagcggcgagaggaggaagagcggcggatggaagagcagaggaaggctgcttgcgccgaaaaactgaaaaggctggatgagaaactcggcatattggagaagcaaccctccccagaggagatcagggaaagagaaagggagaaggaacgggagagagagaaggagctggagaaggaacaagagcaggagcgggaaaaggagagagaaaaggatcgcgaacgccagcaggaaaaggagaaagagctggagaaagagcaggaaaaacagcgcgaaatggagaaagagaggaagcaggagaaggagaaggaactggagaggcagaaagagaaagagaaggagttgcagaaaatgaaagagcaggaaaaagagtgcgaactcgagaaggagcgtgagaaactagaagaaaaaattgagcctcgagagcccaatttggagccaatggttgaaaaacaggaatccgagaattcatgcaataaggaggaagagccagtattcacacgacaggattctaataggagtgagaaggaagctactccagtcgtgcatgagaccgaacccgagagcggcagccagcccaggcctgctgttttatccggttactttaagcaattccaaaaaagcctgcctcctcggtttcagagacagcaggagcagatgaaacagcagcagtggcagcagcagcagcagcagggcgtgctcccacagacagtgcctagtcagccatcctcttctactgtgccccccccaccacaccggccactttaccagccgatgcagccacatccacagcacctggcatctatggggttcgaccccaggtggttaatgatgcagtcatatatggaccccaggatgatgtcaggcaggcccgctatggatattcccccgattcaccccgggatgatcccaccgaagcctctgatgaggagggaccagatggagggatccccgaatagctctgagtccttcgagcacattgccagatcagctcgggaccacgccatctcgctctcagaaccgagaatgctgtggggcagtgacccatacccacacgccgagcctcagcaggcaaccacccccaaagcaacagaagagccagaagacgtcagatccgaagctgccctcgaccaggaacaaatcacagcggcatactccgtggagcataatcagctggaagctcatcccaaagcagattttatcagggaatctagcgaagcccaagttcagaagttcctctcacggtcagttgaggatgtgcggccccaccacacagacgctaataaccagagtgcgtgcttcgaggcgccagaccagaagaccctgtcagccccgcaggaagaaagaatctctgctgtggagagccagccatctcgaaagagatccgtgtctcatggaagcaatcacacacagaagccagatgagcagaggtctgaaccctcagccgggattccgaaagttactagcaggtgtattgatagcaaagagcctatagagagacctgaggagaaacccaagaaggaaggctttatccggagctccgagggccccaaacccgagaaagtgtataagtcgaagtcggagacgagatggggccccagaccgtcctccaaccgtagagaggaagttaacgacagaccagtgcgaaggagtggcccaattaagaagccggtgctgagagatatgaaggaggaaagggaacaacggaaggaaaaggaaggcgaaaaagccgaaaaagtcacagagaaggtggtggtgaagcccgagaagaccgaaaagaaagacctccccccgcctcctccacctcctcaacctccagcccctatccagccccagtctgtgcccccaccgatacagcccgaggctgagaagttcccaagcaccgagactgctacattggcacagaaaccatcacaagatactgaaaaaccactggagcccgtctccaccgttcaggtggagcccgcggtcaagacagtcaatcagcagaccatggctgcaccagtggtcaaggaagaaaaacaacctgagaaggtcatctccaaggacctggtgatcgaacggcctaggcctgatagccgacccgccgtgaaaaaggaaagtactttaccacctcgcacttattggaaagaggccagagagagagattggttccctgaccaaggctatagggggaggggcaggggagaatactatagcaggggaaggtcctaccgaggatcctatggcgggcggggcagaggaggtcgtggccatactcgcgactacccgcagtaccgtgacaacaaaccgagagccgagcatattccttccggtcccctcaggcagagggaggaatccgaaactcggagtgaaagttccgattttgaggtcgtcccaaagaggaggcggcaacggggctcagagaccgataccgactccgagattcacgaatctgcatcagacaaagacagtctctccaaaggaaaactccctaaacgcgaggaacgccctgagaacaagaagccagtgaagccccattcatcattcaaaccagataaccatgtgcgtatcgataacaggttgcttgagaagccctacgtgagggacgacgacaaggccaaacccggttttctgccaaagggcgagccaacacgcagagggcgggggggcaccttcagaaggggggggcgggatcccggcggacgcccgagtcgaccgtcaactctgcggcgtcccgcatacagggacaaccagtggaaccctcgccagtccgaagtgccaaagccagaagacggggaacctccaagacgacacgagcagtttatccccatcgccgctgacaagcgaccaccaaaattcgaacgaaagttcgaccccgcccgagaaaggcccaggagacagcgccccacaagacctcctagacaggacaagcctccccgattcaggaggctccgcgaacgagaggctgcatcaaaaagcaacgaagtggtagcagtacctaccaatggcaccgtgaacaacgtggcccaggagcccgttaacacattgggcgatatctccgggaacaaaactccagacttatcgaaccaaaactcctcagatcaggcaaatgaagagtgggagactgcgagtgagtctagcgactttaatgagcgccgggagcgggatgagaagaaaaatgcagatctgaatgcccagacggtcgtgaaagtgggtgaaaacgtcctgcccccgaagcgcgagattgctaagaggagcttctcctcccagcgacccgtggacagacagaaccggagagggaataatggccccccgaaatcaggaagaaatttctccggacctcggaatgaacgcagatcaggtccaccctcaaaatctggcaagcgagggcctttcgacgatcaacctgccggtacaacaggagtagacctgatcaacggctccagtgctcatcaccaagaaggcgtgccgaacggtacaggccagaagaattctaaagattccacaggcaagaaacgcgaagaccctaaacccggccctaagaagcctaaagaaaaagttgacgccctgagccagttcgatttaaataactacgcttctgtagtcatcatcgacgaccacccagaagtcaccgttatcgaagacccacagagcaatttgaatgatgacggttttactgaagttgtctccaagaaacagcagaagcgcctccaggatgaggagagacgcaaaaaggaggagcaggtaatccaggtgtggaacaagaaaaatgcaaacgagaagggcaggtctcagacgtccaagttacccccacgatttgccaagaagcaagcaactggtatccagcaggcgcagtcttctgctagtgttccacctttggcctctgcgccattacctccctctacctctgcaagcgtgccagcttcaacctcagcccctctgcctgccaccctgactccagtcccagcctctacgtccgctcctgtccccgcctctaccctggcccctgtgcttgcgtccacctctgctcctgtgcctgcctcccctcttgctcctgtgtccgcgagtgccagcgtgagcgcctccgtgcccgccagtacctccgccgcggccatcacatcctcctcggcacctgcctccgcccccgctcccacccctatcttggcctccgtgagtacacctgcctcagtcactatactggcaagcgccagtatcccaatcctcgcgtcagcactggcctccacaagtgcaccaacccccgcacccgccgcctcttctcctgctgccccagtgattaccgcccctaccatccccgcctccgctccaaccgccagcgttcccctggcccccgcaagcgcgtctgcccctgctcccgctccgacaccagtaagcgccccaaaccccgcacccccggcgcctgcccagactcaggcacagacccataagcccgtgcagaaccccctgcaaacgacttcccagagtagtaagcagccccccccatctatccgattgccaagcgctcagacccctaacggtaccgattacgtcgcttcagggaaatccatccagactccccagtctcacggcaccctcacagccgaactctgggataataaagtggctccacccgccgtgctgaacgacatctctaaaaaactgggccctattagtccacctcaacccccctccgtgtccgcttggaataagcccctgaccagcttcggcagtgctccatcttcggaaggcgctaagaatggacaggagagcggcctggagattggcaccgacactatccagttcggggcgcccgcttctaatggcaatgaaaacgaagttgtgcccgtcttgagcgaaaagagcgccgataaaatccccgaaccaaaagaacagagacaaaaacagcctcgagctggtcccatcaaagcccagaagctccccgatttgtcgccagtcgagaacaaagaacacaagcctggacctatcgggaaagagcgttctcttaaaaacagaaaggtcaaggacgcccagcaggtagagcccgagggacaagaaaagccaagccctgcaacagtccgatcaaccgatcctgtgaccaccaaagagactaaagctgtgtcagagatgagcacggagattggcactatgattagcgtttcaagtgccgaatacgggacaaacgcgaaagagtctgttaccgattacacgactccatcttccagcctccctaacaccgtggctacgaacaacaccaagatggaagatacacttgtaaacaatgtgcccctcccgaacaccctgcctctgccaaaacgagagactattcagcagagctcgagtcttacatcagttcccccgaccaccttctccctgacttttaagatggagagcgccaggaaggcctgggaaaatagtccaaatgtgcgtgagaagggttctcctgtaacttcaaccgctccaccaatcgcaacaggtgtgtcttcatccgcctccggcccttctaccgccaattacaatagcttcagtagtgcgtctatgccccagatacctgtggcaagtgttacacccacagccagcctgtccggagccggaacatacactacatcctccctgtctacaaagtccaccactacctcagatccccccaacatatgcaaagtgaagccccagcaactgcagacctccagcttgccatccgcctcacacttcagtcagttgtcttgtatgcccagcttaatagcgcagcaacagcaaaatcctcaagtctatgtttcgcagtcagcggccgcgcaaatcccagccttttatatggacacatctcatttattcaacacacagcatgctcgcttagctccaccgtcactggcgcagcaacagggatttcagcctggtttgagccagccaacatctgttcagcaaataccgatccccatctatgctcctttgcagggacagcaccaggctcagctctctctgggggcgggccccgccgttagtcaggcccaggaactcttcagctcctctctgcaaccataccgctctcaacccgcgttcatgcagagctctctgtcccagccctcagtggtactttcaggcactgcaatccacaacttccccacggtacagcaccaggaactcgcaaaggcacagtctgggcttgcattccagcagacttcaaatacacagccaatacccattctctacgaacatcaactgggccaggctagtggattgggcggctctcagctcatagatacgcatttgcttcaggcccgggctaacctgactcaggccagcaacctatatagcggtcaggttcagcaacccggacagaccaacttctacaacactgcacaatctccgagcgcgttacaacaggtcacagttccactgcccgccagtcagctgtcccttccaaattttgggagtaccggccaacccctcatcgccctgccacagacactacagccgccactgcagcacactacccctcaagcccaggcccagagcctgtcacggcccgcccaggtctcccaaccattccgaggcttaatacccgcagggacgcagcattcaatgatcgccactaccggcaagatgtctgagatggagttgaaagcctttggcagtggcatcgatatcaagccaggtactccacctatcgcaggcagaagcacaacacccacaagttcacccttccgggctacctctacctccccaaactctcagtccagcaaaatgaatagcatcgtgtaccaaaaacagtttcagagcgcccctgctacagtacgcatgactcagccatttcccactcagtttgccccacaggccaaacagagggccgaggtgctccagagtacccaacgctttttttccgagcagcagcagtccaagcagatcggagggggaaaggcacagaaggtggactctgacagctcaaaaccacctgagactttaactgatccaccaggggtctgccaggagaaggtcgaagagaaaccaccacccgcgcctagcatcgccactaaacccgttcgcacaggccccatcaagccacaggctataaaaactgaagaaaccaaatcttag

SEQ ID NO: 49821 - DNA, 8697 bp, Artificial Sequence
  Description of Artificial Sequence: Synthetic coding sequence
atgagcgagaagagcggccagagcaccaaggccaaggacggcaagaagtacgccactctctcacttttcaatacatacaagggcaaaagcctggagacacagaagactactgtcgccgcccgccatgggctccagagtttaggcaaagtcggcatcagtcggcggatgcctccgccagcaaatctcccttccttaaaggccgagaataagggcaacgatccgaacgtgaacatcgtgcccaaggatgggaccggttgggcatcgaagcaggagcagcacgaggaggagaagacaccagaagttcctcccgcacagcctaaaccgggtgtagccgccccacctgaagtggctcctgccccaaagagttgggcttctaacaagcagggcggccagggagatggcatccaggtgaactctcaattccagcaggaatttcctagtttgcaagctgctggcgatcaagagaaaaaggaaaaagagactaacgatgacaattacggtcctggccctagcctccgtcccccaaacgtggcctgctggcgcgatggagggaaagctgcaggcagccccagctcgagtgaccaggacgaaaaattgcccggccaggacgaaagcaccgctggtaccagcgaacagaacgatatcctaaaagtggtggagaaacgcatcgcctgcggccctccccaagctaaacttaatggccagcaggccgccctcgcttcacagtaccgtgccatgatgccgccgtacatgttccaacagtatccccgcatgacatatcctccccttcacggccccatgagattcccaccttcacttagcgagactaacaagggtctccgagggagaggtccgccaccatcctgggccagcgagcccgagcggccctcaatcttatcagctagcgaactgaaagaattggacaaattcgacaacctagatgctgaggcggacgaaggctgggctggggcgcagatggaagtcgattatactgaacagcttaatttttctgacgacgatgagcagggctcaaacagcccaaaagaaaataattccgaggaccaaggctcaaaggcatctgagaacaatgagaataagaaggaaacggatgaggtgtcaaatactaaatcttcttcgcaaatccccgcccaaccttctgtagccaaagtgccttatggcaaaggcccgagcttcaaccaagaacgagggacctccagtcacctaccgccccccccaaaattgctggcacaacagcatccaccacccgatcggcaggcagtgcctggacggcctggccctttccctagtaaacagcaggttgcggatgaagacgaaatctggaaacaacgccgccgacagcaaagtgagattagcgcagcggtggagcgtgccagaaaacgacgcgaggaggaggagagacgcatggaagagcaacgaaaggcagcctgtgcggaaaagctgaaaagattggatgagaagctgggcatcctagaaaaacaaccttcaccagaggagatcagagagcgagaacgagagaaagaacgcgaaagagagaaagagcttgaaaaggagcaggaacaggaaagggagaaggaacgggagaaggaccgagagcggcagcaagagaaagaaaaggagctcgagaaagagcaggaaaagcagcgagagatggaaaaagagcgcaagcaggaaaaggagaaagagctggaacggcaaaaagaaaaggaaaaagaactacagaagatgaaggaacaggagaaagagtgcgaactggaaaaagagcgcgagaagctcgaagaaaagatagaacctcgcgagccaaatttggagcctatggtcgagaaacaggagagcgaaaattcttgtaacaaggaagaggagcctgtgtttactcggcaggactctaatcgctctgaaaaggaggccacaccagtagtccacgaaaccgaaccagagagtggctcccaaccacgcccggccgtactctctggctatttcaagcagttccaaaagtccttgccaccaagattccaacggcaacaggagcagatgaaacaacagcagtggcagcaacagcagcagcagggtgtcctgccccagacagtgccttcacaacccagtagctccaccgtccctccacccccgcatcgtcctctgtatcagcctatgcagccccaccctcagcacttggccagcatgggattcgatccccggtggctgatgatgcagagttatatggaccctagaatgatgtcagggcgccctgccatggatattccacccatccatccaggcatgattcctccgaagccattaatgagacgggaccagatggagggtagcccaaacagcagcgagtcatttgaacatattgcacgatcggcccgcgaccatgccataagcctgagtgaacctagaatgctctggggcagcgatccctatccccatgcagaaccccagcaggcaaccacgcccaaggctacagaggagcccgaagatgtgcgatctgaagcagcattggaccaggaacaaatcaccgccgcttattctgtggagcataaccagctcgaagcccatccgaaggctgactttattcgggaaagctcagaggcccaagtccagaagtttttatctcggtctgtcgaagacgtgaggcctcaccacacagatgcaaacaatcaaagcgcctgcttcgaggcgccagaccagaaaacactgtcagcaccacaagaggaaagaatttcagctgtggaaagtcaaccttcaaggaaacgcagcgtttcacacgggtccaaccacacacaaaagcctgacgagcagagatcagagccgtccgcaggtattccaaaagtgacctccagatgtatcgacagcaaagaaccaatcgagaggcctgaagaaaagccgaaaaaagaaggtttcatcagaagtagtgaaggcccaaaaccggagaaggtttataaatcaaaatccgagactcgctggggcccgcgcccttctagtaacaggcgcgaggaggttaacgatcgcccagtgcggcgctccgggcccattaaaaagcctgtgctgagggacatgaaggaggagcgggaacagcgtaaggagaaagagggagagaaagctgagaaagtcactgagaaggtggttgtgaagcctgagaaaacagaaaaaaaagacttgccacctcctcctcctccacctcagccccctgcacccatccagccccagtccgtgccacctccgatacaacctgaagccgagaaatttccctcaaccgagaccgctactttggcacagaaaccgtcacaggatacggaaaagcctttggagcccgtaagtactgtgcaggtagaacctgcggtgaagacggtgaatcagcagaccatggccgccccggtcgtgaaagaggagaagcagccagagaaggtgatttctaaagatctcgttatcgagagaccacggcccgactcccggccggccgtgaagaaggagagcactcttccccctagaacttattggaaggaggccagggaacgggattggttccccgaccagggctaccgtggacggggacgcggagaatattatagccggggtcggtcctatcgcggatcctacggggggagaggaaggggcggcaggggccacactagagattatccgcagtaccgtgataacaaacccagggcagagcacatcccctcgggaccactgaggcagcgggaagagtctgaaacccggagcgagtcctcagacttcgaggtggtgccgaaacgccggagacaacggggatctgagacagataccgactctgagatccacgagagcgcttctgataaagattctttgtctaaaggaaagctgcccaagagagaagagcgccctgaaaacaagaaaccagttaaacctcactctagttttaagccagataatcatgtgcgcatcgacaatagacttctcgaaaaaccatatgtccgtgatgacgacaaggccaaacccggattcctgcctaagggcgagcccacccgcaggggccgaggtggcacattccgcagaggtgggagagatcccggaggtagaccatcccgcccctcaaccctgcgccgacccgcataccgggataatcagtggaatcctaggcaatcagaagtcccaaaacccgaggatggggagcctccgcgccggcatgagcagtttatccccattgccgcagacaagcgccccccaaaattcgaacggaaattcgaccctgcaagagagcgcccccgaagacaacgaccaacaaggccccccaggcaggataagccacctcgctttcgcagattgcgggaacgcgaggctgcttcaaagagtaacgaagttgtggccgtgcctacaaacggtactgtcaacaacgtagcacaggagccagtgaataccctcggagatattagcgggaacaaaacgcctgatttaagtaaccaaaactcttccgatcaggctaacgaagaatgggagacggcgagtgagagtagtgacttcaatgaacgcagagaaagagacgagaagaagaacgccgatctgaacgcccagactgtcgtgaaagtaggcgaaaacgtgctgccacctaagcgggagatcgcaaagcgctcattctccagtcagagaccagttgaccgacaaaatcgccgtggcaataacggacccccaaagtctggacggaatttcagcggacccaggaacgagaggaggtctggacctcctagtaagtctggcaagcgcggcccttttgacgatcaaccagccggcaccaccggggtcgaccttatcaatggcagctccgcccatcaccaagaaggcgtgcccaacggcaccggccagaaaaacagtaaagattccacagggaagaagcgtgaagacccaaagcctggacccaagaagcctaaagagaaagtggatgctctgtcacaatttgatctgaataactacgcaagtgttgtgatcattgacgaccaccctgaagttaccgtgattgaagacccccaatctaacctgaacgatgatgggttcaccgaggttgttagcaagaagcagcagaaaaggctacaggatgaagagcggcgaaagaaagaagaacaggttatccaggtgtggaataagaagaacgccaatgaaaaaggacgttcgcagaccagcaagctccccccgagattcgccaagaagcaagccaccgggatccagcaggctcagtcttccgccagtgtgcctcctctcgccagcgccccacttccaccaagcacatccgcctcggtacctgcctctacttctgcacctctcccagctacactgacccccgtcccagcttcaacctctgctcccgtgccagcgagtaccctggcccccgttctcgccagcacatctgctcctgtccctgcgagtccactcgcccccgtgtctgctagtgccagcgtctctgctagcgttccggcctctaccagcgcagctgctataacgtcctcctcagccccagccagtgcccctgcacctacccccattttggccagcgtctccacaccagcctcagttaccattctggcgtccgcatctatccccattctggcgagtgccctggctagtacttcggcacccacccctgcacccgcagcaagttcccctgccgctcccgtgatcaccgccccgacaattccagcttcagctccaactgcttccgttcccctggctcccgcgagtgctagcgcacctgcacctgctcccactcccgtgtccgcgcctaacccagctcccccggcccctgctcagactcaggcccagacacataaacccgttcaaaatcccctccagaccactagccaatcttcgaagcagccgcctccatcaatacggctgcccagcgctcagacgcccaacggaacagattacgttgcctctggtaaatctatacaaactccacagtcccatggcacattaactgcagaactgtgggataacaaggtggccccgcccgccgtgctaaacgatatttcaaagaagctcggccctatttcaccgcctcagccacccagtgtgagtgcctggaataagcccttaacatctttcggtagtgccccgagctctgagggcgctaaaaatgggcaagagtccggtctcgaaatcggtactgataccatccagtttggggcacctgcctccaatggaaacgagaacgaggtggtgccagtgttgagcgaaaaaagcgctgataaaattccagaacccaaggaacagcgccagaagcagccacgtgctgggcctatcaaggcccaaaaactcccagatctcagccccgtggagaataaggaacacaagcctggtccaatcggtaaagagcgaagtcttaaaaacagaaaggtgaaggatgcccaacaggtcgagccagagggccaagaaaaaccgagccctgccactgtccgcagcacagatcctgtgacaaccaaagaaaccaaagctgttagcgagatgtcaaccgagatcgggaccatgatctcagtgagctctgctgaatatggcactaacgctaaggaaagtgtcaccgattatactacgccaagctcctctctccctaataccgtggccacaaataatacaaagatggaagataccctcgtcaacaatgttccactccccaataccctgcctttgccaaaacgtgagaccatccagcagtcctccagtctcacctctgtgccacctacgactttctccttgacatttaaaatggagagcgctcggaaagcatgggaaaacagtccaaacgttcgggagaaggggtcaccggtcacaagtactgcgcctcccatcgcgaccggggtgtctagttccgcttctggccctagtacggccaactataactcattcagttctgcaagtatgcctcaaatcccagtggcgagtgtgacaccgactgcctcactgtctggtgcggggacatacactacctcctccttatccaccaagagtactacaacctctgacccgccaaacatctgtaaggtgaagccacaacagctacaaacttcttcactccccagtgcttctcactttagtcaactctcctgtatgccttctcttattgcccagcagcagcaaaacccacaagtgtacgtatcccagtccgccgctgcgcagattcccgctttttatatggatacatcacatctctttaacacacaacacgccagactggctccaccttctctcgcccagcagcaggggttccagccaggcctgagccagcctacctccgtccaacagatcccgataccaatatacgccccactgcagggccagcatcaggcccagttgtccctgggcgcggggcccgcggtgtcgcaggctcaggagttatttagcagttccctgcagccataccgctcccagcccgcatttatgcagagctcactgtctcagccatccgtggtcctatcgggcacagctatccataacttcccaactgtgcaacaccaggaactggccaaggcccagagtgggttggcatttcagcagacaagcaacactcagccaattcccattctgtacgagcatcagctcggacaagcgtcaggcctgggcgggagtcagttgatagatacacacctgctccaggcacgggccaatttgacccaggcttcaaatctttactccggccaagtacagcagcctggtcagaccaacttttataataccgctcagagccccagtgccctgcagcaagtgaccgtgccactccctgccagccagctgtcgcttcctaactttgggtccacaggacagccactaatcgccctgccgcaaaccctacaaccccctctccagcatactacaccgcaggcgcaggcacagtctctcagcagaccagcccaggtctcccagccctttaggggtctaattccagcagggacgcagcacagcatgatagccaccactggtaagatgagtgagatggaactaaaagcttttggtagtgggatcgatattaaaccgggaactcctcccattgccggcaggagtactactcctacgtcttctccttttcgagccacctccactagtccaaacagccagtcctcgaagatgaatagcatagtttatcagaagcagttccagtctgcccccgctaccgtgcgaatgacacagcctttccctacccagtttgccccacaaatcctaagccagcccaacctagtcccaccactggttcgcgcaccacatactaacacgttcccggcacctgttcaacggccaccaatggctctggccagccaaatgccgcctcccctgacaactggacttatgtcacatgcccgactcccacacgtggctaggggaccttgcggaagtttgtcgggcgttcgggggaatcaagcccaggcagcgttaaaggctgagcaagatatgaaagctaagcagcgcgccgaagtattgcagagtacccaaaggttcttttcggagcagcagcagtcaaagcagatcggaggcgggaaggcccaaaaagtggatagtgactcctcaaagcctcccgagactttgacagatccccctggagtgtgccaagaaaaggtggaggagaagcctccacctgctccatccatcgctaccaagcctgtgcgcacaggccccatcaaaccccaagccattaagaccgaagaaacgaagtcttag

SEQ ID NO: 49822 - DNA, 7962 bp, Artificial Sequence
  Description of Artificial Sequence: Synthetic coding sequence
gtgcccaaccagatgttccagcagtacccccggatgacctaccccccactgcatggtccaatgcgattcccaccaagccttagtgaaaccaataagggcctccggggaagaggtccaccaccgagctgggcgagcgaaccagaacgtccttcaatcctttctgcttctgagcttaaggaactggacaagtttgataacctggacgctgaggctgacgaggggtgggccggcgcacagatggaggtcgactacacagagcagctgaacttttctgatgatgatgagcagggctcaaattcccccaaagagaacaactcagaagaccagggaagtaaggcctcggagaacaatgagaataaaaaggagacagatgaggtttccaatactaagagcagcagtcaaatcccggcacaacctagcgtggctaaagtaccctatggcaagggacccagcttcaaccaagagagagggaccagcagtcaccttccccccccccctaagctcctagcccagcagcatccccctccagaccgacaagcagtccctggacggcccggaccatttccttctaaacagcaggtggcagatgaggacgaaatttggaagcaacggcgaaggcagcagtctgagatctcagccgctgttgagagggcgagaaagcggcgagaagaagaagaacgtaggatggaagaacagcggaaggccgcctgcgccgaaaaacttaagcgattggatgagaaactggggatcttggagaagcagccttctcctgaggaaatccgggaaagagagcgcgaaaaggaacgcgaaagggagaaggagttggagaaagagcaggaacaggaaagggagaaggaacgtgagaaggacagagagcgccagcaggagaaagaaaaggagctggaaaaagagcaggagaaacagcgcgagatggagaaagagaggaagcaggagaaggaaaaggaactggaacgacaaaaggagaaagagaaagagctccaaaaaatgaaagagcaagagaaggagtgcgaactggagaaagaaagagaaaaacttgaggaaaaaatcgaaccaagagagccaaatctggaaccaatggtggagaagcaggaaagtgaaaatagctgcaataaagctgaggaggaaccggtgttcaccagacaagactcaaaccgctccgaaaaggaagctacgccagttgtacacgagactgagccagaatctgggagccagccccgtcccgcagtcctaagtggctatttcaaacaatttcagaaaagcttacccccccgctttcagcggcagcaggagcagatgaaacagcagcagtggcagcagcaacagcaacagggggtgctgccacaaaccgtgccctcgcagccttcttccagcacggtccctcccccgccacacaggcctctctatcagcccatgcaaccccacccacagcaccttgcatccatgggcttcgacccaaggtggttgatgatgcagagctacatggaccctcgtatgatgtctggtagaccggcaatggacattcccccgatccaccccgggatgatcccccccaaaccattgatgcgacgcgatcagatggaaggatccccgaatagctccgagagctttgaacacatagcccgcagcgcacgcgaccatgctatctccctgtctgagcctcggatgttatggggttcggacccatacccccatgccgagccacagcaggcaactacacccaaggctacggaggaacctgaggatgtgcgctcagaagccgccttggatcaagaacagattactgctgcatactctgtcgaacataatcagctagaagctcatcctaaggccgatttcattagagaatccagtgaagctcaggtgcagaaatttctttcccgatcagtggaggacgtgcgaccacaccatacggacgccaataaccaatccgcgtgctttgaggcccctgaccaaaagaccctgtctgcccctcaggaagagaggatctcagccgtggaatctcagccttctaggaagaggtcagtcagtcacggttccaaccacacacagaaaccggatgagcagagaagtgagccatctgccggcattccgaaggtgacctctagatgcatcgatagcaaggaaccaatagaaaggcccgaggaaaaaccgaagaaggagggatttattaggtcttcagaagggcccaagcctgaaaaggtgtataagtccaagtccgaaactcgttggggccctcgcccatccagtaaccggcgcgaagaggtgaatgatcgtcccgttcgcaggagtggacctattaaaaaaccggtgctgcgcgatatgaaggaggaacgagagcagagaaaggaaaaggaaggcgaaaaagccgagaaggttacagaaaaggtcgttgtgaaacctgagaagactgagaaaaaggatttgccaccaccccccccgccccctcagcccccagcacctatccagcctcagtcagtccctccccctattcaacctgaagcagaaaagttccctagtacggagacagctaccctggcacaaaagccctcccaggataccgagaagcccctagaaccagtctcaaccgttcaagttgaaccggcggtgaagactgttaatcagcaaactatggcggccccagtcgtcaaggaggaaaaacaacctgagaaagtaattagcaaagacctggtcattgaacgtccccgtccggattctaggccggctgtgaagaaggaaagcacgttgccacccagaacctattggaaagaggcccgcgaacgggattggtttcccgaccaaggatatagaggtcgagggcgcggagagtattacagcagggggagatcctaccggggtagttacggcgggaggggtcggggcgggcgcgggcacacccgcgactatccccagtaccgcgacaacaagcctagagcagagcatattccgtcaggaccactcaggcaacgcgaggagtctgagacaaggtctgaaagctcagactttgaagtcgtcccaaaaaggcgacgtcagaggggttctgagacagatactgattccgaaatacacgagtctgcgtccgataaagactccctgtccaagggaaaattgcctaaacgggaggagagacccgaaaacaaaaaacccgtgaagcctcatagctcctttaagcctgataatcatgtgagaatcgataatcgactcctggaaaaaccttatgtgagagacgacgataaagcaaaacccggattcctacctaagggggaaccaaccaggagaggaagagggggcacgttccgaagaggcggccgagatccaggcggacgcccatctcggccaagtaccctgcggcgacctgcgtacagagataatcagtggaatcctagacagagcgaggtgcctaagcctgaagacggtgagccgccccgacggcacgaacagttcattcccattgctgccgacaaaaggcccccaaagtttgagcgcaaattcgatccagcacgagagcgccctagaagacagagacccacacgaccaccacgccaggacaaacctccgcggttcaggcgcctgagggagcgggaggcggcaagcaagtcgaatgaagtcgtagccgtgcctaccaatggcacggtgaataatgtggctcaggagccagtgaatacgttgggagacatctcgggcaacaaaactccagacttgtctaaccaaaattcctcggaccaagcgaatgaagagtgggaaacagcctctgagagttcggacttcaacgagagacgagaacgggacgaaaaaaagaatgcggatcttaacgcacaaaccgtcgtcaaagtgggagagaatgtactcccaccgaagcgcgagatcgctaagcgcagtttctctagccagcgccctgtcgaccggcagaaccgacggggtaacaacgggccaccaaagtccggcaggaatttttcggggccgagaaatgaacgaagaagtggtcccccctctaaatccggcaagcggggccccttcgatgatcagcccgccggaaccacgggggttgacttgataaacggttctagcgcccaccaccaggagggggtgccaaacggaactggtcagaaaaattcaaaggactctaccggtaagaaaagggaggatcccaaacccggaccgaagaagcccaaggagaaggttgacgcgctcagccagttcgacctgaacaattacgcctctgtcgtgattattgacgatcatcctgaggttaccgtgatcgaggatccccagagtaatcttaatgacgacggtttcaccgaggttgtgagtaagaagcagcagaagagactgcaggatgaggaacgaagaaaaaaagaggagcaggtaatccaggtctggaataagaaaaatgctaacgagaagggcagaagtcagacctccaaactacccccaaggttcgccaaaaagcaagcaaccggcatacaacaggcccaaagttccgcatccgtaccccctctggcaagtgcgcccctgcccccgtctactagtgcttcagtgccggcaagcacctctgcgccattacccgctaccctcaccccagtacctgcttcaacgagtgcacccgttccagcttccactctggcccccgttctcgcatcaacttctgcacctgtcccagcaagcccattagcacctgtctcggcctcggcatctgtgagtgcttccgtgcctgcctctacctccgcagccgccataacatctagctctgctccggcctccgctccggcacccacaccaatcctggcctcagtaagtactccagcatccgtcactattctggcaagtgcatcaatcccaatcctggcgtccgccctagcctctacgtctgcacccacccccgctcccgctgcaagcagccccgccgccccagtgattacagctccaacgatccccgcgagtgcccctactgcttctgtaccactggcgcctgctagcgcatccgcgccagcccccgctccaacacctgtcagtgcgcctaacccagcacctcccgctcccgcgcagactcaggctcagactcacaaacctgttcagaatcctctacagaccacatctcaatccagtaagcaacctcccccgagtatcaggctcccaagcgctcagacaccaaatgggactgactacgtcgcaagtgggaagagtattcagaccccccaaagccacggaaccttaactgcagagctgtgggacaataaggtcgcaccccctgcagtgctgaacgacatcagcaagaagctgggtcccatctcgcctccacagccaccgtccgtctctgcttggaataagccactgaccagtttcgggtctgctccaagttccgagggggctaagaatggccaggaaagcggcctcgagattggtactgacactatccagttcggtgctcctgcctccaacggaaatgagaatgaggttgtgcctgtgctcagtgagaagagcgcggacaagatcccagagccaaaggagcagcgccaaaagcaacctagggcaggacctatcaaggcacagaagctccctgacttaagcccggtggaaaacaaggagcacaagcccgggcctatcggtaaggagaggtcccttaaaaaccggaaggtcaaggacgcgcagcaagtcgagcccgagggccaagagaaaccctctccagccaccgtaaggtccacggacccggttacaactaaggaaactaaagcggtgagcgaaatgagtactgaaatcggaacaatgatcagcgtttcaagcgcagaatacggtaccaatgctaaagagtcagtgactgattacactacacctagttcgtccctgcccaacactgtagcgacgaataataccaaaatggaggacacactagtgaataacgtgcctctccctaacaccttgccccttcctaaacgagagaccattcagcagagcagctccctgacctcagtaccaccaaccaccttctcgctgaccttcaaaatggagagtgcgagaaaagcttgggagaattcacctaacgttcgcgaaaaaggtagcccagtcacctccactgctccacccatcgctacgggcgtgagcagctccgcttcaggaccgtccacagcaaactacaactccttctcatctgcctccatgccccaaattccagttgcatctgtcacccccaccgcgtcgctcagcggcgccggcacatatacgacctccagcctgtccaccaaatctactacaacaagtgacccccctaacatctgtaaagtgaaaccacagcagttgcagacgagctctctgcctagcgcctctcacttctctcagctgtcttgcatgccgagcctgattgcacaacaacagcagaatccccaggtctacgtgagccagtcagctgctgcccagattccagcattttacatggatacatcccatctgtttaacacccagcacgcacgactcgctccacctagcctggcccagcagcagggtttccagccagggctgagccaaccaacatcagtccaacagatccctatcccaatttacgcgccactgcaggggcagcatcaggcccagctcagcctgggggcaggacccgccgtttcccaggcccaggagctgttctccagctcgctgcagccataccggagccagcctgctttcatgcaatccagcttatcccaaccttccgtggtcctttccgggacagctattcacaactttcccactgtgcagcaccaggagcttgccaaggctcagtctggacttgcctttcaacagactagcaacacgcagcccatccccatcttgtatgagcatcaactggggcaagcatctggtctgggggggtcacagctaattgatacccacctgctgcaggctcgggccaatctaacacaggcttccaacctgtacagcggccaggtacagcaaccgggacagacaaacttttataataccgcccagtccccatccgcccttcagcaggtgaccgtgccgctgccggccagccaattatccctgccgaactttggttccactggacagccattgatagccctcccccaaacattgcagccacccctgcagcatacaacgccccaggctcaggctcaaagtctgtccaggcccgcacaagtgagtcagccttttagagggctgatccccgcagggacacagcattcgatgattgccaccaccggcaaaatgtcagaaatggagttgaaggccttcggctctggcatcgatattaaaccaggaacaccaccaatagccggtaggtctaccacccctacctctagtccgtttcgagccacctccacaagtcccaacagtcaatcttctaagatgaacagtatcgtgtaccaaaagcagttccagtctgccccagcaaccgttcgcatgactcaaccgttccctacgcagtttgcccctcagattctgagccagccaaacctcgtgcctccgctagtcagggctccacacacaaacacgttcccagcccctgtgcaacggccccctatggccctggcatcgcagatgccacccccccttacaaccggactgatgtcgcatgctcgactcccacatgtagctcggggaccatgtgggagcctcagcggcgtcagaggcaatcaagcccaggcggctctcaaagctgagcaggatatgaaagctaaacagcgcgccgaagtgcttcagtcaacccagaggttcttcagtgagcagcaacagagtaagcagataggtgggggtaaggcccaaaaagtggactccgacagttcgaagccacccgagaccctcaccgatccccctggggtctgtcaggagaaggtggaagagaaacccccacctgcaccttcaatagccaccaagcccgtacgcacgggtccaatcaaaccccaagcgataaaaaccgaagaaaccaagtcctag

SEQ ID NO: 49823 - DNA, 813 bp, Artificial Sequence
  Description of Artificial Sequence: Synthetic coding sequence
atgagcaccgagatcggcaccatgatcagcgtgagcagcgccgagtatggcactaatgctaaggagagcgttaccgattacacgaccccctcatcttcgctgcccaatactgtggctacaaataatacaaaaatggaggacacactggtgaacaatgtgcccttacctaataccttgccattaccaaagcgagagaccattcagcaaagttcgagcctgacctctgtgccccctactacctttagtctgacatttaagatggagagtgcaaggaaggcttgggaaaactccccaaatgttagagaaaaaggtagtcctgtgacatccactgctccgcccatcgccacgggcgtgtcatcgtcggctagtgggccgtccaccgctaactataactcgtttagctctgcatccatgccccagataccggtcgccagcgttacacccactgctagcctaagtggcgccggtacctatactacttcatccctgagtacaaagtccaccactactagtgacccaccaaacatctgcaaggtaaagccacagcaacttcagacaagctccctgcccagtgcaagccactttagccagctgtcctgtatgccatctctgatagctcagcagcagcagaaccctcaggtatacgtgtctcagagtgctgcagcccagatccccgctttttacatggatacttcccacctctttaatacccagcatgcgcggctggccccaccatctcttgcgcagcagcagggttttcagcctggactgtctcagccaacttctgttcagcttctcaccagcactatttag

SEQ ID NO: 49824 - DNA, 8259 bp, Artificial Sequence
  Description of Artificial Sequence: Synthetic coding sequence
atgagcgagaagagcggccagagcaccaaggccaaggacggcaagaaatatgctactctgagcctttttaacacctataaaggtaaatcattggagacccaaaagaccactgccaggcacggactgcagagcctggggaaggtgggcattagtagacggatgcctcccccagccaatctaccttcactgaaggccgagaataaaggtaacgaccctaacgtaaacatagtgcctaaagacggcacagggtgggcaagcaagcaggaacagcatgaagaagagaagacacccgaggtgccccctgcccaacctaaacccggagtggccgccccacctgaggtggcacccgctccgaaatcttgggcctcaaataaacagggcggtcagggggacggcattcaagtcaacagccagtttcaacaagaattccctagtctccaagccgcgggggaccaggaaaaaaaggaaaaagagactaatgacgacaattacggcccaggcccttccctgaggccccctaatgtagcatgttggcgggacggaggaaaagccgctggatccccctccagctccgaccaagacgagaagctgcccggtcaagatgagagcacagctggaacctccgagcagaatgacattctgaaggtcgtggagaaaaggatcgcctgcgggccgccacaagccaaacttaacggtcagcaggcggctttagcctcacagtacagggcaatgatgcctccatacatgttccagcagtaccctaggatgacctatcctcccctacacggccccatgcgctttccacctagcctctctgagacgaataagggtttgaggggccgtgggccaccccccagctgggcaagtgagcccgagcgcccgtccattctgtctgcctccgagcttaaagagctggataaatttgataaccttgatgcggaagctgatgagggctgggctggagctcagatggaagttgattatacagagcaactgaatttttcagatgacgatgagcaaggcagcaactctcctaaagagaacaatagtgaggatcaaggcagcaaggcttccgagaataacgagaataaaaaagagaccgacgaggttagtaacacaaagtctagcagtcagattcccgctcaacccagcgttgctaaagtgccttatggaaagggcccatcttttaatcaggaacgcgggaccagcagtcacctaccgccgccaccaaaactgttggcccagcagcatccaccccccgaccgccaggcggtgcccggccgccctgggccatttccctcgaagcagcaggtcgccgatgaggatgagatttggaaacaacgacgcaggcagcaatccgaaatcagcgccgccgtggagcgtgcgaggaaacgcagggaagaggaggaacgccgcatggaagagcaaaggaaggcggcctgtgccgagaagttgaagcggctggatgaaaagctaggcattttagagaaacaaccttctcctgaggaaatccgtgaaagggagcgcgaaaaggaaagagagcgcgagaaagagctggagaaggagcaagagcaggagcgtgaaaaggaacgcgagaaggatcgcgagaggcagcaagagaaggagaaggagctcgagaaagagcaggagaaacagcgagagatggaaaaggagagaaagcaggagaaagagaaagagctagagaggcaaaaagagaaggagaaagaactacagaagatgaaagaacaggaaaaagaatgcgagctagaaaaggaaagggaaaagctggaggagaagatagagcctcgcgaacccaatctggaaccaatggtggagaagcaagaaagcgagaactcctgtaacaaggaagaagaaccggtattcactcgccaagattccaatagaagcgaaaaagaagccactcctgtcgtgcacgagacggagcctgagtccggctctcagcctcgtcccgctgttctgtccgggtatttcaagcagtttcagaagtctctgccgccacgcttccaaagacagcaagagcagatgaagcagcagcagtggcagcagcagcagcaacagggggttctcccgcagactgtcccctcacagccttcatcatctaccgtgccacccccccctcacagaccgctttatcagccaatgcagcctcaccctcaacatttggcttcaatgggattcgacccacgctggctcatgatgcagtcctacatggacccacgaatgatgagcggaagaccggctatggacattccccccatacaccccgggatgattccccccaagcctctaatgagaagagaccagatggagggcagcccgaactccagcgaatcattcgaacacatcgccagatcagcccgcgaccacgcaattagtctgagcgaaccgcggatgctgtggggttccgatccatatccccacgccgagcctcagcaagctactacaccaaaggctacggaagagcccgaagacgtgagaagtgaggctgctctcgaccaagaacagataacagccgcctattccgtagaacacaatcagctggaagcccatcccaaagccgattttataagagagtcctccgaggcacaggtacagaagtttctctctcgcagcgtcgaggacgtccggcctcaccacactgacgccaacaaccagtccgcatgcttcgaagcaccagatcagaaaacgctgtccgctccccaagaagagcgaatcagcgccgtggagtcccagccctctcgcaaaagaagcgtgagccacggaagtaatcacacccagaagcccgacgagcagaggagcgagccatccgctggtataccgaaggtgacctctcgctgcatcgatagtaaagagcccatcgaaagacccgaggagaagccaaagaaggagggcttcatccgcagttcagagggccctaaacctgaaaaagtgtacaagtctaagtctgagacccggtggggtcctaggccaagcagtaaccgacgcgaggaggtgaacgatcgtcctgtgcggagatccgggcctattaagaaaccagtgcttagagacatgaaggaagagcgcgagcagagaaaagagaaggagggggaaaaagctgaaaaagttactgagaaagtcgtggttaagccagagaaaaccgagaagaaagatctgcctccacccccacctcccccacaacccccagcccctatccagccacagtctgttccaccaccaatccagccagaggcggagaagttccccagcacagagactgccaccttggcccagaaaccttcacaggataccgaaaagccgctagaacccgtaagtaccgtccaggttgagccggccgttaaaaccgtaaaccagcagacaatggctgcccccgtcgtcaaagaagaaaagcagcctgagaaggtgatctccaaggacttagtgatcgaacgacctagaccggactcccgccctgctgtgaaaaaagagtcaactctgccgcctcggacttactggaaagaggcacgggaaagggactggttcccagatcaaggctaccgtggacgcggaaggggcgagtattactcgcgaggcagaagctataggggaagctatggcggccggggacgcggaggacgggggcatacacgcgattatccccagtacagggataacaagccccgagccgagcacatccccagcggtcctctgcgccaacgagaagagtcagagacgcggagcgagtcatctgattttgaggttgtgcccaagcgaaggcgccagcgggggagtgagacagatacggacagcgagattcatgagtctgccagcgataaggacagtctgtccaagggcaaattgccaaaacgggaggagagaccggaaaacaaaaagccagtaaagccccattcaagctttaagcccgataaccacgtacgaatcgacaatcgactgctagagaagccctacgttcgggatgatgataaggccaagcctggatttctgccaaagggggaaccaactcggagaggaaggggaggtacctttcgcagagggggccgggacccagggggaagacctagcaggccctcaacactccgtaggccggcgtatcgggataatcagtggaacccacgccagtctgaggtccccaagcctgaggacggcgaaccgcccagaagacacgagcaatttatacccatagccgccgacaagaggccaccgaagtttgagagaaaattcgaccccgcacgggagagacctcgacgccagaggcctacacgcccccccaggcaagataaaccaccccgatttcggcgccttagagaacgtgaggcagcctctaagtccaatgaggttgtagccgtaccgactaatggcacagtaaacaatgtggcgcaggagcctgtgaacacattaggagatatcagtggcaacaagaccccagatctcagcaaccagaattccagcgaccaggctaacgaggagtgggagaccgccagcgagagctcggatttcaacgagaggcgcgaacgagacgagaagaagaatgctgaccttaacgctcagacagtggtgaaggttggcgagaatgtgcttcccccaaagcgcgagattgccaagcgcagctttagttcccagcgaccagttgacaggcaaaacaggagagggaacaatgggcctccaaagtctgggagaaacttctctggaccccggaacgagaggaggtccgggcctccgagtaagtccggaaagaggggtccttttgacgatcagcccgccggaaccacaggtgtggacttgataaacggtagttcggctcatcaccaggagggcgttccaaatgggaccggccagaagaacagtaaagattccacaggaaagaaaagggaggatcctaagccagggccaaagaagccaaaggagaaggtagacgccttgtcacagtttgacctgaacaactatgcatctgtagtcattattgatgaccacccagaagttacagtgatcgaagatcctcagagcaatttaaatgatgatggcttcacagaagtggtctcaaagaagcagcaaaagaggctgcaggatgaggaacggcgcaagaaagaggagcaggtcatccaggtttggaacaagaaaaacgccaatgagaagggaaggagccaaacatctaaactgcccccccggttcgcaaagaagcaggcgacaggaatccaacaggcacagtcctccgcctcagtgccacctctggcctcagctcccctcccaccgtcaactagtgcatccgtgcccgcatcgacttccgccccactgcccgctactttaacccctgtcccggcatcaacgtctgcccctgtgccagcttcaacacttgcgcctgtgctggccagcactagtgctcctgttccagcctcccccctggctcccgtgagcgctagtgccagcgtgtccgcgagtgttccagcttccacttccgctgcagctattacttcttcctcggctccagcctcagcccccgcaccaaccccaatcctcgcaagcgtgtccaccccagctagcgtgaccattctggcctcagcctcaatcccgatccttgcatccgctctagcaagtacttcagctcccaccccggcaccggcggcctctagcccagctgcgccagtgatcacagcgccaacgattccagcatccgcacctaccgccagtgtgcccctggcacccgcctctgccagcgcgcccgcgccagcccccacacctgtcagtgcccctaatccggctccgccagccccagcccagacccaggcgcaaacccataagcctgtccagaatccactccagaccaccagccaatcttcgaagcagcctcccccatcgatcagactgccaagcgcccagacacctaatggcacagactatgtggcatcaggaaaatctattcagaccccacagtcacacggcactctcacagccgagctctgggataataaggtggcccccccagctgtgctgaatgatatcagcaagaagttggggccaatctcacccccccagccacctagtgtgtccgcgtggaataaaccactcactagctttggaagcgcaccaagcagtgagggtgcgaagaacggacaggaaagcggcctggagatagggacagatacgattcaatttggcgccccagcatctaacgggaacgagaatgaagtggttccggtcctgtcagaaaaaagcgctgacaaaatacctgagcccaaggaacagaggcaaaagcagcctcgcgctggtccaattaaggcccagaagctgccagacttgtcccctgtcgagaacaaggagcataagcccgggcccatcgggaaagaaaggtctctcaaaaatcggaaggtaaaggacgcacaacaggtggaacctgagggtcaggaaaagccctctcctgcgactgtgcgctctaccgatcccgtgactacaaaagaaaccaaagcagtctccgaaatgagcactgagattggaactatgatcagcgtgtcctctgctgaatacggaactaatgctaagatggagagcgccagaaaggcctgggaaaacagccctaatgttcgagagaagggtagccccgtcacaagtacagcacctcccattgcaaccggcgtgagctcttctgcatcgggtcctagcactgctaactacaacagtttctcttccgccagcatgccccagattcccgtcgcctccgtgacacccacggcttcactgagcggcgccggcacgtataccacaagttctctgagtacgaaaagcacaacaacatccgatcctcctaacatctgcaaggtgaagcctcagcagttgcagacatcttctctgccgagtgcctcccacttttcacagttatcatgcatgccctcgttaatcgctcagcagcagcagaacccacaagtctatgtcagccaatccgctgctgcccagataccagcattctatatggacacatcccatctcttcaacacacagcatgctcgactggcccctcccagcttggcacagcagcagggatttcagccaggtctgtcccagcccacctcagtgcagcagatccccatcccgatctatgctcccctgcaagggcaacatcaggcccagttgagtctgggggccggcccagctgtgtcacaggctcaggaactattcagtagctcactgcagccttacaggtcacaacctgcattcatgcaatctagtttgtctcaaccgtccgtggtcctatccggaacagctatacacaacttccctactgttcaacatcaggaactggccaaggcccaatccgggctggcatttcagcagacgagcaatacccagccgatccctattctgtatgagcaccagttgggtcaggccagcgggctcgggggttcacaacttattgacactcacttactgcaggcccgagcaaatcttactcaagcctccaatttgtattccggccaggtgcagcagcctggacagactaacttttacaatacagcgcagtcgcctagcgccctgcagcaagtgacggtgcctctccctgcaagtcaactgtccctgcccaacttcggaagtacgggccagcccctcattgcgctcccgcaaactttacaacctccgctgcagcacactacaccccaggcccaggcccaaagcctgagcagacctgcccaggtgtcgcagccttttcgcggactgattccagccggaacccaacatagtatgatcgccaccaccgggaagatgagtgaaatggagctaaaggcctttgggtctggtatcgacatcaagccgggcaccccaccgatcgccggacgatccacaacaccaacatcctccccattcagggctacatcaaccagtccaaattctcagagcagtaagatgaacagcatcgtctaccagaagcagttccaatccgctcccgccacggtgagaatgacacaaccctttccgacacaatttgctccgcaggctaagcagcgagctgaggtactgcaatcgacccaacgatttttctctgagcagcaacagtccaagcagattgggggtggtaaagcccaaaaagtggattctgattcatccaagccacccgagactttaactgacccacctggggtgtgccaagaaaaggttgaagaaaaaccccccccggcgccttccattgcaaccaagcctgtgaggacaggacctatcaagcctcaggcaattaagaccgaagagaccaagagctag

SEQ ID NO: 49825 - DNA, 8553 bp, Artificial Sequence
  Description of Artificial Sequence: Synthetic coding sequence
atgagcgagaagagcggccagagcaccaaggccaaggacggcaagaaatatgctacgctgtccctcttcaatacctataaagggaagagcctggagacccagaagaccactgcccgccatggcctacagtctctgggcaaggttgggatctcccgtcggatgcctccacctgccaatcttcctagccttaaagcagagaataaagggaatgatcctaacgtgaacatagtaccaaaagacggtacgggctgggcctctaaacaggagcagcacgaggaggagaagacacccgaggtgcccccagcccagcccaaaccaggagtggctgcgcccccggaagtcgcccctgccccaaagtcttgggcaagtaacaagcagggagggcagggggacgggattcaggtaaacagccaatttcagcaggaattcccttcccttcaagccgccggcgaccaggagaagaaagaaaaagagacgaacgacgataattatggtccgggtccttctctgcgcccccccaacgtggcatgttggagggacgggggtaaagctgcaggttcaccttcatcgagcgaccaggacgaaaaactacctggacaggacgagtccacagctggaacaagcgaacagaacgatatcttgaaagtcgtggaaaagaggattgcctgtggcccaccacaagccaagcttaatggtcagcaggccgcactcgcttcccagtaccgcgcaatgatgcctccatatatgtttcagcaatacccacgcatgacttatccccccctgcatgggccaatgagattccctcccagtctgtcagagaccaataagggtctcagaggcaggggacctccccctagctgggcatccgagcccgaacggccctctatcctctcggctagtgaacttaaggagcttgataagttcgataacctggacgccgaagctgacgaggggtgggctggtgcccagatggaggttgactacactgagcagctcaactttagcgacgacgacgaacaggggagcaattcccctaaagaaaataactccgaggaccaggggtccaaagctagtgaaaacaatgagaataagaaagaaaccgacgaagtctccaacacgaagtcctcatcccagataccggcacagccctccgtcgctaaggtcccctatgggaaggggccatcttttaaccaggagcgtggtacttcgagtcacctgcctccccccccaaaactgttggctcagcagcatcccccgccggaccgacaggccgtgccagggcgacccggacccttccccagcaaacagcaggtcgcagatgaggatgaaatatggaaacagagacgccggcagcagtctgagattagcgcagccgttgagagggctaggaaacgacgggaggaagaagaaaggagaatggaagaacagcggaaagccgcctgcgcagagaaactgaagagactggatgagaaactgggcatcctggaaaagcaaccgagcccagaagagatccgggaacgagagcgggagaaggaacgtgagagggagaaagagctggagaaagagcaggaacaagagcgagagaaagaacgtgagaaggaccgggaaagacaacaggaaaaagaaaaagaactggaaaaagaacaggagaagcagagagagatggagaaggagcggaagcaggagaaggagaaggagctggagaggcagaaggaaaaagagaaggaactccaaaaaatgaaggaacaagaaaaggagtgcgaacttgagaaagaacgcgagaagttggaggaaaaaatcgagccccgcgaaccaaacttggaacctatggtggagaaacaggaaagcgaaaacagctgtaacaaggctgaagaggaaccggtcttcactcgtcaagactcaaacagaagcgagaaagaagccacaccagttgtgcacgagaccgaacctgagtcagggtcacagccaaggcctgccgtgctgtctgggtactttaagcagtttcaaaagagtttgcctccccgcttccagaggcaacaagagcaaatgaagcagcaacagtggcagcaacagcagcagcagggagtgctgccccaaactgtgccaagtcagccgtcatcctcaacagtgcctcctcctccacatcgaccactttaccagccaatgcagccccacccgcagcatctggcatcgatgggattcgaccccagatggttgatgatgcaatcctacatggacccccggatgatgagtgggagacccgcaatggatataccacccatccatcccggcatgatccccccaaaacccttgatgagacgggaccaaatggaaggttcccccaatagtagcgagtctttcgagcatattgctcggtcagctcgtgaccacgcaataagcctgtccgagccccgtatgttatggggcagcgacccatatccccatgcagaaccacagcaagccaccacccctaaagctacagaggagccagaggacgtgcggtcagaggccgcattggaccaggaacagataactgcggcttatagcgtcgagcacaaccaactggaagcccaccccaaggccgattttattcgggagtccagcgaagctcaggtgcagaaattccttagtaggagcgtcgaggatgtgcgcccccaccacacggacgctaacaatcagtccgcctgtttcgaagccccagatcagaaaacactgagcgcacctcaggaggagaggatctccgctgtggagagccagccatccagaaagcggagcgtgtctcatggttcgaaccatactcagaagccagatgagcaacgaagtgagccatccgcaggcattccaaaagttacaagtagatgcattgactccaaggaacctattgagcgtccggaagaaaagccaaagaaggaaggattcatacggagcagtgagggtcccaaacctgagaaggtgtataagtcaaaatctgaaacacgatggggcccccggccttcctccaatcggcgtgaggaggttaacgacagaccagttagacgctcggggcccatcaaaaagcctgtgctgcgcgatatgaaagaagagcgagaacagcggaaggaaaaggaaggtgaaaaggcggagaaagtgacggaaaaggtggtggtgaagccagagaaaacagaaaaaaaggatctcccacctcctcccccaccacctcagccccctgcccctatccaaccccagagtgtgccaccgcccatacagccagaggctgagaaatttccctccaccgagaccgcgaccctggcccagaagccaagccaggatacggagaaaccgctggaacccgtcagcactgtccaagtagaacccgccgtcaagaccgttaaccagcaaactatggccgcaccagttgtcaaggaggagaagcagcctgagaaggtcattagcaaagacctggtgatcgaaagacctcgtccggacagccggcctgccgtgaagaaagagtctacactgcctccacggacatattggaaggaggcgcgtgagcgtgattggttcccagaccagggataccgaggaaggggcagaggtgagtattactcgagagggaggtcctatcgcggctcctacggaggcagggggcggggcggtagaggccatacccgggactaccctcaatacagagataataaaccccgagccgaacatattccaagtgggcccctgcgtcagcgagaagagtctgaaacaaggtcagaaagcagcgacttcgaagtggtccccaaacgccggaggcagcggggcagcgagaccgataccgacagtgaaatccatgaatcagccagtgataaggatagcctgtccaaaggcaaactacccaagcgggaagagagacccgagaataagaagccggtgaagccacattcaagctttaaacctgataatcatgttcgaattgacaacaggctcttagagaaaccttatgtgcgcgatgatgataaggcgaaacccggcttcttaccaaaaggggagcccacgaggcggggcagagggggaaccttcaggaggggtggtagggacccaggcggcagaccatcaaggccctcaactctgagaagacccgcttatcgtgacaaccagtggaatccaagacaatctgaggtacctaagccagaggatggggaacctccacgacgccacgaacagttcattcccatagcagccgacaagaggcccccgaagtttgaacgcaaatttgatcctgctcgggagagacctaggagacaaaggccaacgcggccaccccgccaggacaagccgcctcggtttcgaagacttcgagaaagagaggcggcctcaaagagcaacgaagtcgttgcagtacctaccaacggtacagtaaacaacgtagcccaggaacctgtcaacaccctaggggacatatccggtaacaaaacaccagatctaagtaaccaaaactcttcggaccaggcaaacgaagaatgggagacagcttccgagtcctctgatttcaacgaacggcgcgagcgcgatgagaaaaagaacgctgacttaaatgcacagactgtagtgaaggtcggggaaaacgttctgccacccaaaagagaaattgccaagcgcagcttttcctcccagcgtcccgtcgataggcagaacagaagagggaataatggaccaccgaagagtggtcggaactttagtgggccaaggaacgagaggcgcagcggaccacctagcaagagcggcaaacgtggaccattcgacgatcagccagctggcacaactggcgtggaccttataaatggctcctcggcccaccatcaggagggagtacctaacggaacaggtcagaagaatagcaaggatagtacaggaaaaaaacgagaagatcccaagcctggaccaaaaaagccaaaagaaaaagtcgatgccttgagtcagttcgacctaaataattacgcatcagtggtaatcatcgacgatcacccggaagtgactgtgattgaggatccgcaaagcaaccttaatgacgatggatttactgaagtggtgtctaagaagcagcagaaaaggctgcaagacgaggagcgaaggaagaaagaagaacaagttatccaggtttggaacaagaagaatgctaatgagaaagggaggagtcagacttccaaactgcctccacgcttcgccaaaaaacaggccaccgggatccaacaggctcaatcctctgccagcgtgccaccactggccagcgccccactacccccttcgacgctcgcacctgtcagtgcctctgctagcgtttccgcttccgtgcccgcaagtacctctgccgctgccataacaagcagcagcgcccctgccagtgcccccgcgccgacaccaatccttgccagcgtctctacccccgcctccgtcaccatcctggcaagcgcttctattcccatcttggccagcgccctggcttccacgagcgccccgactcctgcgcccgccgcatcctctcccgctgctcccgtcatcacagcccccacaattccagcttcagctcccacggccagcgtgccattggctccagcttcagccagtgccccagcgcccgctccaactccggtttcagctcccaatccggctccgccggccccagcccagacgcaggcccagacacataagcctgtccagaaccccctgcagacaacctcccagtccagcaaacaaccccctccatccatacgtctgccctctgctcagactcccaatggtacggactacgtggcctccggcaagagcatacagacacctcaatcccatggtacactgaccgccgaactgtgggacaataaggttgcaccaccagccgtgcttaacgatatttctaaaaagttgggccccatctccccaccacagccaccaagcgtgtcagcctggaacaagccactcacatcgtttgggtctgctccctctagcgaaggagccaagaatggccaagagagcggcctcgaaatcggcaccgatacaatccagtttggagctcccgcgagtaatggaaatgaaaacgaggtcgtgccagtgctgtccgagaaaagcgcagataagatccccgaacctaaagaacaaaggcagaagcaacctagggccggacctatcaaagcacagaaattgccagacctcagcccagtggagaataaagaacacaagccaggtcctattggaaaagagcgcagtttgaagaacagaaaagtaaaggacgcccagcaggtggaacccgaaggccaggagaagcccagccccgccacagtgcgatcaacagatcctgtcactacaaaggagaccaaggctgttagcgagatgagcaccgaaattggcactatgataagtgtgtcttctgcagaatacggcacaaatgcgaaggaaagtgtgacagattacacaaccccctcgagttccctgcctaacacagtggccacaaataataccaaaatggaagatacccttgtaaataacgtccctctgcctaacacgcttccactgccgaagagagagactattcagcaatctagctccttgaccagcgtacctcccactacctttagtcttactttcaagatggaatccgcaagaaaggcctgggagaatagcccaaacgtgcgggaaaagggaagtcccgtcactagtacagccccacccatcgccacgggggtgagttcatccgcatctgggccatccaccgctaactacaatagcttttcttccgcatccatgcctcagatccccgtcgctagtgtgactccgaccgcttctcttagcggtgccggcacttatacaacaagttctctgtctactaagagcaccaccactagcgatccccccaatatttgtaaagtgaaaccccagcaactgcagacatcatcactgccatcagcttctcatttttcgcaactctcctgtatgccgtccctgattgctcagcagcaacaaaacccccaagtttacgtgagccagtctgccgctgcacagatcccggctttctatatggacacaagccatctcttcaatacgcaacacgctcgcctggcaccccccagccttgcacaacagcagggcttccagcctggtttgagtcaaccaacctctgttcagcaaattcctattccaatctacgctcctctccaaggccaacaccaggctcagttgtctctcggcgctggacctgccgtgagccaggcacaggaattgttctccagttctctccagccgtaccgctctcagcccgccttcatgcagagcagtctgagccagccttctgttgtgctgagcgggaccgccatacacaatttcccaaccgtgcagcaccaagagttggccaaagcacagtccggactggcattccaacagaccagtaacacccaaccaatcccgattctctatgaacatcagctgggccaagccagtgggctgggaggctcgcagctgattgatacacatcttttgcaggcgcgtgccaacctcacacaggcaagcaacttgtacagcggccaggtacagcaacctggacagacaaatttctataatactgctcagtctccgtccgctttgcagcaggtgactgtgcctcttccagcatcccagctgtccctgcctaactttgggtccacagggcagccactgatcgccctccctcagaccctccagccaccactccaacacactaccccacaggcccaggcacaaagtctaagcagacctgctcaggttagccagccttttcgaggattgatccccgccgggacgcagcacagcatgatagctactactggtaagatgagcgagatggagctaaaggcgttcggttcggggattgacatcaagcccggaacccccccgattgccggcaggtcaacgacccccactagttctccgtttcgagcaacatccacttctccaaacagtcagagctccaagatgaacagcatcgtgtatcagaaacagttccagtctgctcccgccaccgttcgcatgactcagccgttccccacccagtttgctccccagattctgtcccagcccaatctagtccctccactggtgcgagctcctcacacaaatacctttcctgcccctgtgcaaaggccccctatggccctggcctcgcagatgcccccacctcttacaaccggcctcatgagccacgcaaggctcccccacgtggcccgcggcccttgcggcagtctctctggtgtgagaggaaaccaggctcaagctgccctgaaagctgaacaggatatgaaagccaagcagcgtgctgaggtactgcagtccacccagaggttttttagtgaacagcagcagtctaagcaaatcggaggtggcaaggcccagaaggtggactccgacagtagtaagccacctgagacgttgaccgacccacctggagtctgccaggagaaagtcgaagagaagcccccgcctgccccctccatcgctaccaaacctgtcagaacgggccctatcaaaccgcaggcaattaagaccgaggaaaccaagtcctag

SEQ ID NO: 49826 - DNA, 2292 bp, Artificial Sequence
  Description of Artificial Sequence: Synthetic coding sequence
atcctgccccccacccagatgttccagcagtacccccggatgacctaccctccgctccacggacctatgaggttccccccgagtttgtctgaaaccaacaagggccttaggggccgaggtcccccgccttcatgggcgagcgaaccagagagaccaagtatactcagcgcttccgagcttaaggagctagacaaattcgacaacctggatgccgaggcggacgagggttgggccggggcacagatggaagtagattatacagagcagctcaactttagtgacgatgacgaacagggctccaattcccctaaggaaaataattccgaagaccagggttccaaagctagtgaaaataatgagaacaaaaaagagactgatgaggtcagcaacacaaagtcatcttctcagataccagcccagccctctgttgccaaagttccttatggcaaaggacccagttttaaccaggagaggggtaccagcagtcatcttccacctccacccaaactgctagcccaacagcaccctccgcccgataggcaggctgtgcccggcagacccgggccgtttccctctaaacagcaggttgccgatgaggatgagatttggaagcagcgacggaggcagcagtcggaaattagcgctgccgtggagagagctaggaaacgaagagaagaggaggagcggcgcatggaggaacaacgtaaagccgcttgtgctgaaaaactgaagcggctggatgaaaaacttggaatcctcgagaaacagccaagcccagaggagatccgcgagcgcgagcgcgaaaaggagcgtgagcgagaaaaggagctcgagaaggagcaggagcaagagcgcgaaaaggaaagggagaaagatcgcgagcggcaacaggaaaaggaaaaggagctcgagaaggaacaggagaaacagcgggaaatggaaaaggagcggaaacaggaaaaagaaaaagaactggagcggcagaaggagaaggagaaggaactccagaaaatgaaagagcaagaaaaggaatgtgagctggaaaaggaacgagaaaagctcgaggagaagatcgagcctagagagccaaatctggaacccatggtagaaaagcaggaaagcgaaaattcatgcaacaaggccgaggaagaaccagtcttcacgcggcaggactcaaataggtcagaaaaggaagctactcctgtggttcacgaaacggaaccagagtcagggagccagcctcgtcccgcagtgctgtctggctacttcaagcagttccagaagagcctgcctcctagatttcagcggcagcaagaacagatgaaacagcagcagtggcaacagcagcagcagcaaggagttcttcctcaaaccgtgccatcacagcctagcagttctactgtgcctccccctccccacaggcccctttaccagcccatgcaaccccacccgcagcaccttgcttctatgggattcgatccacgctggcttatgatgcaatcttatatggacccgcgaatgatgtctggtaggcctgcaatggacatcccaccaattcatcctggcatgatacctcccaagcctttaatgcgcagggatcaaatggaaggctccccaaatagcagcgaaagttttgaacatatcgctagatccgctcgggatcacgcgataagcctgtcagagccccggatgctgtggggatccgatccgtacccccacgcggaaccccaacaagctaccacacccaaggctaccgaagaacctgaggacgtccgctcggaggcagctctagaccaagagcagattactgcagcgtactccgtggagcataatcagctagaggctcatcccaaggcggatttcatcagagagagctctgaggcccaagtgcagaagttcctgtctagaagtgtcgaggacgtacggccccaccacaccgacgcgaacaatcagagcgcctgttttgaagcgcctgatcaaaagactttgagcgcacctcaggaagaacgtatttcggcagtggaatcccaaccatcgcgcaaaaggagcgtaagccatggcagcaaccatacacagaaacccgacgaacagcgctctgaacccagtgcagggatacctaaggtgacaagtcgttgcattgacagtaaggaaccgattgagaggcccgaggaaaagcccaagaaagagggttttatacgatcctctgaagggcccaagcctgagaaggtgtacaagagcaagtctgagacaagatgggggcctaggccatcctctaaccggagggaagaatag

SEQ ID NO: 49827 - DNA, 930 bp, Artificial Sequence
  Description of Artificial Sequence: Synthetic coding sequence
atgctgctgatcctgctgagcgtggccctgctggccctgagcagcgctcagtccctgaacgaagacgttagccaggaggagtcaccatccgtcatatccggaaagcccgaaggacggagacctcaggggggaaaccagccccagcggacccctcccccccccgggaaaccagaggggcgcccccctcagggggggaaccagagccaggggccccctccccgcccaggcaagcccgagggaccccccccccagggcggaaaccagtcccagggacccccccctcggccggggaaacccgagggtcagccgccccaggggggaaaccaatcacaaggcccccccccccggccaggcaagcccgaggggcccccaccccaaggcgggaaccaatctcagggacctcccccgaggccaggcaaacccgaggggccaccccctcagggaggaaatcagagtcaaggacccccgccacgcccggggaaaccggaagggccgcctccccaaggagggaatcagtcacagggaccaccccctcacccgggtaaacccgagggacccccccctcagggagggaatcagtctcagggcccaccccctcgtccgggcaagcctgaaggaccccccccacaggggggaaaccagtctcaaggaccaccaccgcgtcccgggaagccagagggacctcctagtcagggggggaataaaccgcaagggcccccacctcaccccggcaaaccccagggcccgcccccccaggaaggaaataaaccacagcgcccccctcctccaggccgccctcagggtcctccccctccaggaggaaacccacagcagcctcttcccccgccagccggcaagccccagggcccacccccccctccgcaaggcggtaggccccatcgcccccctcaggggcaacctccccagtag

SEQ ID NO: 49828 - DNA, 930 bp, Artificial Sequence
  Description of Artificial Sequence: Synthetic coding sequence
atgctgctgatcctgctgagcgtggccctgctggccctgagcagcgcgcaaagtcttaatgaagacgtgtcccaggaggagtcacccagcgtgatcagtggtaagcccgaaggtagacggcctcagggtggcaatcagccccagaggacaccacctccaccagggaagccagaagggcggcctcctcagggcgggaaccaatcgcaggggccacctccaagacccggaaagcccgaaggcccccctccgcaaggcggaaatcagtctcagggacccccaccacgaccgggcaagccggagggccaacctcctcagggcgggaatcaaagtcaggggccgcctccccggcctgggaaaccggagggtccccctccccagggaggcaaccaatcccagggccctccccccagacctgggaaacccgaggggccccccccacagggcggaaatcaaagccagggccctcctccccaccccggaaaaccagaaggcccccccccccaaggaggcaatcagagccaaggcccacctccgaggccagggaagcctgagggccctcccccccagggtggcaaccaaagccaaggcccacccccacggcccggcaaaccggaggggccaccgccgcaaggaggcaatcaatcccaaggtccacccccaaggcccggcaagccagagggtccaccatcacagggtggcaataaaccacaaggccctccaccccatcccgggaagcctcagggccctcctccacaggaagggaacaagccacagaggccgcccccccctggaaggccgcaaggaccccccccacctgggggaaacccacagcagcctctaccgccacctgcaggcaagccccaggggcctccccctcccccgcagggtgggcggcctcaccgcccacctcagggtcagccaccccagtag

SEQ ID NO: 49829 - DNA, 501 bp, Artificial Sequence
  Description of Artificial Sequence: Synthetic coding sequence
atgctgctgatcctgctgagcgtggccctgctggccttcagcagcgctcaagacctcgacgaggacgtgtcccaggaagacgtcccactggtgattagtgatggtggggactctgaacagttcatcgacgaggagcgacagggccccccgttaggcggacagcaaagtcagcccagtgccggggatggaaatcagaatgatggaccgcagcagggtcccccacagcagggcgggcagcagcagcaaggccctcctcctccccaggggaaaccccagggacctcctcagcaagggggtcacccacctcccccacaagggcggccccagggccccccccagcaaggaggacacccaagacctccccgtggacgaccccaggggcctccacagcagggagggcaccagcagggccctcctccgcccccccccggcaagccgcagggaccgccaccccagggcggccggccacagggacctccacagggacagagcccccagtag

SEQ ID NO: 49830 - DNA, 501 bp, Artificial Sequence
  Description of Artificial Sequence: Synthetic coding sequence
atgctgctgatcctgctgagcgtggccctgctggccttcagcagcgctcaggacctggatgaggatgtatcccaagaagacgtaccgctggtaatctccgatggtggagatagtgaacagtttatcgatgaagagaggcagggcccgccccttggcgggcagcaaagtcagccatcagcaggggacggcaatcagaatgatggcccgcagcagggtcctccccagcaaggtggccagcagcagcaggggccaccaccaccccaggggaaaccccagggccccccgcagcagggaggtcaccccccacccccacagggcagacctcagggccctccgcagcagggcgggcatccaagacccccacgtgggcgtccccaaggccccccccagcaaggagggcaccagcagggcccccctccgcctcctccgggaaagcctcaaggcccacccccccaggggggccgccctcagggtcctccccagggtcagtcgccccaatag

SEQ ID NO: 49831 - DNA, 501 bp, Artificial Sequence
  Description of Artificial Sequence: Synthetic coding sequence
atgctgctgatcctgctgagcgtggccctgctggccttcagcagcgctcaagacctggatgaggatgtcagccaagaagacgtgccccttgtaatttcagacgggggtgactctgagcagtttattgatgaggagcggcagggtccaccgctcgggggacaacagtctcagccaagtgccggagatggaaaccaaaacgatggaccacaacaagggccaccacagcaaggaggtcaacagcagcagggtccgcctcccccgcaaggcaaaccacaggggccgcctcagcagggagggcatccccctcctccccagggccgaccccaaggaccgccccagcaagggggtcatccacggccgcccaggggccgcccacagggtcctccccagcaggggggccatcagcaaggaccgccccccccccctcccggtaaacctcagggccccccaccccagggtggaaggccccagggcccaccccaagggcagtcgcctcagtag

SEQ ID NO: 49832 - DNA, 501 bp, Artificial Sequence
  Description of Artificial Sequence: Synthetic coding sequence
atgctgctgatcctgctgagcgtggccctgctggccttcagcagcgcacaggatcttgatgaagatgtgagtcaggaggatgtcccactggtgatctccgatggtggggactctgagcagtttatagatgaggagcgacaaggccctcccctaggtgggcaacagtctcagccctcggcaggcgatggaaaccagaacgatggcccgcagcagggccccccccaacaaggaggacagcagcaacaggggccccctcctccacaggggaaaccacagggacctccacagcagggaggccatcccccccccccacaggggagacctcaggggccaccacagcagggtggccaccctcggcctccgcggggtaggcctcaaggcccaccacagcaagggggacaccagcagggacccccccctccccctcctggcaaaccacaaggccctcccccacagggtggaagaccacaggggcctcctcaggggcagagtccccaatag

SEQ ID NO: 49833 - DNA, 486 bp, Artificial Sequence
  Description of Artificial Sequence: Synthetic coding sequence
atgttcagcctgcccctgaactgcagccccgaccacatccggcggggcagctgctggggtcgtcctcaggatttgaagattgccgccccagcatggaattccaaatgtcatccaggcgccggggctgccatggctaggtgcaagaacgcagacggagtggagctgtacaatgaaatagagttctatgcgaaggtaaactctaaggatagtcaggacaagcggtcttccagaagtattacctgttttgtgaggaaatggaaagagaaggtggcatggcccagactgactaaagaggacattaagccagtttggctctccgtggatttcgacaactggagggattgggagggggacgaagaaatggagctagctcacgttgagcactacgcagaactgctgaagaaggtctcaactaaacgcccgccaccagcaatggatgacctggacgatgatagcgactctgccgacgatgcaacttcaaattag

SEQ ID NO: 49834 - DNA, 387 bp, Artificial Sequence
  Description of Artificial Sequence: Synthetic coding sequence
tgacagcacgcccggaccctgtggtacgaccggcccagctgcaagaacgcagatggagtcgagctgtacaacgaaatagagttttatgcaaaggtcaactctaaggacagccaggacaagaggagcagtaggtctatcacatgctttgtccggaaatggaaggagaaagtggcctggccaaggctgaccaaggaggacattaaacccgtgtggctgtctgttgatttcgacaattggagagactgggagggtgatgaggaaatggaattggcacacgtggagcactacgccgagctgctcaaaaaagtatctacgaagagacccccaccggctatggatgatctggatgacgacagcgattccgcagatgatgccacatctaactag

SEQ ID NO: 49835 - DNA, 297 bp, Artificial Sequence
  Description of Artificial Sequence: Synthetic coding sequence
atgcggaagatgaacaccctgctgctggtgagcctgagcttcctgtacctcaaggaagtcatgggcctgaagtgtaatacatgcatttacacagagggctggaagtgcatggccggacggggcacttgcatcgcgaaggaaaacgagctgtgcagtactacagcttactttagaggtgacaagcatatgtattcaacacatatgtgtaaatacaaatgtagagaagaggaatcatccaagcgtggacttctaagggtgaccctgtgctgcgatcgcaatttctgcaacgtattttag

SEQ ID NO: 49836 - DNA, 345 bp, Artificial Sequence
  Description of Artificial Sequence: Synthetic coding sequence
atggccggcctggccctgcagcccggcaccgccctgctgtgctactcatgcaaagcccaagtgtctaacgaggactgcctgcaggtggagaattgcacccagctgggcgaacagtgctggaccgccagaatcagagccgttggtttgctaactgtgatcagcaagggctgttccctgaattgtgtcgacgacagtcaagattactatgttgggaagaagaacattacatgctgcgataccgacctgtgcaatgcttctggtgctcatgccctgcagcccgcagcagcgatcctggcgctgttaccggcccttggtctgctactgtggggaccaggacaattgtag

SEQ ID NO: 49837 - DNA, 312 bp, Artificial Sequence
  Description of Artificial Sequence: Synthetic coding sequence
atgggcagccggtgcgccaagctgaacaccggccagagccccggccattccccaggccattctaccggacatgggcgtggacatgaaagctcaatgaagaagctaatggcctgtgtttctcaggataacttttcgctgtcaagcgccggtgaagaggaagaagaagaagaggaagagggtgaagaggaagagaaagaggagttgcctgtgcaaggcaaactgcttttactagagccagagcgccaagaagaaggtcataaagataacgccgaagctcagcagagccccgagcctaagaggactccgagctag

SEQ ID NO: 49838 - DNA, 744 bp, Artificial Sequence
  Description of Artificial Sequence: Synthetic coding sequence
atgaacctgctgctgatcctgaccttcgtggccgccgccgtggccgcacccttcgatgacgatgacaaaatcgtgggaggctacatctgtgaggaaaattcagtgccctatcaagtgtctttgaacagtgggtaccatttctgtggaggatctctgatttcggaacagtgggtggtatccgcggggcactgctataagtcaagaatccaggtgcggcttggtgagcataatatagaagtcctggaaggcaacgagcagtttataaatgcagccaaaatcattcggcatcccaagtataactcacgcaccctcgataacgacattttgctgatcaaactatcgtctcccgccgtaattaattcgcgcgttagcgccatatccctcccaacagcccctccggccgctggtacagaatccctgattagtggctgggggaataccttgtcaagcggagccgactacccggatgaattgcaatgtctggacgcccccgtcctctctcaggcagaatgcgaggcatcataccccggaaagattacgaacaacatgttctgtgtgggttttttggaagggggcaaagattcttgccagggtgatagcggcggaccggtcgtttccaacggcgagctccaggggattgttagctggggctatggatgcgcgcagaaaaatcggccaggcgtgtatacaaaggtttataactacgtggactggattaaagacaccattgcagcaaacagttag

SEQ ID NO: 49839 - DNA, 525 bp, Artificial Sequence
  Description of Artificial Sequence: Synthetic coding sequence
atggcctgcggccccggcgacctgcagagcctgaccagccccctgagttccgcaaggctggactaccaaccctccatagagggtccttggctgagagcctgcggacagactaacgtctcttgcagagtcgtgaagggcaagctggttgaggtcggcaaatggccatggcaggtctcaatcctgttcctcgggacctacatttgttccgggagcctgattcatcaccagtgggtactcacagcagcccactgcctgcagagattcaaggacctatcactctactctgtgatggtgggcgtgcatcagcgtcctgagaactccacacagcttccgctgaccaggatggtcattcataaagacttctctaacctgatgtcccaggacatcgccctcctcaaacttagggactctatcagctggtctccattcgttcagcccgtgtgcctccccaatatcaagttcaagcctagcattgggtctatgtgttgggtgatcggctggggtaccaccggcaagaaaggatag

SEQ ID NO: 49840 - DNA, 726 bp, Artificial Sequence
  Description of Artificial Sequence: Synthetic coding sequence
atgaagttcatcctgctgtgggccctgctgaacctgaccgtggccctggccttcaaccccgattatacagtgtcttcaactccaccatatctagtctacctcaagagtgactacctcccttgtgccggggtgctgattcacccgctttgggttatcacagcagctcactgcaacctcccaaaactaagagttattctgggggtcacaatccctgcggattctaatgagaagcacctccaggtgattggttacgaaaagatgattcaccacccacacttctctgtgacctcaatcgaccacgatattatgctgatcaagctgaagacggaggccgaattaaacgactatgtgaagttggcaaaccttccatatcagaccattagcgaaaacacaatgtgcagcgtgtcgacctggtcctataacgtgtgtgacatttataaggaacccgactctcttcaaacggtgaacatcagcgtaatcagcaaaccccaatgcagggatgcctacaagacctataatatcaccgaaaacatgctctgtgtgggcatcgtcccaggacggcgccagccatgcaaggaagtgagtgcagcaccggctatttgtaacgggatgttacagggcatcctgtcctttgcggatggatgtgtgctgcgggcagatgtgggaatctacgcaaagatcttttattatataccttggatagagaacgtcattcagaacaattag

SEQ ID NO: 49841 - DNA, 783 bp, Artificial Sequence
  Description of Artificial Sequence: Synthetic coding sequence
atgacccggcactggccctgggaggtgagcctgcggatggagaacgaacatgtctgtggcggcgcacttatcgacccttcctgggttgtaacagccgcccactgtatccaaggcacaaaagaatactccgttgtgctgggaactagtaagttacaaccaatgaatttttcccgcgccctatgggttcccgtccgagacattattatgcatcctaaatactgggggcgcgctttcataatgggagacgtcgcccttgtccacctccagacaccagtcacattttctgagtacgtccagcctatatgcctccccgaaccaaatttcaatctgaaggtaggaactcagtgctgggttacaggttggagtcaggtgaaacaaagattctcggctaacagtatgctcactcctgaactccaagaagccgaggtgttcatcatggacaacaagcgttgcgacagacactataagaaatctttcttccctcccgtagtaccactggtgctgggagatatgatatgtgccaccaactacggggaaaatctgtgttacggagactccggtggtccactcgcatgtgaagtcgaaggcagatggatcctggcaggagtgttaagttgggagaaggcctgcgtcaaggcacaaaaccctggagtgtacacccggattactaagtacactaagtggattaaaaagcaaatgagcaatggggccttcagcgggccatgtgcgtccgcttgcctcctttttctgtgctggttgctccagccacagatgggcagctag

SEQ ID NO: 49842 - DNA, 687 bp, Artificial Sequence
  Description of Artificial Sequence: Synthetic coding sequence
atgacccggcactggccctgggaggtgagcctgcggatggagaacgagcatgtgtgtggaggcgcgctgattgatcctagctgggtggttactgccgcgcactgcatacagggtacaaaggagtactcagtggtgctcggaacctctaaactccagccgatgaacttcagtcgcgccctctgggtgcccgtgagagacattatcatgcatccaaagtattggggacgagcatttattatgggtgacgtcgctttagtccacctgcaaacgcctgtgactttctcgagcaccgctaacagtatgctgactccagaactgcaggaggcagaggtgttcattatggacaacaagcgttgcgataggcattataaaaagagtttttttcccccagtggttccactagtcttaggcgatatgatctgtgctaccaattatggcgaaaatctttgttacggagatagcggaggccccctcgcttgcgaagtagagggccgatggatccttgctggcgtgctgtcttgggagaaagcatgcgtaaaggctcagaatcctggggtgtacactcgaatcactaaatacacaaaatggattaagaagcagatgagcaatggagccttcagcggtccatgcgcgtccgcttgtcttctcttcttatgctggctcctacaaccacagatgggcagctag

SEQ ID NO: 49843 - DNA, 1179 bp, Artificial Sequence
  Description of Artificial Sequence: Synthetic coding sequence
atggccgcccccctgcggatccagagcgactgggcccaggccctgcgtaaggatgagggcgaagcttggctgagctgtcatcctcccgggaagccctccctgtacggatccctcacttgtcagggcattggtttagatgggatcccagaagtgaccgctagcgagggctttaccgtgaacgagattaacaagaaatctattcacatctcttgtccaaaggagaatgcctcgtcaaaattcctggccccttacaccacatttagccggattcacacaaagagcatcacgtgcctcgatatcagtagtcgtggggggctcggtgtgtcctccagcactgacggtactatgaaaatctggcaggccagcaacggtgaactgaggagagttctggagggccatgttttcgatgttaactgctgcaggttcttccccagtgggcttgtggttctgtcaggtggtatggatgcccaactgaaaatatggagcgcggaagacgccagctgcgtagtcacttttaaaggccataagggaggcattctcgataccgccattgtggaccgtggccggaacgtcgtgtctgcgtctcgcgacggaaccgcccgcctctgggactgtggaaggtctgcgtgtttaggggtcttggctgactgtgggtcaagcatcaatggagtggcagtgggggcagctgacaactctatcaatctgggttctcctgagcagatgcccagcgaaagagaagtcgggactgaagcgaaaatgctgcttctcgctagagaagacaagaagctgcagtgtctcggcctccagagtagacagttggtgttcttgttcatcggcagtgatgccttcaactgttgtacttttttgtcgggatttcttttattggcgggcacacaggatggaaacatctaccagcttgatgtgaggagtccacgggcgcccgtgcaggtgatccataggagcggagcccctgtgctctctctactcagtgttcgagatggctttatagccagtcagggcgacgggagttgcttcattgtccagcaagacctagattacgttacggaactcacaggggcagactgcgacccagtgtataaggttgccacatgggagaagcaaatctacacctgttgtagggacggccttgtgaggcgataccagcttagcgacctctag

SEQ ID NO: 49844 - DNA, 1128 bp, Artificial Sequence
  Description of Artificial Sequence: Synthetic coding sequence
atgctggtgccctgcttcctgtacagcctgcagaaccggaagccctcactctacggttcacttacttgtcagggtattgggctggacggaatccccgaagttactgccagcgagggatttacagtgaatgaaatcaacaagaagagcattcatatatcttgtcctaaggaaaacgctagttccaaattcctcgcgccatatacaactttcagcaggattcatactaagtctatcacttgcctcgacatttctagtcggggcggccttggcgtgtctagttccaccgatggaactatgaaaatctggcaggccagcaatggagaactgcgcagagtgcttgagggccacgtgtttgatgtgaattgttgtaggttcttcccctctgggctcgtggtgctgtccggaggaatggatgctcagttgaaaatttggtccgcggaagatgcttcttgcgtggtcacctttaaaggccataagggcggaattcttgatacagcgatcgttgatcgagggcgtaatgtggtgtctgcatcgagagatgggaccgcaaggctttgggattgcggacgaagcgcatgtctcggcgtgcttgccgactgcggctcctctattaatggcgtggcggtcggggccgctgataattcgatcaacctgggcagccccgagcagatgccttccgaacgcgaggtcggaaccgaggcaaagatgctattgctggctcgcgaggacaagaaactgcagtgccttggcctgcagtcaaggcagctcgtatttctgttcattggatcggatgccttcaattgctgcactttcttgtcaggctttctgttactcgccggtacccaggacggaaatatctaccagctggacgttcggagtccacgggcccctgtgcaagtcatacaccgttcaggggctcctgtgctcagtcttctcagcgttcgagacggcttcatcgcctcccagggggacggctcgtgttttattgttcagcaggacctcgattacgtgaccgagctgaccggcgctgattgcgaccccgtttacaaggtggcaacttgggagaagcagatttacacgtgctgcagggacggcctggtcagacgatatcagctcagcgacctctag

SEQ ID NO: 49845 - DNA, 714 bp, Artificial Sequence
  Description of Artificial Sequence: Synthetic coding sequence
atgctggtgccctgcttcctgtacagcctgcagaaccggaagccctcgctatacggctccttgacctgccagggtatcggactcgacgggatccctgaagtcacggcctctgaaggcttcacggttaatgagatcaataaaaagagtatccacatctcgtgccccaaggagaatgctagctctaaatttctggcaccatatacaactttttcacgcatccacacgaagtcaatcacttgcttggatatatctagtcgggggggtcttggagtgtcctcatctacggacgggactatgaaaatctggcaagcttcaaatggtgaattaagacgggtacttgaaggacacgtgttcgacgtgaattgctgtaggttcttcccttccggcctagttgttctttctggtgggatggacgcacagttgaaaatctggtccgccgaggacgcaagctgtgtggttacgtttaagggacacaaaggcggaatccttgacacagcaattgtggaccggggtaggaacgttgtgtccgccagtcgcgatggcacggcacgtctgtgggactgtgggagatccgcctgtcttggtgtgctggctgattgtggcagttccatcaacggagttgccgttggcgctgccgacaactccattaatctggggtctcctgagcaaatgcctagtgagcgtgaggtggggaccgaggcaaagatgctgtag

SEQ ID NO: 49846 - DNA, 1128 bp, Artificial Sequence
  Description of Artificial Sequence: Synthetic coding sequence
atgctggtgccctgcttcctgtacagcctgcagaaccggaagcccagcctttacggcagcctgacttgccagggtatcggcttagatggcattccagaagtaaccgctagtgagggcttcacggtaaacgaaatcaataaaaagtctattcacatctcatgtcccaaagaaaatgctagctcgaagtttctagccccttatacgaccttttcaagaatccacactaaatccataacatgtctcgacatctcgtcaagaggagggttaggggtcagctcttctacggatggaaccatgaaaatctggcaggccagtaatggcgagctgaggcgggtgcttgaggggcatgtgtttgacgtgaactgctgcaggttttttcccagtggactggttgtgctgagcgggggaatggacgctcagcttaagatctggtccgctgaagatgccagttgcgtggtgacatttaagggacataagggagggatacttgacacagccatcgtggatcgaggacgaaacgtcgtctccgcttcccgagacggaacagctcgactgtgggactgtggacggtctgcatgcttgggggtgctggctgactgcggctcatccataaatggcgttgctgtcggagccgcagataacagtatcaaccttgggagtcccgagcagatgccatccgagagggaggtcggaacagaagccaaaatgctcctactggcccgcgaggacaagaagttacagtgtcttggactgcagagcaggcagctagtctttctattcatcgggagcgatgctttcaattgctgcacattcctgagtggctttctgctcctggccggaactcaagacggaaacatctatcagctcgacgttaggagccctcgtgccccagtccaagttattcaccggagcggagctccagttcttagtttactttctgtgagggacgggttcatcgcttcccagggggacgggagctgctttatagtgcaacaggacctggactatgtgactgaattgacgggagccgactgtgatccggtgtataaagtggcgacatgggagaaacagatctatacttgctgcagagatggcctggttcgaagataccaactgtcagatctctag

SEQ ID NO: 49847 - DNA, 744 bp, Artificial Sequence
  Description of Artificial Sequence: Synthetic coding sequence
atgctggtgccctgcttcctgtacagcctgcagaaccggaagcccagcttgtacgggtccctgacctgccagggtataggactggatggcatcccagaagtgactgcctccgagggcttcacggttaatgagatcaacaaaaagagcatacatatttcctgccccaaggagaatgccagctcaaagttcctggcgccctacacaactttcagccgcatccatacgaaatcgatcacatgcctcgatatcagcagcaggggcgggttaggcgtatcatcttctactgacgggactatgaagatctggcaagcttcgaacggggagctaaggagggtgttggaagggcatgtcttcgatgtgaattgctgcaggttctttcccagcggcctggttgtgctttcagggggcatggatgcacagttaaaaatttggtcagcagaggatgcttcttgcgttgtaacattcaaggggcataaaggcggtattttagatacagccattgttgatcggggtcgtaacgtagtttctgcatccagagatggtaccgctcgtctgtgggattgcggcagatccgcgtgcctgggagtgctggccgactgcggctcctctataaatggcgtcgcagttggagcagctgacaatagcatcaatctcggtagccccgagcagatgccaagtgagagagaagtagggacagaagctaaaatgctgctcctagccagggaggataaaaaactacagtag

SEQ ID NO: 49848 - DNA, 1128 bp, Artificial Sequence
  Description of Artificial Sequence: Synthetic coding sequence
atgctggtgccctgcttcctgtacagcctgcagaaccggaagccctcgctgtatggcagcttgacctgtcagggtatcggactcgacggcatccctgaggtgactgcctccgaaggtttcacagtgaatgagattaataaaaagtccatccacataagttgtcccaaggagaatgcttcatcgaagttcctagctccatacacgactttctcccgtattcataccaaatctattacttgcttggatatcagttcccggggagggctcggagtgtcatcatccacggatggcaccatgaagatctggcaggctagcaatggagaactcaggcgcgtgctggaggggcatgtctttgatgtgaattgttgccgcttcttcccctccggactagttgttctgagcggtgggatggacgcccaactgaaaatttggagtgcagaagacgctagttgcgtcgtgacctttaagggacataagggaggcatcttggatactgccatcgtagaccgcggcaggaacgtggtttccgctagccgggacggaaccgcaagattgtgggattgtgggcggtctgcttgcctgggcgtgcttgctgactgtggcagttcaattaacggggttgccgtcggcgcagctgataacagcatcaacctcggcagccctgagcagatgcccagcgaacgggaggtgggcactgaagccaaaatgttgctgctggcccgcgaggacaagaagcttcagtgccttggacttcagagccgacagctggtcttcctgttcataggcagtgatgcctttaattgctgcacatttcttagcgggttcctactgcttgccggcacccaggacggtaatatttaccagcttgacgtgagatccccacgcgctcctgttcaggtgattcataggtctggggctcccgtgctgtccctgctcagtgtgagggacgggttcatcgcctcccagggcgacggctcctgtttcatagtgcaacaagacctcgactacgtcacagagctgactggcgccgattgcgatccagtctataaggtggcgacctgggaaaaacaaatttatacttgttgccgcgatgggttggtgagaagataccagttgtctgacctctag

SEQ ID NO: 49849 - DNA, 1566 bp, Artificial Sequence
  Description of Artificial Sequence: Synthetic coding sequence
atgaagcaggagggcagcgcccggcggcggggcgccgacaaggccaaaccgcccccagaggatgtggagatgaaggaagaagccgccacgggggggggctctactggggaggctgatggcaaaactgccgcagccgctgctgaacactcacagcgagagttggatactgtcaccctggaggatattaaagaacacgtgaagcaattggaaaaagctgtgtctgggaaagaaccacggtttgtactgagggcccttaggatgctgccatccacaagccggagattgaaccactatgtactgtacaaggccgtccagggcttctttacctctaacaatgcgaccagggattttctcctgcccttcctagaagagcctatggacacagaggccgacttacagttccggccacgcaccggcaaggcggccagcacaccacttctcccagaagtcgaagcatacctccagctattggtggtaatttttatgatgaactcaaaaagatacaaggaggctcagaaaatctccgacgatcttatgcaaaagatcagtacacaaaataggcgcgccctagatctggtggccgccaaatgttattactaccacgcacgagtctacgagttcctcgataaattagatgtggtacgcagctttcttcacgccagactgaggactgccacattgaggcatgacgcagatggccaggctaccctgctgaacttgctgctgcgcaattacctgcactactctctgtacgatcaggccgaaaaacttgtgtccaagagcgtgttcccagagcaggctaacaacaatgagtgggccaggtacctctattacactggaagaatcaaggctatccagctggaatactccgaagccagaagaacgatgacaaatgcgcttcggaaagccccacaacataccgcagtgggcttcaagcagactgttcataagctgttaattgtggtggaactgctgcttggcgagattcccgacaggctacaattcagacaaccctcgctgaagcgcagcctgatgccatactttctgctcacacaggctgttaggacaggcaatctggccaagttcaaccaggtcctggatcagttcggggaaaaatttcaagccgacggcacctatactctcattatccggctcagacacaatgtgatcaagaccggggtccggatgatctctttgagctatagcaggatcagtttggcagacattgcccagaaactgcagctcgattctcctgaagatgccgaattcatagttgccaaagctatacgtgacggcgtcatagaagcttccatcaatcacgaaaagggatatgttcagtctaaagagatgatagacatctacagcacaagggagccacagctggctttccaccagagaattagcttctgcctcgacatacacaacatgagcgtgaaggccatgaggttccctcctaagtcctataacaaggacttggaatctgccgaggagcgcagagaacgagaacagcaggatctcgaattcgccaaagaaatggccgaagatgatgacgattccttcccatag

SEQ ID NO: 49850 - DNA, 348 bp, Artificial Sequence
  Description of Artificial Sequence: Synthetic coding sequence
ctgaccagcccccggagctgcagctggatcgcccccaagatgcagtcttctttactggcccaggccattcgagacggagtgattgaggcgagcataaatcacgagaaaggttatgtgcagagcaaggaaatgatcgacatttactccacacgagaacctcagctcgcgtttcaccagcgcatcagtttttgcctggatatccataacatgtccgtgaaagccatgcgctttcctcctaaaagctacaacaaagatttggagagtgccgaggagaggcgagagcgcgagcaacaagaccttgaattcgctaaggagatggcagaagacgacgacgattcttttccttag

SEQ ID NO: 49851 - DNA, 1071 bp, Artificial Sequence
  Description of Artificial Sequence: Synthetic coding sequence
atggacaccgaggccgacctgcagttccggccccggaccggcaaggccgcctccacgccactgctccccgaggtggaggcttacttgcagctgttagtggtgatctttatgatgaacagtaaaaggtataaagaggctcaaaagataagcgatgatctcatgcagaagatcagcacgcagaatagaagagcactcgacttagtcgcagccaagtgttattattaccatgcacgggtctatgagttccttgacaaactggacgtggtaagatctttcttgcacgcccgattgagaaccgcaactctcagacacgatgcagacggacaggctactttgctgaacctgctattaagaaactacctccactatagcttgtacgatcaggccgagaagctagtcagcaagtctgtgtttccggagcaggcgaacaataatgaatgggcaaggtacctgtactacacagggaggattaaagctatccaactggaatattctgaggctagacgcacaatgacaaatgcgttacgaaaggcaccacagcatacagccgtggggtttaagcagaccgtgcataagttacttatcgtggttgaattactacttggcgaaattccagaccgtctgcagtttagacagccatccctgaaaagatcactcatgccatactttctgctgactcaggctgtgcgcactgggaatctggcaaagtttaaccaggtgctcgaccagttcggcgaaaagtttcaggctgacggcacatacacactgatcatcaggcttaggcacaatgttatcaagaccggggtgcgcatgatctccttaagctattccagaatatccctggcagacattgcacagaaactgcagttggattctccagaagatgctgaatttatagtggccaaggccatcagggacggggtcattgaggcaagcattaatcacgagaagggttatgtacaaagtaaggagatgatagatatctactcaacacgcgaaccccagcttgcatttcaccagcggataagcttttgtctggacattcacaatatgagcgtcaagggttggtag

SEQ ID NO: 49852 - DNA, 369 bp, Artificial Sequence
  Description of Artificial Sequence: Synthetic coding sequence
atggaggacacccccctggtgatcagcaagcagaagaccgaggtggtgtgtggagtgcccacccaggtggtgtgtacggcattctcttctcatattttagtcgtggttacccagttcggtaagatgggaacattggtctccctggagccttcttccgtagcaagtgacgtatcaaagcctgtcctcaccactaaggtacttttgggccaagacgaaccactgatccacgtgttcgccaagaatctggtcgcgtttgtatcacaagaggctggcaatcgagctgtgctcctcgccgttgccgtgaaggacaagagtatggaagggctgaaggccctcagagaggtgatccgcgtgtgccaggtctggtag

SEQ ID NO: 49853 - DNA, 369 bp, Artificial Sequence
  Description of Artificial Sequence: Synthetic coding sequence
atggaggacacccccctggtgatcagcaagcagaagaccgaggtggtgtgtggtgttcccactcaggtggtctgtaccgctttttcttcccacattttggttgtggttacccagttcgggaagatgggcacccttgtcagcttagagcccagtagtgtagcctcagacgtaagtaaaccggtgttaaccactaaggtcctcctcggccaggacgaacctctgatccatgtgtttgcaaaaaatctcgttgccttcgtgtcacaagaggctggcaacagagccgtacttctggctgtggccgtaaaagacaagagcatggaggggctaaaggcgttacgggaagtaatacgggtgtgccaggtatggtag

SEQ ID NO: 49854 - DNA, 369 bp, Artificial Sequence
  Description of Artificial Sequence: Synthetic coding sequence
atggaggacacccccctggtgatcagcaagcagaagaccgaggtggtctgtggagtgcctactcaggtggtgtgcacagcattttcctcgcatatcttggtggtcgtgacccagttcggtaaaatgggcaccctggtcagtttagagccctcttcagttgcttcagatgttagtaagcctgtcctcacgactaaggtacttcttggacaggacgagccactcatacatgtatttgccaaaaacttggtggcatttgtgagtcaagaggccgggaacagagcagtgcttctagccgttgctgtcaaagataagtccatggaggggttgaaggccctgagagaggtcatcagagtttgtcaggtgtggtag

SEQ ID NO: 49855 - DNA, 489 bp, Artificial Sequence
  Description of Artificial Sequence: Synthetic coding sequence
atggagggcctggtggtggccgccggcggcgacgtgagcctgcacaatttcagcgccaggctgtgggaacagttagtgcacttccatgttatgaggctgacagacagcctgttcctgtgggtgggcgcaaccccacatctgcgcaacttggcggtcgcaatgtgctccagatacgatagtattcctgtctcaaccagcttactcggcgatactagcgatactacttccactggcctggcacagagacttgggctgggaggaaagactggtctggcctgtgaatgtggggtcgagtggggattgagcaaaggccacgaggccgagtgcagcacactgcctaccccccagcatacctcttgtggtccggcgcgcaagacgaacaagcaggtttttgtttcttacaacctccagaataccgattcaaactttgccctattggtcgagaacaggatcaaagaagagatggaagcatttccagagaaattctag

SEQ ID NO: 49856 - DNA, 372 bp, Artificial Sequence
  Description of Artificial Sequence: Synthetic coding sequence
atggagggcctggtggtggccgccggcggcgacgtgagcctgcacaactttagcgccaggttgtgggaacaactggttcacttccacgtgatgcggttgacagattctctgtttttatgggtgggtgcaacaccccacctgcgaaacctggcagtggctatgtgctcacgctacgactccatccctgttagcacgagcttgctcggagacactagcgatacaacctccaccgggttagctcagcggctggccaggaagaccaataagcaggtgtttgtaagttacaacctacagaatacggattcaaattttgcattactagtggagaatagaattaaagaagagatggaagctttcccggaaaaattctag

SEQ ID NO: 49857 - DNA, 315 bp, Artificial Sequence
  Description of Artificial Sequence: Synthetic coding sequence
atggagggcctggtggtggccgccggcggcgacgtgagcctgcacaatttttctgcccgcctttgggagcagttagtgcatttccatgtgatgcgtctcaccgattctttatttctctgggtgggggccacgcctcacctgcgaaacctggccgtggcaatgtgctctcgctatgactctatccctgtgtcaacaagtttgcttggtgacaccagtgatactaccagcacaggccttgcccagaggctcggcatgtacccccagctggccctgcatggccagcctggcggagcacactcactgatggaaccttag

SEQ ID NO: 49858 - DNA, 639 bp, Artificial Sequence
  Description of Artificial Sequence: Synthetic coding sequence
atggccagccggtacgaccgggccatcaccgtgttcagccccgacggtcacctcttccaggtcgagtacgcccaggaggccgttaagaaggggagcacggcggtaggtatccggggacttactgctgatgcccgcgtggtgattaacagagcccgcgtggaatgccagagccataagctcaccgtggaggaccccgtcacagtagagtacattacccggttcatcgccaccttgaaacagaagtatacacaatcaaatgggcgtcggccctttggcatttcagctttgatagtgggctttgatgatgacggaatctctcggctctaccagaccgatccttcaggcacctaccatgcatggaaggctaatgctatcggccggagcgccaagactgtacgagagttcctcgagaagaactatactgaggacgccattgcctccgatagcgaggcaattaaattggccatcaaagctctcctggaggtggtccagtctggcggcaaaaatatcgagctggctatcattcgccggaaccagccactgaaaatgttttctgccaaggaggtggagttgtacgttactgaaattgagaaagagaaggaggaggccgaaaagaagaagtctaaaaagtccgtctag

SEQ ID NO: 49859 - DNA, 753 bp, Artificial Sequence
  Description of Artificial Sequence: Synthetic coding sequence
atggccagccggtacgaccgggccatcaccgtgttcagccccgacgggcacttgttccaggtggagtatgcgcaggaggccgtaaagaaaggctcgaccgctgtcggaattcggggcaccaacattgtcgtactgggtgtagaaaagaaatctgtggccaaactgcaggatgaacggacagtgagaaagatttgtgccctggatgaccatgtctgcatggcctttgctgggctgactgcagatgcaagagtggtcatcaatcgggcaagagtcgagtgccagtctcataagctgaccgtcgaagatccagtcacagtcgaatatattactcgatttatcgcgactttaaaacagaagtatacacaaagcaacggaaggcgcccatttgggattagtgccctcatagtcggatttgacgatgacggaatttcacgcctctaccagaccgatccaagcgggacctatcatgcctggaaggctaatgctattggccggagcgccaaaacggtgagggaattcctcgagaagaattataccgaggacgccatagctagcgatagcgaagccatcaagctggccattaaagcactgctggaggtcgtacagtccgggggaaagaacatagaactagcgatcatcaggaggaaccaacccctaaagatgttcagcgcaaaggaagtggaactgtatgtcactgagatcgagaaggaaaaggaagaggctgagaaaaaaaagtccaaaaagtctgtttag

SEQ ID NO: 49860 - DNA, 639 bp, Artificial Sequence
  Description of Artificial Sequence: Synthetic coding sequence
atggccagccggtacgaccgggccatcaccgtgttcagccccgacggacacctatttcaggtggagtatgcacaggaggcagttaaaaaggggtccacggcggtgatttttatcggacttacagctgacgctagggtcgtgatcaaccgagctagagtcgaatgccagtctcataaactgacagttgaagacccagtgacggtagagtatattactagatttatagccactcttaaacagaagtatacccaaagcaacgggcggcgcccctttggaatctcggctctcatcgtcggcttcgatgatgatggtatctcgagactctaccagactgatccatcagggacgtaccacgcatggaaggctaatgcaattggtcggtccgcaaaaactgtacgggaattcttggaaaagaactacactgaggatgccatcgcaagtgatagcgaggccattaaacttgctatcaaagccctcttggaagttgtgcagtccggcgggaaaaatatcgaactcgctatcattcgtcgaaaccaaccccttaagatgttctctgctaaggaagtggaattgtacgttaccgagatcgaaaaggaaaaagaagaagcagagaagaagaaatctaagaagtccgtgtag

SEQ ID NO: 49861 - DNA, 636 bp, Artificial Sequence
  Description of Artificial Sequence: Synthetic coding sequence
atggacgtgtgcaccttcgagaaggtgggcatccggggcaccaacattgtcgtgctgggcgtggaaaagaagagcgtggctaaactccaggacgagcggaccgtcagaaagatatgcgcacttgacgatcatgtgtgcatggcttttgcagggctgacagcagacgcgagagtggttatcaatagagctcgcgtggaatgtcaatcacacaagctcaccgttgaggatcctgtgaccgtagagtacatcacacgctttatcgctacgctcaagcaaaaatacacacagagcaatggaaggcgcccatttggcatcagtgctctgattgttggttttgatgatgatggcatttctcggctgtaccaaacagatccctcaggcacctaccacgcatggaaggcgaacgcgatcggtcggtccgctaagaccgtgcgggagtttctcgaaaaaaactacactgaagatgccatcgcatcagacagcgaggccatcaaacttgcaatcaaagcgcttcttgaagtcgtgcagtccggcgggaagaatatagaactggccatcataaggagaaatcagcccctcaagatgttcagcgcaaaagaggtcgaattgtacgtcacagaaattgagaaggagtag

SEQ ID NO: 49862 - DNA, 1632 bp, Artificial Sequence
  Description of Artificial Sequence: Synthetic coding sequence
atgaactgcctggagggccccggcaagacctgcggccccctggcctccgaggaagagcttgtcagcgcatgccagttggaaaaagaggaggaaaacgagggagaggaggaagaggaggaggaagacgaagaagatctcgaccccgaccttgaccccgacctcgaagaggaggagaatgacttgggggatcccgccgtgctcggcgcagtgcacaacacccagcgcgcattactgtcctcgcctggagtgaaagccccaggtatgctcggtatgtcactggcctccctgcactttctgtggcagactctggattacctgtctccaattccgttctggccaacatttccctctacctcctcaccggctcaacacttcggacccaggctccctagcccagatccgacactgttctgttctctcctcaccagctggccacctcgcttctcacatctcacacaacttcacccgaggcaccaaaggatcctacagcagcaacaacactcccagaccccttcccctcccgcaaaaaaaccgtggagccagcagcctgatccctatgccaatctcatgaccagaaaggaaaaggactgggtgattaaggtccaaatggttcagttgcagtcggccaagccccgcctggatgattactattatcaggaatattaccagaagttggagaagaaacaggccgatgaggagctccttggccggcggaacagagtcgagtctctaaagttggtgacaccatacattcccaaggcagaggcttatgagagcgtggtacgtatagagggttcactgggacaggtggccgtgtcaacctgtttctcaccaagacgcgctatcgatgccgtgccgcacgggacacaagagcaggacatcgaagctgcttcatcccagcgcctgagagtgctgtataggatcgagaagatgtttctccaactccttgagattgaggaggggtggaagtaccggcctccgcccccctgtttttccgagcagcagtccaaccaggtagagaagctgtttcagactctcaaaacacaggagcagaataatctcgaggaggcagctgatggatttctacaggtcctgtcagtgcgtaagggcaaggcactcgtggcccgactcctgccgtttctcccccaggaccaagcagtgaccatcctgctcgcaatcacacatcatctgcccttgctagtgcgcagggacgtcgctgaccaagcactgcagatgctctttaagcctttaggcaaatgtatcagtcacctgaccctgcacgaactgctccaaggcctgcagggactcactttgttacctccgggctctagtgagaggcctgtgacagtggtgctacagaatcagtttggaatctccctcctgtatgcgctgctgtctcatggggagcagctggtgtctctccattcatctctggaagagcccaattccgatcacactgcttggactgacatggtggtactgattgcatgggagatcgcacagatgccgaccgcaagcctcgccgaacccctggcctttccctccaatctgctgcccctattttgtcaccacgttgataagcagctggtccagcagttagaggcacgcatggagtttgcttggatatactag

SEQ ID NO: 49863 - DNA, 1632 bp, Artificial Sequence
  Description of Artificial Sequence: Synthetic coding sequence
atgaactgcctggagggccccggcaagacctgcggccccctggccagcgaagaggaactggtgagtgcctgtcaactggagaaagaggaggagaacgaaggggaggaggaagaagaagaagaagacgaagaggatctggatccagatctcgacccggacttggaagaggaagagaatgatctcggtgaccctgctgttctgggagccgttcataacacacaaagagccctgctcagcagccctggggttaaggctccagggatgttgggtatgagcctggcgagcctgcactttctttggcaaacactggactacctgagtccaattccattctggcccacatttcctagcacctcctcaccagcgcaacacttcggccctcgactgccaagcccagacccaaccctgttctgtagcctccttacaagctggcctccacgattttctcacctgacccagctccatccaagacaccagcggatactgcagcagcagcagcacagtcagactcctagtccacccgcgaagaagccctggagccagcagcccgacccctatgccaatctgatgacaagaaaggagaaagactgggtgattaaagtgcagatggtgcaattgcagtccgctaagccacgtctagacgattactattatcaagagtactatcagaagctggagaaaaaacaggcagatgaagaactgctcgggcgaagaaaccgcgtagaatccctgaaacttgttactccctatatacccaaagccgaggcttatgagtctgtggtgcgtatcgagggcagtctggggcaggtcgcagtgagtacttgcttttccccccgacgcgccatagacgctgttccgcatggaacacaggagcaagacatcgaggccgcgagtagccagagacttcgtgtcctttaccggattgagaagatgttcttgcaattactggaaatcgaggagggatggaaatatagacctcccccaccctgcttctccgagcagcaaagtaatcaggtggagaaattatttcaaactttgaagacacaggagcagaataatctcgaagaagccgcagacggatttctgcaggtactcagcgtaagaaaaggcaaggcactggtggcccggctgttaccgtttcttccgcaagatcaggctgtaacgatcctcttggccattacccatcatcttccactgcttgtgaggcgtgatgttgcggatcaggctttacagatgctgtttaaacccctgggaaaatgtatctcccacctcacgcttcatgagttgctgcagggcctccaggggctgaccctactaccacctggatcatctgagcgaccggtgacggtggtactacagaaccagttcggcatttctctcctgtatgcccttctaagccacggcgagcaactggtgagtctccacagcagcctggaagaacctaactcagaccacaccgcctggaccgatatggtggtcctgatcgcctgggagattgcccagatgcctaccgcatcactggctgagcccttggccttcccaagcaacttgctccctttgttctgccaccatgtggacaagcagctggtgcagcagctggaagcacggatggagtttgcttggatctactag

SEQ ID NO: 49864 - DNA, 6708 bp, Artificial Sequence
  Description of Artificial Sequence: Synthetic coding sequence
atgcccctgttcttcagcgccctgctggtgctgctgctggtggccctgtcagctctgtttctgggacgatggttagttgtgcgactcgccactaagtggtgccagcggaagctgcaggccgaactgaagatcggatcttttcgctttttctggatccagaacgtgtctttgaagtttcagcaacatcagcagaccgttgagatcgacaatctgtggatcagttccaagctcctctctcatgacctgccccactatgtggcgctttgcttcggcgaagtgcgtattcgaacagatcttcaaaaagtgtccgacctctcagccccttttagtcaatctgctggggtggaccagaaggaactctctttttcccctagcttgctgaaaatcttctgccagctgttctctattcacgtcgacgccattaatataatggttctcaaagtggacacatctgagagtctctggcatatccaaatctcgagaagcagatttctgctcgacagcgatgggaaacgcttgatttgtgaggtgtctctatgtaagattaattccaaggtgctcaagtccggccagctggaagacacatgcttggtagaactatctctggcactggacctgtgcctgaaagttggcattagcagcagacatctgactgcgattacggtcgacgtgtggactctgcacgcagaactgcacgagggtctcttccagtcacagttgctctgccaaggccctagcctggccagtaagccggtgccttgctctgaggtgacagagaacttggtggaacctaccctgcccgggctgttcctgctgcagcagctccctgaccaggttaaggtaaaaatggagaacacaagtgtggtgctctctatgaactcccagaagcgacatctcacatggacattaaagctgctccagtttctgtaccacagggacgaagatcagctgcctcttagaagctttactgctaactcagatatggcccagatgtcaaccgagctcctcctcgaggacggtctgctgctttctcaatcacgacagcgaatcgtctgtttgaatagtctgaaggcgagcgttcaagtcaccactatcgatctttcagctagtctggtgctaaatacctgcatcatccactataggcatcaggagttttcacactggctgcacttactcgccctggagacccaggggtccagtagccccgtgttgaagcaaagaaagaagagaacattcccccaaattctcgcccctatcatattttccacgtccatctccaatgttaatatcagcattcagctgggggatacgccaccttttgccttgggatttaactcaatatcacttgattaccagcacctccggccacaaagcattcaccagcgaggcgtcttaactgtggatcatctgtgctggcgggtgggatccgacagtcatatacagcgcgcccctcacccaccaaacatgcacgtatggggcgaggctttagtgttagattcattcaccctgcaaggttcttacaaccagccactgggcctttctagcactcagtccgatacacttttcctcgattgcactattcgaggccttcaggtggaggcaagcgatacatgtgctcagtgtctgagtcgaatccttagcctcatgggaccgcagtccggcaaatcagcagtgagcagacactcatcattcggtgaaagcgtcagtctgctgtggaaggtagatttgaaagtcgaagacatgaacctgttcactctgtcagctctggtcggcgcatccgaggtgaggttggatacactgaccattcttggatctgccgaaaccagcactgtgggcatccaagggttagtccttgcccttgtcaagagtgttactgagaaaatgcagccgtgttgcaaggctccggatattccaacaccagtcctctctctgtccatgctcagcatcacatatcattcaagcataagaagcctggaagtacagtgcggagctggacttacactgttgtggtcgcctccagatcacatgtatctgtaccagcatgtgctcgctaccttgcagtgtcgcgatctcctgcgcgctactgttttccctgaaaccgtccccagcttagctctagagacgagcggtactacatcggaactggagggccgggcaccagagcctttaccaccaaagaggcttcttaacctcaccctagaggtgagcacggcgaagctgactgctttcgttgcagaagataagttcatcaccctcgctgctgagagtgtaagtcttagccggcatggaggttctctacaagcctactgcccggagctggcggctggatttgatggcaacagtatattcaattttaaagaagtagaggttcagctcttgcctgagctggaggagatgatcctgcatcgcaatcccttccccgcactgcagaccctaaggaatcgagtctggctcctgagcttcgggtccgtgtcagtggagttcccatatcagtacgatttctcccggactctggacgaggcagtgggggtgcaaaaatggttgaagggtctccatcagggcactcgtgcctgggctagccctagccctgtccctctgccacccgacctgctgcttaaggtggagcacttctcctgggtcttcctcgacgacgtattcgaagtaaagctccacgataactacgagttaatgaaagacgagtctaaggaatctgcaaagcgtttgcagctgttggatgccaaagtcgctgccctgcgcaagcagcatggggagctgctaccagctagaaagatagaggagttgtacgcttctcttgaacggaagaacattgagatatacatccagcggtccagaaggctttatggcaatacacccatgcggcgtgctttgctgacctggtctctggctggcctggagctggtggctctggccgacgcaagctttcacggcccagagcacgttgttgaacaggtgcaagagctcgatcccgggtcccctttccccccggagggattggacctggtgatccaatggtgccgtatgttaaagtgtaacgtgaagtctttccttgtgcgcatccgcgattacccaaggtaccttttcgagatcagggattggagactcatgggccgcctggttgggaccgagcagtccggacagccatgttctcgccgccgccagatccttcaccttggcctgccttggggcaacgtagccgttgaaagaaacatgcccccccttaaattctatcacgattttcactctgagatttttcagtatactgtggtatgggggccctgttgggacccagcctggacactgatcggtcaatgcgtcgatttactgaccaagcccagcgctgatcctagcccccccctaccgtggtgggataagtcccgcctgctctttcatggagactggcatatggacatagaacaggctaatctgcatcagcttgctactgaggacccttacaatacaacagagaatatgcactgggaatggagtcatttgtcctttcactggaaacctggccagtttgtgtttaagggagacctggacattaatgtgcgcacggcctccaagtacgacgattgctgcttcctacacctgcccgacctgtgcatgacccttgatctgcagtggttgtgtcatggcaatcctcatgaccatcacagtgtgactctccgtgcacctgaattcctgcccgaagtgccactgggtcagctccatgacagttaccgcgccttccgttccgagaacctgaatcttagcattaagatggacctgactcgtcactcaggcacaatctctcagccccgaatcctcctttactcatccacactacgctggatgcagaacttttgggctacctggacctcagtgacccggcccatctgccgaggaaagctctttaacaacctgaagccctcgaagaaaaaactgggacaacattataaacagttatcttacactgccctgtttcctcagctacaggtgcattattgggcatccttcgcccaacagaggggcatccaaattgagtgcagccaaggccacgtatttacccgcggcactcagcgcctgataccacaggctgggacggtcatgaggcgtcttattagtgattggtcggtgactcaaatggtgagtgatctttcccaggtgacagtgcacctcatggcatctcccactgaggagaatgccgaccattgtttagaccccctagtcacaaaaacgcatctgcttagtttatcctccttgacttatcagcggcatagcaataggacagctgaggaggaactgtcagcccgggatggcgacccaacctttcatactcaccagctacacctggtggatctcaggatctcgtggacaacgactaatcgggatattgcattcgggctttatgatggctacaagaaggcggcggttctgaagcgtaatctcagcacggaagccctaaagggactgaagattgatccacagatgcccgctaagaaacctaagaggggcgtgccaacctcagcttccgcccccccacgtgtcaatacaccctcctttagtggtcagccagacaagggtagctctgggggggcatatatgttacagaagctcatcgaggagactgatcggtttgtggtctttacagaggaggaaagtgggatgtcagaccagctgtgcggcattgccgcctgtcaaactgatgacatatacaacaggaactgtctcatcgagctggtgaactgccagatggtactcagaggcgctgagaccgagggatgcgtcatcgtctctgctgccaaagcccagctgctccaatgtcagcaccacccagcctggtacggggatacactcaagcagaaaaccagctggacttgtctgctagatggtatgcaatattttgcgacaaccgagtcctctcctactgaacaagacgggagacagctctggctggaggtcaagaacattgaggagcaccggcagaggtcactcgacagtgtgcaggagctgatggagtctggccaggcagtcgggggcatggtaaccactactaccgattggaatcagcctgcagaagctcagcaggcccagcaggtgcagagaatcatcagtcgatgcaattgcagaatgtactacataagctactcacacgacattgaccctgagttggccactcagatcaaaccacctgaagttctcgagaaccaggagaaggaagatctcctgaaaaaacaggagggggcggtggataccttcaccctgattcaccatgaactcgaaatctccaccaaccccgctcagtatgccatgatactggatatagtcaataaccttctgctgcatgtcgaaccaaagcgtaaggagcatagtgaaaaaaagcagagagtgcgcttccagcttgagatcagctcaaatcccgaggagcagcggagctccattttgcatctacaggaagccgtgagacagcatgtcgcccaaatcagacaattggagaagcaaatgtatagcattatgaaatccctgcaggacgacagcaagaatgaaaaccttctggacctgaaccaaaagctccagctccagttgaatcaggaaaaggccaatctgcagttagaatccgaggagttgaatatcctcattagatgctttaaagatttccagttgcagcgggcaaacaagatggagctccgtaagcaacaggaggacgtcagcgttgttcgcagaactgagttttactttgcccaagcccggtggcgactcactgaagaggacggccagctgggcatagctgaactggaactacaacggtttttatattctaaagtgaacaaatctgacgacaccgctgagcacttgctggagttggggtggtttaccatgaacaatctgctaccaaatgccgtgtataaggtcgtactccgcccacagagttcctgtcagtcaggacgccaactagctctgagactattctccaaggtgaggccacccgtgggaggtatctccgtcaaggaacatttcgaggtgaatgtcgttcccctgactatacagcttacacaccagttctttcaccgtatgatgggattctttttccccggccgctcagtggaggacgacgaggttggagacgaggaagataaaagcaagctggtcaccaccggaattcccgtggtgaagcctcgccagctgatagccacggatgacgccgtccccctggggcctggcaaaggggttgcccagggtctgacccgctcatccggcgtgcgcaggtcttttcgaaaatctccagagcacccagtcgacgacatagataaaatgaaggaacgggccgcaatgaacaatagctttatctatataaaaataccccaagtccccttgtgcgtatcatacaagggggaaaaaaactccgtggattggggagatctgaacctggtattaccctgtctggagtatcacaacaacacgtggacttggcttgattttgcaatggctgtgaaaagagactctcgaaaagcactggttgcgcaggtgattaaagagaagttaaggctcaaaagtgccaccggatctgaagttcgcgggaagctggagaccaagtcggacctgaacatgcagcagcaagaggaagaggaaaaggctaggttgctgattggactcagcgtgggagataagaaccctgggaaaaaatcgatttttgggcggcgtaaatag

SEQ ID NO: 49865 - DNA, 417 bp, Artificial Sequence
  Description of Artificial Sequence: Synthetic coding sequence
atggaggcctgggagagcagccagcccctgctgcggtgcgagatcccatgccccctgcccggaactgaccgggatgggtccgtgtccttacctggggaggcagcttcttgcgatctggatacactggagccagagcacggaaaccgcagagttagtggtaatcctattagtgtgtgttgggcttacaaagtcacaaaagttaaatgctggagcgtcagagagcgcggaggtaggcacatcggaggaccgcggaacactctgaagcaccctgcgcaccatgggatgggaaagaatctagcaacaagcctaccaactgccgcttccctcggtttagggaagggccagctattggtgagcattaggttcatggatacaacaaaaaagagaggacagtccgagacgtttaacatttgctag

SEQ ID NO: 49866 - DNA, 1203 bp, Artificial Sequence
  Description of Artificial Sequence: Synthetic coding sequence
atgggcgtgctgatgagcaagcggcagaccgtggagcaggtgcagaaggtgtctttagccgtgtctgccttcaaagacggcctgcgcgaccgacccagcataagaaggactggggagctgcctggctcccggcgggggacagtggagggatcagtccaggaggttcaggaagaaaaggaggcagaagcgggaacctccgtggttcaagaggagagttccgccgggcgggctgcttgggagcgcctgagggatgggcgtggagttgaacccgaagaattcgataggacaagtcggttcacccctccagcatttatccgtcccactcggaaactggatgacgacaagccacccgaaatctgtcttgaaccccgggagcctgtggtaaatgatgagatgtgcgacgtctgtgaggtgtggaccgcagaaagtctgttcccatgccgggtctgtacaagagtctttcacgatggctgcctccgtagaatggggtacatacagggagattccgccgccgaggttaccgaaatggcccacactgaaacgggctggagctgccactactgtgataacatcaacctcttactcactgaagaagagatgtattccctgacagaaacatttcagcgctgtaaggtcattcctgactgctccctcacactcgaagattttctaaggtacaggcaccaagccgccaagaggggggaccgtgatagggcactgagcgaggagcaggaggagcaagcagcgcgccagttcgcagccctcgatcccgaacatcgtggtcatatcgaatggcctgatttcctgagccacgagagtctgctgctgttacagcagctgagaccacagaacagtctactccggctcttgacggttaaggaacgtgagcgcgctcgggccgcattcctggcgagaggatctggtagcaccgtctcggaggccgagtgccgcagagcacagcattcttggttttgtaagagatttcctgaagctcccagttgctctgtcagcatttcccacgtggggccaatagctgactccagccccgcatcttcttcctctaaaagtcaagacaagaccctcctgcctacagaacaggaatcccggtttgtagattggcctaccttcctgcaggagaacgtactgtacattctggccgcacggccaaatagcgcagcgattcatcttaaaccacctggttag

SEQ ID NO: 49867 - DNA, 1230 bp, Artificial Sequence
  Description of Artificial Sequence: Synthetic coding sequence
atgggcagccaggccgccgccgagtggcggaactgggccagctgggaagtctctagttcattgtccgggtgtagtatgggctgcttcaaagacgatagaattgttttttggacatggatgtttagtacctacttcatggagaaatgggccccaaggcaagatgacatgctgttttacgttcgtcgcaaattagcctacagcggttcagaatctggcgctgacggtcggaaggccgccgaaccagaagttgaagtggaggtgtaccgtagagactcaaagaaactgcctgggctcggcgaccccgatatagactgggaggaaagcgtatgcctgaacctaattcttcaaaagctagactatatggtgacatgtgcggtgtgcacacgagccgacggaggggacattcatatacacaagaagaagtctcagcaggtgtttgcatccccctctaagcatccaatggactctaagggggaagagagtaagatcagctaccccaatattttctttatgattgattccttcgaagaggtgttctccgacatgactgttggcgagggagagatggtatgcgtggagcttgtcgcctctgacaagaccaatacctttcagggcgtaatattccaggggtctattaggtacgaagccctgaaaaaagtgtatgacaatcgagtgtccgtggctgccaggatggcgcagaagatgtcgttcggcttctataagtatagtaatatggagttcgtgcggatgaaaggtccgcaggggaagggtcatgctgaaatggctgtgagtagagtgagtactggcgatacaagcccctgcggcacagaagaggactcatctcccgcaagtcctatgcacgagcgggtgaccagtttttcaacgcccccaacgccagagcggaataatcgtcccgcattcttctcacccagcctcaaacggaaagttcctcggaacaggattgccgaaatgaaaaagagccactccgcaaacgattccgaggagttcttccgagaagacgatggcggggccgatctacacaatgctacaaacctgcgctcacgttcgctgtccgggaccgggcggtctctagtcggctcatggctgaaattgaaccgcgcggacggaaattttctgctgtatgcccatctgacatacgtcactttaccgctgcaccggattttgaccgatattcttgaagtcaggcagaaacccatcctgatgacctag

SEQ ID NO: 49868 - DNA, 333 bp, Artificial Sequence
  Description of Artificial Sequence: Synthetic coding sequence
ggcgcccggagccccggcagcacccaccagggcagcctggccagcggggttcttccgataaaatgtagtcacgtcgaatttggtatgtggaagggaggaaggtctcacccttttcttccacattcctcgagatgtgccggatcagggggccagctagactccatcctgccccaccaatctccagcgtggggcccctggggttgtaaggatttgtcgtcaggattcccttcgttcctgacaagctctatactgtggaaaagcgccgtcgtgagagagccacatatttctccgcaccaagctcctccttacaagacatctgactgcattatgtag

SEQ ID NO: 49869 - DNA, 3753 bp, Artificial Sequence
  Description of Artificial Sequence: Synthetic coding sequence
atggccgccatggcccccggcggcagcggcagcggcggcggcgtgaatccttttcttagcgactcagacgaggacgacgatgaagtggcagctaccgaggagcgtagagcagttctgaggctcggggccggaagcgggctcgacccaggctctgctggatccctgtcccctcaggatccagtggcactgggatccagcgcccgccctgggctccccggtgaggcctcagcggccgcagtggccctgggaggaaccggggagacccctgctaggctatccatcgacgcgatagccgcccagctgctgcgggatcagtatctattgacagctctcgagctccacaccgaactgttagagagcggaagggaactgccaagattgcgggattacttttctaatcccggaaattttgaaagacagagcggtacccctcctggaatgggggctcccggggtgcctggcgccgctggtgtgggaggagccggcggccgggagccgagtactgcctctggaggaggccagctcaatcgcgccggctctatctccacgttagattcacttgattttgcccgatattccgacgatggaaacagggagacggatgagaaagtagcagtgttggagtttgagttgagaaaagccaaagagacaatccaggccctaagggccaacctgacaaaggccgcagaacacgaggtgcccctacaggagcgcaagaactataagagttcacccgagatacaggaaccaatcaagcctctggagaaaagggcccttaacttcttggtcaacgaatttctgcttaagaataattacaaacttaccagcatcacatttagtgacgaaaacgacgaccaagacttcgaactgtgggacgatgttggacttaatatacctaaacctcctgatctcctgcagctctacagagacttcggaaaccatcaagtgaccgggaaagatctggtggatgtcgcctccggggtggaagaagatgagctggaggcacttacacccataatttccaacctgccaccaacactggagacgcctcagcccgctgaaaatagtatgcttgtccagaagttggaagataagatatctcttttaaacagcgagaaatggtcacttatggagcagatccgccggctgaaaagcgaaatggatttcctcaaaaacgaacatttcgccattcccgccgtgtgtgattccgtccagccccctctcgatcagttgcctcacaaggactccgaagactctggccagcatcctgatgtcaatagcagtgataagggaaaaaataccgacattcaccttagcattagcgacgaagctgattcgacgatacccaaagaaaacagtcccaatagctttcccagacgcgaaagagaaggcatgcctccttccagcctgtccagtaaaaaaactgtacatttcgataagccaaatcgcaagctgtctcccgcgtttcaccaagcattgctgtccttctgtcgcatgtcagccgacagtcgtctcgggtacgaagtctcacggattgcagacagcgagaagtccgtaatgctgatgttgggacgctgtctgccccacatcgttccaaacgtactgcttgccaaacgcgaagagctgatcccccttatcctgtgcacagcctgcctgcaccctgagcccaaggagcgtgatcagctgctgcacatcctttttaatctgatcaaacgacctgacgacgaacagaggcagatgatactgaccggctgtgtggcttttgccagacatgtcggtcctacgcgtgtggaagcggagctgctgccacaatgttgggaacagatcaaccacaagtaccctgaacgcagactgctggtggcggagtcatgtggcgcactcgctccctacctcccgaaagagattcgaagcagccttgtcctgtcaatgttacagcagatgcttatggaggacaaagcagacctcgttagggaagccgtgataaaatccttaggcattatcatgggttatatcgacgacccggacaaataccaccagggattcgaacttttgttaagtgctctgggtgaccctagcgaacgagtggtttccgccacgcatcaggttttcctgccggcgtacgcagcctggacgacagagttgggaaaccttcagtctcacttaatccttacgctgcttaataaaatcgagaaattacttagagaaggcgaacacggcctggatgaacacaagctgcacatgtatctgtccgcactgcagagccttatcccatcgttgttcgctttggtgcttcagaatgccccattcagctcaaaagccaagcttcatggggaagtgccacagattgaggtcactagattccccagacctatgtctcccctgcaggacgtcagcaccataatcggctcccgtgaacagctcgccgtgctcttacagctctatgattatcaattagaacaggaggggacaacaggctgggagtccctactctgggtggtgaatcaacttctaccccaactgatagaaatagtgggcaagattaacgttactagtacagcctgtgtacatgaatttagcagatttttttggagactatgccgcacttttggcaaaatctttactaacactaaagtgaaaccccagttccaggagatccttagactgagcgaagagaacatagatagctcagctggcaatggagtgctgactaaagcaacagttcccatttacgcgaccggagtgctgacatgctacatccaaataaaagaatacctccatattcataacgagatatcatgggagtgggatccctcgctgaatactaagtgtgtatcttacacccactacacacactctctcaaggaggaggatagaaagctgctcgtcggctttctggaagacgtgatgaccttactgagtttaagtcatgccccgctggactctctgaaggcatctttcgtcgagctgggcgctaacccagcctaccacgaattactcctgaccgtactctggtacggcgtcgtgcacaccagcgcattagtgcgatgtactgccgcccgaatgttcgaactgctcgtcaagggagtcaatgaaacgctggtggcccaaagagtagttcccgccctcatcacactttcgagtgatccagagatatccgttcggatcgccactatcccagcatttgggaccattatggaaacggtgattcaaagagagctgcttgaacgcgtgaaaatgcaactcgcatcttttctggaggatccccagtaccaggaccagcactccctccataccgaaattataaagacttttggaagggtgggcccaaacgcagagccaaggttcagagacgagttcgttattcctcacctgcataagctggctctggtaaataacctgcagattgtggactcaaaaagactggacatcgcaacccacctgtttgaagcttacagcgctctgagctgctgcttcatcagcgaagatctgatggtgaaccattttctgcctgggttacggtgtctgcggactgacatggaacacctgagcccggaacacgaagtaatcctcagcagcatgattaaggagtgcgagcaaaaagtcgagaacaaaactgttcaggaaccgcaaggcagtatgtccatcgctgcttccctcgtgtctgaggacacgaaaactaaattcttaaacaaaatgggacagctaactacaagcggggcaatgctggccaacgtattccaacgtaagaagtag

SEQ ID NO: 49870 - DNA, 6054 bp, Artificial Sequence
  Description of Artificial Sequence: Synthetic coding sequence
atgaccagccggaccaagcggcggcagaaggtgaagatcagcatctcgaagattaatcactcctcgtaccgaaaggaacaccgcccgttctgggagcaccagccacctccccatcagaactgggctgtcggggggagatgcggggcgggcgcacggccagggctctcacagcggcgaggccgcgaagtccggcgcgaagcacagggcggcgcatcgagccgccgtctgcgcgctaggctttacttctctgagagtacatccctgccactggatcgcagggggtccccggggccgcttgggccggctccccatggattgagacgtgccgccccaaggggtcctgctagacgcacccccagatccaccgcactgactagccggagaagggcccagagacctcgtcatggggatcgcctccggctccggtccgaagcccgtccaagggccgccggggactggccatgcgctcggggcggagcagtaaggccagggagacctcacagacccccacgtgtggagtccgccagaggtgcccacgctggacgcgctgccaccgatcagttggagcgggtctttctgagactgggccacgccgaaactgatgagcagctgcaaaacattataagcaaattcctcccccctgtgcttctaaagctctcttcaacccaagaaggtgtccggaagaaagtgatggaattgctggtgcatcttaacaagcgcataaagagtaggcctaaaatccaattaccagtggaaacactattagttcagtatcaggacccggccgctgtgtctttcgtcaccaacttcaccatcatctatgtgaagatgggctacccgagactacctgtcgagaagcagtgtgaactcgcaccaacactgctcaccgccatggagggcaaacctcagccccaacaggactcactcatgcacctgttaatccccactttatttcatatgaaatacccagtggagtcctctaagtcagcaagtccgttcaaccttgccgaaaaacctaaaacagtgcagctcttgttggactttatgctggacgtgctcctgatgccatatggatatgtgctcaatgaatcacaatcaagacaaaacagctcatctgcccaaggatctagttccaatagcggagggggtagcggcattccgcagccaccacctggcatgagcttttacgcagcaaagagagtcattggagataacccctggactccagagcagctcgagcagtgtaagctgggaatagtcaagtttatcgaggccgagcaggtccccgagctggaagccgtcctgcaccttgtgatagcgtcctccgacaccaggcattcagtagctaccgccgccgatctggaactgaagtccaagcaatccctcatagattggaacaaccccgcaatcatcaataaaatgtataaggtgtatctgggtgatattcccctgaaaaccaaagagggtgcagttctcaagcccgagctcaagcgcgaccctgtctccacgcgagtcaaactgaagatcgtaccacatctgctgaggagccggcaggctgcagagaccttccccgcaaatattcaggtggtttacgatggcctgttcggaactaacacgaactctaaactgaggaccttatctcttcagttcgtgcatcacatttgtataacctgccccgagatcaaaattaagccactgggacccatgttacttaatggccttaccaaactcatcaatgagtacaaggaagaccccaaactactcagtatggcttacagcgcggtcggaaaactgtcaagccgcatgccgcacctcttcaccaaagatattgccttggtgcagcagttgttcgaggcactgtgcaaagaggaacccgaaactcgcctggctatccaggaggcccttagtatgatggttggagcatacagtacgttagagggcgcacaacggaccttaatggaggccttagttgcttcttacctcatcaagcctgaggtccaggtaagacaggtggccgtgaaatttgcctcaacagtttttcccagtgaccacatcccttcgcggtacctactcctgctggccgcgggcgacccccgggaagaagtgcacggtgaggctcagagggtactcaggtgtctgccagggcgaaaccgaaaggaaagtacttctgaacagatgccgtcctttcctgaaatggtatactatattcaggaaaaggcctcacataggatgaaaacaccagtgaagtacatgacaggcactacagtcctgcctttcaacccagccgctttcggggagattgtattatatctgaggatgtgtctggcccactcagctggagtcgtccccacctcccagtctctcgccgacatgcaggatcatgccccagccatcgggcggtacataagaaccttgatgtcctctggtcaaatggcaccaagcagttcaaacaagtcgggggagacgaacccagtgcagatttatattggactgctacagcagcttctcgccggcgtgggaggtctgcctgtgatgtattgcctactagaagctgtttcagtgtatcccgaaaaactggccaccaaattcgtggataaaaccgaatggatcaagagtctaatgaacaactccaaagaggaaatgagggaactggcagctttattctattccgtggttgtttcaacagtatctgggaatgaactcaagtccatgatcgagcagctcataaagaccacaaaggataatcattcccctgaaatccagcacggctctcttctagctctgggttttacggtgggcaggtaccttgccaaaaaaaagatgcgaatgtccgaacaacaggacctcgaacgaaacgcagacacactccctgaccaggaggagctgatacagagcgccaccgaaacgatcggatcgtttctggacagtacatccccactcctagctattgccgcgtgcaccgccctgggcgaaataggccgtaacggcccgttgccaatcccctcagaagggagcggatttaccaagcttcatttggtggagagcttgttatctagaatccctagtagcaaagaaacaaacaaaatgaaagagcgggcgattcagaccctgggttatttccccgttggggacggcgactttccccatcagaaactgctgcttcagggccttatggacagcgtggaagctaagcagattgagttacaatttaccataggcgaagcaattacaagcgcggctattggcaccagttccgtggctgcccgcgacgcgtggcagatgaccgaggaggaatacacgcctcccgccggtgccaaggtaaatgacgtggtgccctgggtgttggatgtgatcctgaacaagcatattattagccccaacccccatgttagacaggctgcatgcatttggctcctgtctttagtgagaaaattatctactcataaggaagtgaagagtcacctgaaggagattcaatctgctttcgtgtcagtcctcagcgagaatgacgagctgtctcaggatgtggccagtaaaggacttgggctagtatacgaattaggaaatgagcaggatcaacaagaattagtgagtaccttggtggagacactgatgacaggcaagagagtgaaacatgaggtgtcaggggagaccgtggtcttccagggcggagccctgggcaagacacccgacggccaaggactcagcacctacaaggaactgtgcagccttgcatctgatcttagccagcctgacctggtgtacaagttcatgaatctggcaaaccatcacgcaatgtggaattcccgcaaaggcgccgcctttgggtttaacgtgatcgcgactcgcgcgggagagcaactagccccgttcctccctcagctggtgcctcgactgtataggtatcagtttgatccaaacttgggtatacggcaagctatgacctctatttggaacgcactcgtcaccgacaagagtatggtcgacaagtacctgaaagagattttgcaggacctggtgaaaaacctgacttcgaacatgtggagagtgcgggaaagttcttgcttggctctgaacgatctgctgaggggcaggccactcgacgacattattgacaaactccctgagatttgggaaactttgtttagagttcaggacgatataaaggaaagtgtaagaaaggctgctgagctggccctaaagacactgtccaaagtctgcgtgaaaatgtgcgaccccgctaaaggggcagcagggcagcggacaatcgcggccctgcttccttgcctgttggacaaaggcatgatgagcactgtgactgaagttagagccttgtcaatcaatacattggtcaaaatctccaagtctgccggagccatgttgaagccacacgcgccgaaactgatccctgctcttctcgagtccctgagcgtcctggaaccacaagtgctcaattacctctccctgcgagctactgaacaggaaaaggccgccatggattccgcaaggctcagtgctgcaaaaagctcacccatgatggagaccatcaatatgtgcctccagtacctggatgtgtctgtacttggagaattggttcctcggctgtgtgagctgattaggagtggcgtggggctgggcacaaaggggggctgtgcttcagtaatcgtgtccctgaccacacagtgccctcaggacctgacaccgtattctgggaagcttatgagtgcactccttagcgggctaaccgatcgcaactcagtgatacagaaaagctgcgcattcgctatggggcaccttgtgcggaccagccgggatagttcaactgaaaagcttttgcagaaacttaacggatggtacatggaaaaggaggagcctatttacaagacttcttgtgcgctgacaatacacgcaattggtcgatattctcccgacgtacttaagaaccacgctaaagaggttctccccttggcctttctggggatgcacgagattgctgatgaggagaaatcagagaaggaagagtgtaacctgtggacggaggtctggcaggaaaatgtgcccggcagctttggcggtataaggctgtatctccaagagctgataacaattacacaaaaggcgctccagtcccagagctggaagatgaaggcacagggggctattgctatggcgtcaatagctaagcagactagcagtctggtgcctccctaccttgggatgatcctgaccgcattgttgcaggggctcgctggacgcacctgggccggaaaagaggagcttcttaaagcaattgcctgcgtggtcacggcctgctcagcagagctcgagaaatcagtgcctaatcaaccatcaaccaatgagattttacaagccgtcctgaaggagtgcagcaaggaaaacgtcaagtacaagatagttgccatttcttgcgccgccgacattttgaaagccacaaaggaggatagatttcaggagttctccaatatagtgatccccctgattaaaaaaaacagtttggagagcagtggagtccggacgactaagaatgaagaggaaaatgagaaggagaaagagttgcagctcgaatacctgctgggtgccttcgagagtctaggcaaggcttggcctcggaacgccgagacacagcggtgttaccggcaggagctgtgcaaactgatgtgcgagcggctaaaactctctacttggaaggtccagctgggcgtgctccagtccatgaacgcattttttcagggcctcatgctcctcgaggaggagcacgctgatcctgaggccctggcagagattctgcttgagacctgcaagagcattacctactcacttgagaacaaaacatactccagtgtccgaactgaggctttgagcgtgatcgaactgctcctgaaaaagctggaggaaagcaagcagtgggaatgtctcacctcagagtgtagagtactactgatagaatctcttgccactatggagcccgattctagacccgagttgcaggaaaaggctgcactcttgaaaaaaacactggaaaatcttgagtag

SEQ ID NO: 49871 - DNA, 4857 bp, Artificial Sequence
  Description of Artificial Sequence: Synthetic coding sequence
atggacggccagaccctgcggaaggccgagcggagctggagctgctctcgggaaaaaaaagaagggtatgcaaaagacatggtgaccgattttgacgagaagcatgacgaatacctgattctgctgcagcagcggaatcgcatactgaagcacctcaagtctaaggatcccgttcagctgcggcttgaacacctggaacagggctttagtgtatacgtgaatggagctaatagcgaactgaagagctcaccaaggaaggcgattcacagtgactttagccgcagcgcctcccatacggagggaacacacgattacggtaggcggacacttttcagggaagccgaagaagcactaaggaggtccagcagaacggcaccttctaaagtgcagagacgcggttggcaccagaaatcggtgcaaatccggactgaggctgggcctcggcttcatatcgaaccgcccgttgattactccgacgatttcgagctttgtggcgacgtgactctgcaggccaacaacacttcagaggatcgaccacaagaactgcgaagatccctagagttgtcagtgaacctgcagcggaaacagaaggactgtagctccgatgagtatgattccatcgaggaggacatcctgagcgagccagaaccagaagaccccgctctcgttggacacccgcggcatgaccggccacccagctctggggactggactcagaaggacgtacacggtgagcaggagaccgaaggaaggtccagcccaggtccagatacccttgtggtgctggagttcaaccctgccagtaaatcgcataagcgggagcggaacctttcagcgaaacgtaaagataatgctgaggtgttcgtgccaactaaacctgaacctaatttaacaccgcaggcccccgccgtatttccagaccaggaacgtatgtgctctcgtcccggctcacgacgggaaaggcccctgtcagctacgcgtaagacgctgtgcgaggccgagtatcctgaggaagacgcgagcgccgttctccaggccattcaagtggaaaatgctgctcttcagcgcgctttgctgagtcgcaaagccgaacagcccgcctccccccttcaggacgctgagggcccccctgccaagccctggacttccctcttggaagaaaaagaagagactcttgagctgctgcctatcacaactgctacaaccactcaggaacccgcaggggccgccggaggagccagggccatcaatcaggccatggatcgcatcggtctgctgggtagccgacagcagcaaaagttgcttaaggtgctgcaggcggtggagtcagacagcgctcacctgggtcgggtcgtctccccgaccaaggagcaggtgtctgacactgaagataaacaaaggatgcgggccgacgagattaaggacgcaatttatgttactatggagattctctccaattggggaaattcttggtgggtgggcctgaccgaggtcgagttttttgaccttaacgataccaaactgtatgtgtctccccacgacgtagacattagaaatacagccacccctggcgagcttggtcgcttggtgaaccgcaatctagccggaaagaaagacagctcaccctggacatgcccattccaccccccactgcagcttttttttgttatcagaaatacccgacagttaggcgacttccacctcgccaaaataaaagtgagaaattactggactgctgatggagatttagacataggggctaagaacgtcaaattatatgtaaataggaacctgattttcaatgggaagctggataagggcgatagagaggctccagctgaccactctatcttggttgaccagaaaaatgagaagtccgaacagcttgaggaagcaatgaatgcccactccgaggaatccaaggggacccacgagatggcaggggcgtccggtgacaaagaattggggctgggttgctctcctccagccgagacactggctgatgctaagctgtctagtcagggtaacgtgtcagggaaacgaaagaacagcacaaattgccgtaaggactctttatcacagctcgaggaatatctgaggctcagcgccgtgcccacctcgatgggcgatatgccatccgctcctgccacttcaccacccgtcaaatgtcctcccgtgcacgaggagccgtccttgattcagcaactggagaacctcatggggcgaaagatctgcgagccaccaggcaagaccccctcctggttgcagcccagccctacaggaaaagataggaagcaaggcgggcgcaagcctaaaccattgtggttgtctcctgagaagcccctggcatggaagggcagactaccctctgatgatgtcatcggggaagggccgggtgaaacggaggcccgcgataaaggattgcggcatgaacctggatggggaacatcacgctcagttaacaccaaagagaggccacagagagccactaccaaggtccactccgacgattcggatattttcaaccagcccccaaatagggaaagaccagccagcggaaggaggggatccaggaaagatgcaggaagtagctcacatggcgacgatcagccagcatctcgagaagatacatggtctagcagaactcctagtcgcagccgctggcgtagtgagcaggagcataccttgcatgagtcttggagcagtctttccgctttcgatcggtcccacagagggcgcatttccaatacagagctgcccggcgatattctggatgaactgctccagcagaaatctagtcgccattccgatctccccccgtccaagaaaggggaacagcctgggctatcccggggacaggatggctacagcggcgaaacagatgccggaggtgattttaaaatacccgtgctgccgtatggacagcgattggtgatcgacatcaagtccacctggggggaccgccattatgttggcctgaacggcatagagattttcagttcaaagggcgaaccagtgcagatctctaacataaaggcagatcctccggatatcaatatactgccagcctacggtaaggaccccagagtggtgaccaacctcatcgacggggtaaatcgcacccaagatgacatgcatgtgtggctggcgccgtttactcgaggtcgcagccactcgattaccatagatttcacacacccctgtcacgttgctttaataagaatatggaactataacaaatctaggatacactcttttaggggagtgaaagatattaccatgctgctggacacccaatgcatctttgagggggaaatcgccaaagccagcggtacgctggccggcgctccggagcacttcggggacaccatcttatttactactgacgatgatatactggaggccatcttttattcggacgaaatgtttgacctggacgtggggtctttggactccctgcaagatgaagaggctatgcgacggccaagcactgctgatggcgagggtgatgagagacctttcacccaggcggggcttggcgcagacgagcgtatcccagagctggaactgcccagtagctccccagtcccccaggttaccacacctgagccaggaatttaccacggtatctgtctgcaactcaatttcactgcttcttggggagacctacattatctcggactgactggccttgaggtggtcgggaaggaaggtcaagccctcccaattcatctgcaccaaatcagcgcatcccctcgggacctgaacgaactcccagagtactctgatgactcccgtgccttggataaactcatcgacggcaccaacatcacaatggaagacgaacatatgtggctcattccgttctctcctggccttgaccacgtggttacgatacgcctagacagagcggaaagcattgcgggcttgcgcttctggaactacaataaaagccctgaggatacgtatcgcggggccaaaatcgtgcatgtatccctggatggactgtgcgtctctcccccagagggctttctcatcaggaaaggccccggcaattgccacttcgactttgctcaggaaattctcttcgtcgactacttaagagcccaattacttccccagccagcccgaaggctggatatgagatcattagagtgtgcctcgatggactacgaagcaccactaatgccctgcggctttatttttcagtttcaacttctcacatcctggggggacccgtattacattggtctcaccggcctagagctatacgatgagaggggggagaagatacctctgtccgagaataatattgccgccttccccgacagcgtgaactcgcttgagggagtgggcggggatgtgaggaccccagacaaactgattgaccaagtcaatgatacatcagacggtcggcatatgtggctggcccctattcttcccggtcttgtgaatcgagtgtacgttatcttcgaccttcccactaccgtatccatgattaagctctggaactacgcaaaaactccccaccgcggcgtgaaggaatttggactgctggttgacgatctgctcgtgtataatgggatccttgctatggtcagtcacctggtggggggaattttgcccacctgtgaacctaccgtgccctatcacacaattctcttcacggaggatagagatattaggcaccaggaaaagcatacaactatctccaaccaggccgaggaccaagatgtccagatgatgaacgagaatcaaattatcaccaacgcgaagagaaagcagagcgtcgtggatcccgccctacgacccaagacctgtatctcggagaaggaaaccaggcgtcgtaggtgctag

SEQ ID NO: 49872 - DNA, 3354 bp, Artificial Sequence
  Description of Artificial Sequence: Synthetic coding sequence
atgctggccggccggcccggcacccggagcgccgtgggcgagctgggcacagaaagcagcgacaacttggaccgggctcccctgggtcccagagaaagtggagggcaccacagacccggctcctatctggacatgaaaatccacttagagaagaatctcgaggaagagagacagattcttcttcaacagcagaaaatatgtaggaaccgggctaggaagtacttcgttgaaagcaacagaagaaaaaaagcctttgaagagaagcggaaggagcaagaagaaaaggagcaccagatcagagaacaaatactgcaacagcgtaagcagaagtttgaagaagtgactgaaaaattccagagggctcacgtgccactatcacagcgccgaaaagcggttagccgaaagccagtcccccctctagaggaagcccttaagcagattcaggaatccaatcttaagagtgaggtgaatttaccattctctcgtcgcccaaccattaattggagggccattgacagcgccctcccaagcgccctctccaaaaatgatcacaaacaccaaaagcagctgctctcgaaaatcaactgcgaaaaggagatgaacgagaacatgagggctactctggccacctctaaaaatgttttccaattgaagctggaggagacacagaagttactggaggatcagcatttgagtaacctgcagaaattcggtgacgaagtgaatcagattaccaacagcgagacacttagttctatcgacagcctcgaggccaccgaacacgaggaaatatatctgaccctgaacaaggaacatagtacatcgattcagcgcaataccatatctctgaagcctgccaacatgcagtcaaccaatctgtcttgcttcgacgaggataagcttgcctttagcaaaactcagcacattaacaattggctaaccaacctggacgcatcgaacacccagaatgttacagcatttagcgatatcctgagcaaatctaatgtcctgccaagctgggagtactttaactctaaggaacaaaaccctagtccgcttaacggaacagttgagcgagcaaccaacacagccaacaactctgtacccttcgtaagttccccacctatgttcgtgctggacaagaagtgtgagaaaaccagtgagacctccacaatgcgcacgacagattctacctctggtgccttcaaacgggagagacctctggttaccgagtcccccacatttaaattctccaaatcccagtctacttcagattcacttacccaggaggtggcaacattccctgatcaggaaaagtactccgaactcaatcaggaaaacggaacaacctctatccccacgagctgcgtgcctgtggcgactcctttggttctcccctctaatattcaaagcgcccgcccgtctgcaaaaaattctattcatattaaggaaatcgatgcagtgcagtgtagtgacaagctcgatgagttaaaggacggaaaggaggaggagattaagtacttcaactgcaataaggaggaactgcctctgttcagcgacagttttcaggacgcttatattccccacaatcccgacagtaaggacgagaaacagaagctggccgagacttcctcgctatcaaatgtcaccagcaattacgattttgtgggacagcataaaaagatgaagtacaatatacatgaaaggaacggtgtccggttcctcaagtccatcttgaagaaagagtctaagtatgagcacggctacctaaaggccttgatcattaatcagagcttcaaattcggcaatcagaaagccgcggctataagggactctattgagctgaccaaggagaaaggtgcagaaatccctaaaaccatcaagaaactgagatggtttgacgagacatccaatattgagaacaacgccgaaaattctcatagcttgaagaataagacaggcaccacccagcagcattcccagcagttccatatccagtctggtgccggtagcaatattatctctgtcagcacctgcgcagtgaattccgcagatacaaaaaagtcacgagaagacagcatttccgagaacgtaaccaccctgggggggtcgggcgccgaccacatgcccctgaactgctttatcccgtccggatataactttgccaagcacgcctggccggctagcaaaaaagaggaaagcaaaattcccgtccacgacgacagcaaaactaagcagggtaagcctcagaggggccgcgccaaaattattcgcaagcccggtagcgcaaaagttcagagcggctttatctgcactaatcgaaaaggcgccgtgatacagccacagtccgcttccaaagtcaatatatttacacaggctcaaggaaaactgattatcccatgtcctccaccccagtcaacatccaacatccggtcaggcaaaaatatccaggtgtctcagtgtcagcctgtgacaccggagaacccccagaatattataacccacaattcatttaactctaaacacgttcttcctactgaacactctctgaatcagtggaaccaggaatcatcttcccccttgtccaacgcttgttcggatctcgtcaccgtcattcccagccttccttcctactgttcatcagagtgccaaaccttcgcaaaaatcaaccatagcaacggcacccaagcagttgcacggcaagacgcaaccctctattgcactcaaaggtctcccgtgtgtgaagagtcgtatccctccgtgacactgcgcacagctgaggaggaatccgtccccctctggaagcgcgggcctaacgtgctccaccagaataaaagagcgactgggtctactgtcatgcggaggaaacgcatcgctgagacgaaaagacggaacatcctggaacagaagaggcagaacccaggttccgttggtcaaaagtactcggagcagatcaacaacttcggacagagtgtgctgttgtcatctagcgagcccaagcagactactcgaggaactagctacatcgaagaggtgtctgattcaacctctgagttcttaatggcagagaatctcgtcaaagcatccgtgccggaggatgagatactcaccgtgctgaactctaagcagatccaaaagtctaatcttcccctcaataaaactcagcaatttaacatatgcactctgagcgccgaggagcaaaagatcctggaaagcctgaatgatctttctgagaggctccactatatacaagaaagcatatgcaaaaatccttccatcaaaaacactctgcaaatcattccactcttggaaaagcgggaagaccgcaccagcagctgcagagataaacggtag

SEQ ID NO: 49873 - DNA, 2571 bp, Artificial Sequence
  Description of Artificial Sequence: Synthetic coding sequence
atgggcaccaccgccagcaccgcccagcagaccgtgagcgccggcacgccttttgaaggccttcagggatctggtacgatggattcccggcacagcgtgagcatccactcctttcagagtacttccctgcataattccaaagctaagtccatcatcccaaataaggtggctccggtggtaattacctataattgtaaggaagagttccagattcacgatgaactgctgaaggcccactacacattgggtcgactgtccgacaacacccccgagcactatctcgttcaggggcgttactttctggtgcgggatgtaaccgaaaagatggacgttttgggtacggtggggtcttgtggagcccctaattttagacaggttcaaggcgggctgaccgttttcggcatgggccagccaagcctcagcgggttcagacgagttcttcagaaactacagaaagacgggcacagggaatgtgtaattttctgcgtgagagaagagccagtgctattcctcagagccgatgaggatttcgtgtcatacacccctagggataagcagaacctccacgagaacctgcaaggcctgggaccaggtgtgcgagtcgaatctctggaactggctatccgcaaggagatccacgacttcgcacaactatccgagaatacttaccatgtatatcacaatacagaggacttgtggggcgagcctcacgccgtcgctattcacggtgaggatgatctgcacgttactgaggaggtttacaaacgacccctgtttctccagcctacctatagataccataggctgcccctgccagaacaagggtcaccactggaggctcagctcgatgcattcgtcagtgttctccgcgagaccccaagtctactgcagctccgggacgcccatggacctccacctgcgctggttttcagctgccaaatgggagtcggtaggactaatcttggaatggttctcggcaccctgatactgttgcataggtctgggacaacatcccagcccgaggccgctccaacgcaggcaaaacctttgcctatggaacagtttcaggtgatccagtcatttcttcgaatggtgccacaaggcagacgcatggtggaagaggtggaccgtgccattacagcctgcgccgagctgcatgatctgaaggaggttgtgctggagaatcagaagaaactggagggcatccgacctgagagcccagctcagggatccgggtccagacactccgtgtggcaacgcgccctctggtcgttagagaggtacttttacttaattttgttcaactactatctccacgaacagtacccgctcgcgtttgcgctctcctttagtagatggctgtgcgcccatcctgaattgtataggttaccggtaaccctgagttccgccggaccagtagcgccccgagacctaattgctcggggttcacttcgcgaagacgacttggtgtcccccgatgccctgtcgacagtgcgcgaaatggatgtggctaactttagacgcgtgcccaggatgcctatctacggcactgcccagccctctgctaaagctctggggtccatcctggcatatctgactgacgccaagcggaggttacggaaagtggtctgggtgtcactccgggaggaggctgttctggagtgcgacggacacacatacagcctgcgctggcctggccctcccgtggctccagatcagttggaaacactggaagctcagctcaaagcccacctctcagaaccccctcccggcaaggagggccctcttacgtataggttccagacatgtctgacaatgcaggaggtgttttcgcagcaccgaagggcctgtcccgggctcacgtaccacaggattcctatgcctgacttttgcgctccgcgcgaagaggacttcgatcagctcctggaggctctgagggccgctctgagcaaagatcctgggacggggtttgtgttctcatgcctgagcggtcagggaagaacaaccaccgccatggtcgtcgcagtcctagctttttggcacattcagggcttcccggaggtaggagaagaagagctcgtctccgtgccagatgcaaaatttactaagggggaattccaagttgtgatgaaagttgtgcagcttctgccagacggccacagggtgaagaaggaagtagatgccgcactcgatactgtgagtgaaacaatgactccaatgcactaccatctgcgtgagatcataatttgcacctacagacaggcgaaggccgctaaggaagcacaggaaatgagaaggctccagctacgctcactgcagtacctcgaaagatatgtatgcttaattctttttaatgcatatctgcacctcgagaaggctgacagctggcaacggcccttctccacctggatgcaagaggtggcttctaaagccggtatttacgaaattctcaatgagctcggctttcccgagctggagagcggagaagatcagccattttcacggcttagatatagatggcaggagcagagctgcagtctggagccaagcgcacccgaagacctgttgtag

SEQ ID NO: 49874 - DNA, 1230 bp, Artificial Sequence
  Description of Artificial Sequence: Synthetic coding sequence
atgagcctgcacgcctgggagtgggaggaggaccccgccagcatcgaacctatttcctctattacctccttttatcaaagtacaagtgaatgcgacgtggaagagcacctgaaggctaaggctagagcacaggagagtgacagcgatcgcccctgttcctccatcgaatcctccagcgagccagcaagtacgttctccagcgacgttcctcacgtagtgccctgcaaattcaccatttcgctggcttttccggtgaacatgggtcagaagggcaaatatgcatctctcattgagaagtacaaaaagcacccgaagaccgattctagcgtaacgaagatgcggcgcttctatcacatcgagtactttctacttcctgacgacgaggagcccaagaaagtggacatcctgctgtttccaatggtggctaaggtcttcctggaatctggcgtgaaaaccgtcaagccctggcatgagggcgataaggcttgggtcagttgggaacagaccttcaatatcacggtcaccaaggaactgttgaaaaaaattaattttcacaagatcaccctcaggctatggaacactaaggacaaaatgagccgcaaagtgcggtattaccgcttaaaaacagcaggatttactgatgacgttggggcatttcacaagtccgaagtgagacacctggttcttaaccaacgaaaactgtccgagcagggcatagaaaacacgaacatcgtaagagaggagtctaaccaggagcaccccccaggcaaacaggagaaaacagaaaaacacccgaaaagcctccagggatcacatcaggccgaaccagagacaagtagcaaaaacagcgaagaatatgaaaaatccctgaagatggatgattctagcactattcagtggagtgtgagccgcacccctacgatttcgctggccggagcttccatgatggagattaaagaactgatcgagtccgaaagcctatctagtctgacgaatatactcgaccgtcaaaggtctcaaattaagggcaaagactccgaaggtcgccgaaagatccagcggcggcacaagaagccgttggcggaggaagaggctgaccctaccctgaccgggcctaggaaacagtccgcattctccattcagctggcggtcatgccactgctcgcgggaacacattgcctcccttgttctcagcagctgttgttggtgctgtggccagaaagaccttag

SEQ ID NO: 49875 - DNA, 3603 bp, Artificial Sequence
  Description of Artificial Sequence: Synthetic coding sequence
atggacccccccagcctggacaccgccatccagcacgccctggccgggctgtacccaccctttgaagccaccgccccgacagtgctcggccaagtcttcaggctcctcgattccggttttcagggggacggattgtcattcctgctcgatttcctgattccagctaagaggctttgtgagcaagtgagagaagctgcctgtgccccctactctcattgcctgttcctgcacgaaggatggcctctgtgcttgcgagacgaggtcgttgtgcatctcgcccctctaaatcccctccttctgagacagggcgacttctatctgcaggtggagccacaggaagaacagtctgtttgtatcatgattaaatgcttaagcctcgacctgtgtacagttgataagaagccagtgcccgaaccagcttatcccatccttttcacccaagaatggctcgaagctattaactcagacttcgagggtaatccccttcacaactgcctcgtagcatcggagaatgggatcgcgcctgtgccttggaccaagattacttcccccgagttcgtggatgatagaccccaggtagtgaacgctctttgtcaggcgtggggtccattgccactagaagccctggacctctcctcacctcaggagctccatcaggcctcttctcctgataatcaggtactgccagcccagagcctcgctaaagggaagggaagaacttacggctccaagtatcctggcttgattaaggttgaacaggccaggtgtggagaggtcgcctttaggatggacgaggttgtgagccaagactttgaaggggactatgttgcgctgctcggcttcagtcaggaaagtaggggggaaagtccttccagagaggcaggcacttcttccggctgtaccagcggagcgctggaggagatcgctgggaccaaagagacacccctgtttcagaaaatactgccactgtctgaagcaaacgaaggccctagcctgggcaatagagcttgcaccaagcccgaaagcagcgaggaaagaccctacaatctgggcttcaggagaaaagtgaacctgaaggctcctacacataactcagaaagacccccgcagggcagttacatgaacgttcttgaggatgccctggactgtgctagcggcctgcgggccggagtgtcacaagagcccgctgccagcaaaatgcagggtcccttgggcaacccagaaaatatggtgcaactaaggccgggaccaaggcaggcgagtagtcctcgactgagtccagcttcacccgcagcagccgcttctgaaaccaagatcgaggtgaaaaccaaggagagaaatggacgacttccaaagcctatgccatgtccttcaagaaatacttcatcacctgaaccccccacacctggactgaagtttagcttcctgcgtggacagcgtcagccctccgttacacccgagaaggcctctctccagcacaatggcccttggaaagtcctgtgttcactgtattctcccaagccaaatcgcgctaagagtctaggtaaagctgggacaacgcagactaagacgtctggccccgccaccgcccctagccctttgaccgaagaaaaggccgccctccccgaggctagcgctggcagccccgaacgcgggccaaccctggaagaagagccgcctggaccagaaccacgaatcggtgctcttggagttaaagtcttccggagtaggatcgcttgccttcctggcggacgggatagggccggcaggcctcttttgttggtttctactaccgagggcgcttgggaggctccatggtgtaccgtttcagaggtcacaaagctcctgtcttatctatgcacaatccctagacccgaagataaagccaagggcctggctgtgctgattgatgcgcggcggcagccaccgcagcctgggctcgtgtctgccttacaggctacacaagctcaagttcctgcttccattcgagcaatcctgtttctgggggagaaggaggctgcactccagttgcagaccctacccgacgtgcaggtggaggttctgacaagtctcaaggccctcagccaccatgtcgatccatcacagctccccgccgttttagagggacccttcccttactgccacacagagtgggtgcactttttccagaagcttgatccatttttggctgacctgcaccaggctagctccctgctgcaggcatccattgaagaattcgagaaggccgacccacctgggggcatgcaggaggccactagatgtctgtctaaatccaaggagttaatggaagccgtgctgcgtgatcccggcctgctgggccttcaacgagaggggggggccactctcgccaggcttcagcacgacgccagcaggttggacttctcaccagacgtgagatcccacctagctgccgccactgccctctacagcttggtcgatgagcagctgcacgtattagtcaccgcgtcaaactcactcctgggaaagctggagctccgggttcgactgggccgcttggaagctgccattcatcaggtgtctgactggatggagcaagaaggacggcggtgcctccagagcctaactccgaaggacggtagtttggaaactgtcgaaaaagcccacgctgaatttgagaacttcttccttcaggcagcagcgcagtatcgccgtggactggagttaagcaagcaggccgctcagttgggggccaccgcgcgaggcgctggggaggccgagagagctgagttcccagaacttgccgcattcgcatccactcaaagagccttccaggctgagttgacccatttctatatggctgccgaacgacagcgcactgatttagaaacactgctgcatttgcatcgcttttgcaaacggatgacatggttccacatggactgccaggaccttatggcacagttacgactggacaagacctcccgagtgagccctggggaccaaagaaggctgcaccgctacttgcaacgacttgcaagtgaatttcccgccgagaagctggccgccgtgggcctgcaggtggcctccctgagccgcgctgggcttgggcaggagttatgggaggaggcaagaattcggcacgaagagattcgcatgctgctggaaaaagcactgacccacagttcctgtccagaggcccctgctgcccatagtgcgcgcccagagcggcgcggagtcgcagcaaaaggacaaggagtgagcgtcgaagtaacatccaaaggccgctgggaccaaccaccactggatagcctcggtatggaccatcttccaaagagttattggccccccggacccccccgtggagagcagaatcgtacgttccaagctggaagtcctccccaggaggccggccaggccgccgaggcggaggacggtaagggcagccataagctgccagaccccgccagggagcacctgctggccaccactttcttccgccaacagccaccccggcagtcacaggtgccaagactgaccggtggcagcttttcctctgagggtaccgattcacaaactagcttagaggattccccgcagactagcccgctggcctcactgtag

SEQ ID NO: 49876 - DNA, 1734 bp, Artificial Sequence
  Description of Artificial Sequence: Synthetic coding sequence
atggccgacgtggccggccccagccggcccagcgccgccgccttctggtcccgggacttcagcgatgaagaacagtctgttgtgtacgttcctggcattagcgcagaaggcaacgtccggtcccgtcataaactgatgagccccaaggctgacgtgaagctgaagacctctcgtgtgacagacgcctccataagcatggaaagcctgaagggtaccggggacagtgtcgacgaacagaactcttgccgtggggagatcaagagcgccagtctcaaggacctgtgccttgaagacaagagacggattgcgaatctgattaaggagctggctagagtcagcgaagaaaaggaagtcacagaggagcgcctaaaggccgaacaagagagctttgagaagaagattagacagctcgaggagcagaatgaattaatcatcaaagagagagaggctctccagctgcagtacagagaatgccaagagttgttaagcttatatcagaagtacctcagcgagcagcaggaaaaactcactatgtcactctccgaactgggcgccgctcggatgcaggagcagcaagtgagtagtaggaaatcaaccctgcagtgctcctcagtggagttggatggctcctacttatccatcgccaggccccagacctactaccagaccaagcagaggccaaaatctgccgtccaggatagcgctagcgagtcgcttattgcctttagaaacaattccttgaaacccgtgactctccaccaccccaaggacgatctggataagatcccgtccgagaccaccacctgtaattgcgagagtcctggccgaaaaccggccgtgccgaccgaaaagatgcctcaggaggaactacacatgaaggagtgtcctcatctcaagcctacaccaagtcagtgctgcggccacaggctggcggctgatagagtacatgatagtcaccccacaaatatgaccccccagcacccaaagacgcatcctgaatcctgctcttactgtcggctcagctgggcctcactcgttcacggtggcggagcactgcagcccatagaaactttaaagaaacagatcagcgaagataggaagcagcagctcatgctgcagaagatggaacttgagattgagaaggagagattacaacacttgctagcccagcaggagacaaaactgcttctgaagcagcagcagctgcaccagagccggctggattacaactgtcttctgaagtccaactgtgatggatggctcctaggtacttcatctagtatcaaaaagcaccaagacccccccaactctggggaaaatcggaaggaacggaaaactgtaggcttccattcacatatgaaggatgacgcccagtggagttgccagaagaaagacacctgccgcccccagagggggacggtaacaggagtgaggaaggacgcctcaaccagcccaatgcctaccggttccctcaaagattttgttacaactgcatcaccgagcctccaacacacaacgagccggtatgagacgagcctgctggacttagtacaaagcttgtcacctaactcagcacccaagccccagaggtatccatcgcgcgaggcgggcgcatggaatcacgggaccttccgattatccccattgaaatccactagaaagaaaatggggatgcacaggactcctgaggaactcgaagagaaccagattctggaggacatttttttcatctag

SEQ ID NO: 49877 - DNA, 1416 bp, Artificial Sequence
  Description of Artificial Sequence: Synthetic coding sequence
atggtgctggacagcggcgcccaggcctacgaccaggccccccccagtcccccaacaagtccccccagcctccgccacaggctcaagcccagcgaccgcgatggtccacccctgtacccttggagccaatcactggccctcccattggcactggcagtcccaccagctctccagccacagcccgaacagcaacccttctcacaaatgctcctaggccatcggggtcacatgaggaggagtgaatccacgtattctgtgaattctactggtagacgaggcaggggcaccctgggacgacccccacccggaagaggaaggaatcctggaggcggcacgctgaggcccgccgcttccctccctcatatcgcaaagacgcagcgggatgccgggcacatagcttccaagagcccctgcatgctagttgctttaagacccacgaacatggatcgtgagagggataagttcttccagagtcattatacatacaatccccagtttgagtatcaagagcccatgcccaccgctgttctggagaagtactgcgaggcgagcggtcagtttatccaccaggcagtcggaatcattgaagcagtgcttgagaagttcgggacttacgaacatttcgaagcagccaccggaggtcagttgcttactaaatgtcaaatctggtccatcgtccgcaagtacatgcagaaagaagggtgtgctggtgaagtggtggttcagctgtcagaggacttactcagccaggctgtcatgatggtcgagaactctcgaccgacactagcgatcaatctcacaggagcccgacagtattggctggagggaatgctacgccatgaaattgggacccattacctgcgcggtgtgaataacgcgcggcagccctggcataacgccgaggggcgcctccgctacgggctgaggcccgcaaatccaactgaagaaggcttagcgagtctgcattcagtactctttcgtaagcagccctttttgtggcgtgctgccctgctgtactacaccattcatcgtgccgcacgaatgagcttccgtcagctgttccaagatctggaacggtatgttcaggatgctgacgtcagatgggaatactgcgtacgggctaagcgggggcagacagataccagtcttcccgggtgcttctccaaagaccaggtctatcttgacggcattgtcagaatcctcaggcaccggcagacgattgactttcccctgttgacaagcctcggcaaggtgtcatatgaggacgtcgaccacttaaggccccatggcgtgttggataatacgagggtaccacacttcatgcaggatctggcacgctatcgacaacagcttgagcatatcatggccacaaaccgtcttgacgaggcagagttgggcaggttactgcccgactag

SEQ ID NO: 49878 - DNA, 432 bp, Artificial Sequence
  Description of Artificial Sequence: Synthetic coding sequence
atggtggtgttcgtgggccggcggctgcccgccctgctgggcctgttcaagaaaaaaggcagcgcaaaggccgaaaacgataagcacctgtcagttggtcccggtcagggcccaggctcagctgtagacgagcaccaggataacgtgtttttcccatccgggcgaccaccacacctggaggaactacacacacaggcccaggaagggcttaggagtctgcaacaccaagagaagcagaagctcaataaaggtggctgggatcacggcgacacccagagtattcagagctctagaactggccccgatgaagacaatatctcgttctgttcccaaacgaccagctatgtggctgaatcctccaccgccgaggacgccctctcaatcagaagcgagatgatacagagaaaagatagccagaaagagctagcctag

SEQ ID NO: 49879 - DNA, 2124 bp, Artificial Sequence
  Description of Artificial Sequence: Synthetic coding sequence
atgagccggggctacagcgagaacaacaacttcctgaacaacaacaaccagatggtcctcgatatgatcctctacccacttattggaatccctcagacaattaattgggaaaccattgctcgtctggttcctggcctcaccccgaaggaatgcgcaaaacgctttgacgagctgaaatccagcggcagcagtccagtggacaaccagtataactcgctgatggcagcaggggagagcccggtcgagactctggccacctacattaagagtagccttctggacatacacggcgagtttcaggaaaccccagtcggccacgatgctgtgagcaagaccggacgccatagcattgcctccacccgtaactgcagcagtgaatctgaaaattgtactacacacaacggtggcgaaatgacagaggagtccgaggggcctaatatggtgatccatgtctgcgacgaggcaaagaatttgaaagaggattttacttgtccacgggacttgcttatctcagagatgaaatacttcgctgagtacttgtctatggatgcccaacgctgggaagaggtagatatctcggtgcactgcgatgtacacatcttcaattggttgattaaatacataaaacgcaacactaaggagaataaagattgcgaaatgccaaccttagagcctggtaatgtgataagcatcctcatttccagcgagtttctgaagatggattctctcgtggaacagtgtattcagtactgccataaaaacatgaatgcaatcgtcgctacaccatgtaatatgaactgcattaatgcgaatctgctgacaaggatcgctgacctgtttagccacaacgaagtggacgatctcaaggacaaaaaggacaagttcaaaagtaaactgttctgcaagaaaattgaaaggctttttgatcccgagtatcttaacccagactcccggtccaatgcagccacactgtatcgatgctgcctctgcaaaaagctcctgactaaagagacagaaagacgtattccatgcattccaggcaaaataaatgtagaccgccgaggcaacatagtttacatacatatacgggacaaaacatgggacgttcacgagtatctgaattctttgtttgaagagctgaagagttggcgcgatgtttattggagactttggggcaccatcaattggctgacctgcagtaggtgctaccaggcgtttttgtgcatagaatttagtcactgccaataccactccgagactgtagtgtatccaacagccgctagctcgcttaatactgtgggtactggaatctacccctgttgtaaccagaaggtgctccgcttcgaccctacccagttgactaagggctgcaaagtgagagatcatatggtgacactgagagatcagggggagggaggggatctgccttcctgtcctaccgccaggatgttggacgatctccataaatacagggatgtgatcgttgttccattctccaaggatacggtgagcgatgtgggggtagggctgtgtgacgagaaagggatcgaatgcgacgtcctgctggaacctaatactccttggggaccgaaaactggagaacttaatgctttcctgtccctgaagaattggacactacaactaaagcaacagagtctgttctcagaggaggaggagtataccacaggatccgaggtgactgaggatgaggtgggggacgaggaggaggtctccaagaagcagaggaagaaggagaagccaaaaaaatttactaggcagcctaaaaaacaggtaagttccccctgtgcccagcgcaaggagaaagccctggagaaatcagcctctcgggacgtctcacccttcgtgatgagtatgcagaaaaacaagtgggatgcgacaaggtctcttcgcttcaaccaagacgctcagcgcgaggatgaccagcgcagaatgacagaaataaccggccatctgatcaaaatgcggttaggggatctggatcgggtcaagagcaaggaagccaaggagactgacaagctgcggccccgggacgggactgtatctaaatcgaatcggaaaagtggactgagctccgttttgctgatgacagtgctcctttgctag

SEQ ID NO: 49880 - DNA, 2811 bp, Artificial Sequence
  Description of Artificial Sequence: Synthetic coding sequence
atgctgctggccccccagggccggagcttcagcaagaagcggatgggcctgaatagatggaagcgctttacacgaaaaccaagcccaaagcctacattcggtcctgactctgtagaacattggattaaacgagtggaaaaggcctcggaattcgcagtgtccaacgctttttttaccaggaacagtgatctgcccaggtccccttgggggcagatcacagatctaaagacaagtgagcagatcgaggatcacgacgagatttacgctgaggcccaggagctagtgaatgattggttggacaccaagctcaagcaagagctcgctagcgaggaggagggcgatgccaagaataccgtgtcttccgtcacgattatgcctgaggcaaacggccatttaaagtacgataagtttgacgatctgtgtggttatctcgaggaggaagaagagagtaccactgtgcagaaatttattgatcacttactgcataaaaacgtggtcgactctgctatgatggaagacctaggaagaaaggaaaatcaggataaaaaacagcagaaggacccaagactcacaatggagatgagacataaacaggtgaaagagaatcgtttgagacgggagaaggagttggagtatcagcgaatagaaaagactttgaaaaagtcagccttccttgaggctcagtgtctagtgcaggaagagaaaaaaagaaaagcgctggaagctaaaaaggaggaggaggagattcagcgtgaaatggtcaagctccggagagagattatcgagcgccggcgcactgtcaaagccgcatggaagattgaaaaaaaacgccaggaagagaactcacagaacagttcagagaaggtgatgtttcagagcacacacattctgccagacgaggagaaaatggttaaggagcgaaaaaggaaattgaaagaggtcctcatccaaacatttaaggagaatcaacaatgtcaaaagagatactttgctgcctggcataagctgattctggatcacagaatcaaactgggtaaggccggtaccctctccgattggaaaatacagctgaaggtcttgagagcctggagagactatacacgctttcaaaagctggagcgcgaaacacaggcgctggagaatgatctcagggaggaaaaccggaaacaacagctagccactgagtataacagaaagcaagtgctgcgccattgctttacggagtggcagcactggcacggcgcggaactcctcaagcgcgagcttgcactgacaaaggaggagaccagaaaaaagatggacgccctactgcaggctgcatcattaggaaaactgagcgcaaatgggttgagcggaatctccctgcctgaagaggccaccgccatggtgggcccacctgttaagaatggccaggaaacggctgtccctcccctgtgggagaaacctcctctaggctccagcggctgcatgctgtcaccacccctgggtcgcacgacaacgggaaatctccagggtagcttgcagaatgtatctttgagtgctcctggaaacaagcagcataagacactgggtgcagaaccttctcaacaaccaggctccaatgagaccctacgcacgacctcccagaaagctgaacctctgtgtctgggccacttccataacaggcatgtattccaacagcagttgattgaaaaacaaaagaagaagctccaggaacagcagaaaaccatactggagctgaaaaaaaacctccagctcgcagaggcccagtgggctgccgagcatgctctggccgtgacggaggcgcagtcccatttgctaagcaaacctcgcgaggaggagcccagaacatgtcagatgctggtgaattccccggtggcctcacccggcaccgaggggcggtcagattcccgcaactcgctgagtgggctccgcaggaaacctaaacagctgatgacccctcacccgatcttgaaagcgatggaagaacgggctattcaaagggcggagtgtcgtagaatcttagccgagaagaagaagaagcaggaggaagagaagcttgcacaactgaaggctcaagaagaggagaggcagaaacgtgaagcagaggagaaggaggctcagctggagcgtaaacgcgaggaaaagagattgaaaaaaatgaaggagttggaaaaacagaagagaattaagaggaatcaacaattagaagccattgcaaaagagcactacgagagggtcctgttacgtaaaaaaggtttggaaccttggaagcgtctgcggatgcagtcaaagcagaatatccaagtggcagaggagcattatagtctgttcctgcagcggaagtacatgcttacttggttccagaggtcacaggagtctctggctaggaaaatggctcaagcagaccagttctacagccaaattcttctgaagcgggtgatccagtcgtggctgcagtacgtgatagacctgcaggaggaagtgcgaaagttttgtgtgcattttctacaaaagaaaatctttcgcgcctggttcaacatggtccgcgaagttaagatcgacagccagggcaaacacgagattgcagctgagcactctgataggcgaatcctgtggatcaccctcaggacctggaagaaatttgtaaaattcatgaaagaagagagagtgaaggaggaaagacgtcagcagcttcgccggaaggtcgtggagattttaccagactttcaggtgcccggcagatatcacgagctgtatcaacagtcagacacatggtctctctcaaaaaccagtctggtcaacgaatag

SEQ ID NO: 49881 - DNA, 465 bp, Artificial Sequence
  Description of Artificial Sequence: Synthetic coding sequence
atgagcaagcggaaccaggtgagctacgtgcggcccgccgagcccgctttcttagctaggtttaaggaacgggtgggatacagagagggaccgacagtggagacaaaacggatccagccgcagccccccgatgaggatggagaccattcagataaagaggatgaacagcctcaggtcgtggtgttaaaaaagggggaccttagcgtggaggaggtgatgaaaatcaaggctgagattaaggccgcaaaagctgacgaggagccgacacccgctgatggtcggatcatctaccgtaagcctgtaaagcaccccagcgacgagaaatacagtggactgacggcaagttccaaaaaaaaaaaaccaaacgaagacgaggtgaaccaggactcagtcaagaaaaatagccaaaagcagattaagaattccagccttctgagctttgataacgaagatgaaaatgagtag

SEQ ID NO: 49882 - DNA, 495 bp, Artificial Sequence
  Description of Artificial Sequence: Synthetic coding sequence
atggacgaggaggtgagcgaccccaccagcgccgccgcccagctgcgtcaactccgcgaccatctgccccctccctcatctgccagtccatccagggcattgccagagccccaggaggcccagaagctggcggccgagagagcacgggcaccggttgtcccatatggggtggacttgcattactggggccaggaactccctacagctgggaaaatagtaaagtccgactctcagcatagattctggaagccaagcgaggtggaggaggaggtggtcaacgctgatatctcagagatgcttcgatctaggcacattacatttgcgggaaagttcgaaccagtccaacactggtgcagagcccctcgccctgatggtcgactctgcgaacggcaagataggttgaaaacgtttcatagctgcccaaggccctctggtagccgaggaggtaccgagccgtcccctcggccatgcggatcccaggacgccctcctctag

SEQ ID NO: 49883 - DNA, 6801 bp, Artificial Sequence
  Description of Artificial Sequence: Synthetic coding sequence
atgatgcccggcgagacccacagcgccgcccccggcaccgccgccgatctgagcaggtgtcaaggttgtgccagcctccaacaaaacctcaatgagtatgtggaagctctgattactctaaaacagaaaataattaacacagataacctcctgactgagtaccagaagaaatgcgatgaactgcagttcgctagaagggaaaattctaacttgcaccaccaggtcgaagaaatgctccagaagataagtccattacagaagtgccaggaggagctgggctcacttaaggctgagctagaagaaaagaaaagcagtctaaagctctatcaagatactcatcaggagtacgccagagtgaaggaggagtgtctgaagagcgatgcccagaagaagaagctggaggctaaggtgaaaaagttgcaggaagcggccgtgaagcaaacccaggatttcaagcagctacgcaatgagaaaaaaatactcgagaaggagtttaagaagacacaagagcgtctagatgagtttagcaagcaaaagaatgaaaaggaattgcggcatatcggcactcagatctccagtgacagttacgggtccatcgacaaaaggaaggtaaaattgctgctgaaagaactgtggttgtgcgtgaacacaacacaccggctgcctggagaaggatcccgatgtgtccctgaaaaaccagctaaggcaatcacctcatcacgcgtgcctggcgaggacggcacgttgcctccgacacaggggtcacccctcagaaccagcaacgtgcagacatgtctgactaagctttctatggagatcaaggaggactttctgtgccagaatgtcgagaagcaatccagcagcggcactaactgcagttcagatcacgtcttcaacgaaaatggcaatctggaggtgttggtccagtctcatcgcgatggggggtccaccgaatttgtcgatcatgaccacttttttgacgaggacttgcaggcggctattgacttctttaagcttcccccgcctcttctaagtccagtcccttcaccaccaccgatgagctcaccccaccctggcagcttgccaagcagctttgcccccgagacttacttcggcgaatataccgattcaagcgataacgacagcgtccaattacggaattcagcggagtgtgtgagcgaagatgacaccaccgaatcacagaactactttgggtcactcagaaaaaataaaggtagtggcacatgggaggagaaaccaaagagccatgaggcaattcaagccttgaatacgtgggaagtgaacaaggtgaccacctcgggactggaaaccttcacagccacactgagggaatccagcgcaacccactcattggtcggggagaaacattggaccaccgcctcaagatcaatgtccgataggaaaagagatatcctgcacgagaccaagacccagatggaagtgagggagatggacaaaagtgtgcagaccgaaaaaacaatccacaagctgaccagggggctatgcattgagcgcctgagtgcatcacctgcccaggagaaggaggccgctcccggcaagtccgagctgtgttctagtcccttgggcaagagacccctgaacgagctgatggaatccgagggaaaaactgtattatcaaagatgatggggtcacccaagagcgagtttaccaagtggactcgcatcaatgaaataaccagtgagcccgaccgtataacagtgtctgggcactttcaccgcctgagccgcgaactggagaaagagaaggaggatacacaggggtttaccctgggggagtcccctgaaagtgaagatgatgacagtggggacggaatggatgtggccggcctcgacatcgaaacctcgtttagcagctcaagtaccctcgtcgcgctgtccgtcggcagcaacccccagtccagttcgggtctggactgcgggaacgacactgacatcactaccaaagtattctccactgagcctcaccatagcgaacacaagctgcagactaagacactgaacacactccacctccagtcggagcctccagaatgctccatcggagggaacaatctagagaattccctgtgtgcactgagccccgaactgggagcttccaattttaacgatcaaaagtcttccggcatcgaatatacaaaagttgtgaagggcctcacaaagattcattccctccctcggagcgtgtttatgaaggccacaaaagacgggcaatgcgaatcgcaggaccctagaatcgaattgacccttaataagccagattttaccagtttaattgggagccaggccgctctgataaaatccggcctgggttttgtcaagtctactagctggcaccacagcgacctactaaggaaaggtggggaagagtcgctgagggcaaagtcggaacatgagcagaagacaagccaccaactgcagaaggccatgcctttcctgcagaacagaggccccaccccaaagcccgaccttctccgcgaaaacaacaatcctgtggaattcaagactactgcctccgtgcttcctaatcaggtgtcggtgataactaagcagacacggccagagaaggtgcagtcagctaagctagagcatttgcgtcctcatcgggttgagccaacgctggtcacagaaaatagcgggaacaagacaggcatgtctaccgtcgcaaagtgcgacggtgagcgtgacgatacgacccagaacattacggaggtggccgctgttaaaagcatctctcctgaagtaagcgcttcgcgccgcaaacttgatttcaactccccaggcggcagcagccctgtcgagaacagcgactgcagtaccaactccagactgtcctttagccctgaaaacatcctaattcagaaccaagatatcgttagagaggctgctgtccaaggggacggtcagaaacagagacagccgcaggcaactgacctagattcttctggcacgcatggtagcgagatgctaccagctaccgaggtgaccgtaagcgggggctttagtgtggaggagaccagctgcggagacacaggacgctccggcggggaagctcttgccgtggccaatgacagcaccagcacccctcagaatgccaatggcctgtggaagcttaagtccacaaccccaggtggagccctgcctgagtgtttcggcaccaccgacacaaccttctcctctgctttctgcagaaagcacggcgagacacaagacaccagccagtctagtctgcccgggacactacactgttacacgggcatacgggagggcggggacgacacagaggtggagtccgaggctttttcctgctctgaggggtccgaacaacaggatgccccagacgactctcagaaaaatcttggtgataccgacgcagctgtggcagaagtccgcccttccctggaggtgggatatcttacatcagcccttcaggacttcaatatctcgaccttcagcgagttggacagattgtcaaccagtgaggttgtgatgtttctcgagtcttgtcagcttggggattattccagtggcgattcagtgtcggagtgttcttccaagggaactctatctaaggagatgaacaaggagcttaaagcctcagagataggtgaaaaatatagaaaacagccttgtgaggaggagacacttggaacctgcgaggaatggattgagagcgaggaggatgactattccctgaagaacacaagtcagctgactcaatgcagcctggaaactctcagcgaggttttgactaaaattcggcaggagctccagacaaactcggaagattgtaatgggaaggacacaggaagtttactgttgctgaatgttaataacaatatgactaccgaaaacttgaaggagaagtcaccttttcgggaaactaccggatcctctagtcatgcaagcgagcctacgccccaggctgctgctctcgacacggagggatcgtcccctatttccggtatgcctcagaacgaaaatccacaatcccgcccggaggcccggtccgacgctggaaggcagaccgatggcggggaggaggatttgcccgagcccgtggagccctcggcactgtgctccgacagcgtcatggaacccagtatagagcagtcttccaactgtgaagcggaaaccacttttcagtgtcaaattgctacggtaacgagtgaagttatcaacgttctaatcaacaaggaccagaacctggtcatcgaaaagggcgataattggaccatcataagtggagttgcggttctcccccatgtggatcaggttaccctgtgcgacatccccggggatattcccatcagccaggaccaaggtgagctggaggccgggtgcattccggtgacaagcgcggagaaaagtccggaggcatcacacacaggcccagcattccaggaagctccctgcggcaataacctgtcatgtcctcaagaggatgtgtcctcctcaggacagagtactaatttcgataagtctagactgcgcaatagacctgtgaagccttctatctggatctcctcccaaatctatgaccagaacttcgagacacagatagtggcgtcagaccacacttactacaacagcaagctcgaaccatctggcaaaaataagaacagatcaaaaattagcaacaaggatcagtccaataaaccagttaaaacgtctgcttcctcccgcgtggagacccaccaatccgaagtagcccagtcttttagcggagaaaaggctaatacaaaaacgcagcgatcccagacacagactattctggctaatgccgatacatcaacaccaactgattgtagtcccgacactctctcaaagatcagacaggaggtggggccgcctctccccccactattggccccattaattgccacacccccacgcacttctcaacccctgagtcctcttatttcctcgagctcacctagctctccagcatcccccgtaggccaggtctcgcctttccgcgagactcctgtgccgcccgccatgtctccctggcctgaggaccctcgacgagcaagccccccagatcccagccccagcccctcagccgccagtgcctctgagagagtggtgccaagcccactgcaattctgcgccgctactcctaagcacgctctccctgtgcccggtcggttgccgccctgcgcttcaggtcacgccgctgtgggggggcctcaagaaaattccgtcaaaattctagacacaatgtacccggaattgtccgctcgagcccggacactgaacatcctgaagggtaacatccaattgacacgcggaccccctgctgattgtaagaatctcccgggacctgccagtgccatgattgggtttaaaaccattacgagcgccgccactgccttcgtgaaaacaggcagcagctctgggggagactgtaaccaggacaagagcagggatctgggcactcagcaggatagttcaggaaaaagaaccctgtcaacctcaacactgcgctccgctaagcgcttaagacttgataccggaagccctgaaccagagacacgtggtgtgacagctgagggtattcataagaacctccctgggaatctgccccccgccgaagtggccaccacaaatgaggagagatcctgctcatctcccgccgttagcgcagtgtctcagctgcctctgtctccaaaggagacagtggaatcccacgataaagcgatcgcaaacgctcttaagaagattgccgagttcagttttgatctcttgccggtgattcggtcccacgtgtatgtgggaaatatctcaaaaaagcctgttatgcgggatcaggagaaggaagtggtctatgaattttctaccactaaaaaacatcttgctgagtgtctgctgcactccattctgtcagaattaaaaattcagaaaatcagtatggaccacaactatattcacgccctgtgtcgtgtgtatgtgggcatctgcagacaattgggcgatctggagagagcccggttattttgttacagcttgctgaaggaagacttccccgagtctgaaaaactgaccctatttatcgccaatatgtggcatgatatcttcctgagtcaaagcgttatcaacaaggccatgcagttggtggcccgccagagggctaaaggagaagtgttgaattgcctgagagcattcctcaattgggaaaaaaacgctccagttgatgtgggctttatggtctcaaaacttctactgacaattcaactctgccctaagaccgaatttcagcccagtgaaaagtttggtgaagaccttagtgacaacacgtgggaatacatcttcgctatcgatctgctgtgttgccaccagaaatggatatggactcacgataacattattagcaaagagctgtggccagtcatggataagtggatcaaatacagaaaggggcatgccaacattgcatatactccagacattataatcgccagcattcttcggctaatcggacgtcttgggcaactgggcctgaaagaaggttttccctctgctgttaagaacatttcatctgttatcggcatgttcattcagcacgcacacgatgaagacattccctggggcattcagctcgctgctgtgtacgctctttgtgacttgtcaccatccaacccggccgagatttcaaaaatcctggaagcatggaggagggaggcatccaagtcggtgccctccgctatcgtctcttgcctagaggaagtgtctgctctcagcaccgaagaactgggttag

SEQ ID NO: 49884 - DNA, 1362 bp, Artificial Sequence
  Description of Artificial Sequence: Synthetic coding sequence
atggaccagttcggcgacatcctggagggcgaggtggaccacagctttttcgatagcgatttcgaggagggaaagaagtgcgagactaactcagtcttcgataagcagaatgatgatccaaaggaacgtatcgacaaggacaccaagaacgtgaacagcaacaccggaatgcaaactaccgaaaattaccttaccgagaaaggcaatgagcgaaacgtcaaattcccccctgaacatcctgtggaaaatgatgtgacccagaccgtttcttctttcagtctgccggcctcaagtaggtccaaaaagctgtgtgatgtgactacaggactcaaaatacacgttagtatcccaaaccgcattcccaagattgtgaaagaaggagaagacgactattacactgatggcgaagagtccagcgatgacggtaaaaagtaccacgtcaaatcaaagtcagccaagccttctaccaatgtcaaaaaaagcatccggaagaaatactgcaaggtaagctcctcttctagctcctcgctaagtagctcttcctccgggagcggaactgactgcttggacgccggatcggattcccaccttagcgactcatccccttcttcaaagtcaagtaagaagcatgtttccgggattacactgttaagtcccaagcataagtacaaatccggaatcaagagcaccgagacgcagccttcgtctaccactcccaaatgtggccactaccccgaagagtctgaggataccgtaaccgatgtgtctcctctctctactcctgacatttcaccattgcaatccttcgagttggggattgcaaacgatcaaaaagtaaaaatcaagaaacaggaaaacgtatcccaggagatctatgaagatgtggaggacttaaaaaataacagtaaatatctgaaggctgctaagaagggaaaggagaaacacgaacctgacgtcagttccaagtccagctcagtgctggactcatcccttgaccatagacataagcagaaagtcttgcacgataccatggacctgaatcatctactcaaggccttcctgcaacttgataaaaaggggcctcaaaagcatcacttcgatcagccctctgtggcgcccggaaagaactactccttcacacgcgaagaggtgaggcagatcgatcgagagaaccagcggctcctgaaggagctgtcacggcaagctgaaaaaccgggaagcaagtctactataccgcggagtgccgaccatccacccaagctgtatcactccgccctgaataggcagaaggaacagcagaggatcgaacgtgagaacctgaccatttctctgtgtcaccccggttggtcagcagtaacatag

SEQ ID NO: 49885 - DNA, 342 bp, Artificial Sequence
  Description of Artificial Sequence: Synthetic coding sequence
gaggagcgggccgagtacaccgccgacatcatcagcaccaccgtggctgaaccctaccggacttgtttcaccgcgggaggatccaagacatcccccgtggagcagcagcctgagcagcagcagccacaggatattgtgagtcttcccctgccccccctgccacacgccacaccagatccatttacactctatagtcataggactgaatccgccgggggacatctgtttctgccccaggatttgcggtggaagtctcctggcctgggggtgtttgcggtgcagagtgtgtatgaattagcacggcgccacaatgtttctccattttactcagggccaccttag

SEQ ID NO: 49886 - DNA, 1563 bp, Artificial Sequence
  Description of Artificial Sequence: Synthetic coding sequence
atggccggctgcacccggaagctgacccacctgcggaagcggatccaccgaccaagaaggcgcaccacacgacgatggaaaagatggttcaagtttcgaaagcgaaaaggcgaaaaaaggccaagacccaatcataaagccgtagcccgacgggccaaactcaagtttagcacttccgagaagctgcactggccggaacaggaactcgctaagaaatccatcctaaacgctgaggacagcctgattatcgataacaagcgaagcatcagccacctttcctctggcgtcttgaaggacatcttcactaccggaacgtctagctataacgtcctcctccagtcaaaagaggagaagaagtaccatagccagaagcagtccagtagcacgtatagcaagcgttgtcgaaaaccttccaagtctcctaacacaagcaggtccaaggatccacggagaatgaaggccctggtgcctgtcacaagctcaggaacctggtattgcctggagaggaggcccgccgtgttcgtgacttcctctgtgtccagtcccgtgaagtttacacatgacatttccgtgaccgggaacggcattgtgttgccccctaagcctaagtcaaaggtcaagtggtgtcatttctctaccttacccaaacctaagccgcaattgagtcgatcatttgagaagggtgacgatttctccggcaagaaattttgtatactgacagccattaagcccacaaatctcgagaaggagaagttaagattctttaaatctgattatacatataatcctcagtttgagtacgcaaatccggcgcttcctagtgtgctggcaaaacatagccatgcaagtgacagatttcttaagcaaattgttgttcatctgacagaggacctactgagccgtgcctctatgaccgtggtaaacggctgccctaccctgactatcaatgttagcacggcacgcgagcactggctggaaggaatgcttcggcacgagattgggacacattactttcgcggaatcaataatcttcagcagccgtggaattcctggaccgggcggaaaaaacatgagctaaaacctaataatccgacagaggaggggttagcatctatacacagcgtgttattccgaaaggatcccttcttgtggcgtgctgcactactttactacacagtgtaccaagcatcccagatgagtttctgtgagctgttcaaggatatcggacgctttgtgaaagaccctaatactcggtgggattattgtgtcagggctaagcggggatggaccgacacttcacagcccggatgcttctctaaagaccaggtgtacctggacggcattctgcaaatccttcgataccgggacaccattgactttcatctgttgaccgcattgggaaaggtgtcatatgaagacgtggatcgcctgaagggccttgcagtcactgaaaacatgcgggtgcctcatttcctgcaggaccatggacgctacatggagcacttggagaaaatcatggaagtcaacgagctgacagaccgtgaactcaaagacctcatatag

SEQ ID NO: 49887 - DNA, 2748 bp, Artificial Sequence
  Description of Artificial Sequence: Synthetic coding sequence
atgccccggggcagccgggcccggggcagcaagcggaagcggagctggaacactgaatgcccatcatttcctggcgagaggccccttcaggtgcgccgggccggcctgagaactgcaggggcagccgcatccctgtccgaggcttggttgcgctgtggagaaggctttcagaatacctcaggtaacccctcactcacagctgaagaaaaaaccatcactgaaaaacacttagagctgtgcccgagaccgaagcaggaaactactacttcaaagagtactagcgggctcacagatattacatggagttcctcagggtccgatctgtccgacgaggacaagacactaagccagctgcaacgcgacgaactacagtttatcgattgggagatagatagtgatagagctgaggcttcagattgcgatgagttcgaggatgacgaaggagctgtcgagatttccgactgtgcgtcatgcgctagcaatcaatcgctgacaagcgacgagaagctcagcgagctccccaagcctagcagcatcgagattttggagtattcctccgattcagaaaaggaggatgacctcgaaaatgttcttctcatcgactcagaaagccctcataagtatcatgtgcaatttgcgagtgatgcgaggcagattatggaacgtctgatcgacccacgaaccaagagcacagagaccattttgcacactccccagaagcctaccgctaaatttcctagaaccccggaaaactccgctaaaaagaaactgctgcggggagggcttgccgaaaggctaaatggcctgcagaacagggagcggtcagccatcagtttgtggcggcaccaatgcatttcgtaccagaagactctgtctgggaggaagtctggagttctgacagtgaaaatcctggaactacatgaggagtgtgcaatgcaagtcgccatgtgcgaacagctgcttggcagccctgccacctccagttcccaaagcgtggcaccgcgcccaggggccgggcttaaagtcctatttacaaaggaaacagctggctatttgagagggcgcccgcaggacacggttaggatatttccaccttggcagaaactgatcatccccagcggctcctgtcctgtaatcttaaacacgtacttctgcgagaaagtcgttgccaaagaagatagtgagaaaacctgcgaggtgtattgccccgatatcccactgccgcgaaggtccatttccctagctcagatgttcgtgatcaaggggctcacaaacaattcacctgaaatccaggtggtatgcagcggtgtggcaacaacaggtaccgcttggacccatggccacaaggaggccaagcaacgcattccgacatccacccccttacgggactcactcctcgatgtggtggaatcacaaggcgctgccagttggcccggagccggggtccgcgtggtcgtccagagagtctatagccttccctccagggatagcacccgcgggcagcagggcgcctcatcaggtcataccgatcctgctggaactagagcctgcttgttagttcaggacgcgtgtggcatgtttggcgaggtacatctggaattcactatgtccaaagcccgtcagttagagggtaagagttgtagcctagtgggcatgaaagtcctacagaaagtgactcgcggtaggactgcggggatctttagccttatagacacattgtggcctcccgccataccactgaaaacacccggcagagaccagccatgtgaagagatcaagacacatctgccaccgcccgccctttgttacatcctcaccgcccacccaaacctcgggcagattgacatcatcgacgaggaccccatctacaaattgtatcagccccctgtaaccaggtgcctgcgtgatatcctgcagatgaatgacctgggcactcgatgcagtttttacgccaccgtgatataccaaaagccacagttaaaatccctgctgctgctagaacagagggaaatatggctcctggttacggatgtgacactgcagacaaaggaggaaagggatccaagactccccaaaactttgctggtgtatgtggcccctctctgcgttctgggctcggaggtgctcgaagctctggccggtgccgcacctcattcactcttcttcaaggacgctctccgggaccagggcagaatagtttgcgcggaacgaacagtgctgctgctgcagaagcccttactctcggttgtctccggggccagtagctgcgagctgcctggccccgtgatgctggatagtctagacagtgccacacctgtcaactccatttgtagtgtccaaggtacggttgtgggagtcgatgaaagtactgcattttcttggcctgtttgcgatatgtgcggaaacggaagactcgaacagcgaccagaagatcggggcgcattctcctgtggagattgcagtcgggtggtgacgagccccgttctcaagcgccatctacaagtcttcctcgattgtagaagtaggcctcagtgcagggtgaaggtgaagctcctgcagcgctccatcagcagcttactaaggtttgctgcgggtgaggatggctcatacgaagtgaagtccgtcctcgggaaggaggttggactgctcaattgcttcgtccaatctgtgactgcccacccgacatcatgcattggacttgaagaaatcgaacttcttagtgcaggcggcgcatctgctgaacattag

SEQ ID NO: 49888 - DNA, 918 bp, Artificial Sequence
  Description of Artificial Sequence: Synthetic coding sequence
atggccagccggcagcccgaggtgcccgccctggaggccagcgcccccctgggtaagatgagtctcccaatcggaatatacaggagagctgtctcttacgacgatacgctggaggatcctgctcccatgactccgccaccttcagacatgggatccgtgccctggaagccagtgatccctgagcggaaatatcagcatctggccaaggtcgaggaaggcgaagcttccctgccatcacccgctatgacactgtcctccgcaatagatagcgtggataaagtccctgtggttaaagcaaaagccactcacgtgatcatgaatagtctcatcaccaagcagacacaggaatctattcagcacttcgaaaggcaagcaggacttcgggacgctggatacacgccgcacaagggtttgaccaccgaggaaactaaatacttgagagtcgctgaggcccttcacaagttaaagttgcaaagtggagaggtcacgaaagaggagagacagcctgctagcgcacaatcaacaccatcaacaacgcctcatagctcacccaaacagagaccgagaggctggttcacaagcggatcaagcactgccttgccggggcctaatcctagcaccatggactctggatcaggggacaaagatagaaacctgtccgacaagtggagcctgtttgggcctaggtcactacagaagtatgatagcgggagctttgccacacaggcctatcgtggcgcccagaagccctcacccctggaactgattcgtgcacaagccaatcggatggccgaggacccagccgccctgaagccacccaagatggacatacccgttatggaagggaaaaagcagccgccgcgggctcataacttgaagccccgagacctgaatgtcctgaccccgactggcttttag

SEQ ID NO: 49889 - DNA, 3213 bp, Artificial Sequence
  Description of Artificial Sequence: Synthetic coding sequence
atgtactgctgcagcgcccaggacagcaagatggactacaagcggcgattcctactgggcggcagcaaacaaaaagtccaacaacaccaacagtacccaatgcccgaactcggcagggctctttctgctcctctggcatcaactgctacaactgcgcccttgggatccctgactgccgctggctcctgccaccatgcaatgccacacacgacacccattgcggacatccaacagggcatctcgaagtacctggatgcgctgaacgtcttttgtcgagccagcacctttttgactgatttgttttccacggtattccgcaactcacactattcgaaggctgctacgcagcttaaagacgtccaggaacatgttatggaggcagcctccaggctaacctcagccataaagcccgagatcgctaagatgcttatggagctttctgccggcgcagcaaattttactgaccagaaggagttttccctgcaggacatcgaagtgctgggcagatgtttcttaacagtcgtgcaagtgcactttcagtttttgacccatgccttgcagaaggtacagcccgtggcccacagctgcttcgctgaagtgatagtgcccgagaaaaagaactccggatccggggggggtttgagtggaatgggccacacacctgaggtagaagaggctgtgaggagctggcggggggcagcagaagcgacgagcaggctgagagaacggggctgtgacggctgtcttgctgggatcgaggtgcaacaactgttttgctctcaaagtgcggcgatacctgagcatcagcttaaggagctcaacattaagatagactcggctcttcaggcttataagatcgcgctcgagtccctggggcattgcgagtatgccatgaaagccgggttccatctcaatcctaaggccatcgaagcgtctctccagggatgctgttctgaggcggaagcacaacagacaggtcgccgccagactcctccacagcctatgcagtgtgagctacctactgtccccgtgcagataggttctcatttcctgaagggagtcagctttaatgagagtgccgctgacaacttgaaattgaaaacccataccatgttgcagctgatgaaggaggcaggatgctacaatgggatcaccagccgagatgatttccccgtgacagaggtgcttaaccaggtctgcccgtcaacatggaggggtgcatgtaaaactgccgttcagcttctgttcggacaagcgggactcgtggtggttgataccgctcagatcgagaacaaagaggcctatgcacctcagatctctcttgaaggatcacggatagtggtgcaggtgccttccacatggtgccttaaggaggaccccgcgacaatgagcttgcttcagcgcagcttagaccctgaaaaaacccttggcctcgtggacgtactttatactgccgttctggacttaaaccggtggcgggccggaagagaacaggccctgccgtgtattcaaatccagctacagagagaaatatgtgattttggtaaccaagccgatcttccgagtggaaacgggaataaatccagcggggggctccagaagacgttctcaaagttaacttcacggttcaccaagaaggcatcctgtactagcagttccagctccaccaactacagtatacagaatacccctagcaagaacatctttatcgccggctgctctgaggaaaaagccaagatgccgggaaatatcgatacccgcttacagagcatactcaatattggcaatttccctcgcacaacagatccttcacagtctgcacagaatagctctaatacagtagctaatggatttctaatggagcgccgagagaacttcttgcacggggacgacggtaaagatgaaaagggcatgaacttgccgacagatcaggagatgcaggaagtgattgactttctgtctggttttaacatgggtcagtctcaccagggttctccgcttgttacgcggcataattcagctgccacagctatggtcactgaacaaaaagcgggtgccatgcaaccacagcagccaagcttgccagtgcccccaccaccacgcgccccgcaggccggtgctcacacacctttgaccccgcaacctggcctggccccacaacagcagtctcctaaacaacagcagcctcaagtacagtattaccagcatctgttgcagccaattggtcctcagcagccccctccacagcctcgtgctccgggaaagtgggttcacgggtcttctcagcagccggcacaggcagttggagcgggtctctcgcccctgggacaatggccgggcatttcagatctgtccagtgatctgtactccttagggctagtaagtagctacatggataacgtaatgtccgaggttctaggccagaagccacagggtccgaggaataacacctggcccaaccgagaccagtccgatggtgtctttgggatgctgggcgagattcttccttttgatccagctgttgggagtgaccctgaattcgccagatacgtggccggcgtgagtcaggcaatgcagcagaaaaggcaagcacagcacggacgacggccagggaatccccgaggcaattggccccctatggatgatgcacatagaacctggccctttccagagttcttcaccgagggcgacggtctgcacggcggctggtccggggcccagggcgattctgccagtagctcagatgagacaagctccgcaaacggcgattccctgttttctatgttctctggccccgatctggtggcggcggtgaagcaaaggcggaaacactctagcggcgaacaggacacatccacactgccttctccaccgctgcttaccaccgtcgaggatgttaatcaggataataagaccaaaacctggccccctaaggctccttggcagcacccaagtccgctgccctccactctgccctcaccaagcgcccctctatacgctgttacaagcccaggttcccagtggaacgacaccatgcaaatgttgcaatctcccgtgtgggcggcaaccaacgactgttctgcagcagccttttcctacgtgcagacacccccacagcctccaccccccccagcccacaaagccgctccaaagggatttaaggccttccccggaaaaggcgaacggcggcccgcttaccttccgcagtactag

SEQ ID NO: 49890 - DNA, 4188 bp, Artificial Sequence
  Description of Artificial Sequence: Synthetic coding sequence
atgtaccccatctgcaccgtggtggtggacggcctgcccagcgagtcatcatccagctcgtaccctggtcctgtgtccgtttccgagatgagcctgctgcatgctctgggacccgtgcaaacctggctggggcaagagctcgaaaaatgcgggatagatgcaatgatctacacccgatacgtgctctcattgctgttacacgacagctacgactatgacctgcaagagcaggagaacgacatattcctgggatgggaaaagggggcatataagaaatggggaaaatcaaagaagaagtgttctgacctgaccctggaggaaatgaagaaacaggctgctgtgcagtgcttgcgctccgcttctgatgaaagcagcggtatcgagacattggtagaagaattatgttctcggctgaaagacctgcagtctaaacaggaagagaagatacacaagaaattggaagggagccccagtccagaagcagaattgtcacctcctgcaaaagaccaggtcgaaatgtattacgaggccttcccaccgctgtcagagaaacctgtctgcctgcaagagatcatgactgtctggaacaagtcaaaagtttgtagctactccagttctagctcttccagtactgcccctcctgccagtaccgatacttcctcgccaaaagactgcaacagtgagagcgaggtgactaaggagagaagcagcgaagtacctactaccgtgcacgaaaaaacccagagtaagtctaagaatgaaaaagagaacaaattttcgaacggaactatagaggagaagcccgccctgtacaaaaagcagatcaggcacaagccagagggcaaaatcaggcctcgatcctggagcagcgggagtagtgaagccgggtcctcgtccagtggtaaccagggcgagctgaaggccagtatgaagtacgtaaaggtacgccacaaggccagagaaatcagaaacaaaaaagggcggaacggtcagtcccgcctgtcacttaagcacggagaaaaggcagaacgcaatatacacactggctcttcatcctccagttcttctggatcagtcaaacaactctgcaaaagaggaaagcgcccactgaaggagataggtagaaaggatccaggcagtaccgagggtaaggacctgtacatggagaacagaaaggatacagaatataaggaagagcccctgtggtacacagaacctattgcagagtactttgttccgctgtccagaaagagcaaactggagaccacttatcggaatcggcaggacactagtgacctgacctccgaagctgtagaggagctgtctgagtctgtccatggactctgcatctctaacaataacctgcacaagacatatttagcagccggtacctttatagacgggcactttgtggagatgccggcagtgattaacgaagacatcgatctcactggaaccagtctgtgcagcctgccagaggataacaagtacctcgacgatatccatctgagcgagttgacccacttttacgaggttgacattgaccagagcatgcttgatccgggcgcaagtgagaccatgcagggtgagtctcggattctcaacatgattagacagaaaagtaaagaaaataccgacttcgaagctgaatgctgcattgtgttggacgggatggagcttcagggcgagagagccatctggaccgactctacctctagcgtgggagccgagggattatttctgcaggatttagggaatctcgcacagttttgggaatgctgttcttccagcagcggggatgcagatggggagagctttggaggcgatagccccgtgaggctctctcccattctggatagcacagtcctcaactcccatctcctggctggaaaccaggagctgtttagcgatatcaatgaaggtagtggtattaatagctgtttctcagtattcgaggtccaatgctccaacagcgtgttgccgtttagcttcgagaccctcaatctaggaaatgagaatacggactcctccgccaatatgctgggcaagacacagtccaggctgctgatatggacgaagaatagtgccttcgaggagaacgagcactgttctaatctgtccactcgcacatgcagtccttggtcccacagcgaggaaacccggtcagacaatgaaaccctcaatatccaattcgaagagtctacacagtttaacgcagaagacattaactatgttgtgcccagagtttcctctaattacgtggacgaagagttactggatttcctccaggatgagacctgccagcaaaatagtcgaaccttaggcgagatcccaacgcttgtgtttaaaaagaccagcaaacttgaaagcgtgtgcggcatacagctggaacagaagaccgaaaataagaatttcgaaaccactcaggtgtgcaacgagtcaccccatggggacgggtactcctcaggtgtcatcaaggacatttggaccaaaatggccgacacgaactccgtcgcgaccgtggagattgaaaggaccgacgctgaacttttctctgccgacgtaaacaattactgttgttgcctagatgcggaagccgaactggaaaccttgcaggagcccgataaggccgtacgccgctccgaatatcatctttgggaaggacaaaaggaatccttggagaagcgagcattcgcctcttctgagctgagcaacgtcgatgggggcgactacaccacaccctctaaaccctgggatgttgcccaggacaaagaaaatacttttattttgggtggggtgtacggcgaacttaaaacgtttaatagcgacggagaatgggctgtggtgcctccgagtcataccaagggatccctgctacagtgcgccgcttcagacgtagttacaattgccggcacagacgtgttcatgactcccggtaattccttcgccccgggacacaggcaactatggaaacccttcgtgagcttcgaacaaaatgatcaacctaagagcggagagaacgggctgaacaaaggattctccttcatatttcatgaggatctgttaggggcctgcggcaactttcaagtcgaggacccggggttagagtacagttttagttcatttgatctctctaacccattcagccaagttctgcacgtcgaatgttcttttgaacctgagggaatagcctcttttagcccctctttcaaacccaaaagcattctatgtagcgactctgattctgaggtgtttcacccccggatatgcggcgtcgaccggactcagtaccgcgcaatccggatatcaccgagaacgcattttcgacctatctcagcatcagaactaagccctgggggaggcagtgagtcggagttcgaatctgagaaagacgaagcaaacattccgataccgagccaggttgacattttcgaggatccccaggcggacctgaagcccctggaggaggatgccgagaaagagggccactattacggcaagagtgagctagagagcggcaaattcctgcctaggcttaagaagtcaggtatggagaaatcggcacagactagcctcgacagccaggaagaatccaccggaattttatccgtgggaaaacagaatcagtgtttggaatgtagtatgaacgaatcgttggagatcgatcttgaatcaagtgaggctaactgcaaaatcatggcacaatgtgaggaagaaatcaacaacttttgcggctgcaaggccggttgccagtttcccgcctatgaagataaccctgtttcctcaggccagctggaagagttcccagttctgaacacagacatccagggcatgaaccgatcgcaggaaaagcagacttggtgggagaaggcattgtatagccctttattcccggcctcagaatgtgaagaatgttatacaaacgcaaaaggcgaatccggtctcgaagagtatccagacgccaaagagactcccagcaacgaggagcgactgttggattttaacagagtgtcttcagtctatgaagcacgctgtaccggggagagggactctggagctaaaagcgacggcttccggggcaaaatgtgcagtagcgccagctcgacaagcgaagagacaggatccgaaggaggaggcgaatgggtgggccccagtgaggaagaactgttttctcggacccatttgtag

SEQ ID NO: 49891 - DNA, 5229 bp, Artificial Sequence
  Description of Artificial Sequence: Synthetic coding sequence
atgtggcccgccggcgccggcaccaagctgccctgcccccgggactccgcactgcgccgcgccgctttcagtggaaaccttaccgcactgccctcacatctggtccccgcgggaaggtcagtccgcgtgtttatctccgctaatccagaggacacaggagctgaaagacaggcgctgagagagaatgtgtaccccaagcttagggagttctgccgggagaattacggactcgagtttcaggttatcgatttatactggggcgtggaggaagacgagtgggacagccccgagttgcaaaagactaggatgaagctcctggagaattgtctgaagacaagcgccgggccgtgtttcgtgggactattaggcgaaaagtacggtaatatccgaattcccggcgaggtggaagcctcagagtttgaaatgatcctggatgccgccatagaagccaaactggaaaccaaactgctggaagagtggtactgtcgagatgaaaattctgtgccggcggcctattatctgagacctaaaagcgagatgctccgatcgaatcgcaacgccatgcaaccatcaacgaacgccgagaacgaaaagacgtggcaggagatttccgacgaaatcaagaagatatttaaagccgcggttaagctgctccatgaaaaaggcaaaatgaagcactcccaggcaaagagatacttgttcagcgctatcgaggatgaattcgattttgccctgggcaaacagacacccgccttccttaagaagtgtgtgtgttatatacgcaaaatcgccaatatcgaacggttcgtgaaaattccagagatgggcaagtacatggacatcactgggaccgaaccgaggattatcagagatccagaggcccaggaaaaattgatcaaactgcgggatgaatttattcctactatagtggcgtccagtaatttgcgcgtctacacctctgttacccattgcgacatgaaactgggctatagtcaagagatagaaaaccactacatcgagggtctaggaaagcagttttacgaggacatgatagatattatacaggctactatccagcagaacttcgataccgaaacagataccctctatgacgagatcttgcagcactcctcactgtgcaaaacctacgccagcttctatgaatataaatgcgagagcctgaacatcgtccataactatatattgccttccaaggccggccacatcaatccattgatcatctacggcggaccctgtacagggaaaaccctactgctggccgaagtggccaagaaagcctatggatggctccatgaggataccggccccgagtcagaccctgtagtaatagtgcgcttcctcgggaccacagatatgtcgagcgacctccgaaccctgctgctgtcagtatgcgagcagctcgcagtgaattaccggtgcctggtccagagttacccaaagaagatccacgacttgtgtgaccttttcattaacctgctgaatgagtcctcacttcagcgccctttggttattatctttgacgccctcgagcagttgagcgagaatgatgatgctcgcaaactctggtggctgcccgcccatctgccgaggttcgttagaattgtacttagcacccttcctaataaacacggaatactgcagaagttgcggtgcctgattcatgaagaggacaactatattgaactgatccctcgggataggaagatgtgcagccaggtgcttaagcaccagctgctcagggtgaaacgaaaggtgacctcagggcagcagatttacgtgaataacgcactcagcaaatgcacactgccaatgtttgtcaatctgacattcagggaagtcagacattggcggtcacacaaagacgtggacgaatcaagcctcagcgtgactgttcatgaaagcatcgagcagctgttctggtccctggagaaaaaatgcggacagaagctggtgtcacgggccctcggttatatcaccatggctaaaatgggactcagcgagatggagctagaggatgtgctggcacttgacaacagcgttatgtctgagcttaaagagaataccagaccatccaacccccttagagtaccatacctgtatatcgccaggcttaaagaggggttatccggttatcttattgagagacacgtcaagaacgtgaccctgctggtttgggctaacagacatttgcagcttatcgcccagaagctttatcttcaggatgacaacgacctaagagaaatgcacacaattctagccgactatttccttggagtgtggtcaggaggcaggcggaaagcgttctgcctggaggacccctatctgaacggttgcctggatctggaaaacagaagtttgttagaggaggagaaacacttcatggagcaggcttcgttcgataggcaggctccggatcagccttgggtttttcagtgcaaccccttagagccagacatctttttcgtaaatcatcggaagatgtcagaattgctgtatcacttgacccgctgtggcaagactgatgatctgctatacggaattataatgaatttttcatggctgtataccatgatcaaaatcggacagtttgacaaggtattaagtgacatagaactcgcctacaactatagccaagagaaagaactgaagttcttggccaacactttgcgatctattaagaataaagtcacagcattcccaggttctctatccgccgagctacaacagaggttgctgcctgttgtaagctcgttacctaaactgaggcacctcttgctggaatgcgacaaggacggacccaagtactgctccatcgtgcctctgcatagttctatggacgtgacttattctcccgagcgactccccttgtccagcagccatctccacgtgacagaaattctccccacctgcaaccctagtacggtgctcaccgccttagaaaacggctcaatatcaacttgggatgtggagacccgccagctcctgcggcagatcacgaccgcacagagcgtcatactggggatgaagttgacgtctgatgaaaagtatctagtggtggcaacaactaataatacgctcttaatctacgataacgtcaatagttgcttgctgtccgaagttgaaatcaaagggaccaaacacggctcaagcgccacgtatattaatggcttcacgctgtccgcgaaccacgcgttggcttggcttgaggcctcaaaggatgtgaccgtcatcgacctgctctatggctggccactttatcagttccactgttggtacgaggtcacttgtgtgcagtgtagccttgacggcctctacgccttttgcggccagtatttgaacacaaccaccatctttcacctagggagcggcgagaagctctgtacagtcactagcgagttttcaggcggcttcgtgaaattcctccttatcctcgatactgctcaagagatggttatggtggatagtgaaggcagtctgagtgtgtggaacaccgaggacattagcagtccgcagctgacagatgacttcgactgcaggcgggaggacagcgaggtggtgtccattgaactaagcgaagaccaatccgctgttcttatctgcaaagccctgagtatcgagctcttagatactgggctctggaaagtggccgaaaaattccgtgccaaacacaacgagcgctttattagcgcagtactgtccaaaaacggtgattgcattatcgccaccatggagaatacttcagctgtctttttctggagacgagacaccggacagtgtatggccagtctccaggagatttccggctcaattgtaaaacttgtcaaatcttctcaccacaatatgctactaagcctgagtacaagtggagttctcagtatctgggacatcgatatcataacggccatgagtaacatcgacaaaaccggcaaacctatccagagcctgctgttacctgcacgcggcgagattatctattcactcgatggatctgattgtgtgcataagtggaatttcagctccggctttattgaggctgtatttaagcacgagggcattgtggagcactgtgttctcacttctacaggtgatatcatggtcacctcagatgacaagagctcacagtatgtttggcacacgtcgtctggcgagaacttgtttcggattaatggacaacgtatcagtcagctgctcataactcacaatgatcagtttgtggtttcattgtgtgaagaaaatgcctcccgtgtctggaggctcgctaccggccatcgggtctgtaatattttaacgactttgcagaatgcatttattacttccgccaacaccttcgtcgtcggtatgactaaatctaaggtgctggctgtgagcctgtggacaggatctataaccaagaagttttgctgcgaggatggtactacaatagtgaacttcaagttgattcccgactgtcccgacatcatcgttttcataacctccgcagagacagttaatatatggagcttaactgatgaggtcatttgccgccgggtgcaactgcctaacaactttttaaaaaacctcgaggacttcgagatctcaccaaatggcaagctgggtatcattgctcggggagacgagaatatcaatgtgctggatctctacagcgggaaattgcgtgttgtgcatgcgtcagggataatctggcggcaaagactgtcacgggacggcaggtacctggtgtatatttgcttccgtaatggtgaggaggaagacgaaaatggagcaatcttttcattgatcgttatgaggctcgcggatggcaagaatattggggcctgctccctctacaagacacccacattcctggccctgtctcagcggcacctgaacatcatcgttggctttgacgacggaagcataggcatatataccgtggtcgaccgcgtggacgcagccctcaagatcaagattgcaaccagcaactccagacagattttcaataatgccactcacacttcacggcctaaatgcaattcctactgtttcaagatttcagttgattgcttgtggcgagaaagcacagaagtcttcgcccgagacagccccatcacggtttccgacagtaccgagtcaaacgaggctaccccttccaagaaacacaactcgtgctatgagcgggtttgtagtgccctggaggcacgggggcattcctacgccccagacaattag

SEQ ID NO: 49892 - DNA, 348 bp, Artificial Sequence
  Description of Artificial Sequence: Synthetic coding sequence
gtgagcggcggcgtgcggctgcccgccagcgagcggcggttcctgagctgctgtcccttacctgcccgcccactcctgcagcggctggcttctagacacccagccagcctcccatgctctcagcagttgttgtggagaagttctagagctccacccttgctacccagcctgcctcttggagttctgataaccgatccattaacgaggcaccccgggcatcatcaccctgccccattccattccgccgccctgctggtgcctgtgaaacctccaaccgcctgggaagggaagagtaggctggcgcggccatgtctttcccaggccctggaggcttgtcagctcacttag

SEQ ID NO: 49893 - DNA, 585 bp, Artificial Sequence
  Description of Artificial Sequence: Synthetic coding sequence
atggccgccaagagcacccaggacagcctgccccgggacaccggcgagcctagcgcgctgccagtgcagggacgggccgaggggcgatcgtccgaaggtcggaaagagcggacagcagagtgtgcccttagaggcaaacaggcgtctgagcccgcactccgtaagcggaactttcttcctggccccaatagcgacaccgtgcgccccgccgcagagacagagctggttccttgttctctgcgacatccacggcaggatttgtgtggagaacacccatctttccctgtgatgcaacccagtctggagactcaggccaagcccgagcgcgatagagctgtcttgatcccgcctaagggcccctggccacctgcccaggggctggccatgagaacacactgccccacgggacctccaagcaaggcttactgtcggggtggatcctcctcaacatctagaaatcaggtcgctagcttggcctaccgaactcagaatacagccgcctcccagccgcgccaaccaggcggacgaggcaaggaggatacagcgggatatggctcctgcagtccccgttcactggcggtgtag

SEQ ID NO: 49894 - DNA, 2817 bp, Artificial Sequence
  Description of Artificial Sequence: Synthetic coding sequence
atggactgggacgacgagtacagccacaacagcttcgacctgcactgtctgctgaacagtttcccaggggatttagagttcgagcaaatctttagtgacatcgacgaaaaaattgaacagaatgctgccagtataaagcactgtataaaggagattcagtcagagattaataagcagtgccctggcgtgcagctccagacaactacggactgctttgaatggctcaccaattataattacagcaccagtgaatcatcttttatctcgcacggtgacctgataaagtttttcaagaccctgcaagacttgctcaaaaatgaacaaaatcaagaggaaatgaccttagacctactctgggatctatcctgccatagctccgtctcctttccaagtacactgagcggcactagctttcactttctctcccgcacatccctccacagcgtggaggataacagctctatggacgtgaagtctatgtgggatgatattcgcctgcatttgcgtaggtttctggtgagtaagctccagtcgcataatgagatcaacaattctcagcagaagattctgttgaagaagcaatgtctgcagcagctgctattcctctacccggaatccgaggtcatcattaagtaccagaacatccagaataagttgttggccaatctgttgtggaattgctttccttcatacaaccgtgatagcaatctcgacgtcatcgcacatgggtaccaatctactatgctgaagttatactctgtaataaaggaggactttaacacactttgcgagattctagcacccagttccatggtgaaatttataaaggaaacttatttagacactgttacggaagaaatggctaagttcctggaaaatttctgcgagttgcaattcagggagaacgccgtgcgggtcgttaaaacctctaagtccagttcaaagcataggggggccgtgcacgccctggttaccaccgagtgtccacagaaaggccgtaatttttctctcccattggataaagtggagtttctgtctcagctcattaaatctttcatgaagcttgaaaaaggcgtccaggagcttttcgatgagattttgctttccctcaagatcaccagagatacaagcggcattctggagaagtctgaccgtgaagtggttatggagaagccgagagccaacgagacgaacatccctagcgagcaaagcttgcctggaaaggaggccacactcctggattttggatggcggtctgcctttaaggaagtgagtctacccatggcccattgcgtggtcactgctattgaaggattttccactaagattttacaacaggagcaaaacgagagatcctcagctgtgagctacgctatgaacctggtcaacgtgcaacaagtttggcaggattctcatatgttccctgaggaggagcaacccaagaagatcggaaaattttgcagtgacatcatggagaagcttgatacaatgctgccactggcactggcttgccgcgacgacagtttccaggagatccgggccaacttggtggaagcttgctgcaaagtggcaacggccgttctgcaaagattgcaggagagggctaaggaggtgccttcaaaggccccactgaaaaatctgcacacgtacttaagtactgctgtctatgttttccagcacttcaaacgttacgataacctgatgaaggagatgacgaagaagccgatctttcttgttctggtccagcgttaccaggaatttattaacaccttacagttccaggtcaccaattactgtgtaagagtgtgtgccacatccattctgcaagatgcagagagccaccactgggacgactataaagccttttacgaaggcgaacgttgttcgttcagtattcagatgtggcactacttctgctggtctctccattatgacctgtggacgatactacctcctaagctggcacaagagattctcgtggaagtgttggaaaagtctctttctttactcgcatcacggtatgcgcgggctcacccctccagaaaacgtactccccagctcagattggatgtgaccactatactgatatgtaccgaaaatatgctgtggagcgtgtgcacatccgtccagaagttactcaacccccatcagcatactgatgataagattttcaagattcatactcactgcaataacctgtttaccacacttgtcatacttacctcccctctgacagagctgtacaagacttttcagcatggtctcgacgaatccgctagcgactcgcttaagtcttttttcaagcagccattatactgggtttcttgcatctctcacttttacccctcactgctccggacccctagcgctggtggactaaaggcagagggccaattgaagctcctcctctcacaaccccggtgcaactggaacctcttactcgaaacactgcttcaccatgacggcctactgttaaggatactgctgaagtcctctaaaagaacgtttcaggagcaggtatctgacacagaaaataacctcaaccagggaccgtctctcatggaagcaattttcaaaatcttataccactgcagcttctctccccagacctttgccaatgtcttcgtgtcttacatggaggaggagcagctttgggatttcttgtacaatatacctggcatgcgccatctcctcttcgtgaaggagatgttttacagatatctgtatgtacctctcaaaatgttccggagttgcattgatacggggtttgctgagagcgtcgtcggtgaaagcctcccttacattttctctgtgtag

SEQ ID NO: 49895 - DNA, 480 bp, Artificial Sequence
  Description of Artificial Sequence: Synthetic coding sequence
atgcggaacgcccggagcatccggcccgcccgggccgagagctggcgtctgtcactctgtttccttaattggcaggatgctattatcagtaaaccccactgtccggctggaagaacttgcccaacagccgccgcctctcacggcagccgcggcgcaggacatagtgataaggaccagggcagaagtcctaaacacgtggtgtgtcacgtcgagcacaagaagcagtgccctgccgagttcacggatagcagaggagtacacaatgctgcggccagcatttctagccaggtcggtttcccaggccatctcaccgcgcggaccgctgcacacaagcgggaagcgctggccgtttccccgacacccacattacaagtgaacgctcctggtgctaaattgagggcccctaaggcccctaggactccggaagcactgggcagaggcccaaagagagcgggcgagtggaagacgggctgtttttag

SEQ ID NO: 49896 - DNA, 3240 bp, Artificial Sequence
  Description of Artificial Sequence: Synthetic coding sequence
atggacgacgacgacgacagctgcctgctggacctgatcggcgacccacaggccctgaactatttcctgcatggccctagcaataagagcagcaatgacgacctgacaaatgcgggatactccgccgcgaactcaaactccatcttcgctaactccagtaacgccgaccctaagagtagcctcaagggtgtctcaaaccagctcggtgagggacctagtgatggactgcccctctcgtcatctcttcaattcctggaagatgaactggagagctctcctttacctgacctgaccgaggaccagccctttgatatcctgcagaagagtctgcaggaggccaacatcaccgaacagactctagccgaggaggcgtaccttgatgcgtccataggtagctcacagcagttcgcacaagctcagctgcaccccagcagcagcgcctccttcacccaggcttccaatgtcagcaactactcaggccagactctgcagccaataggagttacacatgtccccgtcggcgcatctttcgcgtcgaacactgtcggcgtccagcacggatttatgcagcatgtgggaatctctgtgccaagtcagcatctcagcaatagctcccagattagcggatcaggccagatccagctgataggtagctttggcaaccacccctctatgatgaccatcaacaatctcgatgggtctcagattatacttaagggttccgggcagcaggccccaagtaacgtaagcggtggcctgctggtgcacagacagacaccgaacggaaattccctgttcggcaactccagcagcagccccgtcgcccagcctgttactgtccctttcaattcaacaaattttcagacttcattacctgttcacaatattatcattcaacgcgggctagcccccaattccaacaaggtacccataaacatacagcctaagccaattcagatggggcagcagaacacatataatgtcaacaacctcgggatacaacagcaccatgtccagcaggggatctcatttgctagcgcttcaagccctcagggcagcgttgtgggcccgcatatgagtgtcaatatcgttaaccagcagaatacgagaaagcctgttaccagccaggccgtgagctcgactgggggatcaatcgtcatacactcccccatgggacaacctcacgcgccacagagccagtttctcatccccacttcactgtccgtgtctagcaattccgtgcaccacgtgcagaccataaatggccagctactgcaaacccagccatcgcagttaattagcggtcaggtggcatccgagcacgtgatgttgaataggaacagttcgaatatgctcagaaccaatcagccatatacaggacctatgctgaacaaccagaacacagcagtccatctggttagcggccagaccttcgccgccagcggcagtcctgtgatagccaatcacgctagccctcagcttgtcggggggcagatgcctctgcagcaagcttctcccactgttctgcacctgtcccctggacagagctctgtgtctcaaggccgccccggcttcgccacaatgcctagcgtgacttctatgagcgggccatctcgctttccagctgtgagttccgcttccaccgcccacccatctctaggctcagcggtacagagtggcagctctggcagcaattttacgggtgaccagttgactcagcccaaccgtacacccgtccccgtgagcgtgtcccatcgcttaccagtgagttcaagtaaatctacatccacctttagcaatacaccaggcaccggaacacagcaacagttcttttgtcaggcccagaagaaatgcctgaaccagacctcaccgatatcggctcctaaaacaaccgacgggttgcgtcaagcccagatcccaggactgttgagtaccactctgccaggtcaggacagtggctcaaaggtcatctcagcttcactggggacggcccagccccagcaagagaaggtggtgggcagtagccccgggcaccccgccgtacaggtggaatcccacagcggaggtcagaaaaggcctgccgctaaacagctgactaaaggcgcatttatcctccagcagctgcagcgtgatcaggcacacacagtgacaccggataaatctcatttcaggtctcttagcgacgcagtgcagcggctgctgagctatcatgtctgccaagggtcgatgccaaccgaggaggacctacgcaaggtggacaacgaattcgagacagtggccacgcagctcctgaaaagaacacaagccatgctgaataagtatagatgtctccttctggaagatgctatgcgcatcaaccctagcgctgaaatggtaatgatagaccgcatgtttaaccaggaagaacgcgctagccttagtcgagacaaacgcttggctctcgtagatcccgagggctttcaggctgatttttgctgtagttttaagctggataaagccgctcacgaaacccagtttggtcggtcggaccagcatggtagtaaggcttcatccagcctacagccccccgctaaggcccagggccgggatcgcgccaagacaggtgttaccgagcctatgaaccacgaccagtttcacttagttcctaaccatatcgttgtgtctgccgaaggaaacatatccaagaagactgaatgcctggggagggcactcaagttcgacaaagttggactagttcaataccaaagcacctcagaagaaaaagcttcccgccgcgagcccctcaaagcctcccaatgttcaccgggtccagaggggcatcggaagactagcagccggagcgaccacgggaccgagagtaaattgtcgagcatcctggccgacagccacctggagatgacttgcaataactcttttcaggacaagagtttgaggaattcaccgaagaatgaagtgctacacactgatatcatgaaaggcagtggtgagccccagccagacctgcaattgacaaagtccctagagacaacattcaaaaacatactagagcttaagaaggctgggcgccagccccaatcagatccaaccgtcagcgggtccgtagaactcgattttccaaactttagccccatggcgagccaggagaattgcttggagaaattcatcccagatcactccgagggagttgtggagacagacagcatcctggaggccgcggtcaactctatccttgaatgttag

SEQ ID NO: 49897 - DNA, 1566 bp, Artificial Sequence
  Description of Artificial Sequence: Synthetic coding sequence
atggaggccagcgtgctgagccccaccagctgggagaagcggcgggcctggctcagacagtcacgcaattggcagactcaggtactagaggaggaagctgcagctgccctgcaggatgtcccggaccccgagcctagttcacttgatgatgtctttcaggagggcaatcccattaacaaaattgaggactggctgcaggattgcggatattctgaggaggggtttagtgaggaggccgggcagttcatctacaacgggttctgctcacacgggacaagttttgaggatgatctcacccttggcgccgaggctactttacttgccgccaacggaaaactgttctccagaagctttctcgaaacagctagaccgtgccaacttctggacttggggtgtagccttgcctcctcctcaatgacaggaggaaccaataaaacgtcttcgagcatctcagagatactcgacaaggtccaggaagatgccgaagatgtcctgtttagccttggcttcggtcaagaggaccacaaggacacctccaggattcctgcaaggtttttcactaccccatcccaggctaaggggattgattttcagctctttctcaagtcccaagtgcgaaggattgagatggaggatccttgcttgatgctcgcaagtcgcttcaagcaggtccagaccctagccgtgaccgccgacgccttcttttgcctatattcctatgtatccaagacccctgtgcagaaattcacccccagccacatgttctggaattgcaatcatccaaccgatgtgccttccataaggatcctgtctcgggagcctgagccccaatcaccccgcgaccgcctgagaaaagccatcagcaagatgtgcctgtatacctgtccccgggaccgaccacctcccccacacaatacaccaaagcgtaatagtctggatcaggtagtgctagaggtgatggataaagtcaaagaggagaaacagtttctgcaacaggacagtgatctgggccagttttcacaggaggaccccgtgccccctgccgaaggcaagaagctccctacctcgccctacccttgcgtgttctgctgtgaggaagaaacacagcagcgaatgtcaactgtcttagccccgtcacagaccctcgactccaatccgaaggtcccctgttgcacccacagcctgccaattgaagatccgcaatggtccacagatccggcacagatcagaagggagctatgcagtctgcccgccactaacactgagacacacccagcaaaggatgaaacattctggaaacggaaatccagagcacgcaagtccctgttccagaaaaacctgatggggcgcaaagtgaagtctctcgatttgtctattacacaacagaagtggaagcagagtgtcgataggcccgagctccgtaggtctctctcccaacagccgcaggacacatttgacctggaggaagtgcagagcaacagcgaagaagagcaaagtcagagtcgctggccgtccagacctcgccacccgcaccaccaccagacctttgctgggaaggactcttag

SEQ ID NO: 49898 - DNA, 372 bp, Artificial Sequence
  Description of Artificial Sequence: Synthetic coding sequence
atgcccgacgccagcctgggcagcctgggcatcacctggtgcttcctcgaatccccactggaagtgtctagcgggcgcttcgggctggccaggctgctgggaagtcaggatcatggcgacgatcctgctgaacgggggcgaaccgctacagatgcctggggtcccagtcgctggggccagagtccaggaaacggtggtgggtattgtgacgcgtccccaccctccgctctcgcccctggtgacagagcttgggccctgcccgccagcccaagctccggcgcgcctgcttctcaacactgctgtctggaaaaggctggcacccgcactaaggccagccctgtttggggacgggatggcaatacctggaactag

SEQ ID NO: 49899 - DNA, 1410 bp, Artificial Sequence
  Description of Artificial Sequence: Synthetic coding sequence
atgctggagagcatccgggtgaccgagaagctgcactggcccgagcaagagctggcaaagaaaagcatactgaacgcggaagatagcctgatcattgataataaacggagcatttctcacctgtcatccggtgtgctcaaagacatctttacaacaggcacatcaagctataacgtactgttgcagtccaaagaggaaaagaaataccactcccagaagcagagcagttctacctactccaaacgctgtaggaaacccagtaaatctcccaatacaagtcggtcaaaggacccgagacggatgaaggcactcgtcccagtcacgtcttcaggaacctggtactgtctggagcggcgccccgctgtttttgtgacatctagcgtgtcatccccagtaaagttcacccacgatatctccgtgaccggcaacgggatagttctaccacccaaaccgaaaagtaaggtgaaatggtgccactttagtacattgcccaagcctaaaccccagttatcgcgaagctttgagaaaggcgacgactttagcggcaagaaattctgcatcctcaccgcgataaagccgaccaacttagagaaagaaaaactacggttttttaaatccgactatacgtataacccccaattcgaatatgctaatcccgctcttccctctgtgctggctaaacactcccatgcgtctgataggttcctgaagcagattgtcgtacacctgacagaggacttgttgagccgcgctagcatgaccgttgtgaatgggtgccccaccctgaccattaacgtctccacggcccgagagcactggttagagggcatgctgagacatgagatcgggacgcattatttccggggaataaacaaccttcagcagccatggaattcttggactggacgcaagaaacacgaacttaagcccaataacccaaccgaggagggattggcatcaatccactccgtattgttcagaaaggaccccttcttatggagggcagccctgctctactacacagtctaccaagcgtcacagatgagtttctgtgaactgtttaaggatatcggaagatttgtgaaggaccccaatacgaggtgggactactgtgtcagagctaagcgcggctggaccgatacgtcacagcctggctgcttttctaaagaccaggtgtacctcgatgggattctccagattttgcgatatcgcgatactatcgatttccacctcttaacagcactgggcaaggtatcttacgaggacgttgaccggctcaagggcctggctgttaccgagaatatgcgagtgccccattttctgcaagatcacggccgttacatggagcatttagagaaaattatggaagtgaacgagttgactgaccgggagctgaaagatcttatttag

SEQ ID NO: 49900 - DNA, 69 bp, Artificial Sequence
  Description of Artificial Sequence: Synthetic coding sequence
cccagcagcacccagtaccacgtgctggcctgcctgcacctgctggtggtgccatgccttgcctggtag

SEQ ID NO: 49901 - DNA, 3933 bp, Artificial Sequence
  Description of Artificial Sequence: Synthetic coding sequence
atgctgctgaacggcgactgccccgagagcctgaagaaggaggccgccgccgccgaaccaccccgcgaaaatgggctggacgaggcgggccccggcgacgaaacaactggccaggaagttatcgtgatccaagacactgggtttagcgtgaagatcctcgccccaggcatcgaaccgttctcactccaggtatctccccaggagatggtccaggagattcatcaggtcctaatggatcgggaagatacatgccaccgcacctgcttcagtttgcacctggacggcaatgtcctagatcatttctctgagctgagatcagtcgaaggattgcaggaaggaagcgtgctccgggtggtggaggaaccctacaccgtccgagaagcgaggatccatgtgcgtcatgtccgcgacctgctcaagtccctcgacccatcagatgctttcaatggcgtggactgtaactccctgtcattcctcagtgtgtttacagacggggacttgggggatagcgggaagaggaagaagggtctcgaaatggacccaatcgattgtacaccacccgagtacatcctgccgggcagcagggaacggcccctgtgcccactgcagccccagaatcgggattggaaacctttgcagtgtctgaaagttctgacaatgtccggctggaatccgcctcccgggaacaggaaaatgcacggggatctcatgtatctcttcgtaattactgccgaggatagacaggtgtctatcacagcttccacgagaggattttacctgaaccagagtacagcctaccacttcaacccaaagccggctagcccccgcttccttagtcatagtctggtcgagctgctgaatcagattagccctacatttaaaaagaattttgcggtgcttcaaaaaaaacgcgttcagcgccaccctttcgagaggattgctaccccgttccaggtgtacagctggaccgcgccccaggcagagcatgcgatggactgtgtcagagctgaagacgcatacacaagcaggttgggctatgaagagcatattccaggtcagactagagactggaatgaagaactgcaaacaacgcgcgagctcccacgtaaaaaccttcccgagagactgctgcgcgagcgagccattttcaaggtccactcagacttcactgccgctgccaccaggggagccatggctgtcatcgatggcaacgtgatggcaatcaatcccagcgaagagacaaagatgcagatgttcatttggaacaatatctttttttcacttgggttcgatgtacgggaccactacaaggatttcgggggggatgtcgcggcctacgttgcccccacaaacgatctcaatggggtacgcacctacaatgccgtggacgtggagggcctatataccttgggcactgtcgtggtggactacaggggctatcgtgttaccgcacaaagcattattcctggcatcttggagagagaccaggaacaaagtgtaatctatgggtccatcgactttgggaagaccgtggtctcacacccaaggtatctcgaattgttagagaggacctctagaccattgaagattctgcggcaccaggttttaaacgatagagatgaggaggtggagctatgtagcagcgtggagtgcaagggcatcatcggtaatgacggaagacactacattcttgacctgctgcggacctttccccctgacctcaattttctacctgtcccaggggaagaactacccgaagaatgcgctcgagccgggttcccccgcgcacaccggcacaagctctgttgcctgcgccaggagcttgtggacgcctttgtcgagcataggtatttgcttttcatgaagctggctgctctccagttgatgcagcagaacgcttcccagcttgagactccctcctctctggagaatggggggccttccagcctggagtccaagtccgaggaccctcccgggcaggaggctggatctgaggaagaagggagttcagcaagcggactagccaaagtcaaggagctcgctgaaaccatagcggccgacgatgggaccgacccacgatcacgggaggtgatcagaaacgcttgcaaagctgtgggaagtatctcttctactgctttcgatataagatttaatcccgacatctttagtcccggtagggttagattccctgaaagttgccaggatgaagttagggaccagaagcagctccttaaggacgccgccgcattcctactgtcatgtcagatccctggcttggttaaagactgcatggaacacgctgtcctgcccgtggatggggctactttggcggaggtgatgagacaacgtgggatcaacatgcgctatctgggcaaggtgctggagctcgtgctcaggagtccggccagacaccagctagatcatgtattcaaaatcgggataggagagctcataaccaggtctgctaagcacattttcaaaacatacctgcaaggagtcgagctgagtggattgtctgctgccatcagccacttcctgaactgcttcctctctagctacccaaatcctgtggcacacctgccagccgacgagttggtcagcaaaaagagaaacaagagacgcaaaaaccgcccccctggcgctgccgacaatacagcctgggccgtgatgacacctcaagaactgtggaagaacatttgtcaggaggccaagaactactttgacttcgatctagagtgtgagacagttgaccaggctgttgagacttacggactgcaaaagatcaccctgctgagggaaatctccctgaagaccgggatccaggtgctcctcaaggagtactctttcgacagcagacacaagcctgcctttactgaagaagatgtcctgaacatcttcccagtggtgaaacatgtgaacccaaaagctagcgacgcatttcacttcttccagtctggacaggctaaggtccagcaaggcttcctgaaagaggggtgcgaactcattaatgaggctctaaacctctttaacaacgtttacggagccatgcatgtagaaacatgcgcttgtctgcgtctgttagctagactgcattacatcatgggggactatgccgaagcattatcgaatcagcagaaggctgtgctgatgagcgaacgcgtcatgggaacagagcatccaaacacaatccaagagtatatgcacttggcgctctattgtttcgccagtagtcagctgagcacggctctgtccctcctgtatagagctcgctaccttatgttattggttttcggcgaagatcaccccgaaatggcccttttggacaacaacatcggcctggtcctacacggtgtcatggagtacgatctctcactgaggttcctcgaaaacgccctagctgtgtcgacaaagtaccacggtccaaaggccctgaaagtggctctttcgcaccatctggtcgcccgggtttatgagagtaaggctgagttcagatccgccttacaacatgagaaggagggctacacaatctataagactcagctgggggaggaccatgaaaagaccaaagaaagcagcgaatatttgaagtgcttaactcaacaggctgtggctctccagagaaccatgaacgagatatacagaaatggatcctcagccaacatccctccactgaaatttaccgcccctagcatggcatcagtgctggagcaactgaatgtaattaacggcattctgtttattcctttatcacagaaggacctcgagaatctgaaggccgaggtcgctagaaggcatcagttgcaggaggcttctcgcaatagggatcgagcagaagagcctatggccactgagcctgcccccgcaggagctcccggcgacctcggttcacagccacccgccgccaaagacccaagcccctcagtccaggggtag

SEQ ID NO: 49902 - DNA, 1518 bp, Artificial Sequence
  Description of Artificial Sequence: Synthetic coding sequence
atggtgagcaaccactacttcctgctgtgcgtgaacctgcccctgcgggaaattcacactcccggcgccgttcaggtctccaggcgcaccattagctccaatagcttttccccagaggtatttgttctgcctgtggatgttgaaaaggagaacgcgcacttctatgttgccgacatgattatctctgctatggagaaaatgaaatgcaacatactgtcacagcaacagacagagtcctggagcaaggaggtttccgggctcctgggcagcgaccagccagacagcgaaatgacttttgacacaaacataaagcaggagtccggcagctccacgagcagttactccgggtacgaaggttgcgccgtgctgcaagtatctcccgtcaccgaaacacggacctaccatgatgtgaaggaaatttgcaagtgtgacgtggacgaattcgttatactggaattgggagactttaacgatattactgagacatgcagttgctcatgctctagctctaaatctgttacgtacgaacctgactttaactcagcagagctgctggcaaaagagttataccgcgtttttcagaagtgctggatcctatctgtggtgaacagtcagctggctggctccctgtccgccgctggatctatcgtcgtcaacgaagagtgcgtgcggaaggatttcgagagtagcatgaacgttgtccaggaaatcaaattcaagtctaggatcaggggtacagaggactgggcgccaccccgttttcagatcatatttaatattcatccccccctgaaaagagacctcgttgtggctgctcagaactttttctgcgccgggtgcgggaccccggttgagcctaaattcgtcaaacgcctgcggtattgcgagtatctggggaagtatttttgcgattgctgtcacagctacgccgaatcctgtatccccgcccggatccttatgatgtgggatttcaagaagtactacgtgagcaacttcagcaaacagcttcttgacagtatttggcaccagccaatttttaacctgctctccatcggccagagcttatacgcgaaggctaaggagctcgaccgagttaaagagattcaagagcagctgtttcatatcaagaagctgctgaagacctgccgcttcgcaaactccgccttgaaggaattcgagcaggttccaggccatctcaccgacgagttgcatctgttcagtttggaggacctggttaggatcaagaaagggctccttgctcctttgttgaaggacattcttaaggctagccttgcgcacgttgccggctgcgagctgtgtcagggtaaggggtttatctgtgaattttgtcaaaacacgactgtcatctttcccttccaaactgccacttgcaggagatgctctgcctgccgcgcctgtttccataagcagtgtttccagagctctgaatgtccgcgctgtgcgcgcatcacagcgcgacgcaaattgttggaaagtgtggctagcgccgcaacttag

SEQ ID NO: 49903 - DNA, 366 bp, Artificial Sequence
  Description of Artificial Sequence: Synthetic coding sequence
atgcggcggagcctgaagaccagccacttcagcgaggagcccagcacatgcttgttcctaaatcaccggaacggaagcactgacccaacaattatccttcatatctctgaaccaatgttcaacggggggaagcgagaaatgcatggcaagcgaacgccaccatttctacttagtttaaaattcaaagatgtgtgttttggcatgccttccctgctgcctatccacaggctccttaagtctctcatctacagcaggcacatgtgtctcttgtgcccaaagtgcattactttcctgctggtgatggcagacttcggctgtgtatgcgttcgacacgctgttaataacgagatgaaagccattgcttag

SEQ ID NO: 49904 - DNA, 1518 bp, Artificial Sequence
  Description of Artificial Sequence: Synthetic coding sequence
aagagcgtgcagatccggaccgaggccggcccccggctgcacatcgagcctcctgtcgattatagcgacgatttcgaactatgcggcgacgtgaccttacaagctaataacacatccgaggaccgaccacaggatactaagtctcctacatctaccaaaccgtgtgggtttaactttagcctgctgaatgcatgcggacacagcgatccaagtagttcagttgacaaagaacgaatcttgctgacaatccaggatgtcatggagttgaggaggtctctggagctttctgtgaacctgcagcggaagcaaaaagactgctcctctgatgaatacgattccatcgaggaggatattctgtcagaaccagaacccgaggacccagcccttgtcgggcatccaaggcacgaccgccctccatcgtcaggcgattggacccagaaagacgtccatggagaacaggaaacggaaggacgctccagccccggcccggatacactggttgtgctcgaatttaatcctgcaagcaaaagtcacaagagggagcggaatctgtctgctaagcggaaagataacgctgaggtctttgttccgacaaagcccgagcccaatttgacaccacaggcaccagctgtgtttccagatcaggagcggatgtgctcccgccctggatccaggcgagaacgacctctgtccgccactagaaaaacgttgtgtgaggcagagtaccctgaagaggacgcaagcgccgtgctacaggctattcaggtcgagaacgctgccttacaacgcgcattgttgagtaggaaggctgagcagcccgctagtccactacaggatgcggaaggcccaccagctaagccttggacttctctcttagaggagaaggaggagactctggaactgctccccataacaacagcaaccacgacacaggaaccagcaggcgccgccggaggggcgagggcaatcaaccaggctatggatagaatcggtctgctaggaagccgtcaacagcagaaattacttaaggtcctgcaggccgtcgaaagtgactccgctcaccttggcagagtggtgagtcctacaaaagagcaggtgtccgacacagaggataagcagcgaatgagagccgatgagattaaggatgctatctacgtgacaatggaaatcctgagcaactggggcaattcctggtgggtggggttaactgaagtggaatttttcgacttaaacgacacgaagctctacgtgtctccccacgacgttgacatcaggaacaccgcaactccaggtgaactgggtaggttggtcaatcgtaatctggcagggaagaaggatagctccccatggacatgccctttccaccctccattgcagctcttttttgtgatccggaatacacggcagctcggagactttcatctagcaaagataaaggttagaaattactggacagccgatggctctctgtctgctgcccaggcaggagtccaatggcgcgaccacggaagcctctag

SEQ ID NO: 49905 - DNA, 612 bp, Artificial Sequence
  Description of Artificial Sequence: Synthetic coding sequence
aagccctacgcctgcaacgagtgcgtgaagagcttctgcgtgaagagttccctgattatccatcagcgtacccacacgggcgagaaaccttacaagtgcaatgaatatgggaagactttccaccataaaagcactttaactgtccatcaacgaacacacggagaaaaaccatataaatgcaacgagtgccgcaagagcttctacatgaagtcccacctggcaaaacaccatcggaaatatactaaaaaaccttacgaatgtaagcagtgcggtaaaacttttcaaaaatcacatttgattgagcaccagaggacgcatccaggcgaaatcccgcacgaatgcaacaagtgcggtaaaagcttctgctacaagagcccactcactattcaccagcgcactcatatcgaggaaaagccatacaaatgttccaagagcgtcacttatttctgcatgaagagtcacctaactgtgcatcagcgtccgcacacgcgaaagaaccctttcgagtgtaacgaatgccggaagatgttctacgtgaagtctaatctgataaatcatcagcgcacccatactggtgaaaaaccgtacgaaggcaatacatgtgggaagtag

SEQ ID NO: 49906 - DNA, 975 bp, Artificial Sequence
  Description of Artificial Sequence: Synthetic coding sequence
atggactgggacgacgagtacagccacaacagcttcgacctgcactgcctgctgaacagtttccctggtgacctggaattcgagcaaatcttttctgacatcgatgagaagatcgaacagaacgccgcgagcatcaaacattgcattaaggaaatccaatcagagataaacaaacagtgccccggggtgcagctgcagactactactgactgtttcgaatggttaaccaactataactatagcacttcagagagttccttcatttctcacggcgatctcatcaaattcttcaagacactacaagacctgttgaagaatgagcagaaccaggaagaaatgactttagatctgttatgggatctgtcctgtcactcttctgtctcgtttcccagtacactgtccggtacgtcatttcatttcctctcacgtacatccttacactctgtggaagacaattccagtatggacgtgaaatcgatgtgggacgacatccggctgcacttgaggagatttcttgtcagcaagctccagtcacataacgagataaataatagccagcaaaagattctgctgaaaaagcagtgcctacaacagcttctcttcctgtatccagaatccgaagtaatcattaaatatcaaaacatacagaacaaactgctggcaaacctgctctggaactgcttcccttcctataatagagacagcaatctagatgtcattgcacacggctatcagagtacaatgttgaaactctactcagttatcaaggaagatttcaatacgctgtgcgagatcctggctccctcctcgatggtgaagtttatcaaggaaacttatttggacacagtgaccgaagagatggccaagtttctagagaacttctgcgagctgcaatttagggaaaatgctgtgcgcgtagtcaaaacctcaaagtcctcttccaagcaccggggagcagtccacgctctgggttag

SEQ ID NO: 49907 - DNA, 459 bp, Artificial Sequence
  Description of Artificial Sequence: Synthetic coding sequence
atgcccggcctggtgttcttcaagttcgccaacctgggcggcggctgggggagccgtaagatgttagaaccagggatgtgccccgccgagatgtccctgacgccctttgtgacaaggtcgctaaatcttctttgctttagcgttacccacagaggtagagggaaagacaaccctctccacttctttctgcagttactggctcccagtgccagtgcatctctggggcttgggcgtgaaactggacctctgccttctccaggactgagtcccggcttgctgagtgagacttttgtttctgagggaccactccttacccttcagatttcctggtgtgggacagaatgtcttatggatggccagggacccctcatccacttacattcacaaaacatacgtatctcattcggtgcaacacagcctcccctgctgttggtgtacgagatccgctggaaccggtag

SEQ ID NO: 49908 - DNA, 558 bp, Artificial Sequence
  Description of Artificial Sequence: Synthetic coding sequence
atgcacggcctgtgcatggtgcccagcccccacggccaccccggcatctccggtacctgctgcgccccaggccaggcacccgatcgccatcccctcagcctgtgcgccccaacccctggccgcaagcgtcagcaccacctcgtggcctggcagccctgtccagccccttcttgtctgtggcctcattggactcagcccccttcacgggaagcctttggctgccgggctggggcgggaagggctcaccctgtagccgggggcacgcaggaaccatggctccacctctgttctagacgaacatgtgggcagctgacactgcagcaggggagtggtcctaagtctctgacacatagagtccttagccctgatcgagcagtcgacagctttccattccacccaggtacatgctggcaggaactgcccgggcctcatcctggcgcggccaccccagccccgccggccacccctgggcatgaaaaggtgcaaaactcttctggaccatcgcacaattttctcgaactgcgtgactcttttctgagcaccaacggtgttcggtag

SEQ ID NO: 49909 - DNA, 3003 bp, Artificial Sequence
  Description of Artificial Sequence: Synthetic coding sequence
atgcccggcaagctgaaggtgaagatcgtggccggccggcacctgccggtaatggatagggcctctgacctcactgatgcattcgtagaagtgaagttcggcaatacaacctttaagaccgacgtttacctcaagtctctgaatccacaatggaattctgagtggttcaagttcgaagtcgatgatgaggaccttcaggatgagcctcttcagataactgtgctagatcacgatacttatagcgcgaatgacgcaattggcaaagtctatatcgacatagaccctctgctgtattctgaagcagcaacggtgatctctggatggttccctatctatgatactatccatggaataaggggtgaaataaatgtggtcgtgaaagtcgacttgtttaacgatctgaaccgcttcaggcagagcagttgtggggtaaaattcttttgtacgacttcaatacccaagtgttatagagcagtcatcatccacggtttcgttgaggagctggtggtgaatgaggaccctgagtaccaatggatcgatagaattaggactccaagagcttctaacgaggcacggcagaggttgatttccttgatgtcaggtgagctgcagagaaaaatcggtcttaaggtcctggaaatgcgggggaacgccgtagttgggtacctgcagtgtttcgacttggagggggaaagtggtctggttgttcgcgcaatcggaacagcctgcaccctcgacaaattgagtagcccggctgcatttttgcccgcctgcaacagcccatccaaagagatgaaggaaataccatttaatgaggatccaaaccctaatacccattcttccggaccctccacccctttaaagaaccaaacctacagcttctcaccatcaaaatcatattcccgacagagttcttccagcgatacagacctctctctgactcccaaaacaggcatgggcagcggctctgccggcaaagaaggaggcccattcaaagctcttttgcgccaacagactcaaagtgccctggagcagcgcgagttcccattttttacactaactgcattccctcctggctttcttgttcatgtgggtggcgtggtgtcagcccggagcgtaaagctgttagaccggatccataatcccgatgaaccagagactcgggacgcctggtgggccgagattcgacaggaaattaaatctcacgctaaggcattggggtgtcacgctgtagttgggtattctgaatctacaagtatttgcgaggaggtctgcattctgtcagcctctggcacagcagccgtactgaaccctaggtttctgcaagacgggacagtagaaggttgtctggaacagagactagaggaaaatctgcccacacggtgcggattttgccatattccctatgacgaacttaatatgccgttcccggcccacctgacctactgttacaactgccgtaagcagaaggttccagacgtattgtttacaaccatcgacctcccaaccgacgcaactgttatcggtaaaggatgtctgatccaggctagactctgcagacttaagaagaaagcgcaggcagaagcaaacgccacagcgatctccaaccttctcccttttatggagtacgaagttcatacccagctcatgaacaagcttaagctgaaaggaatgaatgcccttttcgggctccgtatccagattacagtcggagaaaatatgctgatgggcttggctagcgcgactggggtgtacttagcagcactccctactcctggtggaatccagatagccggcaagacccccaacgatggatcttatgaacagcacatctcccacatgcagaaaaagataaatgacactattgccaaaaacaaagaattgtacgaaatcaatcctcctgaaatctccgaagagatcattggctcccccataccagaacctagacagaggagcaggctgctacgcagccagtcagagtcctccgatgaggttaccgaactggatctgagccacggcaagaaggacgcatttgtgctcgaaatagacgatacggatgccatggaagatgtgcactcgttgttgacagatgtccctccccccagcggattttacagctgtaacactgaaatcatgcccggaataaataattggacttctgagatacaaatgttcacctctgtcagagttataagactgtcaagcctcaatctgacaaaccaagctctgaataaaaatttcaatgatctgtgcgaaaacttactcaaaagcctttattttaaactgaggtcaatgattccatgctgcctgtgccacgtaaacttcacagtgtccctccctgaggacgagctcattcaggtcacagttacagctgtcgctattaccttcgacaagaatcaggccctacagacaacgaaaactcccgtagagaagtccttgcagcgtgcttccacggataacgaagaattgctccagtttcccctcgagctgtgtagtgatagcctaccttcgcaccctttccctccggccaaggcgatgacagttgagaaagcaagccctgtgggcgatggtaacttcagaaatcgcagcgctcctccctgcgccaattcaaccgtcggggtggtaaaaatgacacctctctcttttatccccggggcaaaaataaccaaatatttaggcatcatcaatatgttcttcatacgcgagacaacttccctgagagaggagggcggggtaagtggcttccttcacgcctttattgccgaggtgttcgccatggtgcgcgcccacgtagccgccctgggaggaaatgcagtggtgagctatattatgaagcagtgtgtcttcatggaaaacccgaataaaaaccaggcacagtgcctgattaacgtgagcggtgatgccgtggttttcgtgagagaatccgatctggaagttgtgagttcccagcaaccaactacaaattgccaatcctcctgcaccgagggtgaggtgaccacgtag

SEQ ID NO: 49910 - DNA, 1215 bp, Artificial Sequence
  Description of Artificial Sequence: Synthetic coding sequence
atgctgcgggccatcgccgaggagcggggccggctgagcctgcggcgcgaggtttgtggattggggtgtttcaaagacgaccgcatcgtgttttggacctggatgtttagcacgtatttcatggagaagtgggcacctaggcaggacgatatgttgttctatgttcgccggaagctggcctattctggaagtgagtctggggccgacggccggaaggccgctgagcccgaagtcgaggttgaggtgtaccgaagagattcaaagaagttaccaggcctgggcgatccggatatcgattgggaggagagtgtgtgcctgaatctcattcttcagaagctggattacatggtgacttgtgccgtgtgcacaagggcagacggcggcgacatccatatccataaaaagaaatctcagcaggtcttcgcttcaccttccaaacaccccatggactctaaaggcgaagaatccaagatttcttatcccaacatattctttatgatcgattcctttgaggaggtgtttagtgatatgaccgtgggggagggtgaaatggtgtgcgtagagttggtggcctccgacaagactaacacctttcaaggtgtgatcttccaaggttcaataaggtacgaagccctgaaaaaagtgtatgacaatagggtgtctgttgcggcccgcatggcgcagaagatgtcattcgggttttataaatacagtaatatggaattcgtgcggatgaaaggaccccagggaaagggccacgccgaaatggctgtttcaagggtgagcacaggggacaccagcccatgtggaacagaagaggattcctctcctgcgtcacctatgcacgagagggtgacatcattctctacaccccccaccccagagcggaataacaggcccgcctttttcagcccttcactaaaacggaaggtgcctcgcaacagaatagcagagatgaaaaaaagccactctgcgaacgattctgaggaattttttcgtgaggacgacggtggcgccgacctccacaacgctactaatctcagaagcaggagcctgtctgggaccggacgaagccttgtgggcagctggctcaaactgaatagggccgacggcaacttccttttgtacgcccatcttacctatgtgactttgccgctgcaccgcattctgaccgacattctcgaggttaggcagaaacctatcttgatgacatag

SEQ ID NO: 49911 - DNA, 2151 bp, Artificial Sequence
  Description of Artificial Sequence: Synthetic coding sequence
atggaggactgcctgcacaccagcagcgagaacctgagcaagctggtgtcgtgggcccattcgcacggcacgatatgcagcttgattccaaacttaaaacacctgctaagcgagggctctcatggaaacctgacagctatgtggggctgctccgctggacacgcgtatcattggccactcactgcaacctgtagagctggctctcaggaacgggtatgtttccaggacaaccggagctttaactctgattctccctctatcataggcgtcccctctgagacccagacatctccagtcgagagataccccgggcgccccgtgaaggccaagctcgactgcaaccgaacgcgggactcctgcgacttttcatattgcagtgagccttctgagctagacgagacagtggaggaatacgaagatgaaaacacgcttttcgacatggtgtgcgagtctagcgtcaccgacgaggattccgattttgagcctcagactcaaaggcctcagtccatcgctaggaagaggccaggcgttgttccaagctccctgcattcctctagtcagactcagatggtggatgaatgcagcaatgacgtcatcattaaaaagattaagcaggaaattcccgaggattactacatcgttgccaacgctgagttgaccggcggtgtggatggaccagcactgtccttgactcagatggcgaagccaaaaccccagacccatgccggcccctcttgcgtcggaagcgccaaacttatcccacacgtgacctccgccatttctaccgagctggatccacatggcatgtcagcatccccgagcgttatttcgcgcccaatcgttcagaagaccgctcgcgtctctctcgcctcccctaacagaggaccaccaggcacccacgggaccaaccagcaggtcgccatgcaaatgcctgtctccactagtcaccccaataaacaaattagcatcccactgagcgccctgcagctgcctggccaggacgagcaggtcgcgtccgaggagttcctgagtcacctgccaagccaggtgtcctcttgcgaggttgctctctctccctcggtgaacaccgagcccgaagtgagctcctcgcagcagcagccgccagtcgcgcccgcaatcaccaccgaggcaaccgctcagtgcatcccagcttacagcactaaactaaataagttcccagtgttcaatattaacgatgacttgaacgacctttgcacttccgcagtatcccccaacacgaccaaggctacacgctatgccctaaacgtgtggaggtattggtgcatgactaatggcttaaaggaccatactgacataactaagattccagccgtcaagctgaacgaattgctggagaacttctacgtgaccgtaaagaagtccgacggttctgactttttggcaacaagtctccacgctattcgtagaggactagaccgcatcctgaagaatgcaggggttgggttctcaattaccagtagcactttctcctcgtctactaagaagctgaaagaaaagctatgggtcctgtccaaagctggaatgagcggcgctcggagtcgcaatattgtctatttctccttgagtgacgaggaggaaatgtggcaggccggctgtctaggcgatgatagtcctatcacactgttatcgactgtagtgaagtacaacagtcagtacctcaacatgcggacgctgcaggaacacgcagacctgatgtacggggacatagaactgttgaaggatccacagaatcagccgtactttgcgcgcacagattccgttaaaagagagtcaaggtctgggtcaacaagagtctgtcacggtaagatctatcatgaacacagtcgggggcacaagcagtgtccttactgcctactgtataaatacatgtatattcaccgccccccaacccagatggaagcaaaatccccattctatctgacagctcgaaaagaggctactgacatgggctctgtctggtatgaggagcagcgaatgggcctcaggagtcttcggggcatcgtccccaatctcgcaaagaaggtgaagctcgaaaactgtgaaaactttacatttgtgagctttactcaggtgagccggagactggggtcccactcttgttgccagtag

SEQ ID NO: 49912 - DNA, 1605 bp, Artificial Sequence
  Description of Artificial Sequence: Synthetic coding sequence
atgcggcggcacagcgagaccgacgtggaggagcagacccaggagcttaagacaattacacagctccaggaacaatgtcgggccctgcagattcaaggggtgaaagaaaacatggatcagaataaggcaactctcgctctattgcggtcaaatattcgtcgtggagcccaggattgggcattggctaagaaatatgaccagtggaccattagcaaggcgtgcggcaagaatctgcctctaagacttgcacactgtaggagtactatggaggttgtaagggagaagcttcgtaagtacgtctttgatagagtcaacatgcacaatttgttgatacacctggtccggagaagaggccagaagctcgaaagcatgcagctcgagttggattctctacgctctcagcctgatgcctcaaaggaagagctcaggctactgcagatcatccggcagctcgagaataacatcgaaaagactatgatcaagatcatcacgtcccagaacatacatctgctatacctggatctccttgattacctcaagacagtactggcaggctacccaatcgaactggacaagcttcagaaccttgtggtgaactactgcagtgagctgagtgatatgaagattatgtcgcaggatgcaatgatgatcaccgacgaagtgaaaagaaacatgagacagagggaagccagttttatcgaagagcgacgcgcaagagaaaatcgcctgaatcagcaaaagaagctgatcgacaagatccatacaaaggagacaagcgagaagtacaggcggggacaaatggatctggatttcccttcaaacttaatgtctacagagacactaaaactgcgacgcaaggaaacctccaccgcagaaatggaataccagtctggggtcaccgctgtagtagagaaggtcaaatcggccgtcaggtgttctcacgtttgggacatcacttctcggtttctagcacagcgcaacaccgaggagaatttggagttacaaatggaagattgcgaagagtggagagtgcaacttaaggctctcgtgaaacagttagaactggaggaagctgtgttgaagtttcgccagaagcctagtagcattagtttcaaatcggtggagaagaagatgaccgatatgcttaaagaggaagaagagcgcctacaactggcccatagcaacatgaccaaaggccaggaactcctcttgacaatacaaatgggaattgacaacctctacgtgagattaatggggatcaacctccccgccactcagcgcgaagtggtgttgagcaatacccttgacctaaattccaagttagcttactgtgagggaaaacttacatacctggccgacagggtgcaaatggtctctcggaccgaggagggagacaccaaagtaagagacaccctggagtcttcaaccctcatggaaaaatataatacgcgaatctccttcgagaacagagaggaggatatgatagacacctttcagtttccagatatggatcactcctatgtgccaagcagagccgagattaagaggcaggcacagagactaatagagggaaagctgaaggctgcaaaaaaaaagaagaagtag

SEQ ID NO: 49913 - DNA, 5520 bp, Artificial Sequence
  Description of Artificial Sequence: Synthetic coding sequence
atgtaccacatcgactgccgggaccagctggagcgggtgttcctgagacttggccatgccgagacagatgagcaattgcagaacatcatctctaagtttctacctcccgtgcttctgaagctgtcaagtactcaggagggcgttcggaaaaaggtgatggagctcttggtgcacctcaacaagcgcataaagagcagacctaaaatccagctgcctgttgagaccctgttggtgcaatatcaagaccctgctgctgtgtccttcgtgaccaacttcacaataatttatgtgaaaatggggtatccgagactgccagtcgagaaacagtgcgagcttgctcctactttactcacggcaatggagggtaagccacagccacagcaggattctcttatgcatctgcttattccaacccttttccacatgaagtacccagttgagtcttctaagagcgcatcaccatttaacctcgcggagaaaccgaagacagtgcaattacttcttgatttcatgctggacgtgttgctgatgccctatggctacgtgttaaacgagtcccaatctagacagaattcctcctccgctcagggcagctcttctaatagcggaggaggttcgggaattccacagcccccccctggcatgagtttttatgccgctaagagagtaatcggcgacaacccctggacccctgagcagttggaacagtgtaaactgggcatagtaaaattcatagaggcggagcaggtgccagagctcgaagccgtgcttcacctggtaatcgcctcaagcgacacacggcactctgtggcaacagccgcggatctagagcttaaaagcaagcagtctttgatcgactggaataaccccgcgattataaacaagatgtacaaggtatatctaggagatatacctctgaaaacaaaagaaggggccgttctcaagcccgagctcaagcgcgaccccgtgtctaccagggtgaagctcaagatagttcctcaccttctgcgcagccgacaagctgctgaaacattccctgccaacatccaggtggtctatgatggtctgttcgggactaatacaaatagtaagcttaggaccctctcccttcaattcgtccatcacatatgcattacatgcccagagattaagataaaaccgctcggacccatgctgttgaacggtctgaccaagcttattaacgaatacaaggaggacccgaagctcctgtcaatggcttactcagcggttggcaagctttctagtcgcatgccccacctctttaccaaggacatcgccttggtccagcaactgtttgaagctctatgtaaggaagaacctgagacccgcttggccattcaggaggccctctctatgatggttggcgcatactcaactctggagggtgcccagagaaccctcatggaagccctggtggcctcctacctcatcaagccggaggtccaggtgcgacaggttgctgtcaagttcgccagcaccgtgttccccagtgatcatattccctctcgttatctgctgctactcgccgccggggacccccgcgaggaagtgcacggcgaagcccaacgggtcctgaggtgcctccctggacgcaacagaaaggaatccacctctgaacaaatgccatccttccctgaaatggtgtattatattcaggaaaaggcaagtcaccgtatgaagactcctgtaaagtacatgactggcaccacagtgcttcctttcaatccagccgccttcggagaaatagttttgtatctgagaatgtgcctagcccactccgcaggcgtcgtgccaacctctcagtctctggctgatatgcaggatcacgcgccagccatcggaaggtatattaggactcttatgagtagcggtcagatggccccatctagtagtaataaatctggtgaaacaaatcccgttcagatttacatcggcctgctccagcagcttctcgctggcgttgggggcctccccgttatgtactgtctcttagaggctgtaagtgtttaccctgagaagttggccaccaagtttgtagacaagacggaatggataaagtcactgatgaataattcaaaggaggagatgcgcgaactggccgctttgttctattctgtggtggtaagtacagtgagcggcaatgaactgaagagtatgatcgagcagctgatcaaaactaccaaagacaaccacagccccgagatccagcatggctcactgcttgcgcttggctttacggtgggcagatacctggccaaaaagaagatgcgcatgagcgagcagcaggatctggagcgcaatgccgacacacttccagaccaggaggaactaatccagagtgccactgaaactattgggtcgttccttgactcaacatcccccctgctggctattgcggcctgcaccgctctgggggagatcggaaggaacggccccctgccaatccctagtgaggggtctggctttactaagcttcaccttgtggaatcattgttgtctcgcataccttcctcaaaggaaaccaataagatgaaggagcgggcaattcagacacttgggtatttccctgtgggggacggcgattttccccaccaaaagctacttctccagggacttatggactccgtggaggctaagcagattgagttacagttcacgatcggcgaggctatcacttccgccgcgattggcacctctagcgtagctgcccgagatgcctggcaaatgaccgaggaagagtacacacctcccgcaggggcaaaggtgaacgacgtggtgccctgggtgctcgacgtgattctaaacaaacatatcatttccccgaacccccatgtccggcaagctgcctgtatctggttgctctcacttgttcgtaaactgagcactcataaagaagtaaaaagccacttaaaggagatccagagtgcattcgtcagcgtgctctccgagaacgatgagttatcccaggacgtagcgagtaagggactcggtctcgtctatgagttaggcaacgagcaggaccagcaagagctcgtctcgaccttggtagagacgttaatgacaggcaaacgtgtgaaacacgaggtgagcggagagactgtggtctttcaaggtggtgcccttggcaagacaccagatggtcaggggctatctacctacaaagagctttgcagcttagcctcagatctgagccagccagacctggtgtacaagttcatgaaccttgcaaaccatcatgcaatgtggaactcccggaaaggcgctgcgtttggatttaacgttatagcaacaagggctggtgagcagcttgccccgttcttgccacagttggtaccacgcctgtatagataccaatttgacccaaatctgggcatcagacaggccatgacatccatctggaacgccctcgttaccgacaaatctatggttgataaatatctgaaagagattttacaggatctcgtaaagaatctgacttcaaacatgtggcgggtgagagagtcctcctgtctggccctgaatgacctgctgcgcggcagaccactggacgacattattgataagttgccagagatatgggagactctgtttcgggtccaggacgatatcaaagaaagcgtgcgtaaggccgctgaactcgcactgaaaacgctctcaaaagtctgcgtgaaaatgtgcgatccggccaagggggcagccggccaacggaccattgcagccctcctgccatgtctactggacaaaggcatgatgtccaccgtgaccgaggttcgcgcattatctattaacaccctggtgaagatcagcaagtctgctggggccatgctgaagcctcatgccccaaagttgatccctgcactgctggaatcactgagcgtcctcgagccacaggtcctgaattatttatcattaagagcaaccgaacaggaaaaagccgctatggactcggccagactctcagccgcaaagtcttccccaatgatggaaactatcaacatgtgcctgcaatatctggatgtaagtgtgcttggtgagttggtgccccggctctgtgaacttatccgctccggcgtgggattaggaactaaaggcggctgcgcctccgtgatagtgagcttaacaacgcagtgcccccaggatctcacaccctactcaggcaaactaatgtcagccctccttagtggtttgaccgaccggaatagcgtgatccagaagtcctgcgcgtttgctatggggcatcttgttcggactagcagagattcatccaccgagaagctgctacaaaaattaaacggctggtacatggaaaaagaggagccgatctataaaacctcatgtgcattgactattcatgccatcggaaggtatagccctgacgtattaaagaaccatgctaaggaggtgctgccacttgcctttctcgggatgcatgagattgccgatgaggagaagtctgaaaaggaggagtgtaatctgtggacggaggtctggcaggagaatgttccagggtcctttggaggcatccggttgtacctgcaggagctgatcacgattacccagaaagcactgcagagccagtcctggaagatgaaggcgcaaggtgccatagccatggcaagcatcgcaaaacagaccagcagtcttgtgccaccttacttgggaatgatattaaccgctctccttcaggggctcgccggcaggacatgggccgggaaagaagagctgctgaaggccatcgcctgcgtcgtgactgcatgttcagccgagctggagaagagtgttccaaaccagccatcaaccaacgagatccttcaggccgtactgaaggaatgttctaaagaaaatgtgaagtataagattgtggctatctcctgcgccgccgatatcctgaaggcgacgaaagaggatagatttcaggagttctccaacatcgtgatccctctgattaagaaaaattccctcgagtctagcggggtccggacgacaaagaacgaagaagagaacgaaaaggagaaggaactgcagctggaatacctgctgggggcttttgagtctctgggtaaggcctggccgaggaatgctgaaactcaaaggtgctatcggcaggaattatgcaagcttatgtgtgagagactgaagctcagtacctggaaagtgcaactgggagtactgcaaagtatgaacgcattctttcaagggcttatgctgcttgaggaggaacacgctgaccccgaagcactggctgagatacttctagagacttgtaagtcgataacatacagtctggaaaacaagacctattcatctgtgaggaccgaagccctgtccgtgattgagctgctcctgaaaaaactggaggaaagcaaacagtgggaatgcttaacatccgaatgccgcgtgctcttaatagaatccctggctactatggagcccgactcccgccctgagttgcaagaaaaagctgctcttctgaagaagaccctggagaatctagaatag

SEQ ID NO: 49914 - DNA, 1524 bp, Artificial Sequence
  Description of Artificial Sequence: Synthetic coding sequence
atggtggccaccggctgggcccggcggagcggcctgcaccccgccccccgccctctgcggggggcccaggaggccctcgctaagaacctatggagggaagaacggaaccgccctctcattttatcttcgctaatcataaagaaacttcattggccagagcaggagctggcaaagaaatctatattgaacgcagaagacagcctgattattgacaacaaaagaagcatttcacacctttcaagcggcgtacttaaagacattttcacaacgggcacatcatcttacaatgtccttctgcagagtaaagaggaaaagaagtaccactctcagaagcagtctagctcaacttattccaagcgatgccgaaaaccatcaaaaagcccgaacacctcgagaagtaaggatccccgaagaatgaaggctcttgtacccgtgacaagtagcggcacatggtactgcctcgaacggcggccggccgtgtttgttacctcaagcgtttcctcacctgttaagtttacacatgatatttctgtcaccggcaacggcatagtcctgcctccaaaacccaaatccaaggtcaaatggtgtcatttttccaccctgcccaagccaaaacctcagctaagccgatccttcgagaagggggacgacttctccggaaaaaagttctgtattctgactgcaatcaagccgaccaacctggaaaaggagaaactccggttttttaagagtgactacacttataacccccagttcgagtatgcgaatccggctctgccctctgtccttgctaagcatagtcatgcaagcgataggttcttaaaacaaattgtggtgcacctcaccgaagatctgctgtcccgtgcttccatgacagtggtcaatggatgtcccaccctaactatcaacgtaagcaccgcccgagagcattggcttgagggaatgctccggcacgagattggcacacactattttcgcggcattaacaacctacagcagccgtggaattcctggacagggagaaagaagcatgaacttaagccgaataatccgaccgaggaagggctagccagcatccattccgtcctgttccggaaggacccgttcctgtggcgcgcagctcttctttactatactgtgtaccaggcttctcagatgagtttctgcgagctgtttaaggatattggtcgctttgtcaaagatccaaatacacgttgggactactgcgtccgcgccaagaggggttggacagacacaagccagcccggatgcttcagcaaagatcaggtgtaccttgacggtattctgcagatcctgcgctatagggatacaattgatttccacttactcactgcactcggcaaggtcagctatgaggacgtagaccggctcaaaggactggccgtgactgagaatatgcgtgtgccacatttccttcaggaccacgggcgctacatggaacatctggaaaagatcatggaggtaaatgaactgacagatagagagctcaaagacctgatctag

SEQ ID NO: 49915 - DNA, 576 bp, Artificial Sequence
  Description of Artificial Sequence: Synthetic coding sequence
cagagcggcttcatggacctgcccaaggagaaggtgggccggaaggagcaggttgagaagctggagctagggttcattcagctgagcggcgcaacagatggaatgagggaatacatcaccgaatatgaaagccaaggcgctgtgcctaatactagacatcaggaaaaagaggacatcattaggctcgcgcaaaaggaggaggagatgaaggtgaagttgctcgagctgcaggagctggtgcttccgctcgtcggggatcacgaggggcacggaaagtttctgactgctgcacagaatccagcggatgagcccgcccccggcgccccagccccccaggagctcggtgccgccgatgagcagggcgatttttatgaggtgagcctggatgattcagaggagccggctcctggggccgccggcgagggttcaccccatgataaccctacagctcaacagatagtacagctcccccccgttatgcaggacactcaggaacatcccgggctgccaggaaacccatgcgtctctttcttttaccaggccgcagagaacagagagatcaatattatcatctag

SEQ ID NO: 49916 - DNA, 375 bp, Artificial Sequence
  Description of Artificial Sequence: Synthetic coding sequence
atggagcacatgctgctggccaaccacaccgacaaggccaccttcacagggacccagagacagcgctcttgctccggcgcctctgtgagccaacctagacccctgcggggtaaattggtaggttactgggatcctcacagcaggctgctatcccggggacgtgctctgggaagcgtgagcgctccttctacccccagaggaagggggtggaaagctacctttgatggctgcattctgcacgacgacctcctgacgaaagtccatggtttccagtccctgataggcctccaacaacatttggcctgcggggactcagggtctctgatgaaaaattgtcacgacggaaacagaaacaatcaacgaaagctgccttag

SEQ ID NO: 49917 - DNA, 1371 bp, Artificial Sequence
  Description of Artificial Sequence: Synthetic coding sequence
atgggcaacagccggagccgggtgggccggagcttctgcagccagttcctaccagaggagcaggcggaaatcgatcaactcttcgacgcgctgtcatcagataagaattctcccaacgtgagtagcaagagtttcagtctgaaggccttgcaaaatcacgtcggagaggcgctgcctcccgagatggtgacgaggctctacgacggaatgcgaagagtggacctgacgggcaaggccaaagggccttcagagaacgtgagccaagaacaatttaccgctagtatgagccacttgctcaaggggaacagtgaggagaagtctttgatgataatgaagatgatctcagctaccgagggcccagtcaaagcacgggaagtccaaaagtttaccgaagacttggtgggatccgttgtccatgttcttagccacagacaagagctgcggggatggaccgggaaggaggcaccaggcccaaacccaagagtgcaagtcctggccgcacagctgctgagcgacatgaagctgcaagacggtaagcggctactaggacctcagtggcttgactatgactgtgatcgcgctgtgatagaagattgggtgttcagagtgcctcatgtagccattttcctgtctgtcgttatttgcaaggggttcctgatactgtgtagttctttagacctgacgaccctcgtccctgaacggcaggttgaccaaggccgcgggttcgagtcgattttggatgtgctgtctgtgatgtacatcaacgctcaattgccacgagaacagcgtcaccgttggtgcttactctttagttcagaattgcacggtcattccttttctcagctgtgtggtcatataacccatagaggaccctgcgtggccgttctggaagaccatgacaaacacgttttcggcgggttcgcctcttgttcatgggaggtgaaaccacaatttcaaggagataatcgctgttttctgtttagtatctgtccaagcatggcggtttacactcacaccggatataatgatcattacatgtatttgaaccacggacagcagactatcccaaatggcctgggaatgggcgggcagcataattatttcgggctttgggtggatgtggattttggcaagggccactctcgagccaaacccacctgcaccacttataactcccctcagctctccgcccaggaaaactttcaatttgataaaatggaagtgtgggcggtgggcgacccatctgaggagcagctcgcaaagggaaacaaatctatcttagatgcggacccagaagctcaggcactcttagagattagcggccattccagacactcagagggcctcagggaggtgcccgacgatgagtag

SEQ ID NO: 49918 - DNA, 438 bp, Artificial Sequence
  Description of Artificial Sequence: Synthetic coding sequence
atgggcccctggccccgggactggctgggcaagggctggcggctgggttcttgcgaagccagagccggagcaaaagaggtcagtgtcatccgacatggagcccccaacccagcacagtcccacctgcatgtacaggcccgcgcacaggtccactccgaggacggccattctctcccaccagtggtagatggagaagatgaagtgctcagcctgctggtgttcgtgcaggattcccaggaatgttgtagacaggctgtgcaggggcggcaggggcgaggcgtgacatgggggctgggactgccttcctaccacctaaggacgctcctgtctcctgtgtgtgtgccagctagggatcagagggccccgcgcaaatgttgcgaagccgtgctggcgtgtccacttgtggagacacttgttactaccctgttgacaagatag

SEQ ID NO: 49919 - DNA, 1653 bp, Artificial Sequence
  Description of Artificial Sequence: Synthetic coding sequence
atgggctggagcgacctgcagcccgccatgggcggcgaggccgagcgtttccaggctcagcttgaagtgaagctggtgaccggcggaagcccagtcgtgtttaccggaaacttaacccgtcaggtaggctctaaacttgctttttccgccagcctgtcccacttactgtctgaccaagccaacgtcaccgcccttctggagcggaaggaagagaacgggagaagagtagccgcactgggagctgaactatttgtgccaggattggtaggcctgagagcactgggcttacttcagcagagagggcagctttggaccaactctttgcgaatccaatatagcctgctaggacaggcgaagcaggccgctcacgaatgttccacgagtcagaagctacgggcagatagcgggtccgatggggcttatcgcctagagttgcggcatgagctgcattgcacccaaattctggcattctcccacaaggtgcagctgtggcacgaggaggattccggtcacttacatagccagctggaggtcagctatgggaagcactgggacaagaatagcaataaacgtcacctccgagtttcacagactttcaaaaatgactccggccctgcactgtcaaatcacttcatggagttcgtgttgcaagtgccagaaaggcaggtggactgccgtgtgcagctgtaccatctctctttgcggctgccctacgtcgagagctccagccaccttaaagtgcaatacaatggccggcccctctttgtggcaggcgggcagtggaaggataccagcagggcaaccttatggaagtgggaaggtgccctgaacctggatagcccatggctcatggtaagcgcagctcataggttatactggccccacagggcggtctttcaggctgtgctcgagctgacactgggtaaagcctggacccttaaggacttggtggtgtccgtggggtgtaggtcacaagggcctaacagggaggggaagatccaagtctatacagcagctaccacctatctccgcgtatctaccgtcacagtcttagcccagtctttattccactcttggtccgaactggaatccgcctggaatgccgctgtccagggcgagattcacgccgagaattctcgagacaggaagatcctgaactgctggctcaagggccctcaacaagaactgaaccttacagcagcgtaccggcatttagagtggcctcgaaagacacaggtgtcactgacagccgttaggatcggcgcacaggggcaaccccgtggccttcaactggagggcgagttggaggagttacgtcaggaccggaccttgtatcggaaaaggggcgctctcttactccgacaccctctgcacctgcctattccacagagcctccttctgcaggagacctttaccgctgaccgacgtcaccagcgttactccttggagactcgggtcgttcttaatggaagagaggaaactctacagaccatggtgctagggtgccaggctggccatccatacgtgtgtgcaggactgatgcacccttatgacggaaaggtgattccccgaaatactgaaggatgcctggtcacatggaatcagcacacatccctgaccttgctatccaggctggaatcaggggttcagtag

SEQ ID NO: 49920 - DNA, 411 bp, Artificial Sequence
  Description of Artificial Sequence: Synthetic coding sequence
cggagccggaccggccccgtgagcctgcagggcgaccccaagcaggccccttggtcctctagccaatccaacagttctcggaaaacgctttttctaagcttatgcccgccttttcctactcagccccagatccatctccactttaccgaacatcgggcaagctcccaccagggcgggccctttaagctgcagatctgcctctcgtctctctattctaatctgctcctgcattgtcattacagagaagttcaccatatgtcagggcaccgaaccgagtccgccggagggcacctgttcctcccccaagatctgagatggaagagccctggactaggggtcttcgcagttcagagtgtgtacgagcttgcacgtcgccataacgtgtctcctttctacagtggccctccctag

SEQ ID NO: 49921 - DNA, 372 bp, Artificial Sequence
  Description of Artificial Sequence: Synthetic coding sequence
atggccctgctggccagcaacggctgcttcatccggtgcaacgaggctggggacatagaggccaagtcaaaaactgccggcgaagaggagatgatcaaaatccgcagttgcgccgaaagagaaaccaagaaaaaggacgatatcccagaggaggacaagggcaatgtgaagcagtgtgagataaattatgtgaagaaattccaaagcttccaggagcacaagctgaagatatccaaagaggattctaaaattctaaagaaggcccagaaagacgggttcctacaggaaaccctgctggactcattaggatacgagcaccgatggaagagatggctgctgtattggattaaggatatgtctcgggacggctag

SEQ ID NO: 49922 - DNA, 291 bp, Artificial Sequence
  Description of Artificial Sequence: Synthetic coding sequence
gaggtgcagctggtggagagcggcggcggcctggtgcagcccggcggatctctccgattgtcctgcgccgcctctgggtttacttttagcaatcattatacatcctgggtgagacaggcccctggtaaggggctggagtgggtctcttactcctctggaaacagcgggtatactaactatgccgactccgtcaagggtcgcttcactatcagcagggacaatgctaagaactcgctttatctgcaaatgaactcattgcgcgccgaggacaccgccgtgtattactgctag

SEQ ID NO: 49923 - DNA, 438 bp, Artificial Sequence
  Description of Artificial Sequence: Synthetic coding sequence
ggcgagagcgaggacgtgacccagttcctgcagagccacaagaagacgctcaccaatgagaagctgttcctcatggacggaaagaggacgtggttcctggaaatggaaagcacccccggcgaagacgccatgaatacggtgaagatgaccactaaggacctgaaatacgacagatccctcatcgacaaggcaggtttcgagcgcactgattcaaactttgaacggtcccatacagtcggtaaaatgctctccaacagcattatgtgctacagagatatcttttacgaacgcgaaagtcagctgatgcaacaaaccagtctgttgtcatacgaaatcgccattgctactcctaccttttcaaattactaccccgattggtcagctccgatcaacatcgtggctcgtccttccaccagtaagaagatcatgacgtgttag

SEQ ID NO: 49924 - DNA, 396 bp, Artificial Sequence
  Description of Artificial Sequence: Synthetic coding sequence
atgcggaagccccggcgggccggctgggagaccctgagccggaaggctcccggcccatccgccggtttgcgtccgtccccagcaacatgtgatacctgccattttcctattttaggagacggtaaagcgactctccctttcgcacccgggaaaacttctagggtgcctagcgacagcggtgtgttttcctctgatcctagagccaattggagctcgattcggaactttccttctgccaaatgcgtgggaatcgagctccatgagtcactctccactagcgccgagtggttactgcgcggcagagggggcgcccttccctggatcgtgcgttgtctggccgccacggatctgctcctgcccgggaagaaaggcgttgaaagctgtccagtaggttag

SEQ ID NO: 49925 - DNA, 291 bp, Artificial Sequence
  Description of Artificial Sequence: Synthetic coding sequence
gaggtgcagctggtggagagcggcggcggcctggtgcagcccggcggttccctgcgtctcagttgcgcggccagcggcttcacattctccaatcgctctacacactgggtacggcaagcccctggtaaagggcttgaatgggtcggccactctgtttcaaagaaaaagaagaaaaagaaaaagaagaagaaaaaaggccgattcactatcagtagggacgattccaagaacaccctttatctacagatgaacagtcttaaaaccgaggacacagctgtttactattgttag

SEQ ID NO: 49926 - DNA, 387 bp, Artificial Sequence
  Description of Artificial Sequence: Synthetic coding sequence
atgtactgccaggacagcaacatctgcgccgtgttcgccgtgcagggtggtaaagtcggacgcaaacatggtattaagaggggccggaggccaagcatcaggagtccagcccagcgcgcaagaggcccatggatccatgaaagcaaacacccggcgttcgccaagcagcaaatcaatctcgaaatgccaaactcccgcgcaactactgagctagcttgggtgtgttcgagcacctctcggaaaaagaaatgggcccggtcactgaccctcagtactgctccactgagcccgccacccagtctggtccactgtgaggattgttcttgtctcccgggttgtcattcaggcgatctgtacaatctggcccctgccgaacgaacttgctag

SEQ ID NO: 49927 - DNA, 2157 bp, Artificial Sequence
  Description of Artificial Sequence: Synthetic coding sequence
atgagccggggctacagcgagaacaacaacttcctgaacaacaacaaccagatggtgcttgacatgatcctatatccccttatcggaattccccagacgatcaattgggagacaatcgccagactcgtccctggacttacccccaaagaatgcgcaaagagatttgatgaattgaagtcgtccgggtccagccctgtagataatcagtacaacagcttgatggctgctggagagtcccctgtagagaccctggccacttatattaagagcagtctactcgacatccatggtgagtttcaagaaacacccgtgggtcatgacgctgtgtctaaaaccgggcgtcacagtatagcctcaacccgcaactgctcttcggagagtgaaaattgcaccacacacaacggaggcgaaatgacagaagagagcgaaggccctaatatggtaatacacgtatgcgatgaagctaaaaatcttaaggaagactttacctgcccgcgtgatttgctgatcagcgaaatgaaatacttcgccgagtatctgagtatggatgcccagaggtgggaagaagtggacataagtgtgcattgcgacgtccacattttcaattggctcattaaatatatcaaacgaaacaccaaagagaataaggattgtgagatgccaactttggaacccggcaacgttattagcattttgatctccagcgagttcctcaaaatggacagtcttgttgagcagtgtatccagtattgccataagaacatgaacgcaattgttgccactccctgtaacatgaattgtattaacgccaatttgttgacaaggatcgcggacctgtttagtcataacgaagtggacgatctgaaggataaaaaggacaagttcaaatcaaagctgttctgcaagaagatcgagcggctgtttgatccagaatacttgaatcccgacagccggtcaaatgccgcaactctgtacagatgctgtttgtgcaaaaagctgctgaccaaggaaaccgaacgcaggatcccttgcatccctggcaagatcaatgtggaccgccgcggaaatatcgtctatatccatatccgagataagacttgggacgtgcatgagtacctgaactcattatttgaggaattgaagagctggcgggatgtgtattggcggctgtggggtacaatcaattggctcacatgttcccgctgctatcaggcctttttgtgcattgagtttagtcactgccaatatcactccgagactgtggtgtatccgaccgcagcgtcatccctaaacacagtcggtaccggcatctatccctgctgtaaccagaaggtcctgaggttcgatcccacccagctgaccaaagggtgcaaagtcagagatcacatggtgactctgcgagaccaaggcgaggggggagatttgcctagctgtccaaccgctcgtatgttggacgatctgcacaagtatagggacgtgattgtcgtgccattctcaaaagatacagtgtccgacgtcggagtgggattgtgtgacgaaaagggaattgagtgtgatgtactgcttgaacctaataccccttggggtcccaagacaggtgaactgaatgcctttctttcgctcaagaactggaccctccagttgaagcagcagagcctcttctccgaggaggaggaatataccacaggatccgaggtgactgaggatgaggtgggggatgaagaagaggtgagcaagaagcaacgcaagaaggagaaacctaagaagtttacccgtcagcctaagaagcaggtcagttctccatgtgcacagagaaaggagaaggcgcttgagaaaagcgctagcagggacgtgagcccgttcgtcatgtccatgcagaagaataagtgggatgccactcgcagtcttcggttcaaccaagacgcacaaagggaagacgaccagcgacggatgacagagataacgggacacctcatcaagatgcggctgggcgacctggatagggtgaagagcaaggaggcaaaagagttcgctggcggaatttatagccgtctggaagcccagataaaggcatcagtgccggtgtccgcccgccagagcagttccgagaaaaacacacggtctaaaagtagattcggacagggtcggccggcttag

SEQ ID NO: 49928 - DNA, 942 bp, Artificial Sequence
  Description of Artificial Sequence: Synthetic coding sequence
atgcaggaggccgacgccagcatcaagaccgccgagaccaagggccgaacatggaaataccagaacatagaacccggcggcggccctcaaacctccggaaaggggggcttcggtagcttggtcctagtattcctcgggcagcgggttggctgcaacgaaacggggtccatgaaccttgaaaaactgcagaccaggcccaacatgaccatttttacacgaaataatatagcgactaacttcagctcttctagctcaagctcttactttagtcccccccccccacctgtgcttcttccactgcttctgcttttgcctcaactcttttctagttcttctagctccttcttcttcagcttcagccctagtacgagcccactagtctctccgtgcttctttagtagctcatccagtttctgcttctcggtatcactcctgcccagctcgtcgcccacttcgatgacaaaattccccaaggcagtaactaccaagattaagacggataagagggacttgatcaaactgaagggcttttgtaccgcaaaggagaccattaataggactaacaggcagcccatcgaatgggagaagatatttacaaactacgctagtaataaaggactcatctcccgcatttataaggagctgggtcagtcggataaacagaggccaaacaacccgattaagaaatgggctaaggatatgaaccggcatttcagcaaggaggatatccaggtagcaaacaaacacgaaaaaatgctaagcacatctcttattattggtaagatgcagatcaagaccactgtgcgctaccacctaatgccggcgagaaaggcgaccattaagaagagcgaaaataataggtgttggcagggatgcaggggcaaaggtacatttactcattgttggtcaaagtgcaaactcaaatgtaaatgcaagatgtag

SEQ ID NO: 49929 - DNA, 864 bp, Artificial Sequence
  Description of Artificial Sequence: Synthetic coding sequence
gtgttcttcctgaccggcatccccggcctggagacccggcagatctggacttccatcccattttgttgtctctacgtaattgccatttcaggcaacgggatgatcctcttcgtaatcatcacggagtcttcattgcacgaacccatgtatcactttttgagcatgctatcttttatggatctcggcctttgcttgagcactttaacaacaatgcttggcatcttctggtttaacgcccgcgagatttctttcgatgcgtgtattggacagatgttcttcatccatggattcacatttatggagagcagcgtcttactggccatggcttttgaccgcttcatcgctgtctgtaatcccctgagatatgccactattttaactaatagcaggatcatcaaagtgggattcgcaatcgtcctgagaggtacaactgccctggtcccgttgctgcttctgctaaagcgcttgtccttctgtcgctctcacgtgctccaccactcttattgctttcatcccgacgccatgaagctaagctgcaccgacacctggataaactcggccttcgggctggctatcgtgattagcacggccggcctggacagcgtcctgattctgatctcctacgtcctcatcgtaagaagcgtcttgtgcatcgctagtcccgaagagcagaagaaagcattcgggacttgtgtgagtcacatttccgctgttgccatcttctacatcccaatgatctccttgagcccagttcatcgcttcgggaagcacgccccaccgctggtgcacatgctcattgcaaacgtgtatttgcttataccacctgtgatgaatccaattatctactctgtcaagactaagtag

SEQ ID NO: 49930 - DNA, 396 bp, Artificial Sequence
  Description of Artificial Sequence: Synthetic coding sequence
atgcggaagccccggcgggccggctgggagaccctgagccggaaggcgcctggtccatctgctgggctccggccatcaccagctacctgcgatacttgccattttcccatactgggggacggtaatgcgactctgccatttgctccagggaagacttctcgggtgcccagtgatagcggggtttttagcagcgatcctagagctaattggagttctattaggaatttccccagcgccaaatgcgttgggattgaattacatgcctctctgagcaccagcgctgagtggctgctgagaggtagaggtggcgccctgccatggattgtaagatgcctggcagctactgatctcctgctgcccggtaaaaaaggggtagagtcttgcccggttgggtag

SEQ ID NO: 49931 - DNA, 5421 bp, Artificial Sequence
  Description of Artificial Sequence: Synthetic coding sequence
atggccacccgggtggaggtgggcagcatcacccccctgaccgccgttcccgggctcggagagatggggaaagaagagacactcacaaggacatattttcttcaagccggcgaagctagcggagctcccccggcacgtattctcgaggccaagagtccacttcggagccctgctcgtctgctacccctgcccaggctggccccaaagcccttctcgaaggaacaggatgttaaaagcccagtgccttcacttagaccttcctctacgggcccgagcccttctggtggtctctctgaggaacccgccgcaaaggacctggacaacaggatgccaggactggtcgggcaagaggtgggcagcggcgaagggcccagaacttcctcacctttgttcaataaagccgtttttctacggccctccagctctacgatgattctcttcgaaacaacgaaaagtggtccggctctgggaaaggccgtgtccgaaggtgcagaggaggcaaaacttggggttagtggcagccggcccgaagttgccgccaaacccgctttaccaacgcagaagcccgccgggacacttccacggtccgcacctctgtcccaagacactaagcctccagtaccacaggaagaggctggccaggaccaccctccttccaaagcttctagcgtagaagatacagccaggcctctagttgaaccaaggccgcgcttgaagcgcagacctgtctctgctattttcaccgaaagcatccagccacaaaaacccggtcccggagctgcggccactgtgggaaaggttccccctactcccccagaaaaaacctgggtgcgaaagccccgtccgttgtcaatggatttgacagctcggtttgagaataaggaagcgctccttagaaaggtggccgacgaaggtagcggcccaacagccggtgatatggccggtctcgagagaccaagggctgctagcaagttagatcgcgactgtctggtcaaagctgaggcccctctccacgatccggatctggacttccttgaggtggctaagaaaatccgggagaggaaagaaaagatgcttagtaaacccgagatgggtagccccagagccctggtcggcgggagctcaggtgttacacccagtaacgatcagagcccctgggaagaaaaggccaaactcgatcctgaaccagagaaggccgcggagtctccaagcccacggctaggaagaggccttgaacttgccgaggtaaagagtcgagtggcagacggcgaagccgccgctgggggcgagtgggccagccgcagaagcgtgcgaaaatgtatatctctgttcagggaggacagtaccctggctctggccgtgggcagcgaatcgccactggcaactcctgcgtcaccgtctgccgccccggagccagaaaagggcgtggtctccgttcaagaacgaatccgaggatggacggccgaatcttcagaggcaaagccagaagtgcgccggaggacatttcaagctcgcccgctcagcgccgatcttactaaactgtttagttccagtgccagctccaacgaagtgaagtacgagaaatctgccgagctctcgggcgaatttcctaaggagcctagagagaagcaaaaggagggtcatagcctggatggggcgtgtattcctcgctccccctggaaacccggaaccctccgggacaagtctcggcagaccgagcaaaaagtgagctcaaatcaggatccagactcttgtagagggggttcttccgttgaggcaccatgccctagcgatgtaacgccagaagacgatcgatcattccaaacagtgtgggctacagtgttcgaacaccacgtagagaggcacacagtggccgaccagtctggccggtgcctcagtaccacaccgccaggggacatggctcatgcgcgggttagcgagccgagaccccgtccagagatgggtagttggctgggaagagatcctcctgacatgacgaaactcaaaaaggaaaactctcgcgggttcgataatccagagacagagaaacttggacccacaactctgctgaatggcgaactgagaccatatcatacaccactccgtgataagtatcctctaagcgagaatcacaacaacaatacgtttcttaagcaccttgaaaatccacctacctcacagagaatcgaaccccgttatgatatcgttcacgcagtgggggagagggtgcactcagaggctatctccccagcacccgaggagaaagccgtgacgctcagatcattaagaagctggttgagcctaaaagacagacagctctcgcaggaggttacacctgcagacctcgagtgtgggctggagggtcaagcgggatctgtgcagcgcgcttccctcatttgggaagcaagaggaatgccagaagcaagcgggccaaagttcgggggaaattgcccttttcccaagtggaccgggggggcagtcgtttcctctcacaaggcgactgtggctgtgagcgaagagcattgtgcccccggggctacttccgtcagagcgatcaaggccgctatctgggagtcgcagcatgagggaccagagggagcccggagcaaacccggagttggcgcccgcggcccaccacaagggtgtccacttgatccactgagtcgcgctaccaacggccccagcgatagccaagcaaggactcaccctgacgcctttgctgtccagaaaggaccattcattgtcgcagcaagggagggggatccaggacctgcccaagtgcctcagccggcggtacgtatgaggaaggccggagcaatggatcaaaggatggatcgttggcggagacggacccttcccccaaacgtgaaattcgatacattcagcagcctggtacccgaagacagcccccacgtgggtcaccgacggactgactacgtttcccccaccgcttcagcattgagaaaacctcagctgtcacactatcgtgtagagacccaggaagttaacccgggtgccagtcgcgaccagacatccccagctgttaagcagggatcaccagttgagcctaaagctacatttttcgccgtcacttaccaaattcccaatacccagaaggctaagggtgtggttctgtctggcgccgaaagcctgttggagcattcgcgtaaaataaccccgccctcttcaccccactctcttacgtcaacacttgtttcccttggacatgaggaggcactggaaatggccgggtctaaaaactggatgaaagggcgtgagcatgaaaatgcctctattctaaaaaccttaaaacccactgatagaccatcaagcctcggcgcctggtctctcgacccctttaatggacggatcatagatgtggacgctctttggagccaccgcggcagcgaagatggaccgcgcccacagagcaactggaaagagagcgctaacaaaatgtcaccttccggcggagcacctcagactacacccacacttagatctagaccaaaagacctcccagttaggcggaaaactgatgtgatttccgacaccttccctgggaagattcgggacggatacaggtcaagcgtgctggacattgatgcgctgatggccgagtaccaagagctgtctctgaaggtgcctggtgaagctcaggaacgccgctctccgactgtggagccatcaaccctgccaagggaacgcccagttcagcttgggggggtcgaacaacgtaggcggtccctgaaggagatgcctgacacaggcgggctgtggaagccagctagttcagcagaaatcaaccatagctttaccccaggtctcggtaaacagttagccgagaccctggagacagccatggggacaaagtcttccccacctttctgggcgctgccccccagcgccccatccgagcgctaccctggaggatcgcctataccagctgacccgaggaagaagaccggcttcgctgaggacgatcgtaaggcctttgccagcaagcaccatgtggctaagtgtcagaactacctcgccgaaagcaagccgtccggaagagaggacccgggtagtggggttcgcgtgtcgcctaagagtcccccaaccgaccaaaaaaaagggacccctaggaagtcaacggggcgcggtgaggaggacagcgtggcgcaatggggtgaccaccctcgcgactgtgggcgcgtaccactggacattaaaagggcctattctgagaagggacctccggctaatattcgcgaaggtctatcgatcatgcatgaagcaagagagcggcgtcgtgagcagcccaaagggcggcctagccttactggtgaaaacctagaagctaagatggggccctgttggtgggaaagcggcaccggtgactcccacaaggtgttacctcgagacttagagaaagaggatgcaccgcaggagaaggagcggcctttacagcaggtgtctcctgtcgcttccgtaccatggaggagtcatagtttttgtaaggaccgccgatctggaccgtttgtggatcagctcaagcagtgcttttcaagacaacctaccgagcccaaggacacagacaccctggtgcacgaggcagggtctcagtatggcacctggacagagcagtgtcagagcggtgaaagtctcgcaaccgaaagccccgactcatccgccacgtcaacacgaaagcagcctccatcctctcgactcagcagtctaagctctcagacagagcccactagcgcaggagaccagtacgactgctctagagaccagcgatctactagcgttgaccactcttccacagacctggaaagcactgatggcatggaaggcccaccaccccctgacgcctgtccagagaagagagtggacgatttttcatttatcgaccagacatccgtgctggactcctcagccctgaaaacacgcgttcagctgagtaaacggagcagacgccgcgccccaatcagccactccctgcgtagaagcagattcagtgagagtgagagtcggtcacccctcgaggacgaaactgataacacctggatgtttaaagactcgacagaggagaaatcgcctaggaaagaagagtcggacgaggaagagacagcctctaaagctgaacgaacccctgtgagtcaccctcagcgcatgccagctttccctggtatggaccccgctgtgttgaaggcccaactgcataagagacccgaggtggattcaccgggcgagaccccctcgtgggcccctcagccaaaatcacccaagtctccgtttcagcctggagtgttgggaagcagagtgctgccctcctcgatggataaggatgaaagatcagacgagccaagtccccaatggttaaaggaacttaagtctaagaaacgccagagcctctatgagaaccaggtctag

SEQ ID NO: 49932 - DNA, 741 bp, Artificial Sequence
  Description of Artificial Sequence: Synthetic coding sequence
atggccatcctgcccaaggtgatctaccggttcaacgccatccccattaagcttcccatgacctttttcacagaattagaaaaaacaacattgaagtttatttggaatcaaaagagagcctgtatcactaaatctattcttcgccaaaaaaagaaggccggcggaatcactcttccagacttcaaattatactataccgccactgtcacaaaaaccgcctggtactggtaccagaaccgcgacatcgaccagtggaatagaacagagccctctgagatcatgccacacatttacaattatttaatcttcgataagcctgacaagaacaaacagtggggtaaggacagcttgagcaataagtggtgttgggaaaactggctggctatttgtaagaaactcaaactggatcctttcctgacgccctacaccaaaatcaactccaggtggatcaaggacctgaacattcgacctaagacaatcaagactcttgaagaaaacctcgggatcacaattcaggatatcggaatgggtaaacacttcatgagcaaaaccccgaaggcaatggccaccaaagctaaaattgacaaatgggatctgattaaactcaagagtttttgcactgctaaggaaaccacaataagggtgaatcggcagcccaccgaatgggaaaaaatttttactacttatagtagcgacaagggcctcatctctcgaatttacaacgaactgaagcagatctag

SEQ ID NO: 49933 - DNA, 63 bp, Artificial Sequence
  Description of Artificial Sequence: Synthetic coding sequence
atcatgcccctgtacagcagcagcggcgaccggacccccatcagcaagaaccccactaagtag

SEQ ID NO: 49934 - DNA, 867 bp, Artificial Sequence
  Description of Artificial Sequence: Synthetic coding sequence
atgtacgtgttccagctgttcgactactacagcgccagcggcaccaccctgctctggcaggcattttgggaatgtgtcgtggtggcctgggtttatggcgccgatcggtttacagacgatatcgcctgtatgattggctaccggccctgcccctggatgaagtggtgttggagttttttcacccctttggtttgcatgggcatctttatcttcaatgtagtctactacgaacccttagtatacaacaacaccaatgtctacccctggtggggagaagccatgggatgggcatttgtgttgtcttccatgctgtgtatgccactccacctgctgggctgcctccttcgggctaaaggcacaatggccgagtgctggaagcacctgacccagcctatctggggtttgcatcacctggaatatcgggcacaagacgccgatgtccgaggattgaccacattgactcccgtctccgagagttctaaggttgttgtcgttgagtccgtgatgggacaactgtccagtcatcaccaactgactagtggcttgtgggggaagcggcttcagtactctatactgggagtgtgggccgcaaacctcgcctgctccggcttcccaccatgcgccctgggctgggcccagccccaggagggaacaccagacacagcccccacatcccgcttaaaagctgacgccctcccagctcccccagtcttttgcgttgctgccctgacgcacgtgtgcctgagtaggcccgtccctcgccgcctcagcgaccctaagaagggctttcctgacacacgcactgaggccggcggactcggcctgcgtgagggcggcggtccagccggcacgttcttactctgttag

SEQ ID NO: 49935 - DNA, 666 bp, Artificial Sequence
  Description of Artificial Sequence: Synthetic coding sequence
gcccggcggcggggcgccgccgccgccctgagccgggcccgggtgtggggtaggctatacccccagccaaaactccaagaggccgctcctttgcctagaagaggatgggacggaggtggtcacgtgggtggcgggggggacgctagggggccaagactggagggtgaatcgcttccacaccctcgcctggctcctgctgcaccatcagcctctccggctttggcccatccgttggttgctcacccagcacgattagatagctcccgcaaccccggcaccggaatctacttcgggggctctgctgcctggcgccctgggctgagtcgggtcagtcaggacagaagcccaaattccagtcggccattatccttgtctggaattcccgcagatgtgtcgccccccgctaaaaccagggaggaaaaacgggagcccgccctgtggtctagagagaaggaggaaggtgctacagctctgcaggaccatggctgggaaaaggaatggcgtgggtttcgcaccttttccgttagacttcatgtcccggttttcatctccggatctcaggctctggggtcttgggcgcggatcacctgctgtccccctctttggagcaggggatgcttctgcaaagagagcagtggcagagaaagtatggcatgcctgacctag

SEQ ID NO: 49936 - DNA, 1023 bp, Artificial Sequence
  Description of Artificial Sequence: Synthetic coding sequence
atggcccgggacctgatcggccccgccctgccccccggcttcaaggccaggggcaccgctgaagatgaagaacgagatccctcgcctgtagcaggacctgctctcccccccaattataaatcttcgagttccgactccagtgactcagacgaggacagttcatccctttacgaggaaggtaaccaggaatctgaagaagacgattccggacccaccgcccgtaaacaacgtaagaaccaggacgatgacgacgatgacgacgacggatttttcggcccagcgctgccacctggttttaagaaacaggacgattctccacccagaccgattatagggcccgccctgccaccaggattcatcaagagtacgcagaaatccgataagggtcgtgatgacccgggccaacaggaaacagactcaagcgaggatgaggatattattggacccatgccagcgaagggtcctgtgaattacaatgttactactgagtttgagaaaagagcacaaagaatgaaagaaaagcttactaagggtgatgatgactcatctaaacccattgtgagagagtcctggatgaccgaactccccccagagatgaaggacttcggactgggaccaagaacatttaaacggcgcgctgacgatacatccggcgaccgttcgatttggaccgacacaccagccgatcgcgaaaggaaagccaaagagactcaggaggcacgcaaatccagcagcaaaaaggacgaggaacacattcttagcggccgcgacaagcgtctggccgagcaggtgtcaagctacaatgagtccaaaagatccgaaagtcttatggacatccatcacaagaagttaaaatccaaggcagccgaggacaagaataaaccacaagaacgcattccttttgacagggataaagacctaaaggttaataggtttgacgaggcccaaaaaaaagccctgatcaaaaaatcacgtgaattaaacacccggttcagccacggaaagggtaacatgttcttgtag

SEQ ID NO: 49937 - DNA, 1200 bp, Artificial Sequence
  Description of Artificial Sequence: Synthetic coding sequence
atggagcggaagaaccccagccgggagagcccccggcggctgagcgcaaaagtcggaaagggaactgagatgaagaaggtcgcacggcagctggggatggctgctgcagaaagcgataaagattctggattttcagacggaagcagcgagtgcctatcttctgctgaacaaatggaatcagaggacatgctcagtgctctagggtggagtagggaggatagaccgcgtcagaactctaaaaccgcaaaaaatgcgttcccgaccctttcccctatggtggtgatgaagaatgtacttgttaaacagggatcgtcctcaagccaattacagtcttggacagtccaacccagtttcgaagtcatttccgcccagccacagctgctgttcctgcacccacccgttcctagcccagtgtccccatgccacactggcgaaaaaaagtccgatagtaggaattatttaccaatactcaattcgtacaccaaaatcgctcctcatcccggcaagcgcggcctctccctgggccccgaggagaaagggacgtctggggttcaaaaaaagatctgcactgagcgacttggtccgtccttgagctcatctgagccaacaaaggcaggtgctgtcccgtcctccccatcaacacccgcaccaccttccgcaaaactggccgaggatagcgcattacaaggggtaccctccctggtggctggaggtagtccacagaccctgcagccagtgtcgtcttcccatgtggctaaagccccttcactgacattcgcctccccagcttctcctgtatgtgcctcagactccacactgcacggtttagaatctaactctccgctgtcacctttatcagctaattacagctcacctctgtgggcggccgaacacctgtgcagaagccctgacattttttcagaacagaggcagagtaagcacagacgattccagaatacgcttgtggtgctgcacaaatcaggattgcttgagatcaccctgaagacaaaggagctgattaggcagaatcaggcaacccaggtggaacttgaccagctgaaagaacagactcagcttttcattgaagcaaccaagtctcgagctcctcaggcttgggctaagctgcaagccagtctgactccaggatcaagcaataccggctccgacttagaagctttctccgaccacccagcaatttag

SEQ ID NO: 49938 - DNA, 315 bp, Artificial Sequence
  Description of Artificial Sequence: Synthetic coding sequence
acctgcatcagcttcttcctgttcctgaagaagagcctggccctgctgccaagactggagtattctggtaccatccttgcacattgtaatctgtgcctgctggggtcttctaattcccacgcgtctgcaagccaggtggccggcatcacaggcatgtgccaccacgtctggctcatcttcgttttccttgtggagactggcttccaccatgtggcccaggcggggcttgagctgctcgtgagttcaagctctccagccctggcgagccaatctaccgaaattactgggatgtctcagtgcgcttggccactttag

SEQ ID NO: 49939 - DNA, 303 bp, Artificial Sequence
  Description of Artificial Sequence: Synthetic coding sequence
tgcgagaccccccggctgcccgagatcgccctgcgggccctgccccgcccaggtgtgagctcactgggtactattttgtgtgttccctcagtgcccgtcggcccaatcgtactaaccagtgcaacccccgagtctagcagatttacacggccggccccgtccacagtccccgaggcccatagacacagtcgcattctcagattggcccccgtcccttgtcggtgttatcgccctcctgcacctgctcatactagccgttctacctctctgttttacgagtccccctctacgtttaatgtgtag

SEQ ID NO: 49940 - DNA, 201 bp, Artificial Sequence
  Description of Artificial Sequence: Synthetic coding sequence
acccggaacctgtgggtgttcttcttcttcttcttcgagaccgagagctgctcggtggcccaggccggcgtccaatgggcacagtcgcgactgacaaccgccagtcctggatgcaaacagttcagctgtttgagcctccttagcagttgggactacaggcacgcccctcctcacccggcaaattattgcattttcgtgtag

SEQ ID NO: 49941 - DNA, 261 bp, Artificial Sequence
  Description of Artificial Sequence: Synthetic coding sequence
gtgatctgccccccctggccccccaaggtgctgggcctgcaggccaagtatcatctccataaccacaaattcttcgtcctgagacgctcacttgccctgctgcccaggttagagtgttccggcgcagtcctcgcgcactgcaacctgtgtctgccttccagcagcaattcccctgcatccgcatcccgagtcgcagggatcaccgggtcctgtcatcatacacggctcatattctgcatattttcccgcgaaggagtgtag

SEQ ID NO: 49942 - DNA, 252 bp, Artificial Sequence
  Description of Artificial Sequence: Synthetic coding sequence
atcagcgcccactgcaacctgtgcctgcccggcagcagcgacagctccgcctcagcctccagaatcgccgggatcactggtgctcatcaccacaccaggctgatctttgtattccttgtggagacagaattccatcatgtgggccaggcagggcttaaatggccgcaggtgattcaccccccatggccccctaagtgctgggattatcgccgagaacctccgcgcccagcgctgtttttcaattttctctag

SEQ ID NO: 49943 - DNA, 318 bp, Artificial Sequence
  Description of Artificial Sequence: Synthetic coding sequence
ctgctgccccggctggactgcagcggcaccatcagcgcccactgcaatctccctcgcttcaaaaggttctcatgtctcaggttaccaactgggattacgggcgcctaccaccatacatggattatcttcgcgttcctcgtagagaccggttttcatcatgtcggccaggcaggcctgaagctgcttacttccgagcaactgggtaataccaagagcagaagcagacctcccgggtggagtgcaatggctcctagctggctcaccgcctcatctgcatcccgggtgcacgtcatcctcttgccacagccacctgagtag

SEQ ID NO: 49944 - DNA, 348 bp, Artificial Sequence
  Description of Artificial Sequence: Synthetic coding sequence
atgagcaagtgctgcgcccagagcctgaacgtgccccaccccagcgaaggctctgaaaatatcacccaggactacctggagaaaaattggtatctgcagcggaatacacagaataccgaaattaaagggcctgggggcaaagttaacaatccaccgcaccctcggcttacgttcccaggcgtggtgtcagaacctcctgaggggggaagggtaccgaaagtgctgaaactggcacccagtgcgaagaatctggttaaagccactaaatccctaaccatacccatgatatccatcaagcaccctccaggggtaaggctgtggtcctggggacggcgcttcattacctag

SEQ ID NO: 49945 - DNA, 2436 bp, Artificial Sequence
  Description of Artificial Sequence: Synthetic coding sequence
atgaaggcccggacccggcccctgcgggccagccacgacatcgtgcctaccatcactcaaggaagcagagacggtcaccgcagtcctgcccgggacccacggaccacgcctgcctgccgagattctcttcagaatgggcacactagcgattcttcttctggagaaagcagtggcggccaccgccctcgacgaggcccctctccttcacacgtcaggtttgaggacgaaagcgcgagagaggctgagtttcgtcacctggagaggcttcagcaaaggcagagacaggtgctatccacagtgctgcaagccgccgaccaggggcccctgaggagcaagcccgacctggcagattacatcaatggcgccccaagattaagagatgcagggcaaggcacattccataggctagtgggctccctggatcgcaggggccatcccgcgccacccgccccagggagcgagcggcgctgccaagcctgtggctcttgtattgacgacccgcgcccagcgcagggaaaggctcctcccgtgcccagaaccctgcaggaactgcaggccgcttgtggaatggagagagtgctaggcggcctttcttctcctctccgactgctgccagcagagccgagactgcacatggaatggataagagagactcatatcggggatacagtatgtcctgcagaagtagactccgccctggattcgactgacaactcagacaactgtcgcaccgacagtgaagaggccggcacgtcacaggccgggtgggcatgtggccggacacaaggaagttcccccagactgcgtctgcgggggagtagaccaagaggccacagatggtcaaaaaaggcagaagccgagctgccatggggcctgcaggcgcagcagcatctgccgagagctgacgatgtggaggtggaaaacgaagtgaaggagggtagggggcacactcccgaagggacactgttcctgcgagaggatgcaaaaccgcccgacctggagctgaagagagtatctctgggccctcagtggcaaccaggaccgggtctggggagtcatcagcctcaccctctggactcccgcacaccctgtcggacagcctatgccacgacggctcctatgacacctgaaagtagtggacctgggggtcaagcgcaagtaactgagagtcatgagtccctggaaatcgtgtcccccagtagtctccagcagagccatgccgaaccgagtgcccctcatcaggcctggcagcccaccgcatcactttgtcctgagggatgggcccctacaccccctccttctaggaaaacaaccagcccagtgagccatcgcaaagcagccctagctgggcttctgcggcttggagaccagacagagccagtgggcatacccagacccccaagccgatcagccgtactgagaacatgcgaactgccaccaagccaaactcagccatctagaccccaggttcggcatcctctcctcgccctcagtaccaacaattgtaacaactctgctcccagaggtttgcaggagccatacgggggagccgttcacgaggggcgagtggagcgaggcccttgctcgcgtgaacccgagcctcccctggaaaactcccgggatggcggaccccaaggcttcttggggtccgccgacgtggcgacgattaacagcactggcattaccctgtccctgtcaagtgaggagtccgagtcatcaaaagagagcgaagggtcattgcagagaaccggctccggtagcggtgggcacgtgctatctcgcgcaagcgcgggtgccggcaccggacccggcagtccttctgccgcgcccctggaccagaataagaaacgaagttcatcgatcgcgagtactttgggcctgaagaagcttttctcggccctgggacaatcttctcgcccgaagcttggaaaatctaggagctactcggtggagcagctgcaacccgctcctccaggactaactagccaatctcgggctccttcgctgcagtcattacacccagtcagccctagccatcagaggcgcaaggcagcctcctttcagaacctgcattctctgttaagctccaagggaaacaggtccagcctgtacctcgtggctggtcccggcgaccactccgcggccggccggccagctaaaacctctccacgccgagcgctgtccgtagaggacgtgggcgctccctcgttggcgaggacggtcggccgattagtcgaagtttttccagatggcacaagccagctgcagctgcagagaagccccgggggaaccttcgggttttgtgtcgcgtcaggaaatggccgtccggacagcgggatgccttctccactgcctcaaccacatggctgggggggactatcgaagcagggcagggccttctggctgtggagcgaggcctttctggtattcggatag

SEQ ID NO: 49946 - DNA, 3573 bp, Artificial Sequence
  Description of Artificial Sequence: Synthetic coding sequence
atggagggcaccgaggccgccgccgccaagcccgccggcggcagcccccagggaccaaaaacaggctctggaacggcaagccctgtggagggcaccagtgctgtggagtggtctggccctgagccccagcttgacaatggccatccgccccgcccttggccctgcccccaggagaataggacttccagtctgatggcaccgcagcctccaagagtatggggagtgcagctgcaaggcccatcggttttggagagtaaggtgcgggctctcaaagagaaaatgacagtcgcgaagcagggagtgtctccgtgtagtgcttctcaggagtggagttcccccaagaaaccccagtgcaggcggggcaaagcaggcagggcgggcaccccaagcgaggggagttttctgcccggcgccgttgtagcaccgcgcacacagaatctgcccgacggccagcttgacggctccataaacgaggaacagccagcgagagatggggggcctcgcctgccccggccaccggccccaggtcgggagtattgcaaccgcgggagtccttggcccccagaagccgaatggacactgcctgaccatgacagagggcccctactgggtccgtcgtcccttcaacagtcccccattcatggggtcacacccggacgccctggcgggcctgggcattgcaataagattatccacatcccaagccctaggaccggaaggtcgtacccatttcccgacggcgttgtgactgaagctgacctggatagcacttctctgactagtgaagaggtgtttgtaccccggaccgcgcttctgggtgagagatggagggcaggtgatctggaggccctaggcgcagggagttcagtccttagcctgtccgatcgtgtggaacggaacagacttctcctccaagagatgctgaacgttagtgggcaaagccctcgtaaggtgggcacccctgcctggacgccaagttgggatactgctgccccggagcgtcccgtgggggatgttgattgggcttcgggcacctccctccaagactccggccagaatcggactgtaggcccaaatccggagcctgtgctttccccacgacacgaagaggcgacgcacttactgcagcgcgcccgaatgaaggcccgaacgcgaccactccgggctagtcacgatatcgtgcccaccattacacaaggctcacgggacgggcatcggagcccagcccgcgaccctagaactacgccggcttgtcgggacagcctgcaaaacggccacacatcggactcttcatccggcgagtccagtggcggccaccgaccaaggcggggccctagccctagtcatgtgcgctttgaagatgagtccgcgcgggaggccgaatttagacatctggaaagactgcagcagcgacaacgacaagtgctgtccacagttctgcaggcagccgatcagggccctctcagatccaagcctgatctcgccgactacatcaacggggcaccccgactccgcgatgcgggacagggaacttttcaccgacttgtgggcagtctggaccgaagggggcacccggctcccccagcccccggctctgaaagacgttgccaggcatgcgggtcatgcatagatgacccgaggcccgctcaagggaaagcaccgcctgtgcctaggaccttgcaagagttgcaggccgcatgtggcatggagagggtcctcggggggctgagctctccattgcgcctcttaccagccgagcccagactgcacatggagtggattcgggagacccacatcggggacacagtgtgccctgctgaagtggacagcgccttagatagcaccgataatagcgataactgcaggacggacagtgaggaggccgggacttcgcaggccggatgggcgtgcggaagaacccagggaagtagtccaaggctccgcctaaggggaagccgacctagagggcatagatggagcaagaaagccgaggccgaacttccatggggactgcaggcacaacagcacctgcctcgcgccgatgacgtggaggtcgaaaatgaggttaaagagggcaggggtcatacaccagaaggaaccctgtttctgagagaggacgccaagccaccagacctggaactgaaaagggtgtctctcggaccccaatggcaacctggccccggactggggagtcatcagccccaccctcttgactcaagaacaccttgtcgaactgcctatgcaacaactgccccaatgacgcccgagtcgagtgggccaggaggtcaggcacaagtcaccgaatctcatgagtctctagaaattgtgagcccatcatccctacagcagtcacacgcagaaccctctgccccccatcaggcctggcaaccgactgcctccctgtgcccagaggggtgggccccaaccccccccccatcccggaaaaccacctcccctgtgtcccaccgcaaggccgctcttgctggactccttcggctcggagaccagaccgagccagtgggaatcccacggcctcccagccgcagcgccgtactacgcacatgcgagctgccgccaagccagactcagccgagtcgccctcaggtccgacaccccttgctggcactctctaccaacaattgcaataactctgccccaagagggttgcaggagccatacggaggagccgttcacgaagggcgcgttgaacgtggaccatgctctagagagccggaaccacccctggaaaattctagagatgggggcccacagggatttctgggtagcgccgacgtggctactattaacagtacaggaattaccctgtcactgagctccgaagagtccgaaagcagtaaagagtcagagggcagcctccagcggaccgggtctggctccggcggccacgtgttgagtagggccagtgccggcgcaggcaccggccccggctcccctagcgccgccccactggatcagaataaaaaaaggtcctcttctattgcatctaccctgggcctcaaaaagttgttttcagcactggggcagtcctcccgccccaaacttggaaagagtagaagctattctgtagagcagctgcagcctgccccaccagggctgacctcccagtctcgtgcccctagtctccagtccctccatcctgtgagccctagccaccagaggcggaaagccgcctcctttcaaaacctccacagcctgttatctagtaaagggaaccgaagtagcctctaccttgtggccggcccaggtgaccattcggctgcaggtagacccgctaaaacatctccaagacgcgccctatccgtggaagacgtgggagccccgtcgctggcaaggaccgtcgggagactggtggaggtgttccctgatgggacctcgcagctgcagctgcagagaagcccgggaggcaccttcggcttctgcgtggcttcgggaaacggcaggccagacagtgggatgccaagcccacttccacagccccacggctggggggggttatccaaacaggggagggcgttttggctgtggagcgaggcgtttctggtattcggctag

SEQ ID NO: 49947 - DNA, 405 bp, Artificial Sequence
  Description of Artificial Sequence: Synthetic coding sequence
atgatccccgtgcggggcctgtggtactgctacctgcaggtgaagaaggtgcgcttaagagaagccgaacggctgggaccaaagtcacagtgcccagccgagtgtggggccgccagctggatctcttgggtattgcagcaccagcagctgcttgcttcagagtgggctacgaaggacggcagagggacttggggatccaagccttcttgtactgtgcctgcactctcagccacgtctcagctgctccagctaggtcgcttgaattcagatctgcagttcgtgcgacagcgtgctaaaaaaagcgtaagctcccctagtttgctacagttctggtgttgtcttagccgcctgtcatttcatgcactgaatcagaagattaacagcacgaatataaatatcacttag

SEQ ID NO: 49948 - DNA, 1155 bp, Artificial Sequence
  Description of Artificial Sequence: Synthetic coding sequence
atgagcgccggcagcgccacccaccccggcgccggcggccggcggtctaagtgggaccagcccgcgcctgcgcccttactctttttgccgccggcagcccccggtggggaggtgacaagcagcggggggtcacctggcggcacaacggccgcccccagtggggccctggatgcggcggctgctgtcgcagctaaaattaacgcgatgctcatggcaaagggcaaactgaagccgacccagaatgcttcggagaaactgcaggcccccggcaagggcctcacctcaaacaaaagcaaggacgatctggtagtggctgaagttgaaattaacgacgtgcccctgacatgtagaaatctcttaaccagagggcagacccaagacgaaatatctaggttgagtggggcggcagtctccactaggggcaggtttatgactactgaggagaaggccaaggtgggtcctggagacagacccttatatctgcatgtgcagggccaaaccagagagctcgttgatagggcagtgaaccgcatcaaggaaattatcacgaacggcgtcgtaaaggccgcaactgggacatcgcctaccttcaacggagctactgtcacagtatatcatcagcccgcccccatcgctcaactgtctcccgcggtttcccaaaagccgccgttccagagtggaatgcattacgtccaggacaagctcttcgtcggccttgaacacgcagttcccacttttaacgtcaaggaaaaagtggagggccccggctgtagctaccttcagcatatccagatcgaaacgggcgccaaagtgttccttagaggaaaaggcagcgggtgtatcgagcccgcctccggacgggaggcatttgagcctatgtacatttatatttcacatcctaagcccgaaggcctggctgctgctaaaaagctgtgcgaaaacttactccaaacagtgcatgcagaatattccagatttgtgaaccaaatcaacacagctgtacctctgccagctgcctcatccacatcactccggagcactaaacacagtgccacatcttgttttatttctacttggtcactggccgggatcacttattggagccctacttgcgcaaacaccattcctgacaataccagcgccgccagctcgtag

SEQ ID NO: 49949 - DNA, 1695 bp, Artificial Sequence
  Description of Artificial Sequence: Synthetic coding sequence
atgagcgccggcagcgccacccaccccggcgccggcggccggcggtctaagtgggatcagcctgccccagcacccctgctattcctgccacctgctgccccaggcggggaagtgacatcaagtggagggtcacccgggggcaccaccgctgctccctctggagccctggacgctgccgcggctgtcgcagcaaaaattaatgccatgctcatggccaaaggaaagctgaagcctacgcagaacgcctctgagaagcttcaggctccggggaagggactgacaagcaataagtccaaagacgatctcgtggtggccgaggttgaaattaatgacgtgccattgacctgccggaatttgttaacaaggggccagacccaggacgagatatccagacttagtggcgcagctgtgagtacccgcggaaggttcatgaccaccgaggagaaagcaaaagtggggccgggagatagaccgctttatctgcatgtccaagggcagacaagggaactggtggacagggctgtgaaccgcatcaaggagattatcactaacggagtggttaaggcagcaaccggcacttccccaaccttcaacggcgccacagttactgtgtaccatcagcctgcacctatcgcacagctctctcctgctgtctctcaaaaacctccattccagagcggaatgcactacgtgcaggacaagctcttcgtgggcctcgagcacgccgtacctacattcaacgtgaaggagaaggtagaaggtccagggtgctcgtatttgcagcacatacagattgagactggagccaaggtcttcctccgagggaagggctccgggtgcatagagccggcctctggcagggaggccttcgaaccgatgtatatttacattagccacccaaaacctgaagggctggcagccgcgaaaaaactatgtgagaatctgctacaaaccgtgcacgccgagtattccaggttcgtcaatcagattaacaccgcggtaccactccctggttatacacagccatccgccatttcctcagttcccccacagccaccatattaccccagcaacggttaccagagcggctatccagtcgtgccacctccacagcagccagtacagccaccgtacggtgtgcctagcatcgtaccgcccgctgtcagtttggcaccaggtgtccttcccgcattacctaccggcgtgccgcctgtccctacccagtaccctattacccaagtgcaacctccagcttctacggggcagtcccccatgggaggcccatttatccccgcagccccagtaaaaaccgcccttcctgcaggccctcagccgcagcctcaacctcagccacccctaccatctcagccccaggcacagaagaggcgatttacggaagaactgcccgatgaaagggaaagtgggcttttgggatatcagcatggccctatacacatgaccaacctgggcacggggttcagttcccagaacgaaatcgaaggagccggctccaagcccgcgagctcatctgggaaggaaagggagcgtgaccggcagttaatgcctccccctgctttcccagtaactggaataaagacggaatcagacgaacggaatggatccggaactctgacagggtctcatggggagtgtgacattgcagggggaacaggtgagtggttgcgactcgtttag

SEQ ID NO: 49950 - DNA, 1845 bp, Artificial Sequence
  Description of Artificial Sequence: Synthetic coding sequence
atgagcgccggcagcgccacccaccccggcgccggcggccggcggtccaagtgggatcagccagcaccggcaccattgttgttcttgccgccggccgcccccggcggcgaggtgacttcatccggcggcagccctgggggcaccactgcagctcccagcggagcgctcgatgccgccgccgccgtagctgcaaagatcaatgcaatgctgatggctaaaggaaagctcaaacccacccaaaacgccagcgaaaaactgcaggctcccggcaaggggctgacttcaaataagtcgaaggacgatctggtagtcgctgaggtggaaatcaatgacgtgcccttaacttgtagaaatttacttactagaggacagacccaggatgagattagtagactgagcggcgcagcagtctcaacgaggggtcgatttatgacaacagaagagaaagctaaggtcggccccggcgatcggcctctctatctccacgtccagggccagacaagagagcttgttgaccgagcagtgaatcgaattaaagagattatcaccaatggggtcgtgaaggccgccaccggtacgagtcctacatttaacggggcaacagtcaccgtttatcatcagcccgcccccatagcccagctgtctccagctgtgagtcagaagcctccttttcagagcggcatgcattacgtgcaggataaactcttcgtaggattagagcacgccgtccccacatttaacgtcaaggagaaggtggaagggcccggttgtagctatcttcagcacatccagatcgagaccggcgctaaagtgttcctgagggggaaggggtcaggctgtattgagcctgctagcggaagagaggccttcgaacctatgtatatctacatttctcatccgaaacccgagggactcgctgctgccaaaaaactctgcgaaaacttactgcaaaccgttcacgcggagtactctcgctttgtcaatcaaataaacaccgccgtgcctctccccggatacacccagccgtcagctatttctagcgtccccccccagccgccctattacccaagcaacggctaccagagcgggtatccagtcgtgcccccgccccagcagccagtgcagcctccctatggagtcccttctatagtgccaccagccgtgtccctcgcacccggagtactgcccgccttgccgactggggttcccccagtccctacgcagtacccgattactcaagtgcaaccccccgcaagtactgggcaaagccctatgggaggtcccttcattcccgccgcccccgtcaagactgctcttccagcaggccctcagccacagccccagccccagcctcccctccccagccaaccccaggcccagaaaagacgttttacagaggagctgcctgacgagagggaatccggtctgctcggataccaacatggccctatacacatgacaaatctggggaccggattcagttctcagaacgagattgaaggagccgggtccaagcccgcctcttccagtgggaaggagcgcgagcgcgatcgccagctgatgcccccccccgccttccctgtgaccgggatcaaaaccgaaagtgacgagcggaacggatccggcactcttactggtagccacgactaccccgccaagaagatgaagacaaccgaaaagggctttggattggtagcatatgctgcagattccagcgatgaagaggaagagcacggtggccacaaaaatgcctcaagcttcccacagggttggtctctgggataccaatatccctcctctcagccaagagccaaacagcagatgcccttctggatggcaccgtag

SEQ ID NO: 49951 - DNA, 1581 bp, Artificial Sequence
  Description of Artificial Sequence: Synthetic coding sequence
atgatccagagccagatcagcttcgaggacgtggccgtggacttcacgttggaggagtggcaactgctgaaccccactcaaaaaaatctctatcgcgacgtaatgctcgagaattatagcaatctcgtttttctggaagtttggctggacaaccctaagatgtggctgcgggataaccaggacaatctgaaaagtatggagcgtgggcacaaatacgatgtgttcgggaagattttcaacagcagtattaacatcgtgcatgtaggactccggtcccataaatgtgggaccggcgaaaagtctctgaagtgtccctttgatctcctgatacctaagaacaattgcgaaaggaaaaagatagacgaactgaacaagaagttactcttctgcataaagcccggcagaacccacggtggtatcaagtattgcgactgtagtacttgccgcaaaagttctaacgaggaaccatggctgactgccaatcatataacccacaccggcgtgtatctttgcatggaatgcggtcgcttcttcaacaagaagagccagttggtgatccatcagcgcactcataccggagaaaaaccctatcagtgttctgaatgtggaaaagccttctcacagaaatctttgcttaccgtccaccaaaggactcattcgggtgagaagccgcatggatgcagtgagtgccaaaaagcctttagccgaaagtccctcctgatactccaccagaggatccacaccggcgaaaaaccttacggatgctctgaatgtggtaaagccttctcccggaagagtcagctaaagcgccaccagatcacccacactattgagaaaccatactcttgctccgagtgtggcaaggcgttctcacaaaagctgaagttaataacacaccagcgggcacacacaggagagaaaccatatccttgcagtcattgtggtaaggcatttttttggaagtcacagctcataactcaccagagaactcacacaggtaagaagccatacggctgtggcgaatgccaaaaggccttcagtagaaattccctactcatacggcaccaacgcatccatacaggagaaaagccctatgagtgtaatgagtgtggggaagctttcattcgtaaaccccagcttataaagcaccagataacgcacacaggggaaaagaattaccgttgtagtgactgtgaagaggccttctttaagaagtccgaactgatccgccatcaaaagattcatctcggggagaagccctacggatgcattcagtgcggcaagacctttttcggaaaatctcaactcctgacacatcacagaacacacacaggggaaaagccttatgaatgcagcgaatgtggaaaggcctttacccagaaatctagtttgatttcccatcagcgcacccacactggcgaaaagccttacgagtgtagcgagtgccgtaagacattctccgagaaatcaagcctcatccatcatcagcgtactcataccggcgagaagccattcgaatgctctgaatgcaggaaagctttcgcttggaaacctcagctcctgcggcaccagaggatttag

SEQ ID NO: 49952 - DNA, 4065 bp, Artificial Sequence
  Description of Artificial Sequence: Synthetic coding sequence
atgagcagcaccgccgacctgctggacaccatcctgaaggccatcgaggagaacatcacgacagaaaacagctgcagcctgctgatggccctggacacactactgaactcagattctactaaggaaatgggcttcacttgcaagatacaggctcttagagacaagttgtggatatttctagtgcagtccttctatgctgtgaggcacacggagtcgtggaagctgatgagcacagacgaccagcagaaaatccaagcagcagcatttgataagggagacgaccggcggctcggaaaaaaaccaatcttctccagctcccagcagaggaagcaagtgagcgacagcggagacattaagattaagtcttggagaggtaataacaaaaaggagtgttggtcgtatctatccacaaataagaagatgaaaagcgacggtttgggggcgtcaggccactctagttccactaatagaaacagcatcaataaaactctgaagcaagacgatgtcaaagaaaaggacgggactaagatcgcctcaaagatcaccaaggaactgaagactggcggcaaaaatgtgtcaggaaaaccaaaaacagtaaccaagtccaagaccgagaatggggacaaagcgcgcctggagaacatgtcaccacgtcaggtcgtggaacggagtgcaacagccgccgctgcggccaccggccagaaaaacttgcttaatggaaaaggcgttaggaatcaggaggggcagataagcggcgctcgacctaaagttctaaccggtaaccttaacgtgcaggccaaagctaagccattgaaaaaagccaccgggaaggattccccatgcctttccatcgcgggaccatcttcacgttccaccgactcttccatggaattctccatcagtacggagtgcctggacgaaccaaaggagaacggcagcaccgaggaagagaaacctagcgggcacaagcttagtttttgcgatagccccgggcagatgatgaagaacagcgtggatagtgttaaaaactctaccgtggccataaagagccgcccagtatctcgtgtcaccaacggcacctccaacaagaaatcaattcacgagcaggatacaaatgtcaataattcagttctaaaaaaggtctcaggtaagggttgtagtgaacctgttccgcaggctatcttgaagaaacggggcacaagcaacggttgcactgccgcacagcaaagaactaagagcacgccatcaaacctgacaaagacccagggtagccaaggtgaatccccgaactcggtgaagtcaagcgttagctctcggcagagcgatgaaaacgtcgcaaaactcgatcataatacaacaaccgagaagcaggctccaaagaggaagatggtgaagcaagttcacacggccttgccgaaggtcaatgctaaaattgtggcaatgcctaagaacttaaatcagagtaagaagggcgagaccttgaacaataaagactctaagcagaaaatgcccccaggccaagttatctcaaaaacccagccctcatctcagcgacctctgaagcacgaaaccagtaccgtacagaaaagtatgttccatgatgttcgcgataacaacaataaggactctgtgtctgagcaaaaaccacataaaccactgattaaccttgcaagcgagatttccgacgctgaagctctgcagtcaagttgtcggccagatccacagaaaccgctgaacgaccaagagaaagagaagctcgccctcgaatgtcagaacatttctaagctggataaatcgctgaagcatgagctggaaagcaagcaaatctgcctcgacaagagcgagaccaaattccccaatcacaaagagaccgacgactgcgacgcagccaatatctgctgccattctgtcggtagtgataatgtgaattccaaattctattccaccacagccctgaagtacatggttagcaatcccaacgagaattcactgaattctaacccagtctgcgacctggattctacctccgcaggtcagatccacttgatcagtgaccgagagaatcaggtgggccgaaaagacactaataagcaatccagcattaagtgcgtggaagatgttagcctctgtaaccctgagcgaacaaacgggacgcttaattctgctcaggaagacaaaaagtctaaggtgcctgtggagggactgacaataccttctaaactctccgacgaatctgctatggatgaggataaacatgcaactgctgacagcgatgtatcatccaagtgcttttcggggcagctcagtgaaaaaaacagccccaagaatatggagacaagcgagtctcccgaatcccacgaaacacctgagaccccctttgttgggcattggaatctctcaacgggcgtcttgcaccagcgggagtcgccagagagcgatactgggagcgccaccacgagcagtgacgatattaaacctcgatccgaagactacgacgccggtggatcccaggatgatgatggcagtaatgacagagggattagcaagtgcggcacgatgttatgccatgactttcttggaagaagtagttcagacacatccactcccgaggagctcaagatatacgattccaaccttcgcatcgaagttaaaatgaaaaaacagtccaataatgatttatttcaagtcaattccactagcgatgacgaaatccctcgtaaacgacccgagatctggtctagatccgcaatcgtacattcccgcgaaagagagaacattccacgtgggagtgtgcagtttgcccaggagatcgatcaagtttcatcatcagcagatgagaccgaggatgaacgaagcgaggctgaaaatgtggctgaaaatttctctatatccaaccctgctcctcagcagtttcaaggcattatcaatttggcatttgaggacgcaactgagaatgaatgccgcgagttctcggcaaccaaaaaatttaagcggtccgtacttctgagcgtggatgaatgtgaagaactgggaagcgatgaaggagaggtgcacactcccttccaagcctcggtggactcgttcagcccatccgatgttttcgacggcattagccatgaacaccacgggcgcacctgctacagccgatttagcagggagagcgaggacaatatcctggagtgcaagcagaataagggaaatagcgtatgcaagaacgaatctacagtcttggacttatcctctatcgactcctctcggaaaaacaagcagagtgttagcgctacagagaaaaaaaacaccatcgacgttctttcttcaagaagcagacaactgttaagagaggataagaaagtgaacaatggttcaaacgtggagaatgacatccaacagagatcaaagtttctggactctgacgtgaaatcacaggagagaccttgtcatttagatctgcatcagagggagcctaacagtgacatccccaaaaattcatctaccaaatcactcgactctttccgaagtcaggtattgcctcaggaaggccccgtgaaggaatcgcattctactactactgagaaggcaaatattgctctgtcagccggcgacattgacgattgtgatacactcgctcaaactcggatgtatgaccacaggccaagtaagacccttagtcctatatatgaaatggatgtgatcgaagctttcgaacagaaggttgagagcgagacgcacgtaacagatatggactttgaagacgaccagcatttcgccaagcaagactggaccttactcaaacaactgctgtctgagcaggattccaacctggacgtaactaattccgtccctgaggacctctctctagcccagtacctcatcaaccagacgctcctgctcgctcgcgactcctctaagcctcaggggattacccatattgacaccctgaatcgctggagcgaacttacatccccccttgacagctctgcatcgatcacgatggcttccttctcgtcggaagactgctctcctcagggagagtggacaatcctggagttggaaacccagcactag

SEQ ID NO: 49953 - DNA, 2364 bp, Artificial Sequence
  Description of Artificial Sequence: Synthetic coding sequence
atgggcgaccccggcagcgagatcatcgagagcgtgccccccgccggtcccgaggcaagcgagtccacaaccgacgaaaatgaggacgacatccaatttgtctcggaaggcccctcaaggcccgtactggaatatattgacttagtgtgcggcgatgacgaaaacccgtcggcctactacagtgatatcctgtttcccaagatgccaaaacgccagggcgactttctgcattttttgaacgtaaaaaaggtcaagaccgatacagagaacaacgaggtgagtaagaaccactgcagactgtcaaaagccaaggagccccactttgaatacattgagcagcctatcatagaagagaaaccttccttgagctccaagaaggaaatcgacaatttggtcctgcctgattgttggaatgagaaacaggctttcatgttcaccgaacagtacaagtggttggagattaaggaaggtaagctagggtgcaaggactgttctgccgtgagacatctgggcagcaaggctgaaaagcacgtgcatgtatcaaaggaatggatcgcatatcttgtgacccctaatgggtccaataagaccacacggcaagcgtcactcagaaagaaaattagagagcacgacgtctcgaaggctcacggaaagattcaggaccttctgaaagagagcaccaacgacagcatttgcaacctggttcataaacagaacaataaaaatatagatgcaaccgtgaaagtattcaacactgtgtacagcctggttaaacacaaccgccccctgagcgacatcgagggtgcccgcgagcttcaggagaaaaatggcgaggtcaattgtctcaatacccgatatagcgctacacggatagcagaacacatcgcaaaggaaatgaaaatgaagatcttcaagaatatcatcgaggagaacgcaaaaatttgcatcattattgatgaggcgagcacagtctcaaaaaagaccactctcgtgatatatctccagtgcacaatccagtctgcgccggcacctgtcatgcttttcgtcgctcttaaggagcttgtgagcaccattgctgaatgtatcgtgaacacactcctcaccacccttaatgattgcggctttacaaatgaatatcttaaagcgaaccttattgccttttgcagcgacggcgctaacacgattctgggaaggaagagcggtgtagccactaagctgctagagaactttccagagattattatctggaactgtctgaaccacagactccaattgtccttggatgatagtatatctgagatcaaacagatcaatcacctgaagattttcatcgataaaatctactctatctaccatcaaccgaataagaaccagaccaaactgctggggacagtagctaaggaactcgagaccgagattataaagatcgggagggtcatggggccgagatgggcggcctgctcccttcaagccgcgacagctgtatggcacgcttacccaatactgtatatgcactttagccatagctattcggggctcgcaaaacgcctggccaacataaacttccttcaggacctggccctgatgattgacatccttgaggaatttagtgtcctgagcacagctctccagtcccggagcaccaacattaagaaggcccagaaacttatcaaaagaaccattagggccctggagaacctcaagatcggtaccggcaaatacgagagccaaatagaggacctgataaaaagcgacaaattcaaggatattccctttaataaaaacaataagttcaacgcactgccacgttctattctgctagacaacatcattcaacatatgaacctccgactgctctctgaccgaaaccacgaagacatttttaactacttcgacttactggaacccagcacctggccatatgaagaaattacctcgccttggatcgctggggaaaaaaccctttttcatctctgcaaaattctcaaatatgaggtcgatctgaatgattttcgagaattcgtcaataacaacattaagtcgaacaacgtttccatccctaccacaatttacaaagcaaagaaaatagttagtacaatcgccataaattccgcggaagcagagcggggatttaatctcatgaacatcatttgtactcgagtgaggaatagccttaccatcgaccacgtatcagacctcatgactattaacctgctgggcaaagagcttgctgattgggacgccaccccattcgtgaagagctggtccaactgtaatcacaggctagcaacggacacacgagtccgccagaaaagcactaaggtatttcatgaaaatcagctggctatatggaatttgaaatag

SEQ ID NO: 49954 - DNA, 636 bp, Artificial Sequence
  Description of Artificial Sequence: Synthetic coding sequence
atgcagctgggcgagcacacccacccccagaagaaccccaagagcctcgctggctgcttgctcccaaatcctcaccctcagctgcagctgagggggaagagagctgccggactgctgcttcgcagaaatccctggagacatccccaggcccccggtggaagtagtacctgggcaccatcccttccacccatccttgcacctcaagcatacctcaattttgcccccccgacaccagtacctggcggatctccaggaacagaggctcaaccagtggctccggcaaatgcactcggcagccgttctaagctgaatttgacccagccatcctgcctgagttcaggaagtcaccttccgctgccgttccccgccggcatgtgtccccacccagctaaccccacatgggcattacggaaaggcgccgaggtgcctcagggacccccattgtcccacactcgaaaggccctgtgtctggctgcttccggagtgggcgctctcctcttggaggtgccccgccaccccggctgggggcaacaaagcgctgccggcttccaacaagtgtttcaagaaggcgccggcacgcacttccctagcgtcagagttcaaccgggaagaggcaaattgcagggacagcgatag

SEQ ID NO: 49955 - DNA, 1488 bp, Artificial Sequence
  Description of Artificial Sequence: Synthetic coding sequence
atgaagaagcggaaggagctgaacgccctgatcggcctggccggcgattcacggagaaagaagccgaaaaaagggccatcctcccacagactgcttagaacagaaccacccgatagcgactcggagagttcgtcagaagaagaagaggagtttggtgttgtggggaatcggtcaaggtttgctaaaggagattaccttcggtgctgtaaaatctgttaccctttatgcggctttgtcattctggctgcatgcgttgttgcctgcgtggggctagtctggatgcaggttgcactgaaagaggacctggacgcactgaaggagaagtttcgtacaatggagagcaatcagaagtcaagctttcaggaaatccccaaactgaacgaagaattgctctctaagcagaagcagctggagaagattgaatcaggggagatggggctaaacaaggtctggatcaatatcacagaaatgaataaacaaatctcactcttaaccagtgccgtcaaccatctaaaagctaacgtgaagtccgccgccgaccttattagtctgcccaccactgtggagggccttcaaaagtctgtggccagtataggcaacactctgaactcagtgcacctggccgtggaggcattgcagaaaaccgtcgacgaacacaaaaaaacaatggaactgctgcaaagtgatatgaaccagcattttctcaaggagacacccggcagtaaccagatcatcccttcgccaagcgcaacatctgaacttgataataagacgcatagtgaaaacctgaagcaggacatcctttacttacacaactcactggaagaggtgaattcagcgcttgtcggctaccagcgccagaatgacttgaaactggagggaatgaacgagactgtgtccaacctaactcaacgagtgaatttgatcgaatcggacgtggtagctatgtccaaagtagagaagaaagccaatctgagtttcagcatgatgggggaccggagcgccactctgaagcgacagtccttggaccaggtcaccaacagaactgacaccgttaaaatacaaagtataaagaaggaagactcgtccaacagccaggtctccaaactgagggaaaaactacagctgattagcgccttgacaaacaagcctgaatctaatcgcccccctgagactgccgacgaggaacaagtcgagtcatttaccagtaagccgtcagccctgcccaaatttagccagttcctaggggatccggtggaaaaagcagcccagttacggccaatcagtctccctggagtgtctagcactgaggatctccaggatctatttcggaagacaggccaagatgttgacggtaagctgacctatcaggagatttggacaagtctgggtagcgccatgccagaacccgagtctctacgcgcttttgacagcgacggagatggaaggtattcttttcttgagttgagagttgccctgggaatctag

SEQ ID NO: 49956 - DNA, 345 bp, Artificial Sequence
  Description of Artificial Sequence: Synthetic coding sequence
atgtgcggctgggaggacagccagaagcccagcgtgcccagccacggcccaaagaccccatcctgtaagggtgtcaaggccccccattccagtcgccctagagcctggaaacaggacttagaacagtctctcgccgctgcctacgtgcctgtggttgtagattctaaaggccagaatcctgacaaactgcggttcaatttctacacaagtcaatactccaatagcctaaaccctttttatacacttcagaagcctacttgtgggtatctctatcgacgcgacaccgatcacacaagaaaaaggttcgacgtccccccagccaacctggttctgtggcggtcctag

SEQ ID NO: 49957 - DNA, 324 bp, Artificial Sequence
  Description of Artificial Sequence: Synthetic coding sequence
atgtggctgagcccctggagcacctgccccccccaccccctgcccagctgtttaaccgcgtgttgcagccccgcccaccagccggttcgcggctccgcccaacccccggccagtgacctatgtacttgcgttacttgttgcagtggacctcaccccaactatccccccgcacatttacttccaacgagctcactgcccatctgccctggtctgatctgttgcttgttaacttgcctgttagtcgactgcttctcagccctgctttctgcctgtgagacacgggacctttcaccatggaaggcacgaagagtccttctgcggtag

SEQ ID NO: 49958 - DNA, 2499 bp, Artificial Sequence
  Description of Artificial Sequence: Synthetic coding sequence
atgggcaccaccgccagcaccgcccagcagaccgtgagcgccggcactcccttcgagggcctgcagggcagcggcacaatggatagccggcatagcgtttccatacacagttttcagtccacatccctccataatagcaaagccaaaagcattatcccaaacaaagtggctcctgtggtgatcacatacaattgtaaagaagagtttcagatccacgacgagctattgaaggcccactacaccctcgggcggcttagcgataacactcctgaacattacttggtgcagggaagatattttctggtgagagacgttactgagaagatggacgtgctgggtaccgtgggaagctgtggtgcaccgaactttaggcaggtacagggagggctcaccgtttttggaatggggcagcccagtttgtctggcttccggcgcgtgctccagaaactgcagaaggacggccaccgtgagtgtgttattttttgcgtgcgggaagaaccagtcctttttctacgcgcggacgaagattttgtaagttacaccccgagagataaacaaaatttacatgagaacctgcaggggctcggaccaggagtgagagttgaaagtttggaactggccatcagaaaggagattcacgatttcgctcagctgtccgaaaatacatatcatgtctatcacaacacggaggatctttggggagagccacatgctgtggctatccatggagaagacgacctacatgtgaccgaggaagtgtataagcggcccctctttctccagcctacttaccgctaccatcgactccctctgcctgagcaggggagtcccctagaggcacaattggatgcctttgtgtctgttctgagagagactccatccctgctccagttgcgcgatgcgcatgggcccccccctgccctggttttctcctgtcagatgggcgtaggacggactaaccttggcatggtgcttggcacgctgatactgctccacagatcaggtacgacttcacagcccgaagctgccccaacccaggctaaacctttacctatggagcagttccaagtgattcagagcttccttagaatggtgccccagggtaggaggatggtagaagaagtagaccgggcgattacagcctgcgccgaactacacgacttaaaagaggttgtgctggagaaccagaagaaattggagggcattaggcctgagagcccggcacagggtagcggaagccgccactcagtgtggcagcgggccctgtggtcgctcgagcgctatttctacctcatcctgttcaattattatcttcatgagcagtatcctctggcgttcgcactctcatttagcagatggctgtgtgctcatcctgagctgtatcgtctgccagttactctgtcctcggcgggacccgtcgccccacgtgatttgatcgccaggggcagtctgagggaagatgacctggtgtcacccgacgcactctccaccgtgcgggaaatggatgtggctaactttcgaagggtccctcggatgccgatctacggcaccgcccagccttctgccaaagccctaggttccatcctagcttaccttacagacgccaaacgacgcctgcgtaaggtggtgtgggtctccctgcgggaagaggctgttcttgagtgtgacggacatacgtactccttgcggtggcctggaccacccgtggctcccgaccagcttgagacgttagaggcccagctgaaagcccacctgagcgagcctcctcctggcaaggagggcccattgacatatagatttcaaacgtgcctgacgatgcaagaggttttcagtcagcaccgcagagcttgccccggactgacataccatagaattcccatgccagatttctgcgccccgcgggaggaagacttcgaccagttgctcgaagccctgcgcgcagctctttcgaaagacccaggaacgggtttcgtcttctcctgcctttcgggacagggccgtactacaactgctatggttgtggccgtgctggcattttggcatatccaagttgtgatgaaagttgtccagctgctgcctgacggtcatcgcgtgaagaaggaggtggatgcagcactggacaccgtgtcagagactatgacacccatgcactatcacctgcgggaaatcattatctgcacttatcgacaggcaaaggctgccaaagaggctcaggaaatgaggcgattacagttaagatccttacagtatctcgaacgctacgtgtgtctcattctgtttaatgcctatctacaccttgagaaagcagatagttggcagaggcccttttccacatggatgcaggaagtcgctagtaaagccggcatctatgaaatactgaatgagctcgggttccctgagttggaatccggggaggaccagcctttctctcgattaagatacaggtggcaggagcagtcttgtagtcttgaaccaagcgcccccgaggacctgctgtag

SEQ ID NO: 49959 - DNA, 1428 bp, Artificial Sequence
  Description of Artificial Sequence: Synthetic coding sequence
atgccctgccccagccggaacaccagcagccccgagccccccacccctggactaaagttttcctttctacgcgggcaacggcagccctctgtgacccctgaaaaggcttcccttcagcataacgggccctggaaagtactgtgtagtttgtatagtcctaaacccaacagggcaaagtcacttgggaaggccggcacaacacagaccaagacatccggacccgccacagcccctagccctttgactgaggaaaaagcagcactgcctgaggcttccgccggcagcccagagcgaggacccacattggaggaggagccccccgggccagagccaagaatcggggccctgggtgtgaaagttttccgatcacgcatcgcttgcttgcctgggggccgcgaccgtgcaggtagaccgctactgctggtaagtaccaccgaaggtgcttgggaagctccatggtgcaccgtgagcgaagtaactaaactgctgagttacttgtgtacaatcccacggccagaggacaaggcaaaaggactggccgtcctgatagatgcgcgacgacaacccccgcagccaggtctggttagcgcgctgcaggccactcaggcccaagttcccgcatccatccgggccatcttgtttcttggtgaaaaggaggcagccctgcagctccaaaccctgccagatgtgcagaaactggaccccttcctcgctgaccttcatcaggccagctctctcctgcaggcatccattgaggagttcgagaaagccgatcctccaggcggcatgcaggaggcgacgaggtgcctgtcaaagtccaaagaattgatggaggccgtcctccgcgatccaggtctcctcgggctgcagcgagagggcggggcaactcttgcccggctgcagcacgatgcttcaaggctcgacttttctcccgacgtgagatcacatcttgccgctgccaccgccttatacagtctcgtcgacgaacagttgcatgtcctggtcactgcttccaattctttgcttggtaagctggaactgcgcgtgaggttgggacggctcgaagcggccatccaccaggtgagtgactggatggagcaggagggccggcgatgcctccagagtctcacccccaaagatggcagccttgaaactgttgaaaaggcccatgctgaattcgagaacttttttctccaggccgctgcccaataccggcgtggcctcgagttatcaaagcaggcggcccagctgggagctactgctcgaggtgccggcgaggccgaaagagcagagtttccagagttggccgcttttgcttccacacagcgtgcatttcaggctgaactcacccacttctacatggctgccgagagacagcggacggacctggaaaccctgctgcatctccaccgattttgtaaaaggtag

SEQ ID NO: 49960 - DNA, 480 bp, Artificial Sequence
  Description of Artificial Sequence: Synthetic coding sequence
atgcaccagacccacgccatccagcggctggaggtgctgcccagcttctccaacgagagtcccacatctagagaaacttccgagtcttggaccaatcaggatgacatcttctatgcctatgccagcatgagtcctggtgccgagcaccgtgggaccactcagttactgcggttccagctggcccccatcaagaagctggagggcagtctgcagactcatttcctcctttcctctctgcaccctagaatgacgtttccaggcagggcaggaggaggtgaggccggcagtcgacctcctcggagaccctgggccggtatccttatcttgcagctgccctcaactcgcggggggagaaggagcgggcatggggcagtccgtagttggggaccatggaaggtcgtcgccgaacagcccgtcggaggcaccgacccgcccgcccacggtgggagggggaggcctagtcctaatgagaatacatag

SEQ ID NO: 49961 - DNA, 3108 bp, Artificial Sequence
  Description of Artificial Sequence: Synthetic coding sequence
atggtggtgttcgtgggccggcggctgcccgccctgctgggcctgttcaagaagaaaggatccgctaaagccgagaacgacaagcacctctcagttggcccaggccagggcccaggcagcgctgtggatgagcaccaagacaatgttttttttccttccggaagaccccctcatctggaggaactgcacactcaagctcaggaggggctgcgctccctacagcatcaggagaaacagaagcttaataaagggggatgggaccatggcgacacacaaagcattcagtccagccggactggccccgatgaggataacatctctttctgcagccagaccactagctatgtggccgaatcatcgacggccgaagatgccctgtccatccgctccgaaatgattcagcggaaggggtcaacctttcgacctcatgactccttccccaaatcggggaagtccggccggcgtcgccgggagcgtaggtcaaccgtgctcgggctccctcagcacgttcagaaagagttgggcttgcgtaacgagagggaagctcccggaaccccacgcgctcccggtgcccgagatgccgtgcgcatacccacagtcgatgggcggccccgaggaacctcaggaatgggagctcgcgtgtccctgcaagccctagaggcagaagcagaggctggtgccgaaaccgaggccatgttgcagcgccatattgaccgcgtgtatagggatgacacgtttgtggggcgtagcactggaacaagggccccgcccctgacaagacctatgtcgctggcagtgcccggactaactgggggggcaggcccagcggagcctctctcccctgccatgtccatctccccccaggccacctacctcagtaaactgatcccacacgcagtgctgccgcctactgtcgacgtagttgccctcggccgctgtagcctgcgcaccctgtctagatgctctttgcacagcgcttcccctgcatcagtacgcagcctgggacggttttcgtcagtctcatcgccacagccccgctccagacaccccagcagtagcagtgacacatggagccatagtcagtcctccgacacaattgtgtccgatggttccaccctatccagcaaggggggctccgaaggccaacccgagtcgtctacggcctccaattctgtcgtgccccccccgcagggtggttccggcaggggaagtccttctgggggcagcacagcggaggcgagtgacaccctgagcatccggtcatctggtcagctgtctggccggtctgtgtccctaagaaaattaaaaaggccgcctcccccgccgcggcgaactcattctctgcaccagagaggcttggccgtgcccgacggtcctctgggactgccacccaagcccgagaggaagcaacaaccacaactcccaaggccacctactaccggcgggtcagagggtgccggagctgcgccctgtccccctaacccagccaacagttgggtgcccgggctgagcccagggggatcccgtaggcctcccagaagtcctgagcgcaccctgtcgccaagctccggatatagttcacagagcggaactccaacactgccacctaaaggactggctgggccacctgcttcaccagggaaagcccagccccccaagcccgagcgagttacttcactacggtcacctggtgcttcagtgagcagctctctcacctctctctgttcatccagtagcgaccctgctcctagcgatcgctccggtcctcagatcttaaccccactgggtgatagattcgtgatcccaccacaccccaaagtgcctgcccctttttcacctcctccttctaagcctaggagtcctaacccagctgctccagcgcttgctgcacctgcagtggtgccaggaccagttagtacaacagacgcgtcccctcagagtccgcctaccccacagactactctgactccattacaggaaagcccggttatttctaaggatcaatcccctcctccttcccccccaccatcgtatcaccctccacccccacctacaaagaagccagaggtggtggttgaggccccaagcgccagcgagacggctgaagagcctctccaggatccaaactggcctcccccacctcctccagcgcctgaggagcaggacctctctatggctgacttccctcctcctgaggaggcattcttctctgtggcaagcccagaaccagccggaccatcagggtccccagaactggtgtccagccctgcagctagcagctctagtgcaaccgccttacagatacaaccccctggatctcccgatccccctcctgcgcctcctgctcccgcgcctgccagcagcgcccccggacacgtggcaaaactgccccaaaaggagccagtgggatgctccaagggcggcgggccacctcgcgaagatgtgggagccccacttgtcaccccctcactcctccagatggttagacttagatcagtaggtgcccccggaggagctcccacacctgcgctgggacccagcgccccacaaaaaccactgagaagagcacttagtggccgggccagcccagtgcctgccccaagctccggactacacgccgctgtccgattgaaggcttgcagtctggccgccagcgagggcctttcttccgcgcagcctaatggcccacctgaagcggagcctcgacccccacagagcccagcttccacagcctccttcatcttctccaaaggaagccgtaagctgcagttagagagacccgtgtcccctgagacgcaggcagacctacaaaggaatctagttgccgagctgcgtagtatctccgaacagaggccccctcaggcaccaaaaaagtcccctaaagcccctccacctgtggccagaaaaccaagcgtgggcgtacctcccccggcgagtccttcttatccaagggccgagcctcttaccgcgcccccaaccaatgggttgccccacactcaagatagaacgaagcgagaacttgcggaaaatgggggggtactgcaattagttggccccgaggagaaaatggggttgccaggctctgactcccagaaagagttggcctag

SEQ ID NO: 49962 - DNA, 240 bp, Artificial Sequence
  Description of Artificial Sequence: Synthetic coding sequence
atgatcttcacccccttcctgccccccgccgacctgagcgtgttccaaaatgtcaagggactacaaaatgatcctgaggagtgggttgcagtgtctgacgccaccgaggacccttccggtggaactggactgcccagggagcccgccctgctgagaggatcatggcgctctcgtttccagcgtgccctagcatgtttcacaaaatgcttcagaggcggctatagagctctggggatatag

SEQ ID NO: 49963 - DNA, 228 bp, Artificial Sequence
  Description of Artificial Sequence: Synthetic coding sequence
atgatcttcacccccttcctgccccccgccgacctgaacgtgaagggactgcagaacgacccagaagagtgggtagcagtaagcgacgctaccgaggacccatccggcgggaccggcctgccccgggaaccagcacttctccgggggtcatggcgatcccgcttccagcgcgctctagcttgtttcacaaaatgttttcgcgggggctatcgcgctcttggcatatag

SEQ ID NO: 49964 - DNA, 2217 bp, Artificial Sequence
  Description of Artificial Sequence: Synthetic coding sequence
atggaggactgcctgcacaccagcagcgagaacctgagcaagctggtgagttgggcccattcccacggaacgatctgctctctaatccctaatcttaaacacctgctatcggagggctcacatggtaatttgaccgcaatgtggggctgcagcgccgggcatgcttaccactggccactgacagcaacctgtcgagcaggctcccaggaacgcgtgtgttttcaggataataggtctttcaattctgactcaccctctatcataggcgtgccttcagagactcagactagccctgtggagcgttatccaggtagaccggtgaaagctaagctcgactgcaacaggacacgggactcctgtgattttagctattgcagcgaaccttccgaactggatgaaacggtcgaggagtatgaagatgagaatacactattcgatatggtttgtgagtcgtctgtgaccgacgaagatagcgacttcgagccgcagacacagcgcccacagtctatagccagaaaacggcccggagtggtaccatcttccctccattcctcatcacagacacagatggtcgatgaatgctccaacgatgtaatcatcaagaagatcaaacaggaaatccccgaagattattacatcgtggcgaatgccgagttgactggaggtgtggacggcccagctttgtcactgacccagatggccaagccaaaaccccaaacccacgccggaccttcctgtgtgggaagcgctaaactaataccacatgtgacaagcgcgatctcgactgaactggatccccatggtatgtctgcgagtccgagtgtgatttcaagaccgatcgtgcagaagacggctagggtgtcactagcatcacctaatagaggtcctcccggtacgcatggcaccaaccagcaggtcgcgatgcagatgcctgtcagcacctcccaccccaataagcagatttcaatcccactgtctgctctgcagttaccggggcaggacgaacaagtggcctctgaagagttcctgtcgcacctgccatctcaagtgtctagttgtgaagtcgcactgagtccctctgtcaatacggagcccgaggtaagctccagccaacagcagcctccagtggctcccgccattacaacagaagcgacggcccagtgcatccccgaccaggatgaaagagctgccgagttaagccgggagcagaatgagaagacaataaggtccacccaaacagctctaaggaactttagagagtttcttatttctaagtacccaagcgagacccgagagatatacgtcataccctgtaaggaactggatgcatacttggctagcttctttgtcgacgcccgccagaaagacggctctgaatatgagcccaactccctggcaaactatcagtgtggccttgagcggtatctgaaggagcaccgctatggctactccattacgcgtgacaaggagttcaaacgcagccaggaggccctgaagcaaaaacagatagaactccggtgtaaaggcaaaggtaataaaccccataaatctatgaagctgacattcgctgacgagctgatcttgaggaaacgaggactgctgtcgcggtataatcccgagggcctcttaaatttagtttggttgaataatacaaaagcgttcggacactgtaccggcttccatggctcaacactgaagtggggggatatccgcctgagggttacagaaaccggcttggaatatctcgaatggatgggccaagacaccggggatttgaatgctaagactaaacgtggaggaacggattctcgggtctatgcaacccaacacgccccccagacatgccctgtgcaggactacaaggaatatgcccagcgccgccctccagcaatgagatacgaagatgccccgttctacctgagcattaagcccgtcgttaatctcgccgcgctgcactggtacaattgtcaggccctgggaaagaacaaactggcaaagatggtgaaaacgatgtgtgagaaaggcaatatccctggccgaaaaacaaacttcagcgtctatcagtcatgctcaacactgagcgaggcccagagcaaccaactggtcctcatatgtaacaatttgtctcaacaggccgcacaatcagtggccggacattcaaataatggaaacttcattgtgtcagcctcgtacgattcttccagtgacaccgcatag

SEQ ID NO: 49965 - DNA, 390 bp, Artificial Sequence
  Description of Artificial Sequence: Synthetic coding sequence
atgaaggcccagggcgccatcgccatggccagcatcgccaagcagacttcttcattggtgccaccctacctgggaatgatactgactgccttgcttcagggacttgctggtcgcacctgggccggtaaagaagagctgttgaaggcaattgcttgcgtggttaccgcatgtagcgccgagctagagaagagcgtgcctaaccagcctagcactaacgagatccttcaagctgtgcttaaggaatgtagtaaggagaacgttaaatacaagattgtggccatctcttgcgcagcagatatactgaaggccacaaaagaggacaggttccaggagtttagcaatatcgttattcctctgattaaaaagaaaacacttgaaaacctagagtag

SEQ ID NO: 49966 - DNA, 390 bp, Artificial Sequence
  Description of Artificial Sequence: Synthetic coding sequence
atgaaggcccagggcgccatcgccatggccagcatcgccaagcagacctcctcgctggtgccaccatacttggggatgatcctgacagcactgcttcaaggactggccgggcggacgtgggccgggaaggaagagttgctgaaagctatcgcttgcgtggtgacagcctgcagcgcggaactggaaaagtccgtgcccaaccaacccagtactaatgaaattcttcaagccgtgcttaaggaatgctcaaaggagaatgtgaagtataaaattgtggccataagttgcgcagcagacatattaaaggccaccaaggaggaccggtttcaagagtttagcaatattgttatacccctcatcaagaagaagaccctggagaatttggagtag

SEQ ID NO: 49967 - DNA, 465 bp, Artificial Sequence
  Description of Artificial Sequence: Synthetic coding sequence
atgtgcaccgtggcccacacctgcatcgagcacatgtgcacctacatgaggcttcaccctttggcccaccctcatacgtgtgccctcgcccccatctgtacacacgtgcatacgctcgcacacatgtgtatttgccgtaacgctcccctgcatctgtgtgacaccccagcacacctccataccccaatatgcattcaagcacagacccactcacacaccttcgcccacacggccaccaatctgcacaagcagcacctgtacaccgacacatacccattcgttcctattcagtgtacattaacccatttacacacagctgtgttagctcacacttttgctcatactcatctccatacctgcactcacactacccacctttctgtgcagcacacctacctgtgtgcctatatgcacatttgtacatgtacccagcaatggcacaccctgctataccactcaccctag

SEQ ID NO: 49968 - DNA, 126 bp, Artificial Sequence
  Description of Artificial Sequence: Synthetic coding sequence
cggaagaacggccagcagcagccccggggccggcccggcagcgcccgacctcccgcccagccacctgagtgcggcgccgatcagcgtgttaccctcctcaccggcgatcccgtctcggcagcatag

SEQ ID NO: 49969 - DNA, 372 bp, Artificial Sequence
  Description of Artificial Sequence: Synthetic coding sequence
atggtggacggccggacccggaccatcatcaacgacatcttcttcacagaaccaacccctgaaatgtcctcgttgcctgtgcggtcacactcctccctttccctgaacctcgtgagtcttatggtgatatgtaggggcatcatcaagctggtgattcattttagaatgtactgtccgcctcgtttgaaggctaaacacatcgaacccactctaagacctgtcccactcaaagagttgaggatttcccactggcctaatgagtgtatacggcactcagcttctgtaccaatggctacaggggcaaatggcctggaaactaaggatgagactaaaagaaacgcggaaaagtgcgcgtgcagtgtattcctttag

SEQ ID NO: 49970 - DNA, 372 bp, Artificial Sequence
  Description of Artificial Sequence: Synthetic coding sequence
atggtggacggccggacccggaccatcatcaacgacatcttcttcaccgaaccaactcccgagatgagctctctgcctgtgcgtagccattccagtttatcgttgaatctcgtttcactaatggtcatttgtagagggatcattaagttggtgatccacttcaggatgtactgtccaccaagactgaaggcaaagcacattgagccaacactgaggcccgtgcccctgaaagagctgcggatcagccactggcctaatgaatgcatcaggcacagcgcctcggtgccaatggcaaccggggccaacggtctcgagacaaaagatgagactaaaaggaatgctgagaagtgcgcttgtagcgtcttcctgtag

SEQ ID NO: 49971 - DNA, 423 bp, Artificial Sequence
  Description of Artificial Sequence: Synthetic coding sequence
atggactgcaagagccccaagcgggccaacatctgcccccacctgccaggaggaggcctgttctcaacccctccttcccaagcggcttggagaacactgcttacagcactctgttttcctggcccaacttgtacgggcccgatgcgagaaggaccaagagcagtatataatcctccacgggcccataggaacagctccgataattgcgtgatgaagcacctcttatgtgctggagacaaaaacggcacaaggcgacacgctctgccttctcccctggagggctcattccagccaggtcgccaaatccctcctcctcagacaccctcaaccgatccccaaacacttcccctgtcctttcggagcctgttgcgctgtcaccagctatgcgcggcgtctctgcctccatcactcaagctgccatag

SEQ ID NO: 49972 - DNA, 423 bp, Artificial Sequence
  Description of Artificial Sequence: Synthetic coding sequence
atggactgcaagagccccaagcgggccaacatctgcccccacctgcctgggggaggtctgttctctactccaccctcccaggccgcatggcgaaccctcttaaccgcactctgttttcctggccctacgtgcacaggccccatgagggagggcccgagagccgtctacaacccgccccgcgcccaccgaaatagctctgacaattgtgtcatgaagcacctattgtgtgctggcgacaagaatggaacccggaggcatgccctgccttccccactagagggaagctttcagccaggtaggcagatcccccccccacaaactccctcgaccgacccccaaacattgcccctttcattccgttctctgctgagatgccatcagctctgcgctgccagcctccctccttccttgaagctgccgtag

SEQ ID NO: 49973 - DNA, 651 bp, Artificial Sequence
  Description of Artificial Sequence: Synthetic coding sequence
gcctggaccgtgagcggcctgctgagcgccgccttcgagcccgaggtcccagcttcactctcacagaagtccgaccaccgctcctccttgccgtctagcccaagcctgcctctcagcaagaccctagcagtcgcatacgatccagaggatagctccgcagctaactggtgctttggcctgtgcgcagtgccaggtcctgcttctttggacctgggccgaccctggccggtggaagaagcccaagtaaaggcgggcggctgttgctggctctcatcacttctactggaagtgtcggcttccctgcgcatgggaaggactgatcctctcacagggctgcagtctctagagggctctataggccagggaaacggggggcatgtaacatcttgtagagccccctgccatagacccaaggagcagctgtgtcccttgtccgtagggggccccgggggcgaagttgaccgccacctgcctccaacaggtatctggcaacaggagccaggccttttgtgtaaaaaggggagacctaagggagaacaatggcccataaagacactcgagaataagcacccttttccaaggtggctccagatcatcacaagctgcaagtctacgccaggcgaacagctgacattcatttccctgtcatag

SEQ ID NO: 49974 - DNA, 720 bp, Artificial Sequence
  Description of Artificial Sequence: Synthetic coding sequence
ccccagatgagcgccgtgtacaccccccccagcgtgagcacccaccaaatgcctcgcaacccaaaccctcaacagaggccccaaatgtccgccgtatatactcctaggtctgcacctacaaggtgcccacagatgagcgccgtttacacccctccctccgcgccaaccgaccagatgccacgtaatccaaacgctcagcagagacctcaaatgtcggccgtgtatacacccccgtccgccccgacagatcaaatgccccgtaacccaaacccacagcagcgtccccagatgagcgcagtgtacacacctccttcggctccaaccgaccagatgccaagaaaccccaatcctcagcagagaccccaaatgagcgcagtttacactcccccttccgcacctactgatcagatgccaaggaacccaaatcctcagcagagaccccagatgtctgccgtgtacgcacccccgtctgcgcctactgatcaaatgccacgaaaccccaatccccagcaacgcccccagatgtccgctgtgtacgcacccccatccgctcccaccgaccagatgcctagaaacccgaacccccaacaacggctgcagatgagtgctgtgtatgctccgccttctgcccccactgaccaaatgcccaggaatccaaaccctcagcagcgtccccagatttcggccccccggtgccaattgagtattagacatcggtag

SEQ ID NO: 49975 - DNA, 240 bp, Artificial Sequence
  Description of Artificial Sequence: Synthetic coding sequence
atgaagctggccaagaccgccgtgctggaccccgccacctacacctccttcagcccagggttgtcaacatgctctagtagtcagccaccgggcgacaggcgtaaggggttgttgggctgtgttggctcgggccattgtccccttccaacgccggcacagtttcctaaggtccagcgacctcctacactcttggggggcaagaacacatctacccagacaacccttcaccccgtgatttag

SEQ ID NO: 49976 - DNA, 369 bp, Artificial Sequence
  Description of Artificial Sequence: Synthetic coding sequence
gaccccggcagcctgcggtgccccgtgtgcctgagcatggagggctgtctcgagggcaccacagaggaaatctgtccaaaaggtacaacacactgctatgatggattgctgcgactccgggggggcggtatcttctccaatcttcgagtacaaggctgcatgccccagcctgtgtgcaatcttctgaacggcacacaagagataggcccggtaggaatgacggaaaactgtgacatgaaggattttctgcagctgaaaccagtgggtctccttgaggagcataacgtcggggagaaggaacgcgggcagggacagcatcagtgcgtgcagttggactggcaaaaacgggccgcgacaggagtttcttag

SEQ ID NO: 49977 - DNA, 456 bp, Artificial Sequence
  Description of Artificial Sequence: Synthetic coding sequence
atgcacgccggcaagcggagccccctgacccagagcatcagctgcgtctgcctgccagagctgggcgctctgtgggagatcgaatctgcgcgggtcaacctcagggtctcggggcgcgaggcgagccgagagatggagtctagcccccgcccacaccggatcgctggcgtgaaacgcttcctaaagcatgccggaaaatggtctcttcgctggtttctttctcccagatggattttgcagtttcggcgctgggcaagaaagtggtccaggttcacgcgcagcagttttcaagtgcgatgggctgcagttccagctggcaagtgttctcagcatcaagggttaagcgcagtggctacggccagtccgggcgtattctgggagatggaatttgacgtgtcatctcctttaacagagggcgcaggcagtcctatgagcagtaaacatgcaggcgagtag

SEQ ID NO: 49978 - DNA, 366 bp, Artificial Sequence
  Description of Artificial Sequence: Synthetic coding sequence
atgatcgacagcccccggaaggagggcgccctgagcccccccctgggcggctggcggctcggcgaccgtagatgcgcaggagggaagagaacggagcggaggacacccgagaaactatggggaatcagaggtgagaaggaaggggtgaaacgagagggccggttaagccgtgggggaggggccggcgctggtgccggtgccggcggtgtcactgctccaagacccccactgccagccctgcattcggcggctcccggtctccccccgcccccacctccaccccccccgccaccaccgctgccccctcccccaggcgtggccggatgcggccagaaccggtcacccaaccgggctgctggggagtag

SEQ ID NO: 49979 - DNA, 726 bp, Artificial Sequence
  Description of Artificial Sequence: Synthetic coding sequence
atggcccccgccaccgacaccgcctggctgcccccccaccccgagattcaattgcgactattgtgccccggcgagacttacggaaagctgatgggcgggtctccctcagccggcccaactacccagagccagccccacgccctgcggcctgggctacgagggcgcggcgggtggtggccacagcccttttggattcactctccacccctgacgcatagcgtcggcacgttcatatgccttgacggactggtttgtgcactgaccgcccccgggctcggagttggccttacacccgccccctggagaccacctggccagtcaagaatgctggagggccatggcccgtggcccacccccggtagccgacccgggccaacatgtgtttgtctgctgacgccggcaagcagcagcctccggccatgtctctcagaccgcggaacatgtcccggggctccacaaggtgccgtcggtacctgtcgcgcctctccccagtctccatgccaccgccatccatctctgcgatccggcctcgagtggacccagccgccggaccaggatcagggtctgttaacccccgggtctccacctctggtgtctggtgtcacccagaccccatggacctcgccattctgcccacctcgacccactccctgggtaggcgctgcctttacagcagctaatccctgtccccccgctcctaccgccagttcagtcactggcctgtag

SEQ ID NO: 49980 - DNA, 714 bp, Artificial Sequence
  Description of Artificial Sequence: Synthetic coding sequence
atgcccgtgcaccccgcctggctgggcagcgcctgcctgccccacgcatcacatggtccagcaccacagtcttccgttggcgggttgttagtctcagtgaaatccccccctggtgatgtgcacgctgcacgtgcatgcgctcccggccgccattcaggcgaggggccgccacagggaaacctgtctcctagctgcccagctgaggctgggcatgggtgcgcctcaacaggccgccaggtgggagtgagcggtgccgggtctagcccatctggaccagcaccgtgcgtgaagtgtagcgcatgggttggtacgtgctttccgctgagtctgctgcaagccgccggggggcccgccgggagccctaatggtttttgtcccgagccatgggcccccgaccatgcccccaccctccatgggctgaataagagcctctgccagggaccaagatcgggaggtgctcagcggaaacctcgcgctcatactggggaaggcgtttccggcttagggctgacacagcccagacttagttcctccttgcggatcagctggcacctgctggcgtgcgttgcgacacaggtcggctgtgcctgcagactgcgggagaaaacactaggtgaagattatgtgtccgctttcttacctagtacaggcccgtcttgggcccactgcgatcaaacgatgtgcaaaagcactagggagtcaggccgttcctag

SEQ ID NO: 49981 - DNA, 966 bp, Artificial Sequence
  Description of Artificial Sequence: Synthetic coding sequence
atggtgagccagagcaccgtgcggcaggacagccccgtggagccctgggaagggatttctgaccattctggaattatcgatggcagcccgcgcctccttaacacagaccatcccccatgccagctcgatataagactcatgagacacaaggcagtgtggatcaacccgcaggacgttcagcagcaaccccaggacctgcagagtcaggtgcccgcagccggcaatagtgggacgcacttcgtcaccgatgctgcgtcacccagcggaccttcaccctcatgcttgggtgacagcctcgctgagaccacactctccgaagatacaaccgacagcgtcggatccgcttcccctcatggttctagcgaaaaaagctcgtccttttccctatcaagcaccgaggttcacatggtgcgccctggctattcccatcgagtgagcctccccacttcacccgggattctcgcaacctccccgtatcctgagacagatagcgccttctttgaaccctcacatctgacctctgccgcagatgagggagcagtgcaggtatcccgaagaaccataagttcaaactcattcagcccggaagtcttcgtcctgcccgtcgacgtcgagaaggagaacgctcacttctacgtggcagatatgattatctccgcgatggagaaaatgaagtgtaatatcctgtctcaacagcaaaccgaaagctggtcgaaggaagtgtctggtctcctgggatccgatcagccagacagcgaaatgacgttcgatacaaatatcaaacaggaatctgggagcagtactagttcttacagcgggtatgaggggtgtgccgtgctgcaggtgtccccagtgacagaaactaggacctatcacgatgtgaaggagatttgtaagtgcgacgtagatgaattcgtgatcctcgtatcactcatgagccaaacctccattctgcaaaactactag

SEQ ID NO: 49982 - DNA, 1788 bp, Artificial Sequence
  Description of Artificial Sequence: Synthetic coding sequence
atggtgagcaaccactacttcctgctgtgcgtgaacctgcccctgagggaaatccacaccccaggcccaagtccttcctgtttgggagattcactggctgagacaactctgtccgaagacactactgactctgtaggtagcgcctccccacacgggtcctcagaaaagtccagtagcttttcattgtcaagcacagaggtccatatggttcgtccaggatacagccatcgggttagccttccaacgagtccaggcatcctggctacaagtccgtatcccgagacagactcggcctttttcgaaccctcacacctgacaagcgccgccgatgagggtgccgttcaggttagccgtcgcacgatctctagcaatagttttagcccggaagtttttgtgctgccagtcgacgtggaaaaggagaatgcccacttttacgttgcggacatgatcatatccgcaatggagaagatgaagtgtaatattcttagccagcaacaaaccgagagctggtccaaggaggtgtctggcctgctcggaagcgaccagcccgacagcgaaatgactttcgacacgaatattaagcaggaatccggctcatcaacgagtagctactccggatacgagggatgtgctgttttgcaggtctcccccgtgactgagactcgaacctaccacgatgtgaaggagatttgcaaatgtgacgtagacgagtttgtcatcctggaactcggggactttaacgatataaccgagacctgtagttgctcctgttcgagctccaagagcgtgacttacgagccagactttaactctgctgaacttctggcgaaagaattgtaccgtgtcttccagaagtgttggatcctctccgtggtgaactcgcagctagctgggagtctatccgccgctggatcaatcgtcgtgaatgaggaatgcgtaagaaaagattttgagagcagcatgaacgtggtgcaagaaattaaattcaaatccagaattagaggcaccgaggactgggccccccctaggttccaaatcatctttaatattcacccaccgctgaagagggatctggtcgttgcggcccagaactttttttgcgccggatgcggcacgcccgtcgagcctaaatttgttaaacgcctaaggtactgcgaatacctgggaaaatatttctgcgactgctgtcactcctacgccgagtcttgcatcccagcacggattttgatgatgtgggacttcaaaaaatactacgtgagcaacttttccaagcagttgctggattcaatctggcaccaaccaatcttcaatctcctatccatcgggcaaagtctgtacgctaaggcgaaagagctcgacagagtgaaagagattcaggagcagctgtttcacattaaaaagctattgaaaacttgtcggttcgctaatagtgcactcaaagagtttgagcaagtgcccgggcacttgaccgacgaactgcatctattcagtctagaagacttagtccgcatcaaaaagggcctccttgcaccccttctgaaggacattctcaaagcttcactagcacacgttgcaggctgtgaactgtgtcaagggaagggttttatctgcgagttctgccagaatactacggtaatatttcccttccagacggcaacctgccgccgctgctctgcttgccgcgcatgtttccataaacagtgttttcaatccagcgaatgcccgagatgcgcccgcatcaccgcaagaagaaaactgttagaatcagttgccagtgctgccacttag

SEQ ID NO: 49983 - DNA, 1908 bp, Artificial Sequence
  Description of Artificial Sequence: Synthetic coding sequence
atggtgagccagagcaccgtgcggcaggacagccccgtggagccctgggaggggatctccgatcactctggaattattgatggcagccctcgactgctgaatacagatcaccctccatgccaactggacattcgcctgatgcgccacaaggctgtatggatcaacccacaggatgtccagcagcagccccaagacctgcagtctcaggtgcctgccgccgggaatagcggaacccacttcgtaaccgacgccgctagtcccagcggtccttcacccagctgcttgggggactctctggccgagacgaccctctcagaggacactacggattcagtggggtccgccagcccacacgggagctcagagaaaagctccagcttctcgctgtctagtaccgaggtgcatatggtgaggcccggttacagccaccgcgtcagccttcccacctctcccgggatactcgcaaccagcccttatcccgaaaccgacagcgcgttctttgagcccagccatcttacatctgctgccgacgaaggcgccgtgcaggtgagccgtcgaacaatatcatctaattccttttcccctgaggtgtttgtcctccctgtcgacgtggagaaggagaacgctcacttctatgtggcagacatgattatctcagccatggaaaagatgaagtgtaatatcctgtcacagcagcagaccgagagctggtcaaaggaggttagcggcctgctcgggagcgaccagcccgactccgagatgaccttcgacacaaacataaagcaggagtctggaagcagtacaagttcttacagcgggtatgagggatgtgcggtattgcaggtgtctcccgtaaccgagacccgaacttaccatgacgttaaggagatctgcaaatgcgacgtggacgagttcgttattttggaactgggggatttcaacgatatcacggagacttgctcatgttcatgttccagcagtaaaagtgtcacctacgagcctgatttcaacagtgcggaactgcttgcaaaagagctgtaccgggtttttcagaaatgctggatcctgagtgttgtcaatagtcagcttgccggttcactcagcgctgccggcagcatcgtggtcaacgaggagtgcgtgcgcaaggattttgaaagctcgatgaatgtggtgcaagagatcaagtttaagagcagaatccggggcacagaggactgggcccccccaagatttcagatcatatttaatatccatccaccattaaagcgggacctcgtggttgccgctcaaaacttcttttgcgccgggtgcggcacccctgtggagcccaaatttgtgaaaaggctgaggtactgtgagtatttagggaaatacttctgtgactgctgtcactcatacgctgaatcctgtatccctgcccggattctcatgatgtgggactttaagaaatattacgtatccaacttctcaaagcagctcctggactctatctggcatcaacctattttcaatctgctcagcatcggccaatccctgtacgccaaagccaaggaattagatagggtgaaggagatccaggaacaactctttcacattaagaagctgctcaaaacatgccgctttgccaatagttgcgttaaggaacgcgctctcttcgtaaatttcgcgaggatccgcctgagtagctcccatttccggcagcagcacgtagaggacgttcagagggcagggcttgccttcactaattccgccagctctccccccagtgccccgggagtcagggggagtcagaggggagaaaacttctggaaggtttggccacttcaacagcatgacgccccagaatattgcgaaaaggactgctcaacatgcctcatgattacccctatctgcgtgtactactggtag

SEQ ID NO: 49984 - DNA, 1908 bp, Artificial Sequence
  Description of Artificial Sequence: Synthetic coding sequence
atggtgagccagagcaccgtgcggcaggacagccccgtggagccctgggagggtatttctgatcattccggcatcattgacgggtctccccgcctgctgaataccgatcatcccccttgccagctagatatccggctcatgaggcacaaagctgtatggatcaatccacaggacgtacagcagcagccacaagaccttcagtctcaggtcccagctgccgggaacagcggaacccatttcgtaaccgatgcggcatcccctagtgggcctagcccctcctgcctcggcgatagcttggcggaaacaaccctctcagaagataccaccgactcagttggctccgcttccccacacggctctagcgagaagagttctagcttttccttgtcttctactgaagttcatatggtgagacccgggtatagtcatagagtgagcttaccgacttcccccgggattttggcaactagcccatatcccgagactgactctgcgttcttcgaaccctcccatctcacctccgcagccgacgaaggcgctgtacaggtaagcaggcggactattagcagcaatagcttcagccccgaggtcttcgtgctgcccgttgacgttgagaaggagaacgctcacttttacgtcgccgatatgatcatttcggccatggaaaagatgaagtgtaatattttatcccaacaacagacagaaagttggtccaaagaagtatcggggctattgggtagcgaccagcccgactctgagatgaccttcgacaccaatataaaacaggagtctggttcaagcacctcttcttacagcggctacgaagggtgcgctgtgctgcaggtttctcccgtgaccgaaacacggacctaccacgacgtgaaagagatctgcaagtgtgacgtcgacgagtttgtcattttagaactgggggacttcaacgatataaccgaaacttgcagttgcagttgctctagctccaagagcgttacttacgagcccgatttcaactctgctgaactcctcgccaaggagctttatcgggtcttccaaaagtgttggatactgagtgtggtcaactcccagcttgctggcagcctgtctgcagctgggtccatcgtggtgaacgaagagtgtgtccgtaaggacttcgagtcctccatgaatgtggtccaggagatcaagttcaaatctcgaatccggggtacggaggactgggcccctcctcgctttcagattatcttcaatatccacccaccactcaaacgtgacttagtagtggccgcgcagaatttcttctgtgctgggtgcgggacaccggtggagccaaaatttgttaagagacttagatactgcgaatatcttggaaagtatttctgtgactgctgccattcgtatgctgagagttgcattcctgccagaatcttgatgatgtgggacttcaagaaatactatgtatccaacttcagtaagcagttgctggactctatttggcatcagccaattttcaacttgttgtcaatcggtcagtctctgtacgcgaaggccaaggaactggatcgggtgaaggaaattcaggagcagctgttccatatcaagaagctgctgaaaacatgccgatttgctaattcttgtgttaaggaaagagccctgttcgtcaattttgctcggatccgactgagcagctctcactttaggcagcagcacgtcgaggacgtccagcgggctggcctggccttcactaattccgcttcatcacccccctcagcccccggcgtgcgcggatcccaaagaggggagaatttttggaaagtttggccattgcagcaacatgatgcccctgaatattgtgagaaggattgctcgacctgcctcatgatcacacccatctgtgtatattattggtag

SEQ ID NO: 49985 - DNA, 396 bp, Artificial Sequence
  Description of Artificial Sequence: Synthetic coding sequence
atggacagcacccacccccagcactgcgcctgcaacagccagatcagacctagatgggactgtgttgcccattgtttcttatgggcccctgggctgccctcccgcgatgatcctggtgccgacaaaggtgaggctagcggtggcgtagggacggtatcactcaccctgtcacagcctagggaaaggtcactccaggttaagaaggtcttcgtgaaaggcatgaagaaggaacgggcccttggggaaggtgcagcatggtggcagagtcaacggcttgtgtctccaggaaagcacgaccgggtttctacccaccggaagagtcaatcggtatttactggcgtgagcgccggagataagcagtttactaccacgtttagtattgttttcacaatctag

SEQ ID NO: 49986 - DNA, 1023 bp, Artificial Sequence
  Description of Artificial Sequence: Synthetic coding sequence
atggcccgggacctgatcggccccgccctgccccccggcttcaaggcaagggggacagccgaggacgaggaaagggaccccagcccggtggctggccccgctctgccacctaattacaaatcctcttcatctgattcctccgactcagatgaggactcttctagcttgtacgaagagggtaaccaggaatctgaggaggatgactctgggccaaccgctagaaaacaacgcaaaaaccaggatgacgacgatgatgacgacgacggtttcttcgggcccgcactaccccctggatttaagaaacaggatgattctccaccaagacctataattgggcctgcgctgccaccaggtttcatcaaatccacccagaaatccgataaaggacgggacgaccccggccaacaggaaacagactcatcagaagacgaagatatcattggaccaatgcctgcgaagggtccagtgaattacaatgtgacaacagagtttgagaagcgcgctcagagaatgaaggagaaactgaccaagggcgacgacgatagcagcaagcctatagttagggagtcttggatgactgaactgcctcccgaaatgaaggatttcggccttggccccaggacctttaagcggcgcgctgacgacactagcggagatagatcaatttggaccgacacaccagctgacagagagcggaaagctaaggaaacacaggaagcgcgcaagagctcttccaagaaggacgaagagcatatactgagtggtagggacaagcggcttgctgaacaggtatcctcatacaacgagtctaagcggagcgagtctctcatggacatacatcataagaagctgaaaagcaaggcagccgaggacaagaacaaaccgcaggaaagaatccccttcgatcgggataaggaccttaaagtgaacaggttcgatgaggcgcagaagaaggctttgataaagaaaagcagggagctcaatacccgcttcagccacggcaaaggaaacatgttcttatag

SEQ ID NO: 49987 - DNA, 423 bp, Artificial Sequence
  Description of Artificial Sequence: Synthetic coding sequence
atgtggcccttccggctgcggtgccccatctacttcaagacccggctcttatacagttcaagtcaggacggtttcttgtcctcatctaccaattattacaatcatagaacttaccctggtctggtgaactggctgttcgtcttaacggaacccgagctgacaggagaactgggcgacgacgatcgaaaggggatgcatacagggggaatcattagatggctggggcggccctctagtcaattgaaacctattttccacgccgaagaaagacgagtcccaccacctccagagagactggtgggtcgggcctccccacgcgaacaggcaacggtctttaaaaggatttgtgcaccgctacatgctgaggttttctgcagagccggcttgtgcgcgtgtcatcccgactgtaccgctgcaggatag

SEQ ID NO: 49988 - DNA, 408 bp, Artificial Sequence
  Description of Artificial Sequence: Synthetic coding sequence
atggtggccacctggggcggccggcagctgctgccccagtgcagcgggccaccactgacacctggcagccccgccccatctgtggcccaagcctcccgccccgcgccaccctcgcctaggaagaccagccccggtcctcctcaaccctcagcctcaccctctcttcctttttccccgctcctggctggatgttcaagacttctgcccgtcctggccccctctttgtcttccgtacacagatgccctctgggtgcccgtgctagccggctgccttggaagctcgaggccggaaccagctcatccggagatcgacccctatgtttacatagcggacagaggggagcgtgcctcactgatgagcaaggtagcactttgtcgccgcggcagaggcggggacctggaaagtag

SEQ ID NO: 49989 - DNA, 474 bp, Artificial Sequence
  Description of Artificial Sequence: Synthetic coding sequence
atgctgagcgtgagccggccctgcttcagccagggcgccttcctgggtagaaccctgggctcagtctgggctcaggggggaagtaggctccctctctgcttctggtatagaatacggtgtgggagaccagcagtggtgcacatcggtggcgagggtgcacgttgggaaaagggggcccggggcagaaaagagcacaggttgagacgatcggatctgggtagtaggcccgtgccatttctcgcacagggcatccctgatatcgtgattcgattgttatgtctttcggctggctcagcctcctctcatcaagcttcagatcccctatcctcagccgcagctactttagctgctgaactggactgggcattggtatctcagaagtcgagcgaagacttggcacctccatccttactgttgaactgcatatcattcttaatcacccagtgtccccatccgaggtggctgccagggtag

SEQ ID NO: 49990 - DNA, 627 bp, Artificial Sequence
  Description of Artificial Sequence: Synthetic coding sequence
atgagccccaccaaggacagccaccccagcccccacttcccccgggattcaggcattcacgcccccactccgcccgatagcggagccctgaccctgagccctcctgtgtcccagggccccggcgttgggccacggacaggacgcggcaatcgtctgtgtcgaccacctggacgcagtgccgctcgatcattctgcctgctgcccggtcctccgctggggaccggcgccttgggatcccccagagcagctcaagggctcggtttccggggatccggacagagggcgcgccacaacagctttacttctccatctccacccggagcccatcatccactcggcacgcacacccgggcactgccgcctcctttagcacgttgcccatgcgccgccctactggccgggcgagaatgtcacgggggcccgtcaccagccgctcctcggccactgcctggaacatcgttaacctggccgtcacgagcccccctcccacgccctccgccccgggagcggcagggccccggcgatagatcgccaagtccctcagccccgtcgtgccccggggtgggagcctcaagtcctaggcgcagaaaacctcgtgaagcagccgggctgacaccagacgggtag

SEQ ID NO: 49991 - DNA, 1248 bp, Artificial Sequence
  Description of Artificial Sequence: Synthetic coding sequence
tacgacgccgtgcccatccagagcagcgtggtgctgtgcagctgcccatctccatcaatggttaggactcagactgagagcagcaccccccccggtattcccggggggtctcggcagggccccgctatggatggaaccgcggcagaaccacgacccggcgctgggagcctgcaacatgcccagcctcccccacagccaaggaaaaaacgcccagaggatttcaagtttggaaaaattctcggcgaaggatcgttttccaccgtcgtcctggccagggagctggcgacttcccgtgaatatgcaatcaagatattagagaagcgccatattattaaagaaaataaagtgccctacgtaaccagagagcgcgatgtgatgtctcggctcgaccacccgttctttgtgaaactgtacttcacttttcaggatgacgaaaaactgtacttcggactgtcgtacgccaagaatggggaactcctgaaatatataagaaaaatcggtagtttcgatgaaacttgtacccgcttctacactgcggagatcgttagcgctttagagtatctgcacggcaaaggcatcattcacagggacttgaagcctgagaacatcctgttaaatgaggacatgcacatccagattactgatttcggaacagccaaggtcctgtcacctgagtctaagcaggcacgagctaatagctttgttggtaccgcacagtacgtgtctcctgagctgctcacagaaaagtccgcttgcaagtcctccgatttgtgggctctgggctgcataatttatcagttggtggcaggcctgccgccctttcgcgccggaaatgagtatctgatattccaaaaaattataaagctggaatacgactttcctgagaagttctttcccaaagcgagggatttagttgagaagcttctggtgctggatgcgaccaagcgtctggggtgtgaagaaatggagggctatggacctctgaaggctcacccgttcttcgaaagcgtgacttgggagaacctccaccagcagaccccaccaaaactgaccgcttatttgccagctatgagtgaagacgacgaagattgttacggaaatgttagttggcctggctggcgagcccgacaggtggcactgggacctccatgtactggactgcacgcacgggccccggatccacgcgtgatctgctccagaaaagggagggtatcagtgcctctgaggcaagcttgttggtggctatag

SEQ ID NO: 49992 - DNA, 1734 bp, Artificial Sequence
  Description of Artificial Sequence: Synthetic coding sequence
atggccgacgtggccggccccagccggcccagcgccgccgccttctggagtcgcgatttttccgacgaggagcagagcgttgtttatgttccaggtattagcgctgaggggaacgtgcggtctcggcacaaattaatgtccccaaaggctgatgttaaattgaaaacttccagggtcaccgacgcaagtatttcaatggagagcctgaagggaacgggggatagcgtggacgaacagaattcttgtagaggggaaatcaagtctgcctctctcaaggatctctgcctggaggataaaaggcgcatagccaacctgatcaaggagcttgctcgtgtgtctgaggaaaaagaggtcaccgaagagagactgaaggctgaacaggaaagttttgagaagaaaataaggcagttggaggaacaaaacgaattgattattaaggaaagagaggccataaagctccagtacagggaatgccaagaactcctttcactgtaccagaagtacctgtctgaacagcaagagaagcttaccatgtctctgagtgagcttggagcagcacggatgcaggaacaacaggtgagttctaggaaaagtaccctccaatgcagctcggttgaactcgatggctcatatctgtcaatcgcccgcccacagacatattaccagacaaagcaacgacctaagagcgcagtacaagatagcgctagcgagagtctcattgcctttagaaacaatagtctgaagcctgtcacgctccatcacccaaaagacgacctcgacaagatcccttccgagacgactacctgtaactgtgaaagccctggtcgaaagccagccgtgccaaccgagaagatgccccaggaagaactgcacatgaaggaatgcccgcatttgaaacccactccctcacagtgttgcggccaccgtcttgccgcggaccgcgtgcacgactcacatccaacgaacatgacaccgcagcaccccaaaacccaccctgaatcctgtagctactgcagactttcctgggcaagccttgttcatggaggcggagccctccagcctatcgaaacgctaaagaagcagatcagtgaagatcggaagcagcaattgatgctgcaaaagatggagctggagatcgaaaaggagcggctgcagcatctgctggcccagcaggaaacaaagctgctgctgaagcaacagcagttacaccagagtcggcttgattacaattgtctgcttaagagcaattgcgatggttggctcttaggaacctcatcatccatcaagaagcaccaggacccccctaacagtggtgagaaccgcaaagagcgaaaaacagtcggctttcatagtcatatgaaagacgatgcccagtggtcctgtcaaaagaaggatacctgccgcccgcagagagggaccgtcaccggtgtgcgaaaagatgctagtaccagtccaatgcctactggctccctgaaagacttcgtgaccacggcgtcaccaagcctgcagcacacaacatcgcggtatgagacttctttacttgacctagtgcagtctttatctccgaatagcgcccccaagccccagcgctatccatcccgagaggcaggagcctggaaccatgggacattccggctctccccactgaaatcaactagaaagaagatggggatgcaccggacgcccgaggaactggaggagaatcagatcctggaggacattttttttatctag

SEQ ID NO: 49993 - DNA, 600 bp, Artificial Sequence
  Description of Artificial Sequence: Synthetic coding sequence
atgctgcccgtgcagcggcggaagctggaccccctgctgaagaagtatagacaccacaagaaggcaacccgaaccaagagacgccggaaagagaagatggaagcccagtgctcccctgtacctcctaccccaagcacgccaccccagtccgaggaggatgaggctgttgacaagaagccgacgctgttgtccgcacaggaagacactcctgatctccttcatgaggatagactgcaatatttacaggaagaaggcagtggcgtaatgcatcaagagtgtcagattcagagttgtgaacttagcgtggcacagaagccccggcctagctccccagccgtcaccagtctcgctagccccccgttgtgtttcggttcctttttgagctgcgtctgccagacattctctagatctcggaaacaaaaaccgcctaggcgaaaagggaataatcaggctgaggccgggggcgacgcagaggtgctgaggccgggtcccgccaagccagagctgtctctgagcaagacctgcagccatttgaagtcaatcgaactgtcattcgtgttttcatttatcgtcctttcagtctgtcattgctcctcctag

SEQ ID NO: 49994 - DNA, 6618 bp, Artificial Sequence
  Description of Artificial Sequence: Synthetic coding sequence
atgcccctgttcttcagcgccctgctggtgctgctgctggtggccctgagtgccctgtttctcgggcggtggttggtcgtaaggcttgcaaccaagtggtgccagaggaagttgcaggcggagcttaagatcgggtccttcagattcttttggatccagaacgtctcattgaaatttcagcagcaccagcagaccgttgagattgacaacctgtggatctcttctaaattgctgagtcacgacctgccacactatgtggctctctgtttcggagaagtgcggattcgcactgaccttcagaaggtttcagacctcagtgctcccttttcgcagagcgcaggggtggatcagaaggagctgtcattctccccaagcctccttaagatcttttgtcagctcttttccatacacgtggatgccattaatataatggtgctgaaggtcgacaccagcgaatctctctggcacattcagatcagcagatccaggttcctgttggattctgatggcaagcggctgatttgtgaggtgagtctttgtaagattaacagtaaggtcttgaaaagcggacagctggaggatacctgtctcgtcgaactcagtctggctctcgatctgtgtctgaaggtagggatcagcagccgacacttgacagcgatcacagtggacgtgtggaccctgcatgctgagttgcatgaaggtttattccagtcccagttattgtgccaggggcctagcttagcatcaaaacccgttccatgtagcgaagtgaccgagaacctggtggaaccaacactgccggggctcttcctgctgcagcagttaccagaccaggtaaaagtgaaaatggagaacaccagcgtggttttaagtatgaacagccaaaaacgccatctcacctggactcttaaacttttacagtttctataccaccgagatgaagaccagctacccctcaggagtttcaccgcaaactcagatatggctcaaatgtccaccgagctcctcctagaagacggccttttattatctcaaagccgacagcggattgtgtgtctgaactctcttaaagctagtgtgcaggtgactaccatcgatctgagtgcctctcttgtgttgaatacgtgcattatccattaccgccaccaagagttctcccactggctccatttgctggcgttggaaactcaaggcagtagctctccggtccttaagcaaaggaagaagcgcacattccctcagattcttgccccaattattttcagcacttccatcagcaacgtgaatatctcaatccaactgggcgatactcctccattcgcactggggttcaattctatctcattagactaccagcatctcaggccacagagtatccatcaaaggggggtgctcacagtggaccacctgtgttggcgcgtgggttcagatagccatatacaacgcgctccacaccctccgaacatgcatgtttggggcgaggcactggtcctggattccttcacattgcaaggttcctataatcagccccttggcctctcttctacccagagcgacaccttgttcctagattgcaccatccgcggccttcaagtggaggcttcggacacctgcgcacaatgcctatcaaggattctgagcctgatgggcccgcagtcaggcaaatctgccgtttctcgtcatagcagcttcggagagtccgtgagcctgctttggaaggtggacttaaaagtggaggatatgaacttgttcaccctgtccgctctggttggtgcatctgaggtcagactcgacaccctgaccatactcggtagtgccgaaacctccacagtaggaattcagggcctagtactggcactcgtgaaaagcgtcaccgagaagatgcagccatgctgtaaagccccagatatcccaactccagtcctcagcttgagtatgctttcaattacttatcactcaagcattcgcagcttagaggtccagtgtggtgccgggctgactctgttgtggagccctccagaccacatgtatctgtatcaacacgtgctcgcaactttgcaatgtcgggacctcttaagagccacagtgttcccagagaccgtgcccagcctagccctcgagacctctgggactacatctgagctcgagggcagggcccccgaacctctcccaccgaagcgtcttctgaatctgacactggaggtctctaccgcaaaactgaccgcctttgtggccgaggacaaattcatcacactggcggctgagtctgttagcctgagtagacatggcggttcactacaggcatactgccccgagcttgcagcggggttcgatggcaactccatctttaattttaaagaggtcgaggtgcaattgctgcctgaggtggagtttccatatcagtacgacttctctagaacactggacgaagcagtaggggtacagaagtggcttaaaggcctgcatcagggaacaagggcctgggcatcccctagccccgtcccactgccccccgacctgttactgaaggtggagcattttagttgggtttttctggacgatgtttttgaggtcaaattacatgacaactatgaactgatgaaggatgagagcaaagagagcgccaaacggcttcagctgctcgacgccaaggtggccgcgctgagaaagcagcacggagaactgttacccgccaggaaaatagaggagttgtacgcaagcctagagagaaagaatatcgagatatatatccaaaggagtcgccgactgtacggtaacacccctatgcggagggcgctgctgacttggagtctggcaggccttgaactggtagcactagcagacgccagttttcatgggccagaacatgtggtcgaacaagtccaagaactagatcctggcagcccttttcctcccgaggggctggacctcgtgatccaatggtgtcgcatgcttaaatgtaacgtgaaaagttttctggttaggatccgggactatcctcgctacctgtttgagatcagggactggcgcctgatgggaagattagtggggacagagcagagcgggcagccttgtagtcggcggcgtcaaatcctgcacctgggactaccatggggcaatgtggcagtggaaaggaacatgccgcctttgaaattctatcacgacttccatagtgaaatcttccagtacacagtggtgtggggaccttgttgggacccagcctggacgctaatcggtcaatgcgtggatctgcttactaaaccgtccgccgacccctcccctcccctgccctggtgggacaaatcgcgcttactgtttcacggagactggcacatggacatcgagcaggcgaatctgcaccagctagccacagaagatccttacaacaccacggagaatatgcactgggaatggtcccatctcagctttcactggaagccaggacagttcgtgttcaaaggagatctggacatcaacgtccgaactgcttctaagtacgacgactgctgttttcttcacctccccgacctgtgcatgacccttgatctgcagtggctctgtcatgggaatccccacgaccatcattcagtgaccctgcgcgctcccgagttccttccagaggtcccactgggtcagctgcatgattcttaccgggccttccgtagtgagaatcttaatttgtctattaagatggatctcacacgccacagcggtaccatttcacagccgagaattctgctttattccagcacgctcagatggatgcaaaacttttgggccacttggaccagcgttacccgaccaatttgcagaggtaagctcttcaacaatttaaaaccctcaaagaaaaagctgggacaacattataaacagctgtcctacacagccctcttccctcagctgcaggtccattactgggcaagtttcgcccagcaacgcggcatccagattgagtgctcgcaagggcacgtgttcaccagaggaactcagcgcctgatcccacaagcagggaccgtgatgcgtagactgatcagcgattggagcgtcacccagatggtctccgatctgtcgcaggtgaccgtacaccttatggctagcccgaccgaggaaaatgccgatcactgtctagaccctctggtcaccaagacgcacctcctgtcactaagctcgctgacctaccaacgacactccaatcggaccgccgaggaggagctatccgcgagggacggggaccccacattccatacacatcagctgcacctggtagaccttcgcattagttggacaacaaccaatcgagatatcgccttcggtctgtacgacggttataagaaagctgctgtgctgaaaagaaatttgtccaccgaggccctgaaggggcttaagatcgacccccagatgcccgctaaaaagcctaagcgaggcgtgccaacctccgctagcgcccctccgagggtgaataccccctcctttagtgggcagcctgacaagggaagttcaggaggcgcgtacatgctccagaagcttattgaagagaccgacagattcgtagtcttcaccgaggaggaaagcggaatgtctgaccagctgtgtggcatcgccgcttgccagactgatgacatctataaccggaattgtttaattgagcttgtgaactgccaaatggtcttacggggtgcagaaaccgagggatgcgtcatcgtgagcgcggccaaggcccagctcttgcagtgtcagcaccacccagcttggtacggcgacactttgaagcagaaaacctcctggacttgcctgctcgatggcatgcaatatttcgccacaacggagagttcccccacggaacaggatggacgtcagttgtggctggaggtcaaaaacattgaagagcaccgccagcggtctctggattctgttcaagaactaatggagtcggggcaggcagtaggcgggatggttaccaccacaactgactggaatcagcccgctgaggcacagcaggctcagcaagtccagcggattatatcacgctgtaattgcaggatgtattatatatcatattctcacgacatagaccctgaacttgcaacacagatcaaaccccccgaggtgctagaaaatcaggaaaaagaagatctgttgaagaagcaggagggggccgtagatacgttcacattgattcaccacgaactcgagatctcaacgaaccccgcgcagtacgcaatgatcttggatatcgtgaataatctccttctgcatgtggagcctaaacggaaggaacactccgaaaagaagcagcgcgtgagatttcaattggagatttcttctaaccctgaagaacagagatccagtatcctccacctgcaagaggctgtccggcagcatgtggcccagataaggcagcttgaaaaacagatgtatagcattatgaagtcacttcaagacgacagcaaaaacgagaacttacttgatctgaatcagaagctacagctccagcttaaccaggaaaaggcaaacctccagttggaaagcgaggagctcaatatactaattcgctgcttcaaggattttcagcttcaaagagctaacaaaatggaacttcgtaaacaacaggaagatgtctcggtggttagaagaaccgagttctattttgcccaggccagatggcgtctcaccgaggaagatggtcagttagggattgctgaactggaactgcagagattcctctactccaaggtcaataaatccgatgacactgctgaacatttgctggaactggggtggtttactatgaataatctgcttcccaacgctgtctataaagtcgtgctgcggcctcagtcatcttgccagtctggacgacagcttgccctgagattgttctcaaaagtccggccaccagtggggggtatttcagttaaggaacactttgaagtaaacgtggtgcctctcacgatccagctgacacaccaattctttcaccggatgatgggcttcttcttcccggggcgtagcgtcgaggacgatgaagttggcgatgaggaagacaaatctaagctggtcactactggcatcccagttgttaaacccagacagttgattgcgaccgatgacgcggtgcccctagggcctggaaaaggcgtcgcgcagggactgacccgtagctccggggttagacgatcatttcgcaagagtcccgagcacccggtagacgacatagacaaaatgaaggaacgcgctgctatgaataacagctttatctacatcaaaatcccacaggtacccctgtgtgtgtcatacaagggggagaaaaatagcgttgattggggagaccttaacctggtcctgccgtgccttgaataccataacaacacctggacgtggttagactttgccatggccgtcaaacgcgacagccgcaaagccctcgtcgcccaggtgatcaaggaaaaacttcgcttgaagtcagcaacggggtccgaggtgcgggggaagctagagacaaaaagcgacctcaacatgcaacagcaggaagaggaggaaaaggctcggctgctcattggacttagcgtgggagacaaaaatccggggaagaaatccatctttggtcggcgcaagtag

SEQ ID NO: 49995 - DNA, 2130 bp, Artificial Sequence
  Description of Artificial Sequence: Synthetic coding sequence
atggaccagaagctgagcaagctggtggaggagctgaccaccagcggcgagcctcggctgaaccctgaaaaaatgaaggagttaaagaaaatttgcaaaagtagcgaggaacaactgtcccgggcatatcgtttgctgatagcacagctgacccaggaacatgctgaaattcggctgtccgcatttcaaatcgtggaagaactttttgtgaggtcgcatcagttccggatgcttgtggttagtaatttccaagaatttctggaactcactctgggcactgaccccgcacagccactcccccctcctagagaggcagcacaacggctgcgacaggcgaccactcgtgcagttgaaggctggaacgagaagttcggtgaggcgtacaagaagctcgcactgggctaccattttctgcgccacaacaagaaggttgactttcaagataccaacgcgcgatctctagccgagaggaagcgggaggaagagaagcagaagcacctcgataaaatttatcaggagagagctagccaggccgagcgggaaatgcaggaaatgagtggcgagatagagagctgcttaaccgaggtagagtcctgttttaggttgcttgttcccttcgatttcgatcctaacccagagacagagtcgctgggaatggcttcggggatgtccgatgcgctcaggagcagttgcgcggggcaggtggggccctgccggtccggcactccggatccccgggacggcgaacagccatgttgcagccgagatcttcctgctagtgccggacacccccgtgccggcgggggtgctcagccttcccaaacagccacgggcgacccgtccgatgaggacgaggatagcgaccttgaagaattcgttcggagccacggcttggggtcccacaaatatacccttgatgtggaattatgtagcgaggggttaaaagtgcaggaaaacgaggataacctggctctcatccacgctgctagggataccttgaagctcattaggaataaatttctgcccgctgtgtgttcctggattcaacgcttcactcgcgtgggcactcacggagggtgtctgaagagggccattgatctgaaagccgaacttgagctagtattgagaaaatacaaggaacttgatattgagcctgaaggaggcgagcgtcgccgcacagaggccttgggcgacgccgaggaagacgaagacgacgaagacttcgtcgaagtgccggagaaagagggttatgagccacatatccccgaccacctgcggccagaatatggcttggaagccgcccctgagaaagacacagtcgtccgctgcctgcggacccgtactagaatggatgaggaggtgtctgacccaacctccgccgccgcgcagctccgccaactgcgagaccacctgccccctcctagttccgccagccccagcagagccctccctgagcctcaggaggctcaaaagctcgccgcggaacgagccagggcacctgtcgtgccttatggcgtggacctccattactggggacaggaactcccgaccgccggcaagattgtgaagtctgactcgcaacacagattttggaagccttctgaggtggaagaggaggtggttaatgccgacatttccgaaatgctgcggtcccgccacatcacctttgccggaaaatttgagcctgtgcagcactggtgcagggcgccaagaccagacgggcgcttgtgtgaacgccaggatcgactgaagtgcccttttcacgggaagatagttccacgagatgacgagggaaggccactggatcccgaagacagggcccgggagcaaagacggcagctgcaaaaacaggagcgaccagagtggcaggatccagaactgatgcgcgacgtggaggcggcgaccggccaggacctggggagttcaagatacagtggcaaaggcagaggaaagaagcggagatatccttccctgacaaatctcaaggcccaggcagacactgcccgagccaggatcggccgcaaggtcttcgccaaagcagctgtcaggagagtggtggcagccatgaatcggatggaccagaaaaagcacgagaagtttagcaaccagtttaactatgcactgaactag

SEQ ID NO: 49996 - DNA, 1989 bp, Artificial Sequence
  Description of Artificial Sequence: Synthetic coding sequence
atggtgagccagagcaccgtgcggcaggacagccccgtggagccctgggagggaataagcgaccactctggcatcatcgatgggtctcctaggctgctaaacaccgaccaccctccttgtcagcttgacatccgcctaatgcgacataaggcagtgtggataaacccccaagacgtacagcagcagccgcaggatctccaatcccaggtcccagctgcaggcaatagcggtacacattttgttacagatgctgcttcccctagcgggccgtcaccaagttgtctgggtgactcactggccgagactaccctgagcgaggacacaactgactctgtagggtcagcatcgccccatgggagttctgaaaaaagcagcagcttctccttaagtagcacagaagtccacatggtcaggccggggtactctcatcgcgtgtccctgcccacctctccagggatactcgcgaccagcccataccccgagactgattccgccttctttgagcccagtcacctgacctccgctgcagacgaaggtgcagtccaggtctcccgacggacaatctcttcgaattcctttagccccgaggtattcgtcttgcccgtcgacgtggaaaaagaaaacgcacatttctacgtcgctgatatgatcatcagcgccatggagaagatgaaatgtaatatattgtctcaacagcaaactgagtcgtggagcaaggaggtgagcgggctattgggatccgatcagcctgactctgagatgacgttcgataccaacattaaacaagagtccggctcgtccaccagctcttatagtgggtacgaagggtgtgctgttctgcaggtgtcgcccgtgactgaaacccggacgtaccatgatgtcaaagagatttgtaagtgcgatgtggatgagttcgttatcctggaactcggcgactttaatgacatcacagaaacatgctcatgtagttgctctagcagtaagagcgtcacctacgagccagatttcaattccgccgagctgttggccaaagagctgtatcgcgtatttcagaagtgctggattctgagcgtagttaactcgcaattggccgggtccctcagtgctgctggctctatcgtggtcaatgaagaatgcgtccgcaaggactttgagtcctctatgaatgtggttcaggaaattaagttcaaatctcgcattagagggacggaggattgggccccgccaaggtttcagattatcttcaacatccaccctcccctgaagagggacctggtggtcgctgcccagaattttttctgcgccggatgtggtacacccgtggaacccaaattcgtaaaacgcttacgctactgcgaatatctaggcaagtatttttgtgactgctgtcactcatatgctgagtcatgcattccagcaagaattctgatgatgtgggacttcaaaaaatactatgtgagcaactttagtaaacaacttcttgatagcatctggcatcagccaatttttaatctgctctcaatcggacaaagcttatatgcaaaagccaaagagttggacagagtgaaggaaatacaggaacagctgtttcacatcaagaagttacttaagacttgtaggttcgcaaattccgctctgaaggagttcgagcaggtcccaggccacctcaccgatgagctacacctattcagcctggaggacttggttcggatcaagaagggtcttctcgcccctctgttaaaggacattctgaaggcttcacttgcgcatgtggctggctgcgaattgtgccaggggaagggattcatctgcgagttctgtcagaacaccactgtaattttccccttccaaaccgccacttgccggcgctgtagtgcctgccgcgcatgttttcacaagcagtgctttcaatcctcagagtgcccccgttgcgccaggatcaccgcacgtcggaagctgctggagagcgtggccagtgctgccacatag

SEQ ID NO: 49997 - DNA, 552 bp, Artificial Sequence
  Description of Artificial Sequence: Synthetic coding sequence
aacatgaaccggtacagcttcatgctgagcggcaaccacctgctgtttcacctgttgctctggccagcccagaccgcccgccttttgaaacacatctttcctacaggatcatgcaaactgagggatgtggcagagcatctcttgcaatgcccgcagacaggccacgagtgctgtaaagctcagaaccgggctaatttggtggaaggatggttctcacagaacacccagaggggcccttcccacgatggcgtggccgagttccatatgtccctcacagtgtcctgtccagatcccacaccctcgacagacccccaggggagacacaatagagaaccaatcttaggacgggatgacgacttcatgtgtaaacaagtgaaatttaggatgtgcgtggtgggccgggacggcaacgcgcaatcaagcgtacgttacactggacccctgtataggcgcaaaattcgcacagagtttctgtttgtggtgtttcttttggaaacaagagaactaaaaccccaggtgaataaaaacgtccagggtaccaggccctcttag

SEQ ID NO: 49998 - DNA, 171 bp, Artificial Sequence
  Description of Artificial Sequence: Synthetic coding sequence
atggccatcctgaagatgggccccaagatcgtgctggagtggagcggtggccatcctagtaaagatccgtcctcatattacctcataatactccacaaggacacctcgagtacccttgtggactgccattttcagcatcacaacttgcataaagtcggcttcctctattag

SEQ ID NO: 49999 - DNA, 600 bp, Artificial Sequence
  Description of Artificial Sequence: Synthetic coding sequence
ggccgggccgcccggcggcaccacgacagctgcgaggacgccgccctgcccggcaggtctgacctctgccgcgccctgcatccggcccgacccgccgccagaggtgggagacctgccgacggaggttgtcccgccgtcccggctgaaggactctggcggcatctgcaacaagttggcgccgcaacacatccacatttgatgcgaggaccttcactcagctgggctatcccggctacccatcctttaggtgcagcaccgctcggaaacccaggaccgggcgagccaatttggctgccttgtgtgggcggcgctgaagtgcgcgcccaattgggatcattttacagttgggagagcaaatcaagtctcccctcaacccctctcagcttgctcgtttcctgtggcggctctgctcttaccacccacgcatttccacccatcggaggccccatccccagtagatttcccgccgcaaataagtacttgccctcctctgctagagtccagggttccgtgggcatatccatctacccagcgacggacaaagccacatacctgagtacttggtctgctcacagcggccggcgcgagcggcctaaatag

SEQ ID NO: 50000 - DNA, 216 bp, Artificial Sequence
  Description of Artificial Sequence: Synthetic coding sequence
atgaagatcgtgcacgtgaacgtgatgggcgtgggcggctggggcgccgttttcctcgatatgtggcacgtgacccaggagagcaaaagaccgatcatctctaaaatgcccgcttggatctttccgtgccatccccttgacgaacagacttatcacatggctttaaatgccgcaactttccctaaaaatgctacctggattgggcctttgtggtag

SEQ ID NO: 50001 - DNA, 147 bp, Artificial Sequence
  Description of Artificial Sequence: Synthetic coding sequence
atgagcgacttccccgtgcacagcaagtacttcctgatcagcagcctgcaggtgctcaagatgcataaaaaggacttcacgtcccaagtgctgctcaggatttactttgacctgatttgcatgctagttaagctccacgtgctgtag

SEQ ID NO: 50002 - DNA, 861 bp, Artificial Sequence
  Description of Artificial Sequence: Synthetic coding sequence
atgagcctgcccatcggcatctaccggcgggccgtgagctacgacgacacgttggaggaccccgcccctatgacccctcctccctccgacatgggatccgtgccgtggaagcctgtcattcctgaacgcaaatatcagcatctggccaaggtcgaagagggcgaagcctccctgccttcccccgcaatgactctctcctcggccatagacagtgttgacaaagtccccgtagtaaaagcaaaggcaacccacgtgataatgaacagcttaatcactaaacaaacccaggaatctatccagcacttcgaaaggcaagctggactgcgggatgcaggttatactccacacaaaggcttaactaccgaggagacaaagtatctgagagtcgcagaggcgctgcataagctaaagctccaaagtggtgaagtcacgaaagaggagcgacaaccagcaagcgcgcagagtaccccaagcaccaccccccactcttcacctaagcaaaggccacgcggctggtttaccagcggcagcagcacagccctgccggggccaaatccttctactatggatagcggtagcggggacaaggaccggaatctctctgacaagtggtctctgttcggtcctcggtctctgcagaaatacgacagcgggtctttcgccactcaagcataccgtggggcccagaaaccctctcctttggagctgatacgagcccaggcaaaccggatggccgaggatccagccgctctgaaacctcctaagatggatatccctgtgatggaggggaagaaacagccaccccgcgctcacaaccttaaaccccgtgacctgaatgtgctgacccctacaggattctag

SEQ ID NO: 50003 - DNA, 3240 bp, Artificial Sequence
  Description of Artificial Sequence: Synthetic coding sequence
atggacgacgacgacgacagctgcctgctggacctgatcggcgacccgcaggcactgaactactttctgcacggccctagtaataagagctcaaacgacgatttaacgaacgccggctatagtgccgcgaattcaaacagcatcttcgcgaactcaagcaatgccgaccctaagagttctctaaagggagtgtccaaccagttaggggagggccccagtgatggcctcccattgtcatccagcctgcagtttctggaggacgagctagagtcttcacctttgcctgacctgaccgaagaccagcctttcgacattttgcagaaatccctgcaggaggccaacatcacagagcaaacccttgcagaggaagcctaccttgacgcttctatcggttccagccaacaattcgcccaagctcagctgcacccatcatcaagtgccagctttacacaagcctctaacgtgagcaactatagcggccagacacttcagcctatcggtgtaacacatgtgcctgtcggtgcttcgttcgcctcaaataccgtcggagtgcaacatggcttcatgcagcacgtgggaattagtgtgcctagccaacacctgagcaactcatctcagatcagcggttctggtcagattcagcttattggatcgtttggaaatcatccatccatgatgacaattaacaaccttgacggcagtcagattatcctaaaggggtccggacaacaggcaccttccaatgtttccggcgggcttttggttcatcgccagacacccaacgggaactccctgtttggaaattcatcgagcagtcctgtggcccagcccgtcaccgtgccttttaatagcacgaactttcagacctctctgcctgtgcacaatataataatacagaggggcctagcacctaacagtaataaggttcccattaacatacagccaaagcctattcagatgggccaacagaacacttataatgttaataacctcggcatccagcaacatcacgtccagcaagggattagctttgcaagtgcctcgtctccacaaggtagtgtcgtcggccctcatatgagtgtcaatatcgtgaaccaacagaacactcgaaaaccagttacctcccaggctgtgtcgagcaccgggggctctattgtcatccatagtcctatgggccaaccccatgcccctcagagtcaatttctgataccaacgtcactatcggtctcctcaaattctgtccatcacgtgcagactatcaatgggcagcttctgcagacacagcccagtcagttaatctccgggcaagtcgctagcgagcatgtgatgctaaaccggaactctagcaacatgcttcgcactaaccagccttacacaggtcctatgctgaacaatcagaacacagctgtgcatctggtttctggacaaacattcgcagcgtctgggagccctgttatcgcaaaccatgccagccctcagctcgttggcggccagatgcccctgcagcaggcctcgccaactgttttacacctatcacccgggcaatccagcgtgtctcaggggagacctggatttgccacaatgccctctgtgactagcatgtccggtccatctcgcttccctgcagtttcttccgcgtcgaccgcccaccccagcctcgggagtgccgtgcagagcgggtcatctggaagtaatttcaccggagatcagctgacgcagccaaatcgtacacctgtccccgtcagcgtctcccaccgcctgcccgtgtcgagctcgaagtccacctcaacgtttagcaacacacccgggacggggactcagcagcaattcttctgccaggctcagaagaagtgtctgaatcaaacttccccaatatctgcacccaaaacgacggatggactcaggcaggcccagatcccaggattactgagcaccaccttgcccggtcaggattccgggtcaaaggtcatttccgcttccctgggaacagcccagcctcaacaggagaaggtcgtaggcagctctcccggacacccagctgtgcaagtggagagtcattctggtggccagaaaagaccagcagccaagcagctgaccaagggcgcttttatccttcagcaattgcagcgagatcaggctcataccgtgacaccagacaaatcgcatttcagaagcctgtccgatgcagtccaacgccttttgtcctatcatgtttgccagggatctatgcctactgaggaagacctcagaaaggttgacaatgaatttgaaaccgtcgccactcagctgttgaaaagaacacaagctatgctgaataaatatcgatgcttactgctggaggatgccatgcgaatcaacccaagcgccgaaatggttatgatcgaccgcatgtttaatcaggaagagagagcttccttgagtcgtgataagcgtctggcacttgtggacccagagggctttcaggcagatttctgttgcagtttcaaacttgacaaggcagcacatgagacccagttcgggcggtcagatcagcacgggagtaaggcctcatcctctctgcaacctcccgccaaagctcaggggcgcgatagggcaaagacaggcgtgaccgagcccatgaatcatgatcagtttcacctggtaccaaatcatattgtggttagcgctgagggaaatataagtaagaagaccgagtgcttgggtagagccctgaaatttgataaggtcggtctggtacagtaccagagtactagcgaggaaaaagcctccagacgtgagcctctcaaggcctcgcaatgcagcccaggacccgagggtcacaggaaaacgagcagcagatcagatcatgggacagagagcaaactcagctcgattctagctgattctcatcttgagatgacctgtaacaactcgtttcaggacaagagcttaaggaactcaccaaagaatgaggtgctccacaccgacatcatgaagggaagcggcgagccccaacctgacttgcaactaacaaagagcctcgagactacattcaagaatatactagagttaaagaaagcagggcgacagccccaatcagatcctacagtgagcggatcagtcgagctcgattttcccaacttctctccaatggcttcacaagagaattgcctggaaaagttcatcccggatcattccgagggcgtggtagagacagactctatcctcgaagccgccgtgaactcaattttagagtgttag

SEQ ID NO: 50004 - DNA, 3240 bp, Artificial Sequence
  Description of Artificial Sequence: Synthetic coding sequence
atggacgacgacgacgacagctgcctgctggacctgatcggcgacccccaggccctcaactattttctccacgggccttctaataaatcctctaatgacgatctgaccaatgccgggtactctgccgctaactccaacagcattttcgctaacagcagcaacgccgaccctaagagttcacttaagggagtgagcaatcagctaggtgaagggccgagcgacggtctcccactgtccagcagcctgcaatttttagaggatgaacttgaatcgagcccgctgcctgatttgacagaggaccaaccattcgacatcctacaaaagagcttgcaggaggccaatatcaccgaacaaaccctcgccgaggaagcttacctggacgcatctatcggctcctcacagcaatttgcccaagcacagctacaccccagctcaagcgcttccttcactcaggcctcaaacgttagcaattacagcgggcaaacgctccagcctatcggggtgacccatgtgcctgtaggtgccagcttcgcctcaaatacagtgggcgtccagcatggcttcatgcagcacgttggaataagcgtcccgagtcaacacctttcaaatagcagccaaatctctggtagcggtcagatacagctcataggctcttttggtaaccaccctagcatgatgactatcaacaacctggacggcagtcagattatactgaagggctctggacagcaagctccaagcaatgtgtcaggaggactgctcgttcatcgccagactccaaacgggaacagcctgttcgggaactcttcttcctctcctgttgcccagccagtcacggtccctttcaactcaacgaatttccagacgtcacttcctgtgcacaacataattattcagaggggtcttgccccaaactccaataaagtgcctatcaacatccaacctaagccgattcagatgggccagcaaaacacatataatgtgaacaaccttggaatccagcagcatcacgttcagcagggaatctcgttcgccagcgcctcttcgcctcagggcagcgtagttggccctcatatgagcgtcaatatcgttaatcaacagaatacaaggaaaccagtgacaagccaggcagtcagctcgacgggcggatctattgttatccactctcccatggggcagccgcacgccccgcagtcccagtttctcatccccacctccctttccgtgagctcaaactcagtgcatcacgtgcagacgatcaacggtcaattgctacaaacgcagccatctcagctaatttcaggccaggtggccagtgagcacgtgatgctgaatagaaattcaagcaacatgctgaggaccaaccaaccatataccggacccatgctaaacaaccaaaatacggccgtgcacctcgtcagcggccagacttttgcagccagcggatccccagtgattgccaatcacgcatctcctcaacttgtgggtggccagatgcccttacagcaggcctcccctaccgttctgcacctcagcccaggccaaagcagtgtgtctcaggggcgtcccggctttgcaaccatgcccagcgtcacctcaatgagtggaccgtctcggtttcctgcagttagttcggcctcaacagcccatccttccctaggaagtgccgtgcagtccggttcaagtggctccaattttacaggcgatcagcttacacagcccaatcgtacacccgttccagtctcagtatcacacaggctccccgtaagttccagtaagtcaacatctacattttcaaacactccaggtacaggcacacaacaacagtttttctgccaggcccagaaaaaatgcctgaatcagacttcccccatttcagccccgaaaaccacagatggcttgagacaggctcaaatccctggcctcctctccaccacgctccccggtcaggactccggatcgaaagtgatctcagcctctctgggcacagctcaaccacagcaggagaaggtggtgggttcctccccaggacacccagctgttcaggtcgagtcacactcagggggccagaaaaggcctgctgctaaacagctgactaaaggggcattcatcctacagcagctacagcgggatcaggcccacactgtgacacccgacaaatcccacttccgatccctaagcgacgccgtgcagagactgctcagttaccacgtgtgtcaaggaagcatgccgaccgaggaggacctgcgcaaagtggacaatgagtttgagacagtcgctacccagctcctgaaacgtacccaggccatgctgaataagtatcggtgcctcctgcttgaagacgccatgaggattaaccccagcgctgagatggtgatgatcgatcgcatgttcaaccaggaggagagggcctcactgtctcgggacaagaggcttgccttggttgacccagaaggttttcaggccgacttctgctgctccttcaagcttgacaaagccgctcatgaaacccagttcggcagatcggatcagcatggaagcaaagccagttctagtttgcagccgcctgccaaagcccagggcagggacagagccaaaaccggggtcactgaaccaatgaatcacgatcaattccatcttgttccaaatcacattgtggtgtccgctgaagggaatatcagtaaaaaaacagagtgcctcggacgggcattgaagttcgacaaagtgggactagtgcagtaccagtccacttcagaggaaaaagcctccagacgggaaccccttaaggcttcccagtgtagtccggggccggagggtcacagaaagacttcatctcgtagtgaccacggaactgagagtaagctgagcagcatcctggccgatagccacctggagatgacgtgcaacaactcattccaagataagtcactgagaaactctcctaaaaacgaggtcctgcacactgacatcatgaaaggctctggagagccacagccggacctccagctaactaagtccctggaaacaacattcaaaaatattttggagctgaaaaaagcaggtcgtcagccccagtctgaccccaccgtaagtggatcagttgaactagactttccaaacttcagcccgatggcaagccaggaaaattgtcttgaaaaatttatcccggatcacagcgagggcgtggtggagacagacagcatcttggaggccgcagtaaattccatccttgaatgctag

SEQ ID NO: 50005 - DNA, 792 bp, Artificial Sequence
  Description of Artificial Sequence: Synthetic coding sequence
atgtggccccagccctgcctgcccccccaccccaccatgctggaggagactcagcaaagcaagctggccgctgctaagaaaaaactgaaagaatatcagcaaagaaacagccccggcgtgccagccggcgtcaagatgaaaaagaagaatactggaagctccccagagactgctactttcggcgggtgtcactcccctggagcaagtcggtaccaggagttagagctggcattagattcctcttccgccatcatcaaccagttgaatgagaacatcgagtccttaaagcaacagaagaagcaggtggaacatcagcttgaagaggagaagaaaactaatagcgagatccataaagcacagatggaacagttagaggcaatcgacatcctcaccctggagaaggccgacctgaaaaccacactataccacacaaaacgagcggcacgtcactttgaggaggagtcgaaggacctggccggtagactgcagtacagcctccagcggatccaggaactcgaacgggcactgagcgctgtttccacgcagcaacaggaggaagaccgctcttcctcttgtcgtgaagctgttctgcaatggaggctgcaacagaccatcaaagagcaggcactgctcaatgcgcacgtaactcaggtgacggagtctctcaagcaagtgcaacttgagcgggatgagtacgcccagcatataaaagaagagcgcgcacgctggcaggaaaggatgtggaagatgagtgtcggcttgtcaccccatcccaggcatccacaacagtag

SEQ ID NO: 50006 - DNA, 60 bp, Artificial Sequence
  Description of Artificial Sequence: Synthetic coding sequence
tggatcttcatcttcaagtgcagcgtgatgtacgtgcacttcttctttgctttcttctag

SEQ ID NO: 50007 - DNA, 618 bp, Artificial Sequence
  Description of Artificial Sequence: Synthetic coding sequence
atgaacagctggccctggctgttcgacagcaacttctgcagcgccgtggagatcatcctggaacctgagaaaaagattcccaatagcaccctccacttctgtgaggaactagtgcctaactctggatcgcttttcggaaaaaacatttgttgtggcaaacagtgttgtatatgtgacctcaaatcactcctggagctggacagagacggtgagttccagccagagagaccaaagaatagttgtcctgcgttactcaacgctatctctagaaggacctccatatttccacctcccacatcactacttctgcccgtgaccctggccagtagccaatgttgctgggcaaccagcggtagtgccggcggacgaggcatagcccccacgcccggaggtcagccctgtggctccagtaggaagtccgggtcatcatgcgcctggagatggagcccttcagggggttctccttggccttgctcccgggctggcggcgcatggagaagattggggacctcgctagatacccacccagcggggtccagagcttgtagagctgtccaccagttagctggggaatctccaactcccaggcaggcccggcgacctcccttccccacatag

SEQ ID NO: 50008 - DNA, 219 bp, Artificial Sequence
  Description of Artificial Sequence: Synthetic coding sequence
atggagaagtggaagctgggccggcagatccagcccccctggcccttggcccacgcacggggaagttggatggcgctgccgcgtagcgaacagctgggaaccggtggagaccaggactggcagctccagggacacacaagagcaactgaaaccaaagaaaatttccagaaggagagcatggtgaagtctctgcggatgcagagacgacagggagagtag

SEQ ID NO: 50009 - DNA, 312 bp, Artificial Sequence
  Description of Artificial Sequence: Synthetic coding sequence
atgaagctgaagagcctgttcggcgagatcaccttcaccttcggcatcagcaaagagaagctgaaaatacttgacgatctgacactccttcccttgctcgttaagcaatacaagatgctgtggagctacaagctccctggttccggcatagtcatctggagcacgttccacgctgtcatggactcagagtggcggaggcagaatgcagaattgaatcttatcacgaataagcatttcctcaaaaacttgcagtcgaagcacttggatgtgaaaatcttaaaaaccaagaacaaattggtggagggaatctag

SEQ ID NO: 50010 - DNA, 69 bp, Artificial Sequence
  Description of Artificial Sequence: Synthetic coding sequence
gacggcaagatcatgctgcacgtgtgctgcatcagcctgtgcagcgtgctcgtctggaaatttccttag

SEQ ID NO: 50011 - DNA, 237 bp, Artificial Sequence
  Description of Artificial Sequence: Synthetic coding sequence
gtgctgctgttcatcttctacctgctgatcttcatgttcagcttcttcgagacccggtctcactctgtcacgcaggccggagtccagtggcacgatcactcttctttgcagccacaactgcccggcttgaaacagagccccacaagcgccagccagtcatcctgggaccatggttgtgctccaagacaccccattcatctgccccagacccccaaggtgctgggactacaggtctag

SEQ ID NO: 50012 - DNA, 297 bp, Artificial Sequence
  Description of Artificial Sequence: Synthetic coding sequence
ctggagtgcagcggcaccgtgctggcccactgcaacctgtgcctgctagcaagtcaggcggccggcatcaccggcacaagccatcatgctcagctcatctttgtattcctcgtggagacctggttccatcatgtgggccaggctggcctcgaacttcttacgagcggagatccaccagcgtccgtttctgagaatgctgggatcacaggtgtgtcgcaccgcgcgtggcctggccctcaattcttcaatttggaacagggattttctatgctggtgaggctggtttctaattcatag

SEQ ID NO: 50013 - DNA, 453 bp, Artificial Sequence
  Description of Artificial Sequence: Synthetic coding sequence
cggaaccggatccagtacaaccagagccagaaggacatcctgcagtcttggtttcaacatgaccccttccccgataaagccgcacgagagcagttggccaaggagatcggagtgccggaatcaaacatccaggtgtggtttaaaaattacagggtaaagcaacgaaagctggactacaagtgtttttcggaaaaggatcaaacccaggggcacgatcagagtcagcacctaacccaggaataccttccgaaggaagcgcggcagaagcagacatttatcacatggactcagaaaaaccgcctggtgcaagcctttgaaagaaatccattccctgatattgctacccgtaaaaaactggcagagcaaacgggcttgcaggaaagccgcatccagatgtggtttcagaaacagcgcagtctttatttaaagaagtcaaggatggaaccaatgtag

SEQ ID NO: 50014 - DNA, 3651 bp, Artificial Sequence
  Description of Artificial Sequence: Synthetic coding sequence
atggccgccatggcccccggcggcagcggcagcggcggcggcgtgaatcctttcctgtctgactctgacgaagatgacgatgaggtggcagctaccgaagagcgccgcgctgttctgcggctgggggctggcagcgggctagatcccggcagcgccggcagcctttcaccccaggatccggtggctctcggcagtagcgcacgaccaggcctgcctggggaggcaagcgccgccgccgtcgcattaggcggtacgggagagacccccgccagactgtctatcgatgccattgccgcacagctgttgagggatcaatatctactcacagcgctggaactccacaccgaactactggagtcaggtagagaactgcctcgcttgcgggattattttagcaatcctggaaactttgagcgacagtcaggcactcctcccggtatgggggccccaggagtgccaggggctgcaggggtggggggagctggcggacgagaaccatccacagctagcggcgggggccagctgaatagggctgggtcaatctctaccctggatagcctggactttgccagatacagcgacgacggtaaccgggaaacagatgagaaggtggctgtgctggaattcgaactgcggaaggcaaaagagacgatccaggctttacgtgcaaatctgaccaaagccgcagaacatgaagtcccccttcaggaacgcaagaactataagtcttcccccgaaattcaggagcccatcaagcccctggaaaagcgtgcattgaacttcctggtgaacgaatttctacttaaaaataactataaactcaccagtattactttttcagatgaaaatgatgatcaggattttgagctgtgggatgatgtcggactgaatatccccaagcctcccgatcttctacagctgtatcgagacttcggaaaccaccaggtcactggcaaagatctggtcgatgtcgcttctggagtggaagaagacgagttggaggcccttacacccatcatcagcaacttacccccaacactggaaacacctcagccagctgaaaattctatgctcgtacagaagctcgaagacaaaatctcactcctgaattcggagaagtggtctctcatggaacagatccgacgacttaaaagtgaaatggacttccttaagaatgagcactttgctatcccggccgtttgtgactcggtccagcctcctctcgatcagctgcctcacaaggacagcgaggacagcggacagcaccctgacgtgaacagtagcgacaagggcaaaaacactgacatccacctgtcaatctcagacgaagccgactccacgatccccaaagagaatagcccaaattcctttcctaggcgcgagcgcgaagggatgcctccctctagcctctccagtaagaaaaccgtacattttgataaacccaacaggaaacttagcccggcctttcaccaggctctcctgagcttctgtaggatgtctgctgactcaagactcggttacgaggtcagtaggatcgcggattctgagaaaagcgtcatgttgatgctcgggaggtgcctcccacatatagtacccaacgtgctgcttgctaaaagggaggagctaatccctcttatcttgtgcacagcgtgtcttcatccagagccaaaggagagagaccagcttctccatatactgtttaatctgatcaagagacctgacgatgagcaaaggcagatgatcctgaccggttgcgtggcgttcgcaaggcacgtagggccaacacgagttgaggccgagctgctcccccaatgttgggagcaaattaatcataagtaccctgaaagacgactcctggtggccgagtcatgcggtgccctcgccccttatctgcctaaggagatacggagttctttggtgttatccatgttacagcagatgcttatggaggacaaagctgatcttgtgcgcgaagcagtcatcaaatcactgggaatcataatggggtatatcgacgatccagacaagtaccaccaagggttcgagctcctcctgtccgctttgggcgatcccagtgagagggtggtcagcgccacccaccaagtgtttctgccagcatacgccgcatggactaccgaactaggtaacttgcagtcccatctcattttaacattgctgaacaaaatcgagaagctgctgcgcgagggggaacatgggctcgatgagcataagttgcatatgtacctgtccgctctgcagtccctgattcctagtctgtttgccctggtgttgcagaacgcccccttcagcagcaaggccaagttgcacggggaagtgccacagatcgaagtgacccgatttccgagaccgatgtcgcccctgcaggacgtgagtacgattatcgggtcccgcgagcaactagctgttttgctccaactttacgactaccaactcgaacaggaaggcaccactggatgggagtctttgctttgggtggtgaaccagctcctgccacagttaatcgaaattgtcggaaaaatcaacgtgacctctacagcttgcgtgcatgaattctcccggttcttctggcggctgtgtcgaacgttcggaaaaatattcactaacaccaaggttaagccccaatttcaggagatattgcggttgtccgaggaaaatatagacagtagtgccgggaacggggttctcaccaaggcaactgtccccatttatgccaccggagtcctgacctgctacatacaggaagaagatcgcaaactgctggtcgggttcctagaagacgtaatgacattactgagtctttctcacgccccacttgacagtctgaaagcttcctttgtcgagctgggagccaatccagcataccacgaattgcttttaacagttctgtggtatggcgtagttcatacttccgcgctggtgcggtgcactgcagccagaatgtttgagctgacactgcggggcatgagtgaggccctggtggacaagcgggtggcgccggctctggtcacgttgagcagcgatcctgagttctccgtcagaattgctacaatacccgccttcgggaccattatggagaccgttatccagagagagcttttagaacgtgtgaagatgcagctagcttcattcctggaggacccccagtatcaagaccagcacagcctgcacacagagatcattaaaacctttggacgcgttggccccaatgcggaacctcgttttagagatgaattcgtcatcccacaccttcacaaacttgccctagtcaacaatcttcagatcgtggattcgaagagattggacatagctactcacctttttgaggcctacagtgccctatcctgttgctttatcagcgaagatctcatggtgaaccactttttgcctgggctccgctgccttagaacagatatggaacaccttagtcctgagcatgaggtgatactctccagtatgataaaagaatgcgagcagaaggtggaaaataaaactgtgcaggaaccacagggctctatgtcgattgcagcttctctggtgtccgaagatactaagacaaagttcctgaacaagatgggacagttgacgaccagtggagctatgctggccaatgtgtttcagcgcaagaaatag

SEQ ID NO: 50015 - DNA, 435 bp, Artificial Sequence
  Description of Artificial Sequence: Synthetic coding sequence
atggagcgggccagcggcctgagccccggcggcggcctgggcgccacatcgaggcaaatgtctcctgggacccaactggccaaccccccggaccacggcgacaaagattgcctgggaagaatctctcccggtagcggtaaacagatccaggcagcaggccagctgccaggccctccaactagtctcgctccagcccaaggcaggcttcgtagtctcactccatggggacttcaaactcccgagcacagcgaacctgagggaataggccatcttcaggccgccactgaggccgtcctgcctcatagtactcaaaacctcatcacaaagaggaacctgatggttcaggcacgcgtgcaatggcgagacctgggcagtctgaagccgccaccacctcgtttcaagcaattctcatgctttagccttccaagcagctag

SEQ ID NO: 50016 - DNA, 177 bp, Artificial Sequence
  Description of Artificial Sequence: Synthetic coding sequence
cccggcggcgccgccgccgccgccagcgtgatggccccccggcgggggcggtgcttctgtaccagcatctgcggtggccgcggtgccagaccccaactccctagaacatgcggagacggtacgcagcactgcggacggggaaagcccgctctggcagcggcagaagagtggccctag

SEQ ID NO: 50017 - DNA, 294 bp, Artificial Sequence
  Description of Artificial Sequence: Synthetic coding sequence
atgggcagcatccccagcaagccctgcaacaaccccgagggccccctcctccaggggatggaggctgcagattggacaggcataggagtgtgcctccctcccgggggtgcaagaggacacatatactgctgcaccaggctctgccatcagcgggccgccagcgcccaccgctccctcttattaccccgcaccgtgcaaaccggggggactgagcgggagaaacctggccctggccagcgtaagagaggggcacattgtagcgcatgtaagcgaagctctacaaggcctagctag

SEQ ID NO: 50018 - DNA, 504 bp, Artificial Sequence
  Description of Artificial Sequence: Synthetic coding sequence
atggacctgatcaaggtgctgtacgtgaagaagcccctgatcttccctatgtatcttatctataagcacgaaaatctcatactcgagagaaaccccctggacgtacggagcgtggtgatggtcagcgttattcccttgacgtttgatattatgcgagaactcaccctggagaaaaaccctatgaatgtaaaaaatgttgtcaaaccatctgatattgtggtcccctatgagaatatgaccgagttaatcctggaacgtaacccaatgagtgtaagaattatcggtaagtgtcttgttatgccaatcatcttcgtggctataaaggagctgacccctgagcgtaaccctatttctaaagattgcggtaaggctttccgcagttctagtttttgtcagcagcacaaatccactcacacgggcgagaagccctatgagtgtaaaaaatgtggcaagacttttcgattctactcaagtctgccgaagcacaagagaacacacacatag

SEQ ID NO: 50019 - DNA, 408 bp, Artificial Sequence
  Description of Artificial Sequence: Synthetic coding sequence
atggtggccacctggggcggccggcagctgctgccccagtgcagcggcccccccctaacccccgggtcaccggctccctccgttgcccaggcgtcccgcccggccccaccctcccccagaaagacgagcccaggacccccacagcccagtgcttccccatctctccctttttctcccttgttggccggctgttctcgcttgctgcctgtcctggccccatcattaagttccgtgcaccggtgccctcttggggcaagagcctctcgcctcccttggaaactggaggcgggtacctcatcatcaggagatcgccccctatgcctgcactccgggcagagaggggcttgcttgacggatgagcagggctccacattgtctcctagacaacgccgtggcccaggtaagtag

SEQ ID NO: 50020 - DNA, 5529 bp, Artificial Sequence
  Description of Artificial Sequence: Synthetic coding sequence
atggagctgatgttcgccgagtgggaggacggcgagcggttcagctttgaagatagcgatagattcgaagaagattcactgtgtagctttattagcgaggccgagtccctgtgtcaaaactggcgaggctggcggaagcagtccgccggccctaattctcctactggcggaggtggaggcggcggctctggaggtaccagaatgcgagatggacttgtcatcccactggttgagctgtctgcgaaacaggtggcctttcatatccccttcgaggtggtggaaaaagtctatccccctgttcctgaacagctacagctcaggatcgccttctggtcttttccagagaatgaagaggacatccgcctgtatagttgtctcgcaaacggttcagctgacgagtttcagaggggcgatcagctctttaggatgcgcgctgtcaaggaccctcttcaaattggattccatctgtctgccactgtcgtgcccccgcagatggttccacctaaaggcgcctataacgtcgccgtgatgttcgaccgatgtagagtgactagttgctcctgtacgtgtggcgccggagctaaatggtgcactcacgtcgtcgcgttatgtctcttcagaatacacaatgcatccgctgtgtgtctaagagcccctgtgtcagagagtctgtctaggctacagcgagaccaactccagaagttcgcccagtaccttatcagcgaactgccccagcagattctccccaccgctcagagactgctagatgagttactgtcttcccagtcaacagcgatcaacactgtctgcggagcccccgaccctacagccggaccatcagcctcggaccaaagcacatggtacctggacgagtccacactcactgacaacatcaaaaaaacactgcacaaattctgtggaccttcgccagtggtcttcagcgatgtcaactcaatgtaccttagttctaccgaacccccagccgctgccgaatgggcttgccttcttcgcccactgcgcggcagggagcctgagggagtgtggaatttactttcaatagtgcgggagatgttcaagagaagggattccaatgccgcgccacttctcgagattctgaccgaccaatgcctcacttatgaacaaattactggatggtggtactctgtgaggacatcagccagccacagttcagcatcgggtcacactgggcgctcaaacgggcagagtgaagttgcggcccacgcgtgtgcctcaatgtgtgatgagatggtcactctctggcggttagcagtgctagacccagctctgtctccacaacgaagacgcgaactttgcacgcaattgagacaatggcagctgaaggtaattgagaacgtgaagcgcggccagcacaaaaagaccctcgagagactttttccaggtttccggccagccgtcgaagcctgctatttcaattgggaggaagcataccctctgcctggtgtaacctattctgggaccgaccgtaaactggcactgtgctgggcacgggctctgccatcccggcccggcgcaagtcggtcaggaggcctggaggagtccagggatcggcctaggcccctcccaaccgagcccgccgtgcgtccaaaggagcccggaacaaagagaaaagggcttggcgagggcgtgcctagctctcagcgaggcccaaggcgcctttccgccgaaggcggagacaaagccctacacaagatgggtcctggggggggcaaagccaaggcccttggaggggcaggatcagggtcaaaaggcagtgcaggcggcggatctaagcgacgcctcagttccgaggactcgtcactcgagcccgatcttgcggaaatgtctctggacgactcctcgctggccttgggagctgaggcctctaccttcggcggcttcccagagtctccacctccgtgtccgcttcatggaggctcccggggacccagcacattcctgcccgagcctcctgacacatacgaagaggatggcggggtgtatttcagcgaaggcccagagcccccgacagcttccgttgggccaccgggattactgcccggagacgtctgtactcaagacgacctgccaagcaccgatgagtctggaaatggcctcccaaaaacaaaggaggcggcaccggccgtgggcgaggaggatgatgactaccaggcatactatctcaacgcacaggatggggctggcggggaggaggaaaaggccgagggaggcgcaggtgaggaacacgatctttttgccggtttgaagccgttagagcaggagtctaggatggaggttttattcgcatgcgcagaggcccttcatgcccatggatattcctctgaagcttcacgactgaccgtggaactggcccaggatttactcgctaaccctcctgacctgaaggttgagccaccccctgcaaagggcaagaagaataaggtgtcgactagcagacagacctgggttgctaccaacactcttagcaaagccgcatttctactcactgtgttaagcgaacgaccggaacaccataacttagccttcagggtggggatgttcgcactggagcttcagagaccaccagcatctacaaaggctctcgaggtgaagcttgcataccaggaatcagaagtcgccgcactgctgaagaagatccccctggggccgtctgaaatgagcactatgcggtgtcgcgctgaggagttgagagaaggtacattgtgtgactataggcccgttctgccattaatgcttgcaagctttatattcgacgttctctgcgctcccgtcgtgtcccctactggatcccggcctcccagtcgcaactggaacagcgaaacgcctggggatgaggagcttgggttcgaagctgccgtggcggcactaggcatgaaaaccactgtaagcgaagccgaacatccattgctgtgtgagggaacacggagggaaaaaggcgacctagcgttagcacttatgattacgtacaaagacgaccaggccaagctgaagaagatcttggacaaactgctggaccgggaaagccagactcacaaaccacaaactctgtctagtttttattcttcttctaggcctacaacagctagccagagaagtccatccaagcacgggggaccatctgccccaggcgcactgcaacccctcaccagcggcagtgccggacctgcccagcctggaagcgtagccggggccggtcccggacccaccgaaggctttacagagaagaatgtgcctgagagttcacctcatagtccgtgtgaggggctgccaagcgaggcggctcttacaccccgcccagagggcaaagttccttcaagacttgccttgggctctagaggaggctataatggccggggctggggctcaccggggcggccaaagaaaaaacatacaggaatggcatccattgatagcagcgccccggaaactacatccgactcaagtccaactctgtctcgaagaccactgagggggggatgggcgccgacttcctggggacgggggcaggatagtgatagcatttcttctagttcttctgatagcctcgggtcatcaagcagctctggctcaagacgggccagtgcaagtggcggagcaagggctaaaaccgtcgaggtcggaaggtataaaggacgtcgacctgaaagccacgcccctcacgttcccaaccaacctagtgaagcagctgcccatttttatttcgagttggctaagacagtcctgattaaggctgggggaaacagctctacatcaatttttacccatccctcgtcgagcggagggcatcagggaccccataggaacctgcacctgtgtgcctttgagattggactttatgcactgggactgcacaactttgtgtcccccaattggcttagtcgtacatattcttctcacgtaagctggataacgggccaggctatggagatcggcagcgccgctcttaccatactcgtagagtgctgggacggacatctcacccctccagaggtagcctctctggcagacagagcatctcgggcaagagacagtaacatggtaagagccgccgccgaactcgcactttcttgtctccctcacgctcacgcactgaatcctaacgaaatccaaagagcactggtccagtgcaaggaacaagataacctgatgctcgagaaagcttgcatggccgtcgaggaggcggccaagggaggcggcgtatacccagaagtcttatttgaagtggctcaccagtggttctggctgtacgagcagaccgcgggtggatcatccactgccagggaaggagctacttcctgctcggcgtcgggtatcagagccggcggcgaagcgggacgcggcatgccagaggggagaggaggcccaggcaccgagcctgtgaccgtggccgccgctgctgtgactgccgcagctacagtcgtgcccgttatttccgtgggatcttcattatatcctggaccgggcttgggccacggccactccccgggactgcatccctacacggcgctacagccccacctgccctgttcccctcagtacctcacacatccagcccaccccgcccatccaatgccacacatgcctagacccgctgtgttcccagtgcccagctccgcctaccctcagggcgtgcaccccgctttcctgggggcccaatatccttactctgtcactccaccctccctggccgctacagccgtcagctttccagtccctagcatggcccctataacagtgcatccataccacacagaaccagggttaccactacccacctctgttgcctgcgagctgtggggtcaggggactgtgtcaagtgtccatccagcgagtactttccccgcgatccaaggagctagtcttccagctctgactactcaaccctcaccattagtctcaggggggtttcccccacctgaggaagagacccactctcaacctgtcaatccacatagcctccaccacctccatgccgcctacagagtgggtatgctggcacttgaaatgctgggccgccgtgcccacaatgaccatccgaacaacttctcaagaagtccaccatacaccgacgacgtcaagtggctgctgggtctggccgccaaactgggagttaactacgtgcatcagttttgtgttggtgccgccaagggagtactgagcccctttgttctgcaagaaattgtcatggagacactgcagagactgagccccgcgcatgcgcacaaccatctgagagccccagctttccaccagctcgtccagagatgtcagcaggcctatatgcaatacatacatcatcgcctgatccatcttacacctgctgactacgacgactttgtgaacgctatccgctctgcgaggtctgcgttctgtttaacacctatgggtatgatgcaattcaatgatattcttcagaaccttaagcggagcaagcagacaaaggagttgtggcaaagagtcagtctggaaatggctacgttttctccttag

SEQ ID NO: 50021 - DNA, 87 bp, Artificial Sequence
  Description of Artificial Sequence: Synthetic coding sequence
gacgccgtgatcctgttcagcgtgtggcggctgaagaagaagagccgggtgctcttttttatctatataattgccatcagcgtgtag

SEQ ID NO: 50022 - DNA, 111 bp, Artificial Sequence
  Description of Artificial Sequence: Synthetic coding sequence
atggaggagaccgagagcggcagcggccggaaggagcggcggtggctcggagcggtggctcatgtgtgcaaccctagtacgttgggcggccaggtgggccggataatttag

SEQ ID NO: 50023 - DNA, 495 bp, Artificial Sequence
  Description of Artificial Sequence: Synthetic coding sequence
atgggccagaagaagaccatgggcaccgagcggagccggggcggcaaaaggggaccacaacccggagccgaaagacctgaagaaccgggtgcgacattctctaaaaaacctccagaaggcgcccgagcccctcgatgtctgtcgcggccaactgcaccaaaatccggagcgtgcctcgcccgccggagaccccccggatcaccttgctccatccgagacgctcccttccacacaggtgacgatagattcctggcgagagaaaatttccctaatgtgctacagccactgcctcgtatgtttgctgtacagcaggcggctgatttcgagtctcagtgtcccaggcggtgggactctcgaaagagacctagcgaaggactcccctccgcaggttgggggagatggagagggagacccattcatctgggcctatgggtttccggcagcgtgcggagaaaagtcagcggttctcacgtttccaggtctctgcatctctag

SEQ ID NO: 50024 - DNA, 1143 bp, Artificial Sequence
  Description of Artificial Sequence: Synthetic coding sequence
gtgcaccaggagatccacaccatcgagaagaccttcgagtgcagccatggcaagaaaagcttttgccaggagtcacacttcaccgaacatcataggacttgtacgagagaaaagccctgcgaaagctccgattgcaaaaagcggttctgtcattcctccgtgctgcgcgtgcatcaaagaacccacaccggcgaaaagccatatgaatgtaaagaatgcaggaaatcatttcacgttaaaccaaatctgaccaaacaccaaaaaacacatatcggtgaaaaaccttttaagtgcacggcctgcggccggactttttttcagcagagtaccctaaatgttcatcagcggacccacactggagagaaaccatgcggttgcaatgagtgtgagaagtcattttataataaagacgccctaattatccatcagcgcacacatacgggagaaaagccttacaaatgtaacgaatgtgaaaaaagctaccttaaaaaaagccaccttaatattcatctgcgtaatcacactggcaagaggccccacgtgtgtaacgagtgcggaaaggccttttccatgaaaagcactttaacagtgcaccagcgcacccacggcgagaaaccctacaagtgcaacgagtgtaggaaatccttctatatgaagtcagccttgagccagcaccagcgcatccatatttgggaggagcactgtgagtgcaaagagtgtggaaagacctaccaaagatcgcatctggcaaaacatcaccgcaaatacactaaaaaaccatatgaatgtaagcaatgtggcaagactttccagaagtcacatttgatcgagcatcaacgcacacatccgggagagatcccacacgagtgcaataagtgtgggaagagtttttgttacaaaagtccactaaccatccaccagcggacccacatcgaggagaaaccatataagtgttctaagtccgtgacatatttttgtatgaagtcacacctgaccgtccaccaacgccctcacacacgaaaaaacccgtttgaatgcaacgaatgtcggaaaatgttttatgttaagagcaacctcattaatcatcagaggactcacacaggggagaagccttacgagggaaacacttgcggcaagagttag

SEQ ID NO: 50025 - DNA, 585 bp, Artificial Sequence
  Description of Artificial Sequence: Synthetic coding sequence
atgcccgccccccggttcctgtacagcctgcggaactacgagcccatgaaacccttgtttttcattaattaccctgtgtctgatatggagcttcccgtgcgcagcagtacggttaccctgcttcctgcccccctcccacgtcgcggatccgtcaagacttttctagctcccagtaagtcctacttccctgaggaagaacgtgcactcctgaaatcatcacatgctttttgtacaggcttgtggccatggcggcgcgattttcagctcccacagtgtcacttggcactgggactactgccaggagagaggagcgtgcggctcccgcgctttttggcagtactcaaggaattgagtgcaaccgcgagttttaccctggccagtgaagccatccccttcctgtcctcatttccattcccatggaatcttttattgccctccgtgttccaggcccttccacagaagtggcagttcaaggcagatttcttgttagaatgcacactgtcagtcaaggaagcctttcaccaggaatgtggagctggtgtttcactggctaacggcctcaacaaggggctgaggactggttag

SEQ ID NO: 50026 - DNA, 6312 bp, Artificial Sequence
  Description of Artificial Sequence: Synthetic coding sequence
atgagcgtgcccggcacccccggcgccatggagcccgccggcgaggaggaacggcctcctcctgccgctgagggagaggacgatgaggaggaggtggccgccgctgcccagaccagcggtccagcccatgggcgcagcgccagcagcctggaggacgccgacgatcaagaggaggagatggaggcgatggtgatcggaggggggtgttgcaaagagcaggaactgacgtatgagctgcagcaggggtatcggatcctcggggagtttctgcaagagaagcaccgcgggttgaccgccccatttttgcaacctttaggaggggtagcgaccgcagaggaggaggttgctgaaggccctagatcaggaggtcggggcggaagggcctttccgcagcagcccgggcaaggcatgtgccttttgcagatggaggaaaagttcgccagcggccagtacggggggataacagagttcgttgccgatttcaggctcatgctggaaacttgttatcggctccatggcgtggaccattggataagtaaacagggccagaagctggagatgatgctggaacagaaacttgctctcttatcccgccacttacgcgagaagaccacgattgccgttacctcccgagggtattatggcctggaagacgaaaaaggcactgcctgtacatctacaagaaggcgctctacaccacggtcccttgccggcctgaccagtggagtctttgaaagcataatggtacaggtcctgcgtcaggaggagcagcttagagcgaaggaggagaaacggctaagggagcaggaacgaaaagaggcagaggaggcatctcagaaggaaatcgaggaatgggaacgtaaattgttagcccaagccgcaccaacatgtatggagaccatgtgggaaatccccgcaattgggcacttcttgtgtcttgcccagcagattttgaacctccctgaaatcgttttttacgaactggagcggtgtctactgatgccccagtgtaacgcattcctctctaagataatgacgtctcttctgagcccaccacacagacgtcctacgttacaccgaaggccgacactgccttatcgcacatgggaggccgccctgaggcagaaagtgcagcaatggtacactgcggtaggacaaacggagaatccggacaactgcgcagaaaagcttgggctgtgccctcaatttttcaaggtattgggagaggtcaacccactggaggagaaaccctttcacgaactgcctttttaccagaaggtgtggctcctcaaggggctatgtgattttgtgtatgaaacacaaaaggaagtgcaggatgccgttctcggacagccaatccatgaatgtcgggaggtcattctgggctatgactatctcgagaacgcttatgtccattttccccagttctgtggagctgatgttaggatatacaagcaacggccattccaggctccagagttccccatcccccctataaaaattcagcgggtccctagaatcaaactggaaaaacttaagtgtgattacgtctcgacctcaaatggagaacaccggtgctccagggattccctgccatcttccttcaaaaaagaacaggagaataacttcgacccagcctgttgtccagccaaaatgattttggacaaccatgacatctcggtagagatgggggtgaaatccaattatgaaatacgaattcgtcgtccgtgcgaaattaagaaaaccgactgttgtaaggaaaacctggagaagccccgatcaccaggagaggtgacaggattcggggagccactgagccccggtgaaattagatttattgagaaccaggagaagtatggcgaggccagcaggatcaagatcgaaccatctcctctgaaggagaacactctgaagagctgtcagatccatgtgaacggaagtcatagtgatcatcccgaaattaattgccacaaggtggtcagagacattctgctcgaacaatctctgcagtcccataagaagctgaagctgactaagatgcgtgcaaaaaagaaaaagaagaagaaaaaaaagttgaaagacgtgttaaatgaaaatctgcaaagaaagagggaaggactgcattcactggcattcaagtcatacaagcccgagattcagaacaagctacttatcattaagaaaaaggccaagcataaaaagcacaaatctggcaaaaagtccgtgagtaagaaggccataacgaaaaagcgaaaaaccgtcattaagtctcctacagttcccgagtttcagcttatttgcaccaacctggatgagctgagggaattgatcaccaaaatcgagaatgagctcaaggatctggaaaactctcgcaaaaaatcgggaaaatggtaccaccggcgccaggccgtcaaggaattgcacagtactctgattcgtttattgaatgagctgctcccctgggagcctaagttaatgaaggccttccagagaaacaggtctcgactgaagaaagattatgatgacttccgtcggcaacccgatcacgataccttcaatagagagttatggaccactgacgaaggggagggcgatctggggaaggacagccctaagggcgagatttctaagtctattgacagcactgaacccttggacatactggaaaaggatcacttcgactcggacgacatgaagttgtccgagatcgatttcccaatggctagatccaagctcctcaaaaaagagctcccaagtaaggacttgcctaagactctgctgaagactctcaagcgccagtcaaagcaaacagactatgtagatgactccaccaaggagctgagcccgcgcaagaaggcaaagctgtctacaaacgagaccacagtcgagaacttggaaagcgatgtacagatcgattgcttcagcgaatctaagcataccgaaccgagttttccggagagttttgctagtttggatagtgtccctgtgtcaactctgcagaagggtacgaagcccatccaggccctgctggctaaaaatattgggaacaaggtgaccctgacgaaccaattgcccccatccacaggccggaacgcactcgccgtggagaaacccgtgctgtccccccccgaagcatcccccatcaaacccgcactgacgtgtcacactaataccaaaggtccactgcagatggtgtacaaaatgccatgcggtcagtggttacctattgaccttcagaacagttcagtgaagattcaagtccaaccaatggtggatcccaagacgggagaaaagataatgcagcaggtgctcattctccctaagaatttcgtaatccagcacaaggaaggtaaggcagtggccaaagaggtgccacctctacagcaaaaggggactgagcagcactgctcgagctttccacagacaacgaatatcaacagtagtctagctagtgtgttcgtcaattctcccggaactgttagcacacagctgccaaacaccgcatttaataagaccatcacccctttgagcaacatctccagcgcccggcctcaacccttgtctccggtgacttcagtgagcaacctgctcaccccgagcgtgaaaacttcacagtctgaggctggcaaagccaaaaacgcggtaagtgcagccacctttagtttaccctcagcatcgccgaccatttcatctaccgggcagccattgagctccacaacgaccttgaatggaagtaccaatcctgggtcctcttttaattgtttcgcccagcaaactgccgatagtagtgaggcaaagcaggaattgaaaacagtgtgcatccgggattcccaatctatcctggttcgcacgagggggggcaatacaggcgtggtgaaggtccagacaaatccggaccaaaacagtcccaataccgtcagcagctccagtgtgtttaccttcgcaccccaactacaggccttcctcgtaccaaagtccacgactagctcaagcgctttttcccctgtagcgggcacaactactacatccagcctatcacccttctctcagaccccgactagcgtcagcattcccgcctcctttgcaccaagcatgggaaaaaatctgaaactcacgcttggccatacaactggttccggggatttgggacacgttatcgataagacatcacacatgccctcctcccctttaaaatcctcgatttgttcctcgaccctgctgcccagcacgactagttcgtcagtttctgtcatcagtattagcgccgccaatttcggacaaaataatgccaacattattcacactcctactaagcagcaacaggtggattatataacgaaaagctatcctgtgacgagaagtgaagcgacagccgccacaaacggggatgtcataagcggcacgccggtacaaaaactcatgctcgtgtcagccccctcgattctgagctccggcaacgggacggctatcaatatgacccccgcattaacatcgaccggcgtgtcagctcagaagctcgtttttattaacgcccccgtgccttctgggacgtccacacccactctggtggcggaaagcctgaagcagactctacctcctcctctacacaaagcctacgtgaaaacacccgagcagccacagatcgtcctcatcccaagcaccgtgggcacgcctatcaagataaactcatcccccgctgtcagccagatcaaagatgttaagatcggcctcaacatagggcaagcaatcgttaacacatccggaaccgttcctgctataccctctatcaacattttacagaatgtcacaccaaagggtgaggacaagtcttcaaagggctacatcctgcctctgagtactagcggtaactctgtgcctgtgagtagcaattttgtctctcagaatattacccccgtgaacgagagcgtagtaagctccgcacgggcagtaaatgtgctgtccgtgacaggcgcgaacctgtccctgggttccttcccagtcacctccgccagtgccagtgccggcgctcaaccccctgtactcgttagtggaaatgacacatcaagtagaatcatgcccatccttagcaacaggctgtgcagcagctccctgggcaataccgtggcgatctctaccgtgaagaccggacatctcgcctcatccgtgctcattagcactacgcagcctgtggtttcgcccaaatgtctgacgtccgcactccagatacccgtgaccgtggccctccctactcccgcaactacaagtcccaagataatcaatacggtcccccacagcgccgccgtcccgggagcgactagatcggtgagcatcagtaagcgccagtctagaacgtctcttcagttccactcacctggcattagcactaccgtgccaacgaacgtgaacaccaacaaaccacaaacggagctgtcaagcctttccactagcccagggaaaataaccaacacgagtaatttcgcatctctcccaaaccaacaggctctggtgaagactccttcctatagttctgccccaggcgggacaactatccatactgcaagcgccccatctaatgtgaccagcctggtgggctcacaattttctgaaccgtgtatccagcagaaaatagtgatcaacacctcaacacccttagcccctggtacgcagattatgatcaacggcacacgtttcatcgtcccacctcaaggcctaggggccgggagtcacgtgctcctcatctctaccaaccccaaatacggtgcaccactcgtcctgaactcaggccagggcatccagtcgacccccattgataattccgcacagaagatcacccttgcatctaacaacagcctgtcaggccaacccctgcaacacccacttaggtccccaaccaagttcattaacagctttgggaacgcctcctctatcccaaccgtacatactagcccacaactcataaataccaccgccaaagtaccggtacctcctccagtgccaaccgtttccctgacatctgtcatcaagtctcccgcaactttgctcgctaagacgtcattagtctcagcaatttgcccttctaatccaccactccccagctctacgtctgtgtttcatctggatccgcctgtaaagaaactactagtctcacctgagggcgccatcttaaataccattaatacacctgccagcaaggtgagctccctctcaccaagcctgagtcaaatcgtcgtgtccgcctcaaggtcacctgcatccgtcttccctgccttccagagcagcggtcttgagaaacctgaccgggccgccagctag

SEQ ID NO: 50027 - DNA, 342 bp, Artificial Sequence
  Description of Artificial Sequence: Synthetic coding sequence
atgcacaccgtgccctggggcgtggacttcgccctgatcgccatgaagaacttcatcagccagtggtcgtccttcttcaggtccgggatgggaaagagccagaccggttatctgcccagggttccccgcgagcaaccctttgctgcagggctgtggggattggctgccgcattgtcccatctcgcggtcaatgctttcagcctcttatgtccacccttgccgaaaacaagctgttcactgaatccccacggtgatgttgaatctaggaaggtacacgcaacagtggagaacgtctacatttcagcattgaatctgccttgggtacgggtgaaatggtgctag

SEQ ID NO: 50028 - DNA, 66 bp, Artificial Sequence
  Description of Artificial Sequence: Synthetic coding sequence
cggggcgccgaccgggagcggttcgcccggtgcgtgatcctggtgacccaggaagccgacgcatag

SEQ ID NO: 50029 - DNA, 243 bp, Artificial Sequence
  Description of Artificial Sequence: Synthetic coding sequence
atgtgcctgatcagcctgtgcgtgagcttcaccagcgtgaacaagagggagcagaacaagcctaagatcttgatccttttaaagaaaaggttatctggttgcttcattaaagaggctagagggacgagactcaaggggaaccagttagccgtcactaaggcccgagatgacggcggattggcggaggacggagacagcggaggaggcaaggtcatcaggttttggatttattttgaaggctag

SEQ ID NO: 50030 - DNA, 417 bp, Artificial Sequence
  Description of Artificial Sequence: Synthetic coding sequence
gccggcggccggccccaccagcccgccagcctgccccccggcaacccccagttggcagccctgagcttagagcagctcaagtcccaggctcccatggacacaaaacccgcataccagaatcctcgtcgcaaagccgaacattccgtatccgtgcatctggacgagcaggactggaatcctaccatgcacaaaagccttctgggcaatgatcagacgcagtccgaggtccagtccggcaccctcgaagccggagtagaccgggtcatttctcagaccgtggacccgaaactgaatcatattctcagaccgcctgttgaaggggccatccacgagtttctggaggccagaaaaaaaagctctagcgcaagctccccaacacgcgcccagcgggcccgcaccctgcagctctacccttag

SEQ ID NO: 50031 - DNA, 84 bp, Artificial Sequence
  Description of Artificial Sequence: Synthetic coding sequence
tgctggggcttctactacatcctgtacctgctgtacatcatctacctctacaatatttatattctcaaaacccgcagctattag

SEQ ID NO: 50032 - DNA, 108 bp, Artificial Sequence
  Description of Artificial Sequence: Synthetic coding sequence
atcgtgctgctgctgttcatctgcttcctgagcaagctgaacttcaccgtgctcgaaaagttccctaagtccaccttcctgtgcaagattcagcacgaaagtctgtag

SEQ ID NO: 50033 - DNA, 570 bp, Artificial Sequence
  Description of Artificial Sequence: Synthetic coding sequence
atgtgcgccaagcggctgcggggccccttccggatcttcctgcccctcaggaagtattcttttttccctagccaagtggctcagccatttgcatccgccgccgtggcccaggccttactgagctctcctggtacaaatctgcagcagactcttgtgggtggcctgaggttgcgacatgggagtgttggtggtgctcaatgggtggtgaaggcggcttgcccgtgggagccccaggatgtggcatgctgcggcggcttcaccgtaaccgcaaggattgccgcctgcgtcctcctctgtctttgcgaacacatgtacactcccagcgcccacgcgcgtatgacgtttggcacagagcacttgttgctatggccagcccaacggcgagcggaccctagaaccgcagctcctataaggctccaccagggacagctcgaccctagccgggatcccgagaacctcagggcttgggcggttggttcatgcagagcaggcgtggagctccatgggagccctgttcatcttcacatgcgtgcgggccaacacatcagtatgtttgcaggggttgcgtag

SEQ ID NO: 50034 - DNA, 3285 bp, Artificial Sequence
  Description of Artificial Sequence: Synthetic coding sequence
atggccgcccgggccccccccgccgcccccgccgccgaggagcccgggaacccaggaggaccccctagaaggaagaaatctagatcaggggcatctggactgaggagagccttttcctggctgcgcggaaagcggcggaaaaaaaaggctgccggtgcagagggagcagagccggcagccccccgcgctaaaaaggctgaggacaaagccaagagagctaagggcaaaggcaggggatcggcaaaggccgaaaacgataaacatctgtccgtggggcccggccaggggcccggcagcgcggtcgacgagcaccaggataatgtgttttttccatctggtagacccccgcacctagaggagctccatactcaggcccaggaaggattaaggagtctgcagcatcaggaaaagcagaagttgaataaaggcgggtgggatcacggcgatactcagtccatccagtcatctcgaactggacctgacgaggacaacatctccttttgctcacaaactacaagctatgtggctgaaagctccaccgctgaggacgccttaagcatacggtccgagatgatccagcgcaaaggaagcaccttcaggccgcacgactctttcccgaaaagcggcaaatctggccggcggcgccgagaaaggcggtccaccgtgctgggcctgcctcagcatgtacagaaggagctaggactgcggaatgagagggaggccccagggacaccaagagccccgggtgctagagatgctgtccgcataccaaccgtcgatggaagaccgaggggtacgagcggtatgggcgcacgcgtctctttgcaggccctggaggccgaggctgaggcaggggctgagaccgaggccatgctccagaggcacatcgaccgtgtttatcgggacgacacatttgttggacggagtactggcactagggctccaccacttactcggcctatgagcctcgcggtgcccggtctcaccgggggagccggccctgctgagccgctgtcgccagcaatgtctatctcaccgcaggccacttaccttagtaaactgattccacacgccgtcctgcctccaaccgtagatgtcgtcgccctgggaagatgtagcctcaggaccctgagcagatgctctttgcactctgcttccccagcctccgtgaggtcactggggagattttcttccgtgtcctcaccccagccaagaagcagacaccccagtagttccagcgatacttggagccattctcagagctctgacactattgtgtccgatgggtctacgctgtctagcaaaggaggttcagaaggtcagcctgaatctagcaccgcaagtaattccgttgtgccccctccacagggtggctctggacggggcagtccttctggggggtctactgccgaggcttctgataccctgtccatccggtcaagtggccagctgtccggccggtcagtgtctctgaggaaactgaagagaccaccgccacctccacgtcggacacactctctccatcagcgcggcctcgctgtgcctgatggccctctcgggctgccgcccaagccggagcgtaagcagcagcctcagctgcctaggccacccactaccggcggttccgaaggggccggggcagcaccgtgcccccctaaccctgctaattcttgggtccctggcctgagcccgggaggcagtagacggccgccacggagtcctgagcggacactgtccccaagctccggatatagcagccaatctggcactcctaccttaccccctaaaggactcgcaggacctcctgcgtcccccggtaaagctcagcctccaaagccagagcgggtgacttccctgagaagtccaggcgcatctgtctcctcctccctgacaagtttatgctcctcatcttctgatcctgcaccaagcgacagatccggcccacagatcctcacacccctgggggatcggtttgtgattccaccacaccccaaggtgccagccccattctcgcctcctccatcaaaaccacgcagcccaaatcccgcagctccagccctggcggcacccgccgttgtcccggggcctgttagcaccaccgatgccagcccccagagcccaccgactccgcaaacaaccttgacccctctgcaagaatcccctgtgatcagtaaagaccaatctccacctcctagtcctccgccctcttatcacccacctcccccccctacaaagaaaccagaggtggtggtggaggcccccagtgctagcgagactgctgaggaacccttacaggacccgaactggccacccccaccaccacccgcccccgaagaacaggacctgagcatggctgactttccccccccagaagaggccttcttctccgtagctagccctgagccagctggtcccagtggcagcccggaacttgttagctctccagcagcttcttcatcaagcgcgactgccctacaaatccagcctcccgggtcaccagatcctccccccgctccaccagcccccgcccctgcaagtagtgcgcctggccatgtcgccaagttgcctcaaaaggagcctgtcggatgttccaagggcggtggtccgccaagagaagatgtgggcgcaccacttgtcaccccctctttgttgcagatggtacggttacggagcgtcggggccccggggggcgctcccactcctgctttgggcccctccgccccccagaaacctctccgaagggctctctccgggagggcttcaccagttcctgccccttcttcgggactccatgcggccgtgcgactcaaggcttgctctttggccgcatccgaaggactgagtagtgctcagcccaatggaccacctgaagccgagccccggcctccacaatctcccgccagtacggccagctttattttctccaaaggaagccggaagctccaactggaacggccggtttcgccagagacacaggccgacctccagcgcaatctcgtggctgagctgcgcagcattagcgagcagcgcccaccacaggctcccaagaaatctccaaaggcgccaccgcccgtggccaggaaacccagcgtgggcgtgccgccccctgcgagtcccagctaccctagagctgaaccgctgacagccccccccaccaatggcctccctcacactcaggatcgcacaaagcgcgagctagccgagaatgggggagttctccagctggtggggcccgaagaaaagatgggcttgccaggcagcgactctcaaaaagagcttgcctag

SEQ ID NO: 50035 - DNA, 942 bp, Artificial Sequence
  Description of Artificial Sequence: Synthetic coding sequence
atggagtactactactgccccagcctgctgaagctgctgcggtacctatgggatcaacttaagcagtgcttcagtaggcaaccgactgagccaaaagacacggacaccctagtgcacgaggctggctcacagtacggaacctggaccgagcagtgtcaatcaggcgaatcgctcgcaacagagagccctgactcttctgcaacctctacacgaaagcaacccccctcaagtcggctttctagcctgtctagccagacagagcctacttccgcgggggaccaatacgactgttcacgagatcagcgttctacgagtgtggatcacagctccactgacctagagtcaacagatggcatggagggcccaccaccaccggacgcttgccccgaaaaacgagtcgacgactttagttttattgatcagactagtgtcctggattcctccgctttgaaaactcgtgtgcaactctccaaacgctccaggcgacgcgcgccaatctcccacagcctgagacgttctaggttcagcgaaagtgagtctcgttcacccctggaagatgagactgacaacacatggatgttcaaggattccactgaggagaaatctccaagaaaagaggagtctgatgaagaagagaccgcaagtaaagcagagcgcactccggtgtcccacccacagcgaatgccagcatttcccggtatggaccctgccgtgttgaaagcacagctgcataagcgaccagaggtggatagccctggggagaccccctcctgggcacctcagccaaaatctcccaaatccccattccagcccggggtgctggggtctagagttctccctagctctatggataaggacgaacgatccgatgaaccaagccctcagtggttgaaggagctcaagagcaagaagagacagtccctgtacgagaaccaggtgtag

SEQ ID NO: 50036 - DNA, 1170 bp, Artificial Sequence
  Description of Artificial Sequence: Synthetic coding sequence
tgcgagaagagcaccttcttcaagcaccagaagcggacccacaccgtggagaaaacatttgaatgctcacacgggaagaaaagtttctgtcaggaatcccactttactgaacaccatcggacgtgtactcgagagaagccatgcgaatctaacaagtacgggaaaaccttccatcagaagcgtagctttattcaccatcagaggacccatactggcgaaaaaccttatgaatgtaaagagtgccgcaaaagctttcatgtaaagcctaacttgacaaagcaccaaaagacacacattggggagaagcccttcaaatgtaccgcttgcgggaggactttcttccagcagtccactttgaatgtgcaccagggtaaacataccgaagagaagccctataaatacacagaatgcgaaaagtcattctacaaatctgttctgataattcacgagaggacacatacgggagagaaaccctgcggatgcaacgagtgtgagaagagtttcgaggtcctgaccaccctagtgatacaccagaggacgcacacaggcgaaaagccctacaaatgtaacgagtgtgagaagagctatctcaacctgaagtcacacctaaacatacatctcaggaaccataccggcaagcgacctcacgtctgtaacgaatgcggcaaggcctttagcatgaagtccacacttacagtccatcagcgaacccatatgggtaagccttataaatgtaacgaatgccgcaaatcattttacatgaagagcgccctttcacagcatcagagaattcatatctataaaaagccctacgagtgcaagcagtgtggcaagacatttcaaaaatctcatctgatagagcatcagcgcacacacccgggtgaaattcctcacgaatgtaacaaatgcggcaagagcttttgctacaaatcaccattgaccatacaccagaggactcacattgaggaaaaaccttataagtgtagtaagtccgttacctacttttgcatgaagagccatctcaccgtgcaccaaagaccccacacgaggaagaatccgttcgagtgcaacgagtgcagaaaaatgttttatgtgaagtcgaatctgatcaaccatcaacgcacgcacactggggagaagccatatgagggcaacacgtgtggcaagtag

SEQ ID NO: 50037 - DNA, 96 bp, Artificial Sequence
  Description of Artificial Sequence: Synthetic coding sequence
atgagcgagaagaccggcgagcccgccgccgagaaccgggacaaggaagcttccgtagccggtgctcagataacgttacaaacacaaacaccctag

SEQ ID NO: 50038 - DNA, 2157 bp, Artificial Sequence
  Description of Artificial Sequence: Synthetic coding sequence
atgagccggggctacagcgagaacaacaacttcctgaacaacaacaatcagatggttcttgatatgatcctgtatccactcataggcatcccacaaacaatcaactgggagacaattgctaggctcgtccccggccttacaccaaaggaatgcgccaaaaggttcgacgagctgaaaagtagcggttctagcccagtagataaccagtacaattccctgatggctgctggtgaatcccccgtcgagacacttgctacctacatcaagtcgagcttactggatatccatggcgagttccaggagacccctgttggtcacgatgctgtctctaagacaggacgacactccattgcttccacccgcaactgctcctccgagtctgaaaattgtaccacccataatggcggcgagatgaccgaggaatcggaaggcccaaacatggtgatccatgtctgcgacgaggccaagaatcttaaggaggactttacgtgcccacgggacttgctgataagcgaaatgaaatatttcgcagaatatctatccatggacgcgcagcggtgggaggaggtcgatatatccgtccactgtgacgtgcatatttttaattggctgataaaatacatcaaaaggaacacaaaggagaataaggactgtgaaatgcccacattggagcccggtaacgtgattagcatcttgatcagctccgagttcttaaaaatggatagcctcgtcgaacagtgtattcaatattgccataagaacatgaacgccatcgtagccacaccttgcaacatgaattgtatcaatgcaaaccttctgacgagaatcgcagatctgttttcccacaatgaagttgatgatctgaaagacaaaaaggataagtttaaatcaaagctgttttgtaagaaaatcgagcgcctcttcgatcctgagtacctaaacccagattctagatccaacgctgccaccctgtatcggtgctgtctttgcaaaaagcttctgaccaaagagaccgagagaagaatcccttgcattcccggcaaaataaacgtggatagacggggcaacatcgtctatatacacatccgggacaagacatgggacgttcacgagtatctcaatagcctcttcgaggaactgaagtcttggagggacgtgtactggcgcttgtggggaaccatcaactggctgacctgcagccgttgctaccaggccttcctgtgcatagaattcagtcactgccagtaccactccgaaactgtcgtataccctactgctgcgtcttctctcaatacagtcggcacgggcatctacccatgttgtaatcagaaagttctgagattcgatccaacacagctgaccaaggggtgtaaagtgcgcgatcatatggtgaccctaagggaccaaggggaaggtggagacttaccaagttgtcctaccgcccggatgctggatgacctccacaagtatagagacgttatcgttgtgccgttctccaaggataccgtgtccgatgttggggtgggactgtgtgacgaaaagggcatagaatgtgatgtgctcctcgagccaaacactccatgggggcccaagactggcgagctgaacgcgtttctgagtcttaagaactggaccctgcagttaaagcaacagtccttattctctgaggaggaagaatatacaacaggcagcgaggtcacggaggatgaggtaggggatgaagaggaggtgtccaaaaagcaaaggaagaaggagaagccaaagaagtttactcgccagccaaagaagcaggtgagttctccttgtgctcagcggaaagaaaaagctctagagaagtctgcgtcccgggacgtttccccctttgttatgtctatgcagaagaacaaatgggatgccacccgctccctccgctttaatcaagacgcccagcgcgaagatgatcagcggagaatgaccgaaatcacaggccacctcatcaagatgcggctcggggatttagacagagtgaaatcaaaggaagcaaaggaatttgctggaggcatctactccagactggaggcgcagatcaaagcatcagtgccagtgagcgcccggcagtcaagtagcgagaaaaacacaaggagtaaatccagatttggtcaaggccgccccgcctag

SEQ ID NO: 50039 - DNA, 5130 bp, Artificial Sequence
  Description of Artificial Sequence: Synthetic coding sequence
atgcgggccggctggaccccccggggcttcagcgccttccacgccagcctgctgcctggcaggcacccatatctggcccacctgggaccccgtgatagaggagcgcgaatcgggtcgcgggcctacagccagggctgctgttcgtgcctgtggctgacatacaagggtaagaaggaggggagcaccaaaggcgagctgggccccgctgccgtcacagatctcgagatacccagctacagcagggggtttctgccctgtactcctcgattccccacaacttggtgccgggggcctggatgcttctgtggtaccgccgtgattgccggaaacttaggcgacttggccagaattgtcgggccttctcaccatgcatcacagctccttttgcttcaggaacaagactcagggaatcatccaacgatggccgagtcattgtctgaaatttctgactccctcgatgtgctcgaggccggcgacgaaggcaagaagaagtgtaagttcaaagcactgaaaagcttctttgtaaagaaaaaggagaaagaagctgaggatacccaagaagaagaaatgctggagctcagcctttcctcttcaaacatcaacataagtagtttgcagccagtgcgagagaaccagcctaccaaggcgcgggctaagtcaagcatgggctccaaggccctctcgcatgactcaatattcatgcttggccctgagccagagaggagcgcttctaaaatgttcccaagtatggatccgcagagggggagaccacagcagagatctcacatcagcaggacgctccccaaaccaaggtccaaggtgccgggagtcgtcagtggggcaatgtctggagccgtgttacagaatgttcccacgtcagccgtgtgggttgccggacccaaaattactgagaaccccccttctcgtcggagacgactgtcaataattcctcccgtaatacaacccgaaattattagcaagaatctggtggagatctctctggatgatgaatctcccaagaaccctcagaagaaggccttgcctcataagtcgcttactgctacacagtctttctccgagttgtccagtggccctgattgtagccagtcactgacggctttcgcgactcttgcctccaccagctccacgcagctgcccattgggttcagtaccccagccactacccaagggtgtcttgatagttcagccgctagacacaaaatgaccctgaaccccaggaagcagaaaaagaacctgcaagtaattatcaggggcctacctgtatggttttcacattttcaagggatcctcgaagggagtctgcaatgtgtgacacagacactcgagacgccaaatcttgatgagccgcttcccgtggaacccaaagaagaagagcctaatcttccactcgtctctgaggaggagaaatctatcacaaagccgaaggagatcaatgagaagaagctgggtatggactcagccgactcatcctctcagaagcagaataacaagaccgaaatgtacgataagaagactactgaccaggcaccgaatacagatgcctcccgtagccagggctatccaatgagcgccgcatacggccggcggtggagaaggaagggggcctccgtatcagggctttcgggctgcgaatttaagggtcgtagcctcaagcaaagttccgaggggtatggcttgggggacagggccggatctagcccaacaaacaagactgccagaaacgtaccattcagccacttgagcctggaaaaggacaatatggaacagccaacaaccagtcagcctgagacgaccacccctcaggggcttttatcggacaaggacgacatggggcggcggaatgccggaatcgacttcggctctcgtaaggccagtgccgcccagcccattccagagaacatggacaatagcatggtctccgatccccaaccttaccacgaggacgctgcaagcggcgctgaaaagacagaagcacgggcttcgttgtccctcatggtggagagtctgagcactacccaagaggaagctattctgagtgttgccgctgaagcccaggttttcatgaacccaagtcacatccagcttgaagatcaggaagctttttcgtttgaccttcagaaggctcagtccaaaatggagtctgctcaggacgtgcagacaatctgcaaagagaaaccctcaggcaatgtacaccaaaccttcaccgccagcgtcctcggtatgacttccacaaccgccaaaggggatgtatatgctaaaacactgccgccccgctctctgttccagtcatctagaaaaccagacgccgaggaggtgtcctcggattccgagaatatccccgaggagggagatggttccgaagaactagctcacgggcattcatcccaaagtctcggcaaatttgaggatgagcaagaagtattctcagagtccaagtcatttgtggaggatctgtctagttctgaggaagagctggaccttcggtgcctttcacaggctctggaagaacctgaggatgctgaggtctttaccgagagtagctcttacgtagagaagtataacacctctgatgactgctcctcatccgaggaagatctgcctctgcggcatcccgctcaagccttgggaaagccaaagaatcagcaggaggtcagctctgcatccaataataccccggaagagcagaatgatttcatgcagcaactgccaagccggtgtccaagtcagccaattatgaacccgaccgtgcagcagcaggtgccaacaagttccgtaggcacctcaatcaagcaaagcgactctgtggagccaattcccccgaggcacccattccaaccttgggtgaaccccaaggtagaacaggaggtctcaagctctccaaagtcaatggcggtcgaagaaagtatctctatgaagccactcccccctaaactgctgtgccaacctttgatgaaccctaaggttcagcagaacatgttttccggttccgaggatattgctgtggaacgagtaatttctgtggagcctctgttgcccaggtactcaccacagtctctgacagatccccagatccgtcagatctcagagtctacagcggtagaagagggaacatatgtagagccactccctccgcggtgcctcagtcagccaagcgagagacccaagttcctggactcaatgagcacatcagccgagtggtcatcccccgtggcccccacccctagcaagtatactagccccccatgggtcactcccaaatttgaggagttgtaccagctgtcagcccatccggaatcaacaacagttgaggaagatatctcaaaggagcagctgcttcctagacatctgtcacagctgacagtcggaaacaaagtccagcaactgtctagtaactttgaacgagcagctattgaggctgacatcagtggatcaccactgcccccgcagtacgctacccagtttctgaagaggtccaaagtgcaggaaatgacctctaggctcgaaaagatggcagtggaaggtacatcaaacaaatcacccatcccaagaaggccgacccagtcttttgtgaaatttatggcgcagcagatcttttctgagtcctccgccctgaagagaggttcggatgtcgctcctctgccaccgaacctcccctcgaagtctctctcaaagccagaggttaaacaccaagttttttctgacagtggaagcgccaatcccaaggggggaatttccagcaagatgctgcctatgaagcatcctctacaaagcctgggtagacctgaagatccacagaaagtgttctcctacagcgagcgggctcccgggaaatgctcctctttcaaagagcagctgagccccagacagctgagtcaggcgctgagaaagcctgagtatgagcagaaggtgtccccagtatctgccagtagcccgaaagaatggcgaaatagtaagaagcagctcccgcccaagcactctagccaggcctcagacagatccaaattccagcctcagatgtcgagtaaggggcccgtgaacgtgcccgttaagcaaagttccggtgaaaagcacctcccgtcctcgtctcccttccaacagcaggttcattcctccagcgtgaatgccgctgcaagaagaagtgtctttgagagcaactcagacaactggttcctgggcagagatgaagcgttcgccatcaagaccaaaaagttttcacagggttcaaaaaatcccatcaaaagtattcctgcacctgcaaccaaaccagggaagtttaccattgccccagtgaggcaaaccagcacaagcggggggatttattctaagaaggaggatctggaaagtggagacggtaacaacaatcaacacgccaacctcagtaaccaagacgatgtcgagaaacttttcggcgtacggctcaagagagcgcccccatcccagaaatacaaaagcgaaaaacaagacaactttacccagttagccagcgttccgtccggtccaatctcctcctcggtggggcggggccacaaaataaggagcacctctcaaggtctgttggacgccgctggaaatctgaccaagattagttatgtagccgataaacaacagtctagacccaagtcagaatctatggcaaagaagcaacccgcatgcaaaacgcctgggaaacccgcaggccagcagtcagactatgctgtgtctgagcctgtctggattaccatggctaaacagaagcagaaatccttcaaggcgcatatttccgtgaaggaactgaagaccaaatccaacgctggcgccgatgcagaaactaaagaacctaagtatgagggcgcagggagtgccaacgagaatcagccaaagaagatgttcacatcctccgtgcacaaacaagaaaaaacagcccagatgaagcctccaaaacccacaaaatctgtgggtttcgaggcccagaaaatccttcaggtgcctgctatggagaaagagactaaaaggtcaagcacgctgccagcaaaattccaaaatcccgtggaacctatcgagcctgtctggtttagcctggcccggaaaaaggctaaagcctggtcccacatggcggaaatcacccagtag

SEQ ID NO: 50040 - DNA, 5421 bp, Artificial Sequence
  Description of Artificial Sequence: Synthetic coding sequence
atggccacccgggtggaggtgggcagcatcacccccctgaccgccgtccctgggcttggcgaaatgggaaaagaggagacactgactcgaacctacttcctgcaagcaggagaggcctctggagcaccgcccgcccggatcctggaggctaaatcaccactccggagcccagcaaggctgctgccgcttccgaggctggcacccaaacccttttccaaagagcaggacgtgaagagccccgtcccttctttgagaccgagctccacaggcccatccccctccggcggcctgtccgaagaaccggccgccaaagacttggacaaccgtatgcctggactcgtaggccaagaagttgggtcaggcgaggggccgcgcaccagctcacctctgtttaacaaagcagtattcctgcggccttcctctagtacaatgatcttatttgagaccactaagtccgggccagcgctcggcaaggctgtgagcgagggcgcggaagaagctaaattaggggtgagcggaagccggcccgaggtcgccgcgaagccagctctgcctacgcagaagccagctggtaccctgccgcgaagtgcgcctctctcccaggacacgaaaccacctgtaccgcaggaagaagccggccaggatcatcctccttcgaaagcctcctccgtggaggacacggctcgacctttagtggaaccgaggcccagactcaaaaggcgccctgtctccgcgatcttcactgaatccatacaacctcaaaagcccgggccaggggctgctgccaccgtcgggaaagtccctccaactcctccagaaaaaacgtgggttcgcaagccccgaccactcagcatggaccttacagcccggtttgagaataaggaagctctgcttcggaaagtcgctgacgagggttcaggccccacggccggcgatatggcgggcctggaaaggcctcgggcagccagcaagctggatcgggattgcctagtgaaggccgaagccccactgcatgaccctgacctggattttcttgaggttgcaaagaaaatcagggagaggaaggaaaagatgctgagcaagcctgagatgggatctcctagggccttagtaggcggctcttctggggtaacccccagtaacgatcagtccccatgggaagaaaaagcaaagctggatccggagccggagaaggccgctgagagtccaagccctcggttagggagaggtcttgagctagccgaggttaaatcacgtgtcgccgatggcgaggcagctgctggcggggagtgggcttcaaggcggtccgttcgcaagtgtatctcattgtttcgggaggacagtaccctggccctcgccgttgggtccgaatctccactggccacacctgcctctccctctgctgcaccagagcccgagaagggggtcgtcagtgtgcaggaaaggatccgcggatggaccgctgagtcatccgaggcaaagcctgaagtgagacgcagaacctttcaggcgcgcccgctgagtgcagatctgacaaagctgttctcctcatccgcctctagtaacgaggtgaaatacgagaagagtgcagagctgagcggtgagttccccaaagaaccaagagaaaaacagaaagagggacattcgctggacggcgcctgcatccccagatccccttggaagccaggaaccttgcgagataaaagccggcagactgagcagaaagtttccagcaatcaggaccccgacagctgcagaggcggtagctccgtggaggcgccctgtccttccgatgtgacgcccgaagacgaccggagttttcagactgtgtgggccacagtcttcgagcaccatgtggagcggcacacggtggctgatcagtcaggtaggtgtctatccaccaccccgcccggcgatatggcacacgcaagagtgtctgagcccaggccccggcccgagatgggtagctggctcggacgggatcctcctgatatgacaaaattaaagaaggaaaacagccgtggcttcgataaccctgaaacggagaagctgggtcccacgacccttctcaacggcgagcttaggccataccacactcccttgcgggacaagtaccctctgtcggaaaatcacaacaacaacacctttctgaagcacttggagaatccccccaccagccagagaatcgagccacgatacgatattgtccacgccgtcggtgaacgggtacactcagaggccatctctcccgcgcctgaggaaaaagcagtcaccctgcggagcctgaggagctggttgtccttgaaggatcggcaattatcacaggaagtgactccggcagatctcgagtgcggactcgagggtcaggcagggtccgtgcagagagcctctcttatttgggaggcacgtggaatgccggaagctagcggaccaaaatttggcggcaactgcccttttcctaaatggacgggaggtgccgtggtctcttcgcacaaggccacggtcgctgtcagcgaagagcactgcgctcctggagcaactagcgttcgggctatcaaagcagctatttgggagtctcagcacgaggggcccgagggggcacggtccaaaccaggcgtcggggccaggggcccaccccagggctgccccctggaccccctgtcccgggcaaccaacgggccgtcagactctcaggcacgcacacatccagatgccttcgcggtacaaaaaggcccttttatcgttgctgcccgggaaggggaccccggccccgcccaggtgccacagcccgcagtgcggatgaggaaggcaggtgccatggatcaacgaatggatcggtggcgcagaaggaccctcccacccaacgtcaagttcgatacctttagcagtctcgtgcctgaggactctccgcatgttggccataggcgcacggactacgtgtctcccaccgcgagcgcgctcaggaaacctcagctgtcacactaccgggtagagacacaggaggtgaatccaggagccagccgtgaccagacgagcccagccgtgaaacagggctctccggtggagcccaaggccactttttttgcagtgacgtatcaaataccaaatacacaaaaggcaaaaggagtggtcctctcgggggcagaatcattgctagagcattccagaaaaattacccccccatcaagcccgcactccctcacttctaccttggtgtctctgggccatgaggaggccctggaaatggccggctcaaaaaattggatgaaaggaagagaacatgagaacgcaagtatactaaagactttgaaaccaactgaccggccctcctccctgggggcctggtctctggacccctttaacgggaggatcatagacgtagacgccctttggagccatcggggctccgaggacggtccaagaccccaaagtaactggaaggagagtgccaataaaatgtccccctccgggggtgcaccacagaccacccccactttacgatccaggcccaaggacctgcccgtgcggcgcaaaaccgacgtgataagcgacacctttcctggtaagattagagacggatataggtcttcagttctggacattgatgcccttatggcagaataccaagaactgagcctcaaggtaccaggcgaggcccaggagcgacgcagtcccaccgtcgaacccagcacactgcctcgggaacggccagttcagctcggtggcgtggagcaacgaaggcgtagccttaaggagatgcctgacacaggcggcctgtggaaaccagcatcctcggccgagatcaaccattcatttactcctggcctcgggaagcagctagccgagacccttgagaccgccatgggcaccaagtccagtccaccattctgggcacttcctccatccgcacctagcgagagatatcccggcggcagccctataccggcagaccccagaaagaagacggggttcgctgaagatgaccgaaaagcattcgcctcaaagcaccacgtggcaaaatgtcagaactatcttgccgaatcaaagccatccgggagggaagatccaggctcaggcgtcagagtgagccctaagtcacccccaaccgatcagaaaaaaggcacacctcggaagtctaccggacgtggggaggaagacagtgttgcccagtggggcgaccaccccagagactgcggcagagtgccattggacatcaagcgggcctattccgaaaagggacctccagccaacattagagaaggcttgagtataatgcacgaagctcgtgaacggcggcgtgagcagccaaaaggcagacccagtctgacgggtgagaacctcgaggcaaagatgggcccctgttggtgggagagtggtactggagattcccacaaagtgttaccgcgagatcttgaaaaagaagacgcgccgcaagagaaagaacggccactccaacaggtgagccctgtggcttctgtcccctggcgttctcacagcttttgcaaagataggcgctccggccctttcgtggaccagctcaagcagtgtttcagcagacagccaaccgagcctaaagacacagatactcttgtgcatgaagcaggcagccagtacgggacctggacagagcagtgtcagagtggggagtcgctcgcgacagaaagtcccgattcaagcgctacatcaactagaaaacagccaccttcaagccgtctttctagtctatcttcccaaacagagcccacttctgccggcgaccagtatgattgttcgcgggatcaaaggagtacttctgtcgatcacagtagcacagatctagagagtaccgatgggatggagggccccccgccccccgacgcttgccctgaaaagagagttgatgacttttcctttattgatcagacatcggtgctcgatagctctgcccttaagaccagggtgcagctgagtaaaagatccagacgccgggctcctattagtcactctctgcgcagaagccggttttccgagtccgaatctaggtctccactcgaagatgaaacggacaacacttggatgtttaaggattctaccgaagaaaagtcaccacggaaggaggagagcgacgaggaagagacagcttccaaagcagaacgcacacccgtctctcatcctcagagaatgcctgcatttccaggcatggaccccgctgttctcaaagcgcaactccataagcggccggaggtggactcacctggggaaacaccaagttgggccccgcagcctaagtcaccaaagtcacctttccagccaggcgtgttgggtagtagagtactgccaagctcaatggataaggacgagaggagcgacgaaccctcacctcaatggctgaaagaactgaagagcaagaagcgccagagtctctacgagaatcaggtgtag

SEQ ID NO: 50041 - DNA, 4230 bp, Artificial Sequence
  Description of Artificial Sequence: Synthetic coding sequence
atggagagcgaccggctgatcatcagcctgccccgggtgaagtggactgaagccgccctgaccatggccagccagttgcaggagaagtgcattgccttcatcgtagacaatttttcaaaaatcattcagtccgagaatttcgctctcctgcttcagagtcaggccatgagctcaactgcggatcttcttgacaccatcctgaaggctatcgaagagaacatcaccactgagaattcatgttctctgttaatggcactggacaccctgctgaactctgactctactaaagaaatggggtttacctgcaagatacaagctcttcgagataagctctggattttcctggtgcagtcattctacgcagttaggcacactgagtcttggaaacttatgtctactgacgatcagcagaagatccaagccgccgcatttgacaaaggcgatgaccggagattagggaagaagcctatcttcagttcctcccagcagcgcaagcaggtatccgacagcggggatattaaaatcaagtcatggaggggaaataacaaaaaagaatgttggtcatacctatccacaaacaagaaaatgaaatccgacggcctcggcgcatccggacactcctcctctacaaacagaaactccatcaacaaaacgctaaaacaggacgacgtgaaggagaaggatgggaccaagatcgcctccaaaattactaaggaactcaagacaggaggcaaaaatgttagtggaaagcctaaaactgtaacaaagagtaagactgagaacggcgataaagctcggcttgaaaacatgtctccacgccaggtcgtcgagcggtccgctaccgccgccgccgccgcgactggacagaagaacctgctgaacggaaaaggagttagaaaccaggagggacagatcagcggcgccagacccaaagtattgactgggaacctaaacgtgcaagccaaggcaaaacctctgaagaaggccactggcaaagactcaccgtgcctcagtatcgccgggccgtcatcgcgttctactgattcctctatggaattttccatatctactgagtgtctggatgaaccgaaagagaacggcagcacagaagaagagaaacctagtggccataaactgtccttctgcgattcaccaggacagatgatgaagaatagcgtggactccgtgaaaaatagcaccgttgctatcaagagtcgtcctgttagccgggtgaccaatggaactagcaataagaagagcattcacgagcaggatactaacgtcaacaactcagtcctgaaaaaggtcagcggcaagggatgcagtgagcccgtcccccaggccattttgaaaaaaagaggcacatcgaatggttgcaccgccgctcagcagaggactaaatcaacgcctagcaatctgacgaaaactcagggaagccaaggtgagagccccaattcggtcaagtcaagcgtgtctagccgccagagcgatgagaatgttgctaaactggatcacaacactactacagagaaacaggctcctaagcgtaagatggtcaagcaggtacatactgctctgcccaaggtcaacgcgaaaattgtggccatgccgaaaaatctgaaccaatccaagaaaggcgaaacgctcaacaacaaggactccaagcagaagatgccacccggtcaggttatctcgaagacccagccatcatcccagcgacctctaaaacatgaaacaagcactgttcaaaagagcatgttccacgacgtcagggacaacaacaataaagactctgtctcggaacagaagccgcataagccactgattaatttagcaagcgagattagcgatgccgaggctctccagagctcatgtaggccagatcctcagaagcccctaaatgatcaggagaaggagaagcttgccctagaatgtcagaacatcagtaaactcgacaagtccctgaagcacgagctcgaaagtaagcagatctgcctggacaaaagcgaaactaaatttcccaaccataaggaaaccgatgactgcgacgccgctaacatctgctgtcacagtgtaggtagcgacaatgtgaattctaaattctacagtaccacagccctgaagtatatggtctcaaaccccaacgaaaacagcctgaattcaaatcctgtctgcgatctggatagtacctccgccggccagatccacctcattagcgatagggagaaccaagtgggcaggaaagatactaacaaacagtcgtcaattaagtgcgtcgaagacgtctccttatgcaatcctgaacgcacaaatgggaccttgaattccgctcaggaggataaaaaatcaaaggtgcccgtggagggactgacaatcccgtctaagctgtcagacgaaagcgcaatggacgaggacaaacacgcgacagctgattccgatgtgtctagtaagtgttttagtgggcagctgtcggagaaaaacagtcctaagaatatggagacttccgagagccccgaatcacatgagacccctgagaccccattcgtcggtcactggaatctgtccaccggggtactccaccagcgggaatcccctgagagtgataccggctctgccacgacatcttcagacgatatcaagccacgaagtgaggactacgacgccggcggttctcaggacgatgacggatccaatgatcggggcattagcaagtgtgggaccatgctgtgtcacgacttcttgggacgtagctcttcggacacatccacacccgaagagctgaagatttatgactcgaacctgagaatcgaggtcaagatgaagaagcaatctaataacgatctgtttcaggtcaatagcacctccgatgacgagatccctagaaagcggcctgagatctggtcacggtccgcgatcgtgcactctagggagcgcgagaacatccctagggggtcagttcagtttgcccaggaaatcgaccaggtttctagcagcgctgatgaaacggaagacgagcgaagtgaggcagaaaatgtggctgagaatttctcgatcagtaaccccgcaccacaacagtttcaggggatcattaacctggcctttgaggacgcaaccgagaatgaatgcagagagttcagcgccacaaaaaagttcaagcggtctgtgctcctgtccgtcgacgagtgcgaagaactcggctcggacgagggggaagtgcacaccccctttcaggcatcggtcgatagctttagcccatccgatgtgttcgacgggatcagtcacgagcaccacggccgcacatgttactcaagattttcccgggaatctgaagacaatattctggagtgcaagcagaataaaggcaatagtgtgtgcaagaacgagagcactgtgctcgacttgtcctccattgactcctcgcggaaaaacaagcagtccgtgtctgctaccgagaaaaagaatactatcgacgtactgtcctcccgctctcgccagctcctacgcgaggacaaaaaagtaaataacggaagcaacgttgagaacgacatccagcaaaggtctaagttcttggactctgatgtgaaaagtcaggagcgaccttgtcacctggacctccaccagcgggagcctaactctgatattcctaaaaattcttccacgaaatcactcgacagctttcggtcccaggtcctgccccaggagggacctgtcaaagaatcccactccacaacgacggaaaaggctaatattgctctgtcagcgggagatatcgacgattgcgacacgcttgcgcagaccaggatgtacgatcaccgtccttctaagaccctgtcccccatatacgaaatggatgttatcgaggcctttgagcagaaggtagagtcggaaacgcatgtgacggatatggactttgaagacgatcagcactttgccaaacaagattggacccttttgaagcagctattgtctgagcaagacagcaatttggacgtaacaaacagtgttcctgaagatctttccctcgcccagtatttgatcaaccaaactctgctgcttgccagagattcttctaagccgcagggtattacccacatcgacactctgaataggtggtcagaactgaccagtccccttgatagttccgcgtcaatcaccatggctagctttagttccgaggactgtagcccccaaggcgagtggacaattctggagctggagacacagcactag

SEQ ID NO: 50042 - DNA, 369 bp, Artificial Sequence
  Description of Artificial Sequence: Synthetic coding sequence
agccacatcatgctgaacaacggcaccaagaccgacatgctgggcctggggacatggaagtccccccccgggcaggtggccgaggccgtcaaagtggctataaacaccgtctacaggcacatagactgctctcatgtccaccagaataaggaccaggaacagcttaaggagcaggtcgtacgcagagaatggctgtttattatcagcaaaccctggggtatttgccaccggaagtgtttggtaaggggctcttgccgtaaagtcctgagtggtttggagctggattatcttgatctgcatttgatacattggcccactggttgccaccccggtaaagaattctccttcttggacgagtccggcaactag

SEQ ID NO: 50043 - DNA, 3339 bp, Artificial Sequence
  Description of Artificial Sequence: Synthetic coding sequence
tgatactacctgaacgcccaggacggcgccggcggcgaggaggagaaggccgaaggcggagcaggcgaggaacacgatttattcgcggggcttaagcccttggaacaggaatccaggatggaagtgttgtttgcgtgcgctgaggccctgcatgcacatggttacagtagcgaggcctcacgcctcaccgtggagctggctcaggacctgctggctaacccacctgacctcaaggtggagccccctcccgcgaaaggcaagaagaacaaggtgagcactagcagacaaacttgggtagccacaaacacgctgtcaaaggctgcattcctactcacagtgctgagcgaaagaccggagcaccacaatctggctttccgggtagggatgttcgctctggagctccaacgccctccagcttcgaccaaggctctggaagtgaagctggcataccaggagagcgaggttgccgcactactgaagaagattcctttgggccccagcgagatgtccaccatgagatgccgagccgaagaactgagggagggcaccctgtgcgattaccgcccagtgctccctctcatgcttgcatcattcatctttgatgtgctctgcgccccagtcgtttctcctactggaagccggcccccctctcggaactggaatagtgaaacgccaggtgatgaagagctgggcttcgaagccgcagtcgccgccctgggaatgaaaaccactgtgagtgaggctgagcaccccctcctgtgtgaggggacaaggagggaaaaaggcgacttggccctcgccttgatgattacatacaaggatgatcaggctaagctgaaaaagatcctcgataagctccttgaccgcgagagccagacccataagcctcaaactctctcttccttctactcatcctctaggcccactactgctagccagaggtccccatctaagcacggaggtcccagtgcccctggagcgctgcaaccactcaccagcggtagcgcgggtcccgctcagccaggatcagtggccggcgccggtcccgggccgaccgagggattcacggagaagaatgtgcccgagagctctccgcattctccttgtgaagggttaccatctgaggccgccttaacaccccgacccgagggcaaggtcccctctcgcttagccctggggtctcgtggaggatacaatggtcggggatggggcagcccaggccggccaaaaaagaagcacaccggtatggcctctattgattcgtctgccccagagacaacctccgacagcagccctactctcagtcggagaccacttagaggggggtgggccccaactagctggggcaggggccaggattctgactccatttcttcgagcagtagcgattcactggggtcatcttccagctctggatcacggcgggctagcgcttcaggcggcgctagagcaaagaccgtagaagttggaagatacaagggtaggagacccgagtctcacgcaccgcacgttcccaatcagccatccgaagcagccgctcacttctactttgaacttgccaaaactgtgcttattaaggcggggggcaacagttctacatcaattttcacacacccatcctcttccgggggtcaccagggtccgcataggaacttgcatctgtgtgcattcgaaattgggctgtacgctctgggacttcacaactttgtttcccccaactggctctcccgcacctatagctcgcatgtgtcgtggatcacaggacaggccatggagattgggagcgccgctcttacaattctcgtggaatgctgggatgggcacctcacaccacctgaagtggcctctctcgctgaccgcgccagtagggctcgggacagtaacatggtccgcgctgccgctgagttagccctcagctgcctgccacacgcccacgctttgaatcccaatgagatacagagagcccttgtccagtgtaaggagcaggacaatctgatgctcgaaaaagcctgtatggcagtcgaagaagccgctaaaggggggggggtgtaccctgaagttctgttcgaagtagctcatcagtggttctggctctacgagcagacggccggagggagctcaacagccagagaaggcgcaacctcatgtagtgcatccgggatacgggctggaggagaagccggacgcggcatgccagaaggccgaggtggacccggtactgaaccagtaaccgtagccgccgccgctgtgaccgcagctgccactgtcgttcctgtaatttcagtgggctcttcactgtatcccgggccaggccttgggcatgggcactcaccagggctccatccatatactgctttacagcctcacctaccatgttcaccccaatatttaacccaccccgctcatcccgcacaccccatgccccacatgcccagaccggcagtgtttccagttccaagcagtgcctatccacaaggagtgcatccggcattcctaggcgctcagtatccatattccgttactcccccctcacttgccgctactgcagtaagttttccagtgcccagcatggcccccattactgttcatccatatcataccgagcctggcttacccttgcctacatctgtggcgtgtgaactgtggggtcaaggcaccgtctctagcgttcacccagccagtaccttcccagctatacagggcgcatcactacccgctttaactactcagccctcacccctcgtctccgggggctttccccccccagaagaagaaacacatagccagcccgttaacccacatagtctgcatcatctgcatgctgcataccgtgtgggcatgctggcccttgagatgcttggcagacgagcccacaacgatcacccaaataatttcagcaggagtcccccatacacggacgacgtaaagtggctgctcgggttggcagcaaaactgggggttaattacgtacaccagttctgcgtaggggccgctaagggagtgctctccccattcgtgctacaagaaattgtgatggagaccctgcaaagactaagcccggcgcatgctcataatcacctcagagctccggcgtttcatcagctagtacagcgatgccaacaagcatacatgcagtacatccatcaccggcttatccacctgacacctgctgattatgatgatttcgtgaacgcaatccgcagcgcaaggagcgccttctgtttgacccccatgggtatgatgcagtttaacgacattttgcagaatctgaaacgctctaagcagacgaaggagctgtggcaaagggtgagtctcgaaatggcaacgtttagcccctag

SEQ ID NO: 50044 - DNA, 660 bp, Artificial Sequence
  Description of Artificial Sequence: Synthetic coding sequence
ctggagaaggaggagaagaaccccaacaccgagttctacctgaagaaccttgttctaaccactttaaatttgttcgtcggcggcaccgagacagtttcaacaacactccattatgggttcctgctgttgatgaaacatcctgaggtcgaggcaaaggtgcacgaaatcgaccgtgtgattggaaaaaatcagcaacctaaatttgaggatagggctaaaacgttgtacactgaagcagttatccacgaaatacagcgattcggggatttactcccgatgggcgtgtctcggcgggtgaaaaaagacaccaaatttcgcgatttttttctctccaagggcattgaggtgttccccatgctgggcagcgtcctgcgggacctgcggttcttcagtaatccccgggatttcaacccacagcatttcctcggcgagaagggacagtttaagaaacgagacgcattcgtgccttttagcattcggaggcgaaattgcttccgcgaaggtttggcacgaatggagctcttcctttatctgacgacaattatgcagaattttaggtttaagagcaggcagtcccctaaggacatcgttgtgagccccaaacatgtgggctttgtcactattccccgtaattacaccaaatgttaccttccatgctag

SEQ ID NO: 50045 - DNA, 132 bp, Artificial Sequence
  Description of Artificial Sequence: Synthetic coding sequence
accgacttcctgcggacccagcccacccggacccgggtgaacaagcagccactgctactgactctctctctttttaaactcagtctgcagctggacgcgagaattaccttcggcgccgaatctccaggttag

SEQ ID NO: 50046 - DNA, 375 bp, Artificial Sequence
  Description of Artificial Sequence: Synthetic coding sequence
atgaccctgaacgagcacgccgccttcaagcacctgttcaacaaggcccatcttgcaccacccctgatccatctcacactgtctggccattcaacatgcttccgcgagcaccgggttggagggaaagttactgaccagcaggatcccaaggccgaggaattttttctggtgcagaataagatgaaaagcctcccatgcctacccctgtctacgcaaacgcagcagcctagtgatttcagtattttcagcccccccttcccgcctttctactccaccaagccacctttaagcagctggcctgtgctgaacgagctcttgggaaccccaccgcggtgggggggagggagagctgaaggcctgttaacaagccagtag

SEQ ID NO: 50047 - DNA, 621 bp, Artificial Sequence
  Description of Artificial Sequence: Synthetic coding sequence
ctgggcatcagcctgggcatcgaccaggacagcgccgccttcctgctgagcacgatggccattgccgaagtattcagacgcattggggctggtttcgtgctcaacagggagcccatacgggtgatctacatagagctaatatgtgtgattctattgactgtgtcactgttcgcatttacatttgcacgcgagttttggggcttgatgagctgttcagtctttttcggatttatggtcggcacaaccgggggaacgcacattccccttctggccgaagatgacgtcgtggggatcgaaaagatgagtagtgcagctggagtgtacatctttatacagtcaatcgcagggctggcaggcccccctctggcaggactcctagtggatcagtcaaagatttactcgagagccttttattcttgtgcagctgggatggccctggcagcagtgtgtctcgctctcgtgcgaccctgcaagatggggctgtgtcagcaccaccattccggtgaaaccaaagtggtaagtcatagaggaaagaccttacaggatattcccgaggacttcctggagatggatttagcaaagaacgaacaccgagtgcatgtgcagatggaacccgtttag

SEQ ID NO: 50048 - DNA, 582 bp, Artificial Sequence
  Description of Artificial Sequence: Synthetic coding sequence
atgaacatcttcatgaccttcgtgatcaacgtgctgcggaagaacctgttccatgggttcatggtgatcacacaggccccagttagaattcttcccagtcaggagagaattagaactccatgccacagccccgcaatcctattgtctagttgccgggtgctaagtggaaataattgtataatggccgctcttacaagtgtcatcaaacgcaatctccttttctttcgccttgatttgtttccactatggctgatctttctgtacattgttaaaatgggagacttcccctccgcccccactcatcttaacactgccgccatttgcacatgtctgctgcctatccccctgggcacgcatagcgacctgctttcagtgtcctgcagttggtttcacctgtttgagaaaggtccccctctttcgtataagcatcttgttcgacaggtgcatcctctaatgaatgctgacacggccgccggaggctttgtatatacttgcaaggacaagctcaggagcctgctcttcggcgaggtaaaggaggacggcaacgggtgcttcatatgcatgtccttggagcagtgctag

SEQ ID NO: 50049 - DNA, 99 bp, Artificial Sequence
  Description of Artificial Sequence: Synthetic coding sequence
gacaccgagaacagccccggcgagctgagcctgagccggaagaccgaggcacagagaggagaggccatccatccacagtctcattctcgggacgggtag

SEQ ID NO: 50050 - DNA, 915 bp, Artificial Sequence
  Description of Artificial Sequence: Synthetic coding sequence
atggtggccaccggctgggcccggcggagcggcctgcaccccgccccgcgccctctgcgtggcgcacaggaagccctggctaagaacttgtggagggaggaacggaatcgccctttgatcttatcctccctgatcataaaaaaactccactggccagaacaggagcttgctaagaaaagcatattgaacgccgaagattctcttatcatcgacaacaaacggagtattagccatctgtcatcaggtgtgctgaaggatatattcaccactggaacttcaagctataatgtgttgttgcagagcaaggaggagaagaagtaccactctcagaaacagtcgtctagtacctattcaaaaagatgtcggaagccctctaagtccccgaataccagccgctccaaggacccccggaggatgaaggccctggtccccgttacatcttcagggacctggtattgtctggagcgaaggccagccgtgtttgtgaccagttccgtatcctcacctgtcaagttcacccatgacatcagcgtcacgggaaatggaattgtcctgcccccaaagcctaaatccaaagtgaagtggtgtcatttcagcacgctccctaagccaaagcctcagctatcaagatctttcgaaaaaggtgacgatttcagcggaaagaaattctgtattttaacagctataaagcctaccaatctggagaaggaaaaactgaggttctttaagagcgactacacctacaaccctcagtttgagtacgcgaatccagctcttcccagcgtgctcgctaagcacagtcatgcaagcgacaggtttttaaaacaggtcaaatgtcactttaattcaggaagcagcttcctatgtactaagactataatctgcgacctgatttccaaaaataaggatatctag

SEQ ID NO: 50051 - DNA, 402 bp, Artificial Sequence
  Description of Artificial Sequence: Synthetic coding sequence
atgggccaggacgccggccggctgcagcggcggagccgggtgggcttcggcgaaaatggtgcttgcagaaaagagcgccaaaaactggcactcgaaggctccaaaaaaggcccctggaagggaaggtctggcgaccgcaagggtaactccaagggccaagaagaactcgggagaggcgctcgggttaatacggaatggcctatgccaaggatgcgggactggaaggagcggcggggacctagcagagaagaagcccacaaatcactgggcaggcaggggatgggcctgcagcgtggggaaggcgttcgagccgtcgccgcaagagtcctgtgtcatccatgcccactgagcaggggattacaacacaacaggggcgatcgtttcgtctggggccaagtctag

SEQ ID NO: 50052 - DNA, 255 bp, Artificial Sequence
  Description of Artificial Sequence: Synthetic coding sequence
atggtgctggccagcttcacccagaacatgaacatcaagtgctgcgagtttgtgtgtcaggtggtacagaagtacattattaataatctcgtgaagaaaaggaattgtgaaccttcatggtcagtgtacagtattttatgcctgtacgtgatcttttctagcaaccggtttattattatcggtttcacgaaacgatctaggaagaagtctgaaggtgagattgccagcaccgccttgcaggcaacttcaggatag

SEQ ID NO: 50053 - DNA, 156 bp, Artificial Sequence
  Description of Artificial Sequence: Synthetic coding sequence
ctgaagcccggcttcttcctgagcttcttcatcagcatgacctacctgtttagcttcttctttttcggcaagagctttcggtccctgctcggagagggctttagcttgtgcctctctttgagcctcacccacacccatactcatactcactcatag

SEQ ID NO: 50054 - DNA, 438 bp, Artificial Sequence
  Description of Artificial Sequence: Synthetic coding sequence
ggcgagagcgaggacgtgacccagttcctgcagagccacaagaagactttgacaaatgagaagctgttcctgatggacggaaagcggacctggttcctcgaaatggagagcacaccaggcgaggacgcaatgaacaccgtcaaaatgactactaaggatctcaagtacgatcggtcactgatcgacaaggccggcttcgaacgtacagactcaaacttcgagcgcagccacacagtggggaagatgctgtccaactcaatcatgtgctacagggacatcttctacgagcgcgagtctcagttaatgcagcagacttcactcctgtcctacgagatcgcaattgcaacgccgacgttctccaactactacccagattggagcgcaccaatcaacattgttgcaagaccctcaacctcaaagaagatcatgacttgctag

SEQ ID NO: 50055 - DNA, 3144 bp, Artificial Sequence
  Description of Artificial Sequence: Synthetic coding sequence
atggcccactgcggccagctgaccaactggctgtgcctggcctgggaacggaaagagtcgcccgattttctttcaatctttttgcggtatatcgatttaacaccaaagctgcacaaaatctgcagcgacaaaaccattacccagaaaacgcattgcctgctaccccttatcagcagtgctcttagctccatcgtgctaatccaggggtggtggcagaagactgcccataagtacgcttacaagggcgccaagcatatcgagcagcaaaacccacaaagcaggcaccggcctaggcctgccggagcgctcccccagatatctagagattcaaggcagcggtgtttacttttaagattcctggttcgaccacgaggtttctctttttcctttgcagaacccgctgcagccttcccgggtgcgaccgcgatggccgcatcactgtcggagcgtctgttttctttggagctcctggtagactgggtgaggttagaggcccgccttctgccgtccccagctgccgctgtcgagcaggaagaagaagaagaggagaaggagcagggggaggcctcctcaccccgtggcctgtgccctgccgttgcctttcggctgcttgatttcccaaccctgttggtgtacccgccagacggcccaggtgctcccgccgctgaaccttggcctggcgtgatccggttcggccgagggaaatcttgcctttttcgactccaacccgccaccctgcactgccggttgctgagaacgccactggctacattgttattacagttaccacccggcagacccacaccgacaccacagttactcggggcctgcgacatcagcctggccaccgccgcacaccgggtggtgggccccgcagcaagtggttgctcccatcgacacagaggcaggttcccactccacaatagagttggtgagcggaccggcgacatagccctcgcctacaggttgaccgacctgggttccaggcttctgagccagctggagagaccacttaccttcactcgtacaggaggtggtgccgaagtttcccctcagacgcagcaggagaggcagcagctccagcagccagcaagtcagccatcacccaaagaggctgacaaaccgctgggagagctggagatccccgaggcccagaaagatcttaaagagatggtcaaaagcaaagctgaatgcgataatgtgggatctgtggaaaatgggaagaccaactcagtggtaacgtgttccggagctggaaatggcaggaacgtcagttctctcaatgaggaggtgactgaactagatatggagactaatatcttttgccccccgcctttatattacacgaatttaacacaggagaagccaccccctgcacaggcgaaaattacaatcgagccacagatgaatgcccctgaggagatggacgacgctagtcccgaaaagaaacgggtgaaccctcccgcccacaggtcctgcctaaaacacccttccagcgcggctcatgagcaccctccgatgctggtgaatccacctcacatacagaacataggcgcgaccaatcaaacatgccagaccgagcagaacaggataaacacaattcgacagttgcctctgctgaatgctctcctcgtggagctgtctcttctctatgatcagcccgtgacttctcctgcgcatattcatccccacctggcatggctgtatagaaccgaggataagaagtctcccgagagcagtgctaaatcaacttgccgttccgaagcgaaaaaagataagcgaagcgtgggtggctgcgagaagagcgtctcccttcaatacaagaagaaccaaatcgagaattacaaggaggataaatattctgaaaaaagttccggcgctctccacaaacgggtcccaaaggggagactactttacggcttgaccaacacattgcggctaaggctgaaactgactaatcctgacatgctggtcgtgcacgaaaagcgtgagttataccgcaagcgacagtcacagatgctcggcactaaatttcgaatcccatctagtaaagtgaagttgctgtcatcagccgagcagagccaaaaacctcagctccccgaggataagtatctggactccgacgcctccttcaccgagaacagcgatacgtcaaggcagatctcaggagtgtttgacgagcccagcacaagtaaggagaccaagctgaaatacgcaaccgaaaaaaaaactgtggactgcagtaaaaaccggatcaataatgtatctctagaagaggtagtctccccagccaacagtatcatccccgagcgcctgacacccacaaatatcctcggaggtaacgtggaaatgaaaattcaatccccatgtgtgttccagcaggatgctgttgtagatcggatcgtagacaaggagattgacatccgccaggtcaagaccacagacaatgacattcttatggccgacattagcgataagagaacaggaaaaaatagctgctacgagaacataagcgagcttaaatactctgacgacctctccagcccctgctacagcgaggacttctgcacttcagaggatactagcagaagcttcaaggcccacgactcctcaagcaggacggagaatcctaaacactcccagtacacatctaaatcttcggatactggagtctcaaagaagaaaaactctagtgacaggtctagcatcctcagcccaccattttcggccggtagccccgtccactcttaccgtaagtttcacatttctaaaactcaagataagagcctggaagaagcttcatccatatccgcatccgatctgtcgagtactcattggacggagcagaaggagaatcagatcgaccagaatagtatgcacaacagcgaaattacgaagcgtgctcaggacatttccgtgaaaacgcggagtagttggaagtccttggagaagagccagtctccccagacctcacaggtgagcagctatttgccctcaaatgtgtccgagctgaacgtgttggatagtagcacgagcgaccatttcgaagaagggaacgatgatgtgggctcactgaacatttcgaagcagtgcaaagacatctgtgagctggtgatcaacaagttacccggatacacgatgtag

SEQ ID NO: 50056 - DNA, 561 bp, Artificial Sequence
  Description of Artificial Sequence: Synthetic coding sequence
cggagcctgctgaaggagctggagaacaccaaggaccacaccctgctcctcgaaaaacggctgaagaagctctctagggaaggttcctcacatcacctgcctaggcaggtgcggccaggacccgtgtacaagccagcccctgcccgtaatcacaggccaagagggggacgcggcaaagccagtccgacttcttttcacgtaagccctcgcgctccccttgcccccctcgcctcaatgccctccagtgtgcctaaaacctctattgagtccctcggcagcccaagttctctgtcaagttctcaggcctctgagccactgtgtccactcaaacacccaagccatagaccccccgcatcgacactgagccccaatctcacctccagcaccgaatcactggggctcttatcaagagaaactccccatgccggcaggaggcgtcaaggaagtcgattcccccagccaggatgcgccaatgcagccggccgtacacggcaccagaatcctcgtcattcccacggccatcgaattagtgacatccacgaacagctgggtataagttag

SEQ ID NO: 50057 - DNA, 405 bp, Artificial Sequence
  Description of Artificial Sequence: Synthetic coding sequence
atgcgggagcccatctacatccacagcaccatggtgttcctgccctgggaattgcataccaagaaaggcaagatggccctcctggcgagcaatggctgcttcatccggtgcaacgaggccggcgacattgaagctaaaagtaagacagccggcgaggaagagatgattaagatccgctcctgtgcagaaagggagaccaaaaaaaaagatgacattccagaagaggataaaggaaatgtcaagcagtgcgaaatcaactacgtaaaaaagtttcaatccttccaggagcacaaactgaagatatccaaggaagactccaagatcctgaaaaaagcgcagaaagacggttttctgcaggagacccttcttgacagagttgccgtcatcgcatgtctgcatctctag

SEQ ID NO: 50058 - DNA, 447 bp, Artificial Sequence
  Description of Artificial Sequence: Synthetic coding sequence
atggagcacatgctgctggccaaccacaccgacaaggccaccttcacaggaactcaaaggcaaagatcgtgttcaggggcttctgtgagccaaccgaggcccctgcgcggaaagttggtgggctactgggaccctcactctcgtctgctgagtaggggcagagcgttaggaagcgtttccgctccgtcaacacccagaggcagaggctggaaggcgacgtttgatggctgcatactccacgacgacctgcttaccaaagtgcatggatttcagtccctgattggtctccaacagcaccttgcatgtggggattctggctccctcatgaaaaactgccacgacgtgagaaaaagtcttagcgagagagggtggggtgccgcttgttgggggggtggcggagtggcctcaagggaaaagctccatccacttgctgagtcagggacctag

SEQ ID NO: 50059 - DNA, 1296 bp, Artificial Sequence
  Description of Artificial Sequence: Synthetic coding sequence
atgtggccccagccccacctgcccacccacccccacctgcccacccacccccatcttcccacccatccacaccttcctactcatcccatgatgtctaaagagacgcgccagagtaaattagcagaagctaaagagcagcttacagaccaccacccccaaactaatccttcagtgggtactgcagcatccgacactaagaaaaaaaagataaacaacggcaccaatcctgagaccaccaccagcggcgggtgccacagccccgaggacgagcagaaagcctcccaccagcatcaggaagcactgcgacgagagctggaagctcaggtgcatactatccgcatcctgacgtgccagaaaactgaactacagatggctctgtattatagccaacacgccgtgaagcagctcgaaggagaagcgcgtgacctgattagtcgactgcatgattcatggaagtttgcaggagagctcgagcaagcactcagcgctgtggccacacagaaaaaaaaggcagacagatacattgaggaattgaccaaagagcgcgacgccctgagcctggagctttaccgcaacaccataaccgacgaggaactcaaagagaagaatgcaaaattgcaggaaaaactgcagctggtggagtctgaaaagagtgagattcagctcaatgttaaagagctcaaaaggaaactggaaagagccaaacttctgttaccccagcagcaactccaggctgaagccgaccacctcgggaaggaactgcagagcgtgagcgccaaacttcaggcccaggtagaagagaacgaactgtggaaccgccttaatcaacagcaggaggaaaaaatgtggcgccaagaggagaaaatacaggaacgggaagagaagattcaggagcaggaagaaaaaatccgagaacaggaggagaagattagggagcaggaagagatgatgcaggaacaagaggagaagatgggggaacaagaggaaaagatgcaggaacaggagaaaatgcggcgccaggaagagaagatccgggagcaggaggaaaagatcagggaacagaaggaaaagattagagaacaagaggagaagatctgggaacaggaggaaaagatccgggagcaggaggaaatgatgcaggagcaggaagagaaaatgtgggaacaggaggagaaaatgtgcgagcaagaggaaaaaatgcaagagcaggaggagaaaatgcgtcggcaggaggagaaaatgcgcgagcaggaagtcaggttgaggcagcaggaggagaaaatgcaggaacattag

SEQ ID NO: 50060 - DNA, 1701 bp, Artificial Sequence
  Description of Artificial Sequence: Synthetic coding sequence
atgaagatgcagaagggcaacgtgctgctgatgttcggcctgctgcttcacctcgaagccgccactaacagtaatgaaacttcaaccagcgccaacacaggatcttccgtgatctctagtggtgccagcacagctaccaactccggttcctctgtaaccagcagtggagtgtcaacagcgacaatcagcggaagctctgtgactagcaacggagtgtccattgtcacaaattctgagttccacaccacttcctctggcatctctactgccacaaattccgaattctctacagtgtcctccggaatctctatcgcaaccaactctgagtcatcaaccacgtcctcgggagcttcgaccgctaccaattcagaatcaagtactccctcatctggcgcatccactgccacaaatagcgatagttctacaacctcgagtggagcttctaccgccactaattcagacagctctacaaccagtagcgaggcctccacagccactaactcagagagttccaccacgagtagtggcgcaagtaccgtgactaacagcgaatcatccacagtgtcctcccgcgctagcacagcaaccaattcagaatcctccactacaagttcaggtgccagcactgccaccaattccgaaagtcgcacaaccagtaatggcgccggcaccgcaactaatagcgagagttctacaacgagctccggggcctctaccgcaacgaactccgagagcagcacaccgtccagtggtgccggaactgcaactaactcagaatcatcaacgacaagctctggagccggaacagccaccaatagcgagagttccacagtgtcatccgggatcagcacggtgaccaacagcgagtccagtacacccagcagtggagccaatacggcaactaattcggaaagcagcactacctcctctggggccaatacggcgacaaattctgactctagcaccactagctcaggcgcgtccactgctaccaacagcgagtcgtctacgactagcagtggcgcctcgacagccactaactccgaaagcagcacaacatcctcgggcgctagtactgccaccaacagcggctcgtcaacaacatcctccggcacctcaacagccaccaattccgagtcttcaacggttagttcaggcgcaagtacagctactacaagtgaatcgagcacgacttcatccggagctagcactgcaactaacagcgagtcatccactgtctcttccggggcgtctactgccacaaacagcgagtcctctactactagctctggggccaacaccgcaacaaattctggatcatcggtgacatcagctggctcaggtactgccgcactcacaggcatgcacaccacttcacatagcgcatccacagccgtgagtgaagcgaagcctggcggatctctggtgccatgggaaatctttctgataactcttgtatctgtggttgcagccgtgggactgttcgccgggctgtttttctgtgtcaggaactctctaagtctgaggaacacctttaatacagcggtctaccatccccatgggctaaaccatggattaggcccgggccccggaggcaatcacggggcaccacacaggccgaggtggagtccaaactggttttggagacgacctgtttcatccatcgccatggagatgtctggacgcaacagcggaccctag

SEQ ID NO: 50061 - DNA, 183 bp, Artificial Sequence
  Description of Artificial Sequence: Synthetic coding sequence
aagggctgggtgagccacctgttcctggcccccaccaacttcgaggagttcaccgccccagcgaccccaccacattgtagtcagtgtctcaggtctaattgctctacgtgggccactgccgctattattgagcgaagcctgcaggtgccttttctctatctatccactcctggcggccattag

SEQ ID NO: 50062 - DNA, 399 bp, Artificial Sequence
  Description of Artificial Sequence: Synthetic coding sequence
atgagccagccctggctgtacagccagtgcatcatcagcggcaagcctagtgaagaggccgccggcgaaaacggatccataagcgccgctcttagaccactgctcctcgtggcagatgtgcccgtgttggggtatctgtgcccatcaagcgtgagtagtggggtctgcgaggctaaacttctcggatggggattgggaggcgtgtcagcagccccagaagccaaaaccaaggccgaggccgaagcagaagctgaggcaaccctcgtgaggcggaagctccaggtggaaaaactggtggacagggatctcgacctgactgtgattctcatggttccgatgccaagcgccaggcggcctccggcgctcgcaaccactgggtcttgcagtcctcctgggtag

SEQ ID NO: 50063 - DNA, 1395 bp, Artificial Sequence
  Description of Artificial Sequence: Synthetic coding sequence
atgcggcggcacagcgagaccgacgtggaggagcagacccaggagttgaaaaccatcactcaactccaggagcagtgtagggctctacaaattcagggtgtgaaagaaaacatggatcagaataaagccacattggcccttctacgttccaatatccgacggggcgctcaggactgggcgctggcaaagaagtacgaccagtggacaatttctaaggcctgcggcaagaacctcccgctgcggcttgcacactgccgaagcacaatggaagtagtgagagaaaagctccgaaagtatgtgtttgatagggtgaacatgcataaccttctaatccatttagtgcggaggaggggtcagaaactcgagtctatgcaactggagctggacagccttcgaagccagcccgatgcttccaaggaggagcttcgactcctccagatcatcaggcagctggagaataatatcgagaaaactatgatcaagattataacgtctcagaacattcatttattgtatcttgacctcttagattaccttaagacggtgctggccgggtaccctatagagttggataaactccaaaatctggttgttaattattgctccgagctgtccgatatgaagattatgtctcaggacgcgatgatgatcacggacgaggtcaagagaaatatgcgccagagagaagcctcctttatcgaagaaagaagggcacgcgaaaatcggctcaaccagcagaagaaactgatcgataagatacacacgaaagaaacctccgaaaagtatcggcggggacaaatggaccttgactttccttctaacctcatgtctaccgagacgctcaagctgcgacgaaaggagacctccaccgccgaaatggaatatcaaagcggagtgactgccgtggtggaaaaagttaaatctgccgtccggtgcagccacgtatgggacattacttctcgatttctggcccagagaaatacggaagagaatctggagttgcaaatggaggactgcgaggagtggagagtccagctcaaggctctcgtgaaacagctggaactggaagaggcggtcctgaagttcagacagaagccgagcagtatctcttttaagtcagtcgagaagaaaatgacagacatgctaaaggaggaggaagaacgcttgcagcttgcacattccaatatgaccaaggggcaggaactgctgctgaccatacagatggggattgataacctgtacgttagattaatgggaatcaacctgccagccacccaggtgccgggcgtgcggctcagctgtcacacccctggcccctgggctggacctgaagggcgccaagcgcagcggcttattgaggggaagttgaaggctgctaagaaaaaaaagaaatag

SEQ ID NO: 50064 - DNA, 381 bp, Artificial Sequence
  Description of Artificial Sequence: Synthetic coding sequence
agcggcagccccgccggcctgctgaagggcgacagcaagaagccctcacagagaagagtgaagcggcaaccatattctaccactaaagtgactagtgggagtacgtttaacgagaatacgaggcgatacgcagtgcacactaaccagtgcaggcgccctcacggcagtcgagtgaagaagaagcgctacccgcaggaggacgacttccatcataccgttttttccaatctggagcggctggataagctgcagccaacgctcgaagcctcagaagagtccttggtgcacaaggaccgaggggatggagaacggcctgtgaatgctcgggtagtgcaagttgcccccctccgactggagagccgcatcagcatcggcgaatag

SEQ ID NO: 50065 - DNA, 1314 bp, Artificial Sequence
  Description of Artificial Sequence: Synthetic coding sequence
atgtggccccagccccacctgcccacccacccccacctgcccacccaccctcacctgcctactcacccccatctccccacgcacccacatttacctacccaccccatgatgagtaaggagacgcgacaaagtaaactcgcagaagccaaagagcagctgacagaccatcatccgcaaacaaacccctccgtcggaaccgccgccagtgatacgaaaaaaaagaagattaataatggcaccaatcccgagacaactacctcagggggttgccattctcctgaagacgagcagaaagcttctcaccagcatcaggaggccctgcggagggagctggaggcacaggtccaaacaattcgcatcttaacttgccagaaaactgaactgcagatggccctgtattactcccagcatgccgtgaagcaattggaaggcgaggcccgagaccttataagccggctccatgattcatggaaattcgccggggaactggaacaggccctttccgccgttgcaacccaaaagaaaaaggccgaccgatacattgaagagcttacaaaagagcgagacgctctctcccttgagctataccgcaataccattacagacgaggaactgaaggagaagaatgccaagttgcaggaaaaattgcaactggtggagagcgagaagtctgagatccaacttaacgtgaaggaactgaaaaggaagctggaacgtgctaaactgcttttgcctcagcaacagttgcaagctgaagccgaccacctgggcaaggagttacaaagcgttagtgccaaactccaggcacaggtggaggaaaatgagttatggaatagactgaatcagcagcaggaagagaaaatgtggcgacaggaagaaaagatccaggagcgggaggaaaagatccaggagcaagaagagaaaattagagaacaagaggagaagattcgggagcaggaggagatgatgcaggaacaggaagaaaaaatgggtgagcaagaggaaaaaatgcaagaacaggagaaaatgcggagacaggaggagaagataagggagcaggaagagaaaatcagagagcagaaagaaaaaattagagagcaggaggaaaaaatatgggagcaggaggagaagatcagagagcaggaggagatgatgcaggaacaggaagagaaaatgtgggagcaggaagaaaagatgtgtgagcaggaggagaagatgcaggaacaagaggaaaaaatgcgcagacaagaggagaagatgagggagcaggaggtcagactgcggcaacaggaggagaaaatgcaggagcactag

SEQ ID NO: 50066 - DNA, 597 bp, Artificial Sequence
  Description of Artificial Sequence: Synthetic coding sequence
tgaaccagccggcagacctgggtggccaccaacaccctgagcaaggccgcattcctcctgacagtgctaagcgaaagacctgagcaccacaatctggcttttcgtgtcggaatgttcgccttagagctccagcgcccccccgcaagtactaaagccctggaggtgaagttggcttatcaagagtccgaggtcgccgccctgctgaaaaagatccccctcggtcccagtgagatgtcaacaatgaggtgccgcgcagaagagcttagggaaggtactttgtgtgactataggccggttctgccgttgatgttagcctcttttatcttcgatgtgttatgtgcgcctgggtcacgacccccttccagaaattggaactcagaaactcctggcgacgaagagcttgggttcgaggcagctgtggccgccctagggatgaagaccacagtgtccgaagctgagcatcctctgctctgtgagggaacgagacgtgagaagggtgacctggctctggcacttatgatcacctacaaagacgatcaagctaaactcaagaagcctggacagcagagtgagactctgtcactcaaaaagaagtag

SEQ ID NO: 50067 - DNA, 4188 bp, Artificial Sequence
  Description of Artificial Sequence: Synthetic coding sequence
atgtaccccatctgcaccgtggtggtggacggcctgcccagcgagtcctcatccagttcgtaccccggacccgtctccgtgtcagagatgagcctgcttcatgctctcggaccagtacagacttggctcgggcaggagttagaaaaatgcggtatcgacgccatgatttatacccgatatgttctcagcttattgctgcacgatagctatgactacgacctgcaggagcaagaaaacgacatttttcttggctgggagaaaggagcctataagaagtggggcaaaagtaagaagaaatgttccgaccttacgctggaggagatgaaaaaacaggctgctgtccagtgtctccgatccgcgagtgatgaaagcagcggcattgaaaccctggtggaagagctgtgttcaagactaaaggacctgcagagtaaacaggaggaaaaaattcacaagaaactggaaggatccccgtcgcccgaggctgaactctcaccacccgccaaggaccaggtagagatgtactatgaggcatttccccccctatctgagaaacccgtttgtcttcaggagatcatgacagtatggaacaagagcaaggtttgtagctattcctcttcatcatcttcaagcactgctccgccagcctctactgacactagcagtcccaaggattgcaattctgaaagcgaagtgaccaaggagaggtcaagtgaagtaccaactaccgtccacgaaaagacccagagtaagagtaagaacgagaaagaaaacaaattttcaaatggtaccattgaagaaaagcctgcactctataaaaaacagatcagacataaacctgagggtaagatacggcctcggtcatggtcatctggaagctctgaggccgggtcatcgagctctggtaaccaaggggaattgaaggccagcatgaaatatgttaaggtgcgccataaggcacgcgagatacggaacaagaaggggcgaaatggacagtctcgcctgagtctgaagcatggcgagaaggcagagcgaaacattcacaccggatccagtagctctagcagcagcggttcagtgaaacagctctgtaagaggggcaaaaggcctctgaaggagatcggaaggaaggatccaggctcgacagagggtaaggacctctacatggagaaccgcaaggatacggagtataaggaggagcccctgtggtacactgaaccaatcgccgagtattttgtacctctgagccggaagagtaaactggagaccacataccggaaccgacaggacacttcagatttgaccagtgaagccgtcgaggagctgagtgaaagtgtacatggactgtgtatctcaaataataaccttcacaagacctatctggcagctggcacgttcatcgacggacacttcgtggaaatgcccgccgtgattaacgaggacatcgacctaaccggcacaagtctgtgctctctaccagaagacaataagtacctcgatgacattcatctctctgagctgacccatttctacgaggtggacatcgatcaaagcatgctggatcctggagcttctgaaacgatgcagggggagagtaggatccttaacatgattcgtcagaaaagcaaagagaataccgactttgaagccgagtgctgcattgtgttagatggaatggagttgcagggtgaaagagccatttggacagactctaccagcagtgttggcgcagagggcctttttctgcaggacctgggcaacctcgctcagttctgggaatgttgtagctcatcctcaggagatgccgacggcgagtcctttggcggcgatagtcccgtaaggctgtcaccgatccttgactcgaccgtgttgaattcacatctactggccggaaatcaggaactgttttctgacatcaatgaggggagcgggatcaattcttgcttcagcgtgttcgaagtgcagtgctctaactcagtgctgcccttttcattcgagacacttaatctgggtaatgaaaataccgactcttccgccaacatgctgggtaaaacacagtcccggctcctcatttggacgaaaaatagtgcattcgaagagaacgagcattgctcaaacctctcgacgcgaacctgcagcccctggagtcatagcgaggaaacaagatctgacaatgagaccctgaatatacaatttgaggagtccacacagtttaatgctgaggatatcaattacgtggtgcctcgcgtctccagcaattacgtcgatgaagaacttttagattttcttcaggacgaaacgtgtcaacagaactccagaacccttggcgagatcccaactttagtgttcaagaagaccagcaagctggagtcagtctgcgggattcagctggagcaaaaaaccgaaaataaaaacttcgaaaccactcaggtctgcaatgaatcaccacacggggacggttactcctctggcgtgattaaagacatttggacaaaaatggccgacaccaacagtgtagccacggttgaaatcgagcgcaccgatgcagagctcttctcagccgatgtgaacaattactgctgttgtcttgacgccgaagcagagcttgagacgcttcaagaacccgacaaagcggtacgcaggagcgaataccacctgtgggaaggtcagaaagagtctcttgagaagagggcctttgcatccagcgagctctctaatgtcgatgggggtgactataccaccccctcaaagccatgggacgtggcccaggacaaagagaatacctttatactggggggggtgtacggtgagttgaagactttcaacagcgacggagagtgggccgtcgttccgcccagccacaccaaaggttccctcctccagtgtgccgcctccgacgtggtcaccatagccggtaccgacgtttttatgacacccgggaatagtttcgcaccagggcatcgccagctgtggaagcctttcgtgtccttcgaacagaacgaccagccaaagagtggagagaatggtctcaataagggtttttcttttatctttcacgaggatctcctgggtgcctgcggcaatttccaggtcgaggatcccggtcttgagtactctttcagctcatttgatctttctaaccctttttcccaggttctgcacgtggagtgttccttcgagcctgaaggcattgcgagttttagtcctagctttaaacccaagtcaatcctgtgttctgattccgatagcgaagttttccacccacgcatttgtggtgtcgatcgcacgcagtaccgtgccatccgcatttctccacgtacccactttcggccaatttcggcttctgaactgtctcctgggggaggatcggaatctgagttcgaaagtgaaaaagacgaagccaacatccccatccctagccaggtggacatttttgaggatcctcaggctgatctgaagcccctggaagaggatgccgagaaagaaggacactattacgggaaatccgagctggagtctggaaagtttttgccccgccttaagaaatccggaatggagaagagcgcacaaacatctctggactcgcaggaagaatcgaccggaattcttagcgtgggcaaacagaaccagtgtctggaatgctccatgaacgaaagcctcgagattgatctggagagttcagaggctaattgtaagattatggcccaatgtgaggaagaaattaataacttttgcggatgcaaggccgggtgtcagttccccgcttatgaagacaaccctgtttcttctggccagttggaggagtttcctgttctgaacactgatatccagggcatgaatcgcagccaggaaaaacagacctggtgggaaaaggctttgtacagtcccctctttcctgcctctgaatgcgaagaatgctatacaaacgctaaaggcgaatcagggctggaggaataccctgatgcaaaggaaacgcctagcaacgaagaacgactgctcgactttaatagggttagcagcgtttacgaagctcgctgtaccggcgagcgcgattcaggggctaaaagcgatggcttccgtggcaagatgtgtagtagtgcttcaagcacttcggaggaaacagggtctgaaggcggcggcgagtgggtgggcccttcggaagaggagctattctccagaacacatctgtag

SEQ ID NO: 50068 - DNA, 366 bp, Artificial Sequence
  Description of Artificial Sequence: Synthetic coding sequence
atggagttcgtgctgagctgggtgttcctggtggccatcctgaagggcgtacagtgcgaggtgcaactcgtccagtctggcggcggactggtgcacccggggggatctctccggcttagctgcgccggttcgggattcaccttctctagttacgctatgcactgggtacgacaggcccctggcaagggactggaatgggtgagtgcaattggaaccgggggcggaacctactatgcagatagtgtcaaggggaggttcaccatttcacgggacaatgcaaagaattcgttgtaccttcagatgaactccctccgcgcggaggacatggcagtgtactactgtgcccgggacacagtccgaggatag

SEQ ID NO: 50069 - DNA, 777 bp, Artificial Sequence
  Description of Artificial Sequence: Synthetic coding sequence
cggagcctgctgaaggagctggagaacaccaaggaccacaccctgttattagagaagcggctgaagaaattatcacgcgagggctctagtcatcacctcccaagacaagtgcgcccagggcctgtctacaaacccgctcccgcacgtaaccataggccaagggggggaaggggtaaggcctctccaacctctttccacgtttctcctagagctccgctggcccccttagcaagcatgcccagttctgtcccgaagacatcaatcgaaagtctgggatcacctagcagtctgagcagctcccaggccagcgaacccttatgtcccctaaagcacccctcacataggccaccggcatcaactctatcacctaaccttaccagctccactgagtccctgggttatctaagcagtctttcgtcctcccagccacccgaaccactaaggcccctcgagtgcccttcccataaaccctgtggcaggtctcttccgagacggagaaacccaggatgggttagctggagcgactctatgcaggctgacagtgagacggacgcaatcatctgccctatgtgtaaagcaccagagcgctcctgccctcacacatggtgggttccatcatctcccagggtcatcagaggagtgggaagatgctcagaccccaatttgggtctgagttggagacaggaagccgctcgtgcatggtgccactgtacatcatcgcaatatccgttcaagcatcctaatctgcctacgcatctgccaaaggccagcttctag

SEQ ID NO: 50070 - DNA, 2253 bp, Artificial Sequence
  Description of Artificial Sequence: Synthetic coding sequence
gactacgcccacaccctgacctgcgtgaccgagcgggagaagttcattgtgccaatcaaggctcgcggtgcgcgggctatactggattttcccgacaagttgaatttttcaacctgccctgtcaaatatagtacgcaaaagatcctcctggtcaggaacattggcaataagaacgcagtgttccatattaaaacctgcaggcccttctcgattgagcctgccatcggaacgcttaacgtcggagagtcgatgcagctggaggtcgaattcgaacctcagtctgtcggagaccactctggccgcctgatagtgtgctacgacaccggagaaaaggtattcgtgagtctgtacggcgccgctatcgacatgaacatcaggctcgacaagaacagccttactatcgaaaagacctacatctctctagccaatcaaaggactattaccattcataaccgctcaaacatcattgcccatttcctatggaaagtcttcgcaacccagcaggaagaggatcgggaaaaatatcgggcctgcgatgatctgatcaaagaggaaaaggacgagacagatgaattttttgaagaatgtatcaccgaccctttgctgcgtgagcacctgtcagtgctgtcaagaacttttgcaaaccagaggagactggttcagggtgactccaaactgtttttcaataatgtctttacagttgaacctcttgagggtgacgtatggcctaacagttcagcagagatcacagtttactttaatccacttgaggcaaagctctatcagcagaccatttactgcgatatcctgggacgtgagatccggctacccctccgcataaagggggaagggatgggccccaaaatccacttcaacttcgagctgctggacattggcaaggtgttcaccgggtctgctcattgttacgaagccatcttgtacaacaaggattctattgatgccctgttcaacatgaccccccccacatccgctctgggcgcatgcttcgtgttctcaccgaaggagggtattattgaaccaagtggcgtacaggccatccagatcagttttagttctactattcttggcaattttgaagaggaattcctagtgaacgttaatgggagccccgaacccgtgaagctgacgatcagagggtgtgtgataggaccaacattccactttaacgtgccggctctgcacttcggcgacgtgtcgtttgggtttccacatacccttatttgttcactgaataacacttcactgatccctatgacatataaactccggattccaggcgacggactgggccataagtcgatcagctactgtgaacagcacgtagactataaacggccatcgtggactaaggaggagatctccagcatgaaacccaaggaatttactatttctccggattgcgggacaatccggccccaaggattcgctgcgattagagtcaccctgtgttcgaacacagtgcaaaaatatgaactggccctcgtcgttgacgtagagggtataggcgaagaagtactcgcccttctgatcgccgcccgctgcgtggtccctgccctgcatctggtaaacactgaagtcgacttcggccattgctttctgaagtatccttatgaaaagacactgcagctcgctgaccaagacgatttacctggattctatgaggtacagccacaggtctgcgaggaggtgcccaccgtcttatttagctctccgacacccagcggggttatctcgcctagcagcaccatccatatccctctggtcttggagactcaggtcaccggggagcacaggtccactgtgtacatatcgatcttcggaagccaggatccccctctggtttgccacttaaagtcagctggagaaggccctgttatttacgtgcaccctaaccaggtggatttcggcaacatctatgttctgaaagattccagccggattttgaacttatgcaatcagagttttatccccgcttttttccaagcccacatggcgcacaaaaagtctttatggacgatagagcccaacgagggaatggtgcctcctgagacagacgtccaacttgcgctgactgctaacctgaatgacactctcactttcaaggattgcgtgattttggatatcgagaattccagtacttatcggattccagtgcaggcctctggaacagggtctacaatcgtgagtgacaagcctttcgccccggaattaaacctgggcgcccacttctag

SEQ ID NO: 50071 - DNA, 294 bp, Artificial Sequence
  Description of Artificial Sequence: Synthetic coding sequence
gaggtgcagctggtgcagagcggcggcggcctggtgcagcccggcggcagcttgaggctctcttgcgctggctccgggtttaccttctcttcctatgccatgcattgggtgaggcaagcccctgggaagggcctcgagtgggtaagcgcgattggcaccggcggagggacctactatgcggactccgtaaaaggcaggtttactatctctagagacaacgcaaaaaattcactctacctgcaaatgaatagcctgcgcgcagaggatatggctgtgtattactgtgcccgctag

SEQ ID NO: 50072 - DNA, 714 bp, Artificial Sequence
  Description of Artificial Sequence: Synthetic coding sequence
tgaacctaccaccggatccccatgcccgacttctgcgccccccgggaggaagactttgaccagcttttggaggcactaagagcggctttgtctaaagaccctggaactggattcgtttttagctgcctaagcggacaaggaaggacaaccactgcaatggtggtagctgttctggccttttggcatattcaggggttcccggaagtcggcgaggaggaacttgtgtccgttcctgatgcaaaattcactaaaggcgaattccaggtagtcatgaaggtcgtgcaactgctgcctgatggacaccgggttaagaaagaggtggacgcggcactcgatactgtcagcgagacgatgactccaatgcattaccatcttagggagatcattatttgcacctacaggcaggccaaggcggcgaaagaggcccaggagatgcgtagactccagctgcgttctctgcagtatctggagcgatatgtctgtctgatcttgttcaacgcgtacctgcacctcgagaaggctgactcttggcagaggcccttttctacttggatgcaggaggttgctagcaaagccgggatatacgagatccttaatgagcttggctttccagaactggagagcggggaagaccagccgttctcaagattgcggtaccgttggcaggagcagagctgttctttagagccgagtgctccggaggatcttctatag

SEQ ID NO: 50073 - DNA, 648 bp, Artificial Sequence
  Description of Artificial Sequence: Synthetic coding sequence
tacggcgtgtgcagcgtgggcctggagtggctggcctacctgctggttccctactcactcggggcctctgcaaccagtctgctaggtcttctgggtttatggctgcccaggcccgtaccattagttgctggcgccggtgtgcacctcctgttaaccttcatcctttttttttgggcccccgtccctcgggttcttcagcacagttggatcctgtatgtggcagcggctctgtgggtcgtggggagttctctgaacaagacgggcctaagcactctcctgggcatcctgtacgaagacaaagagcgacaggactttattttcactatctaccattggtggcaggcggtcgcaatttttaccgtgtacctcgggtccagcctgcatatgaaggctaagctcgcactgcttctcgtgacactcgtggccgccaccgtatcttacctgcggatggaacagaaattgagaagaggtgttgcgcctcggcagcccaggattccgagaccccagcacaaggtccgggggtaccgctacctggaggaagacaatagtgacgaatccgacgccgaaggcgatttgggtgacggggaagaggcggaagctgaagctcctccagctggtccgcgtccaggtcccgagccggccgggtag

SEQ ID NO: 50074 - DNA, 3828 bp, Artificial Sequence
  Description of Artificial Sequence: Synthetic coding sequence
atggactgggacgacgagtacagccacaacagcttcgacctgcactgcctactcaattcttttcccggagacctcgaattcgagcaaattttctcagacatcgacgaaaaaattgaacagaacgctgcctctatcaagcactgtataaaggagatacagtctgaaataaacaaacaatgtccgggggtgcaactgcagaccaccacagattgttttgaatggctgaccaactacaactattccacttctgaaagtagttttatctcacatggagacttgattaagttctttaaaacattgcaggacctgctaaagaacgagcagaatcaagaagaaatgacattagatctactgtgggatttgtcttgtcattcttccgtgagcttcccctccacacttagtggaaccagcttccactttctgtcccggacctcccttcactctgtcgaggacaatagctccatggatgtaaagtccatgtgggacgatattaggctgcacttgcggcgctttttggtctctaagctacagtcccataatgagattaacaactcacagcagaaaatcctattaaagaaacagtgccttcagcagttgctctttctgtatcccgaatcggaggttattatcaagtaccaaaacatacagaataaactgctggcaaacttgttatggaactgcttccccagttacaaccgagattccaaccttgatgtaattgcccatgggtaccaaagcaccatgctcaagctgtactctgtgatcaaggaagacttcaatacactatgcgaaatcctggctccttcgtctatggtgaagtttatcaaggagacgtacctggacaccgtgacagaagaaatggccaaatttttggagaacttttgcgagcttcaatttcgggaaaacgctgttcgagtcgttaaaacaagtaaatctagctcaaagcacagaggggcagtgcacgcactggtgaccacggagtgtccccagaagggcaggaatttcagcctacccctagataaggtcgagtttctgtcacaactgattaagtcattcatgaagctggagaagggagtgcaagagctgtttgatgaaatattgttgagtcttaaaattacccgggatacttctgggatcctggaaaagtcggaccgcgaagtagtgatggagaagcccagagctaacgagaccaacatcccctctgagcagtctttacctggtaaagaagcaacactgttagactttggctggaggtctgcgtttaaagaggtcagtcttccaatggcccactgcgttgtgactgccatagagggctttagtacaaaaatcctgcaacaagaacagaacgaacggagcagtgccgtatcctatgccatgaatctggttaatgttcagcaggtctggcaagactcccacatgttcccagaggaggagcaacccaagaagattgggaagttctgcagcgacattatggagaagctcgacacaatgctgcctctggcactggcctgccgcgatgactcatttcaggagattcgggcaaaccttgtggaagcttgctgcaaggtcgccacagctgtgcttcagcggcttcaggaacgagcaaaggaggtgccaagcaaagcacccctaaaaaacttgcacacctatctatctactgcagtatatgtgttccagcacttcaaaaggtacgacaatctgatgaaagaaatgaccaagaagcctatttttttagtactagtccagcggtaccaggaattcatcaataccctccagttccaggtgaccaattactgtgtgagagtctgcgcaacctccatcctgcaggatgccgagagccaccactgggacgactacaaagccttctatgagggcgaaaggtgttcttttagcatccagatgtggcactatttctgctggtctctacattatgatctgtggactattctcccgcccaagctggcgcaggagatcctggtcgaagtgctcgaaaagagtttatcccttctcgcgtcaagatacgcaagggcccacccttctcgaaagcgtaccccgcagctgaggctcgatgttaccaccatcttgatttgcaccgaaaacatgctctggtccgtgtgtacctctgtgcagaagttgctgaatccacatcagcacaccgatgacaaaatttttaagatccacactcattgcaataacttgttcaccacacttgttatactcaccagccctctcaccgaactgtataagacttttcaacatgggctggacgagtccgcaagtgatagcctgaaatcttttttcaaacaaccgttgtactgggtgtcctgtattagccacttttatccctccctgttaaggacgccaagcgctggaggcctcaaggccgagggtcagttgaaactgttactgtctcaacctcggtgtaattggaatttgttattggagaccctgcttcatcatgatggcttactgctgcggatcctgctgaaaagcagtaagcaagtgtctgacaccgaaaataacttaaatcagggaccctcccttatggaggccatttttaaaatcctttaccactgttctttttcaccccagacttttgcaaatgttttcgtgtcttacatggaggaggagcagctgtgggacttcctttacaacataccagtcagcacatgcgtcgaatatgaacttgaggttatccggtgcctacggttggctcttacagacgccattaaagataccgtgcagcagattgtctcagtgatgagctcacgccggaattgtgaaacaaatctgaacaagcacatcgtgcccgactgtcttcttgagtcaatgcctaaggaatggaactattccccgaaggagaccaaccggaaggaatcatgcaaatcatttaccaggcttacggcccaggcagtaagcattgttataagcaaacttccaaccgttatcgcctgcctgcccccgcctgtaaagtacttctttttcctctccgaaagaaagatgagcaaaaagttcgtggaactgaagaaggctggtcttctggtatggaacctcatcgtgattatttgcaggattttcgaggatggaaacacagtggagctgttaactggtgccagcttagatagatggtcaaaggaaaaactgggactgatttgcatgtgtctcaagagcatcatgggcgatcagacttccatccataatcaaatgatacagaaagtgattcagtccattgagcaacaaaaaccaaattggattgagaggcaactcctcaaagctcgaaagttgtccaccgagtgcgcctttatgacgattgagaagagcacggccctgcaggaaggcgacgtggcgttggaactcaccgaacagaaaatcaacacaatggtgctcgacctgtgccataagccaggaggaagggagtacctaagacagatttaccacataatgcagttaaacgaggagtacttgaaggaacagctcttctctatgaattctagtgaggagaaaccactgcctattcgcccactcaagactacactgcggagcattgaggaccagcctagcgctttcaacccgttccacgtctataaagcattcagtgagaatatgctagaccaaagtgccattactaagtggaattggaattgggcaaaactcctaccaaactacttgcgccttgacaaaatgaccttcagtgtgcttctcaagaacagatgggagatgaagaaggatgaaaccttggaagaggaagaaaaagcaattcttgagcatctgaagcagatctgtacaccacagaattcttcagcctcagacaacatcgaggagcagtag

SEQ ID NO: 50075 - DNA, 132 bp, Artificial Sequence
  Description of Artificial Sequence: Synthetic coding sequence
cggctgcggagccggccccaggccggcggcgccggcagcgccgccgcctgtgggccaggtcagggaaggtttcgtcgagcagccccacgaccaagtagctcccgagtgtgcggacagcggacaagcaggtag

SEQ ID NO: 50076 - DNA, 585 bp, Artificial Sequence
  Description of Artificial Sequence: Synthetic coding sequence
atggtgacctggagccacagcaacagcaacaaggagctgaagcaggagaactctgccctggcggaacagctacaggtggtactgatcgataaagccgggatgcagtgcgatctggaagaactcaagaagaagcttgagctgacagagctgacgttgcaacagttgagcagttggtgtgaagcacctgacgcgaaccagcaactgcaacaacccacagacgagcgggcccaactcgaggcacatttggggcaagttatggagtggttaaaatacttgcagatggagcgcgagcagtacgccgagtatctccacggcgaatccgcgatgtggtggcaaagaatgcgagagatgagtgaacaggtccacactttgcgagaggaacgtgttcactccatgagcagggtgcaggaactggaaaccatattggcggaactgagaaatcaattgaacccatgtcctcgcagcctgcagcagggtcccccaaaatggtcacggtcatacaaacagcgtttgtctacctgcggaagatcatggaggatttggcaggattcctttaagcccaagtggaagaaaatgagagcctag

SEQ ID NO: 50077 - DNA, 879 bp, Artificial Sequence
  Description of Artificial Sequence: Synthetic coding sequence
atgatgttctactggctgctgagcatcgtgggccggcagcgggccagcccaggctggcagaattggagcagcgcacgcaatagtgcctccgccgctgaggccagatccatggctctccccacccaagctcaggtggttgtgtgcgggggcggcataaccgggacatcagtcgctcaccatcagtcgaagatgggctggaaggatatcgtcttactggaacaaggccgactagccgcaggctccacgcggttctgtgcgggtattctctcaacagctcggcatttgaccatcgaacaaaagatggcagactacagcaataaactctatcatcagctggaacaagagactggcatccggaccggctacaccagaactggctccattttcttagcgcaaacccaggacagactgattagcttgaagagaatcaacgcaggcttaaacgtgatcgggattccctccgaaatcatctctccaaaaaaagttgccgaactgcatcaccttcttaatgtgcatgatctggtcggggccatgcacgtgccagaagatgcagtggtcagtagtgctgatgtagctctggcactggcatcagcagcctctcaaaatggagtccagatttatgacagaacttctgtgctacaggtgatgggcaaaaagggccaagtcacaggagtcgagacagataaaggccagatcgaatgtcagtattttgtcaattgtgcgggacagctgctgtggatgctgatggaggagtttatattcggtactggtagagtggcctcatgtctaggggcactgagacggacccagaatcagttcagcctcagggctcggacttcttggaggttccgaatatacagaggcctgggatcgctgtag

SEQ ID NO: 50078 - DNA, 1989 bp, Artificial Sequence
  Description of Artificial Sequence: Synthetic coding sequence
atggtgagccagagcaccgtgcggcaggacagccccgtggagccctgggagggcatcagcgaccattccgggataatagatgggtcgcccagacttttaaataccgatcatcctccatgccaactagacataaggctcatgaggcataaagctgtgtggataaacccccaggatgtgcagcagcaaccccaggaccttcagagccaggttccagcagcgggtaattctgggactcattttgtcaccgatgctgcttcaccctccgggccatcacccagttgcctgggtgatagtctggcagagaccacgctcagtgaggatactacagacagcgtcggcagtgcctctcctcacgggagcagcgaaaaatcaagttcattttctctgagcagcacagaagtgcacatggttaggcctgggtacagccacagagtgtccctgcccactagccccggcatattagcgacctccccctaccctgagaccgacagtgctttttttgagccgagccatctgactagtgccgccgacgagggagccgtgcaggtctcacgccggaccatcagcagtaatagcttctctcccgaggttttcgtcctccccgttgatgttgaaaaagagaacgcccatttttatgtagctgatatgatcatttcagctatggaaaaaatgaagtgtaacatactatctcagcagcagaccgagagttggagcaaagaggtgtctggactcctgggatccgaccagccggatagtgagatgactttcgacaccaacatcaagcaagaatctggatcctcaacaagttcttactctggatacgaagggtgtgctgtgctgcaggtatctccggtgactgaaactagaacttaccacgacgtgaaggaaatttgcaagtgtgatgtagacgagtttgtcattctcgagctcggagatttcaatgatataaccgagacttgttcctgtagctgttctagtagcaagtccgttacctatgagccggacttcaacagcgcagagctcctggcgaaggagttatatcgcgtgtttcaaaaatgctggattctgtccgtcgtaaattctcaactggccggctccttgtctgccgcaggaagcattgtcgtgaatgaagagtgtgtgcggaaggacttcgagagctcaatgaacgtggttcaggaaatcaagtttaaatcgcgcatacggggaactgaggactgggcaccccctcgctttcaaatcatttttaatattcatcctcctttgaaacgggacctcgttgttgcagcccagaattttttctgtgcggggtgcgggaccccagtcgaacctaagtttgttaagcgcttgagatattgtgagtatctcggaaagtatttttgtgactgttgccattcttatgccgagtcttgtatacccgccagaatcctgatgatgtgggactttaaaaaatattacgtgtctaattttagcaagcaactgctcgatagtatctggcaccagcctattttcaatctcctgtccattggccaaagcctgtatgcaaaagcgaaggaactggacagagtgaaggaaatccaggaacagttgtttcacattaagaaactcctaaaaacttgtagattcgccaactccgccctcaaggaatttgagcaggtgccgggtcatctgacagatgagctccaccttttcagcctggaggacctggttcggatcaagaaggggttgcttgccccgctgctgaaagacattctgaaggctagcttggcccacgtggcaggctgcgaactgtgccagggcaaggggttcatttgtgaattctgccagaatacaacggtgatattcccattccagacagcaacgtgtcggcgctgctcggcctgcagggcctgcttccacaagcagtgctttcagagtagcgagtgccccagatgcgccaggattaccgctcggaggaaattactcgaatctgtggccagcgccgccacttag

SEQ ID NO: 50079 - DNA, 297 bp, Artificial Sequence
  Description of Artificial Sequence: Synthetic coding sequence
gtgtgcggcagcacccaggagaagaccgtgttccggctggaggccatgctggaaagaactgccggcgtgcagagtaaagaggcagccctggaagaagaggctgtgctgaaagtggaagacataatggccgaggtggaggtcgtggtcgaagttgaggtcgtcgttgaagtggaaccagatgtgggttggcagaaggaaggacagcgcgcccagcccggccctggcccttcaacccccggtccaagtatggattctctcgaggtgcttcacttggaactcggctcagtgaatgcttag

SEQ ID NO: 50080 - DNA, 459 bp, Artificial Sequence
  Description of Artificial Sequence: Synthetic coding sequence
atgctgttcagcttcgagcacaaggccgtggccctgagcgccacccgaagggctacaccccggccccagccttgggtgcttgggttgcaaggcagaggcggggagggcgatgccaggacctgcggcgcaggacgagagaggggtctgcctgggccagcccttgatactgagccgaggtgggatcccaggcggctttgtgaggccttgcgcgccccaggccggcgcctggagggggctgggcagccaccagccacttccggaggtcccgcgacaagcggccgcagtaaggagccttggggtcacattagcggttgcggcgaccctccaggggcgtttcgcggtagcgggcgtatatgccaaggcacatctggcgcccggccctgcttctgcagagcaccggggtatccttggatggcagcgctttgccctagacggcgccctggacggcactccgggtag

SEQ ID NO: 50081 - DNA, 441 bp, Artificial Sequence
  Description of Artificial Sequence: Synthetic coding sequence
cccggcccccccggccggcccggcaagcccggcttccccaagcccggaggaccgggtggccctgcaatccctggggctccaggccgacccttcgtgccaggaatccctggctggccaggcgcaccagccgctcctgggtttccgatgcccagtggccccaggtctcccggagggccttggggtcctggggggcccattggtcccatctcacctggcccaggcattcctgggggccccggcgggcctcggggccccggtcggccggcgggccccacgtcccccttcggcccctatgggcctctgagcccagggtttccgggctccccaggtactccagggtttccgaccgcggatgggcctggtggaccaggtaatcctggttcgccatggtctccaggactgccctacccaagaggccctgcgggccctggcggcccctag

SEQ ID NO: 50082 - DNA, 84 bp, Artificial Sequence
  Description of Artificial Sequence: Synthetic coding sequence
gtgccccccctgcacagcagcctgggcgaccgggcccggttcctgcggccgtgcctgaagaaaaagactaagaaaaagcgctag

SEQ ID NO: 50083 - DNA, 3063 bp, Artificial Sequence
  Description of Artificial Sequence: Synthetic coding sequence
cagctgcggcggagcgagctggagcacagcgtggacctggaggaggcgctggggaggcttgaggctgcggaggagcggagtacgggcctgtgtcaggtgaacgccctgctccgcgagcagcttgagcacatgaagaaagcaaacgatgctcttggacgcgagctcgcagggatgactgggagtgtacagcggctgcagggtgaactcgagctccgtaggtgggcccaaaggcaggagcccagtaggacaagaagtggaggactcggccagccccgggatctcctgcttttgtggagacaagccgttgtcttgggcaccgatcttgcagagcttcgggtcgccactgagaggggcctggccgacctacaggcagacacagctaggaccgctagaagattacatacagcatgtttgaaccttgatagtaacttgagactgtcggccagctccaccgcatctaccctgggtcaacagctgcgcgacaaagccggagaaatgctgcagcttcagggcagatgggatgccgagaaggtggctctccaggctcgtctttccgagcagacactgctcgttgaaaagttgaccgaacaaaacgagcagaaggccaagacgatcgccgccttgaggaccgatctgcagaatctggtcggaggtcaagatggcgggggttgtgtcgccggagtttgccatccctgcagtggggtttcaccagcaaccgggtccctagtagcacaggaggacgcaagatgtctcgagctggcgggttcttccatcacagagcttggcgagcctaggagacccttgagatccccacagagagcgactagtcctcatcaaggagctagtccaccacatatatgctcccctgctaccttggatcccgccctgcaagccatgagggccgccatcgaacgacggtggcggcgcgagcaggaactttgtctgcagctgaagtccagccaagcactggtagctagcctgcaggagcaattatccgagagcaggagagagctttgggccgctcagaagctccagcaggaacgggcccgcgagcaggcaagagaacgggaggcactgaggggtcagctcgaagcccagagattggaagtacagcagtgtagagcctcttgtaaactgctgggacgcgaaaaagcagcattggaaatggtggttgaggaacttaaaggcaaagccgacgcagccgatgcggagaagcagggccttgaggctgaagcggctgagctccagagaagcttgctcctgcaggcagaacggcgagaggaactcgcgctcagacgcgaacgcagttgtcgagccctggagacaagccagggacgcctgcaacagctggaagaaaaggtgagtgggctgagagaggagctggctagtgtgcgtgaggcgctctccaccgcccagctccagagggacgttgtcgaatccgagcgcgagggcctgcggagtgccttagccagggccgaatgttcgaatgctgacctggagctcttggtcagacgcctcaaaagcgagggggtagaacaacgcgacagcttggctgccatggcggccctgatggaggggctggcacaggataagtccgctctgaatcacctcgcgttgcagctagaacaagagagagaccagcttagagagcagagaaaaacgctggagcaagaacgagcacgcgcaggcgagcagctggctcaggcagagcagcagctggcattagaaagggcggaaaggaggggcctccagcaggcctgtgggcgcctagaacaaaggcaggagcagttagagggtcaggctgctctgctgggccgcgagaaggcacagctgcaggaacaagttgggcaggtcacttgccaaaaacaggctctggaggaacagctggcacagagcctgcaggatcaagaggcccagatgggcaccttgcaacaggcattgcagggcaaggacgcactctcagaggaaagagcccagcttcttgcgaagcaagaagccttggagcggcaaggaaggttggccgcagaggaggccgctgatttgagagtggaaagggactcattggaatcatcactgctggaggcacaacagctggcaaccaagctgcaggagcaacttgaagaggaagcaagatccgctggcctcgcacgccaggcactgcaagttgagatggaacagctgcaatccgactgggaagtgcaggagatgaaactacgacaagataccgttcggttgcaacggcaggtagcacagcaggaacgtgaggcccagagagctctagagtctcaagctctagctcatcgagaggcgctcgctcagttgcagagagagaaggagaccctgtctctcaccctggcggaggagaaggaagttgcccggtgtcagctcgaacaggaaaaggaactggtgactaaaagcgcggccgaaagggaggctctgaagggcgagatacagtcacttaagcaagagcgggatgaaagtctgcttcagttggagcacaaaatgcagcaggccttgtccttgaaggaaactgaaaggagcctgctcagcgaggagctttcacgcgctaggcggactctagaaagagttcaacaagaagcccagagccagcaggagcaggctcaggcaacaatctcggcaacaacggaagaactgaaggctctccaagcccagtttgaggacgccataactgcccatcagcgcgagacaacggctttgcgtgagagcttgcaggatctcgccgccgaacggggggatgtagaacgcgaggcggaacgtctgagagcccaactgaccgtggcacaggaggggttagccgctctgcgtcaagaactccagggcgtggaggagtcgcgcgaggggttacatagggaggcacaagaagcccgtcgcgctctaagcgacgaagctagagagaaggacgtgctattgttgttcaactcggagctgcgggcgactatttgccgggccgaacaggagaaagcttctttcaaaaggagcaaagaggagaaagagcagaagctgctcatccttgaggaggcccaggcagcgcttcaacagtag

SEQ ID NO: 50084 - DNA, 1395 bp, Artificial Sequence
  Description of Artificial Sequence: Synthetic coding sequence
tgagccctgtgctgggcccgggccctgcccagccggcccggcgccagccggtccggtggccttgaagagtctagggatcgccccagacccctcccgacagagcccgcagtgcgcccgaaggagcctggcaccaaaagaaaggggctaggcgagggagtgcctagcagccaacgcggcccaaggcggttgtccgctgaagggggcgataaggctctccacaagatggggcccggcgggggaaaggcaaaagcactgggaggagctggcagcggaagtaagggaagcgccggtggaggatcaaaacgcaggttatcgtcagaggactcatcgttggagcccgacctagccgaaatgagtctggacgactcctctctcgccctgggtgccgaggcctccacattcgggggcttccctgaatctccccccccttgcccacttcacggcggctcccgagggcctagcactttcctgcctgagcctccagatacttacgaggaagacgggggtgtttacttttctgaaggccccgagccaccgacggcatcggttgggcctccaggattactcccgggagatgtttgtacacaggacgacctcccctccaccgacgaatcagggaatggcttgcccaagactaaagaggctgcgccagccgttggtgaggaggatgatgattatcaagcgtattaccttaacgctcaggatggcgccggcggggaggaagaaaaagcagaggggggggctggggaagagcacgatctgttcgcgggacttaagccacttgaacaggagtcacgcatggaggtactgttcgcctgtgctgaagcacttcatgcccacggctatagctccgaggctagccgtttgactgtcgagttagcccaggacctgttagccaatcctccagacctgaaagttgaaccgccgccggcaaagggtaaaaaaaataaggtttccacctcacgacagacctgggtggccaccaacactctctcaaaggctgctttcctactgacggtcctgtctgaacgaccagagcaccataacctcgccttccgcgtgggcatgttcgcactggaactgcagaggcctccagcctcaacaaaagctctcgaagtgaagcttgcctaccaggaatcagaggtggccgctttgttgaagaaaatcccgttgggcccgtccgagatgtccacaatgcgatgccgcgctgaagaactccgcgaaggcaccctgtgtgactatcgcccagtgctacctctaatgctcgcctcgtttatctttgacgtcctgtgtgcacccgggagccgccctccatctcgaaactggaactctgaaacccccggcgacgaggagctcggctttgaagccgccgttgccgcactgggcgagtcctag

SEQ ID NO: 50085 - DNA, 3909 bp, Artificial Sequence
  Description of Artificial Sequence: Synthetic coding sequence
tgacccagcgccagcgaccagagcacctggtacctggacgagagcaccctcaccgataatatcaaaaagacactgcataagttttgcggacccagtccggtggttttctctgatgttaattccatgtatctgtcttctactgagccccctgctgcagccgagtgggcttgcctgcttaggcctctccgggggagagagcctgaaggggtgtggaacctgttatccatagtaagagagatgttcaaaagacgggatagcaacgccgccccactgctggaaattttgaccgaccaatgcttaacatacgagcaaatcaccggctggtggtatagcgttcgcacaagcgcaagtcattcatccgcgtccggccacacagggcggtccaatggacaatccgaagttgcagcccatgcctgcgccagcatgtgcgatgagatggttaccctatggcggttggcggtactggaccctgcactctctccacagagacgacgtgaattatgtactcagctcaggcagtggcagcttaaagtcatcgagaacgtgaagcgcggccagcacaaaaagacgctggagcgcttgttcccgggtttccggcccgccgtggaggcttgctactttaactgggaggaggcatatcctttgccgggtgtaacctattcaggcactgatcggaagctcgccctttgctgggccagggccttgccatctcgaccgggtgcttcccgctctgggggattagaggagtcacgtgatcgaccgcgccctctacccacagaaccggccgtgcggcctaaagaacctggaacaaagagaaaggggctcggtgagggtgtgccatccagtcaacgcgggcccaggcgtctgtctgcggaaggcggcgataaggcccttcacaagatgggaccaggaggcggtaaggccaaagctttaggtggcgcaggttcagggagcaaggggtctgcagggggcggaagtaaaaggaggctgagctctgaagatagctctctagagcccgaccttgctgaaatgtccctggatgactccagcttagccctgggggctgaagctagtactttcggtggcttcccagagtccccacccccctgccccctgcatgggggatccaggggcccgtccacattcctcccggaaccacccgacacatacgaggaagacgggggcgtgtacttctctgaggggcctgaaccccccaccgccagtgtcggacctcctggactgctgcctggcgatgtttgcactcaagatgatctaccctcaacagacgagagcggaaacggcctccccaagacgaaagaggcggccccagccgtgggggaggaagatgacgactaccaagcctattacctcaacgctcaggatggcgccggtggagaggaggagaaagctgagggtggcgctggcgaagaacacgatcttttcgcaggtctgaagcccttagagcaggaaagtaggatggaggtactgttcgcttgcgctgaggcactacatgctcatgggtactctagtgaggcaagccggcttacagtggaactagcccaggacctattggctaacccacctgacttgaagggcaaaaaaaataaagtatcaactagcaggcaaacttgggtcgctacaaacacactgtcaaaggcagcttttctcctcaccgtgctcagcgagcgccctgagcaccacaacctggcttttagggttggcatgtttgccctggagctccagagacctccggcgagcacgaaggctttagaggtcaagctggcctaccaggagtcggaggtggcagctctgctgaagaagatcccgctcgggccttctgaaatgtctacaatgagatgccgggctgaggagctcagggagggtaccctgtgcgattatagacccgtactgcccctcatgttagctagtttcattttcgacgtgctatgtgctcccggatccaggcccccgagccgaaattggaactcggaaacacccggagatgaggagctgggttttgaagctgccgtggccgccctcggaatgaaaaccaccgtcagcgaagctgagcacccgctgctgtgtgagggtactaggagagagaagggagacctggctctcgcactcatgataacatataaggatgatcaggccaagctaaagaagatcctggacaagctgttagatcgggaaagtcagactcataaaccacagacattgagcagcttctattcttcttctaggcctacaacagcctcacagcggtctccatctaaacacggcggacccagtgctccaggcgccctccagcccctcacatcgggctcggcaggccctgcccaacccggctcagtcgcaggggcaggacccggtccaaccgagggattcaccgagaaaaatgtgcctgaaagctcacctcactccccatgtgagggtctcccttccgaagccgcgctgactcctagacccgaaggcaaagttcccagcagactggccctgggatcaaggggcggttacaatgggcgtggctggggcagcccaggtcgtccaaagaagaaacatacaggtatggccagcattgattcctctgcccctgaaactacctcagactcttcgcctactttgtcccggcgaccacttaggggcggttgggctccaactagctgggggagaggtcaggactccgatagtatttcgtcctcctccagcgatagtttgggcagctcctccagttccggatcacgaagggcttcggcgagtggcggggctcgggcgaagacagtggaggtgggtagatataaaggacgtaggcctgagtcccacgccccccacgtgcccaatcagccgagcgaggccgccgcccacttttatttcgagttggcaaaaacagtactgatcaaggctggcggaaacagctctacttccatctttacacatccgtctagcagcggcggccatcaaggaccgcacaggaatctccatctctgcgcctttgaaatcgggctgtacgctctcggactgcacaatttcgtgtcccctaattggctttccaggacatatagcagccatgtgagttggatcaccggtcaggcaatggaaatcggatccgcggccctgaccatcctggtcgagtgttgggacggtcatctgaccccaccagaggtggcctcactcgccgatagagccagtcgggccagagactccaatatggtgagggccgcggctgaactggcactatcatgcttacctcacgcacacgctcttaatcctaacgagatccaacgtgccctcgttcagtgtaaagagcaggataacttgatgctggagaaagcatgtatggctgtggaggaagcagcgaaggggggaggggtttatcccgaggtgctgtttgaggtggcccatcagtggttttggttatacgagcaaacagcaggagggtcatcgaccgccagagaaggggccaccagttgcagtgcaagcggaatcagagctggcggggaggctgggcggggaatgcctgaggggcgcggtgggccagggaccgagccagtcaccgtcgccgcggcggccgtgacggccgccgcgacggtagtgccagttatttcagtggggtcatccctgtacccaggaccaggtctggggcacggtcacagtccaggactccacccatacaccgcgctccaaccccatctgccttgttctccacagtatctgactcaccctgcccatccagctcaccccatgcctcatatgcctcgcccagccgttttcccagttcccagcagcgcatatccccaggtgaggccagtcttctgttggggtgtgagacacggcaaaatcctcggaatacatagaggactggagtgggtgctttgggagtacaactggagtgtgggggagagctggtag

SEQ ID NO: 50086 - DNA, 327 bp, Artificial Sequence
  Description of Artificial Sequence: Synthetic coding sequence
cccagctgcgtgcccgtgctgaagggcgcccacgccgccgacagcagtaggtcaaaatggccggctcttatgggcacagggcggaaaagttttggtgcctttctgtttcaccatagcttcagctggggatggaagctaatcagcatcagtttcggtgatctcaacccttttccagtgcgccagatcagaaacaggagggcctatcatttggagaaggttagactggagctcaccgaactcgaagcgatccgcgaagacttcctccacgaacgagacacgagccccgataaaggggaactagttagcgatgaagaggaagacacatag

SEQ ID NO: 50087 - DNA, 3930 bp, Artificial Sequence
  Description of Artificial Sequence: Synthetic coding sequence
atgctgctgaacggcgactgccccgagagcctgaagaaggaggccgccgctgccgagcccccaagggaaaacggcctggacgaggccgggcctggtgacgagactaccgggcaggaggtcatcgttatccaagatacaggcttctccgtcaagatccttgcccccggcattgaacccttcagtctccaggttagtcctcaggagatggttcaagagattcatcaggttcttatggatcgcgaagatacctgccacagaacttgcttttctctgcacttggacggtaatgtgctggaccacttctccgagcttaggagtgttgaaggattacaggaaggctcagtgctgcgcgtggttgaggagccatacaccgtgagggaagcaagaattcatgtccgtcatgtgcgggatcttctgaaatccttggatcccagcgatgcctttaacggcgttgattgcaatagtctctctttcctttccgtgttcacagacggagacctcggcgactctgggaaaagaaaaaagggcctggaaatggacccgatagattgcacgccccctgaatacatcctgcccggctctagagagagacccctgtgccccctgcagcctcaaaatcgagattggaagcctctgcaatgtctaaaggtactgactatgtctggatggaacccgcctcccggaaaccggaaaatgcacggggatctcatgtatctctttgtaattacggctgaggatcggcaggtgtccatcaccgcaagcacccggggattctacctgaaccagtcgaccgcataccatttcaaccccaagcctgcctctccccgttttctgagccatagcctggttgaactgctgaatcagatttccccgactttcaaaaaaaactttgctgttctccagaaaaaaagggtgcagagacatccttttgaacggatcgctactcccttccaggtgtatagttggaccgcaccacaggcagaacacgccatggactgcgtgcgagccgaggacgcatatacaagccgactcgggtatgaggagcacattcccggacagactagggattggaatgaggagctgcagacaactcgcgaactaccaaggaagaacctccccgagagactactaagagagcgcgcaatcttcaaggtccactccgatttcactgccgcagcaacccggggagccatggcggtgattgatgggaatgtaatggctattaatccctctgaagagacaaagatgcagatgttcatctggaacaatatcttctttagcctagggtttgacgtcagggaccactacaaagacttcggtggagatgtggctgcctatgtcgcacctaccaacgacctgaatggggtcagaacatataacgcagtcgatgtggagggtctgtatacactcggaaccgttgttgtcgactacagaggatatcgggttaccgctcaatccatcattcctggaatcctggagagagaccaggaacagtctgtgatttacgggtcaatagattttgggaagaccgtggtctcccacccaagatatctagagctgctcgagagaacttccaggcctctgaaaatcctccgtcatcaggtgttgaatgaccgggacgaagaggtggagctatgcagcagcgttgaatgtaaggggatcattgggaatgatggccggcactacattctagatctcctccggacctttccccccgatctaaatttcctgcccgtacctggggaagagttgcctgaagaatgtgctcgcgccggctttccccgggcccaccggcataaactatgctgcttacgtcaggagttggtagacgccttcgtcgaacatagatacctgctctttatgaaattagccgcgctgcaactcatgcagcagaacgcctcccagctggaaacaccttcctccctcgagaacggcggcccatcctccctggagagcaaatctgaagatccacccggccaggaagcaggcagcgaggaggaaggttcctcggcctctggcctggcaaaagtaaaggagttagccgagaccattgccgccgatgacgggaccgatccacgtagccgcgaagttattaggaacgcgtgtaaagctgtgggaagcataagctctaccgctttcgatatcaggttcaatccggatatttttagccctggagtgcgctttcccgaaagctgccaggacgaggtgcgcgaccagaagcagttgctgaaggacgcagctgcctttctgctctcttgtcagatccccggactggtcaaggattgcatggaacacgccgtcttgccagtggacggtgctactctggctgaggttatgcgccagagggggataaatatgcgctacttgggaaaggttttggaactagttctgcgatctccagccagacatcagctcgaccatgtgtttaaaatagggatcggtgaactgatcaccagaagcgccaaacatatctttaagacctatcttcagggggtggaactgtccgggctcagtgccgccattagccactttttgaactgcttcctcagctcctatcccaacccagtcgcacacctgcctgctgacgaactggtctctaagaagcgtaacaagaggcggaagaatagaccaccaggggctgcagacaacaccgcatgggcagtaatgaccccccaggaactgtggaagaacatatgtcaggaagctaaaaactactttgacttcgatctcgaatgtgaaacagtggaccaggccgtggagacttacggtctgcagaaaattactctgcttcgggagatttccttgaagaccggcatccaggtactgcttaaagagtactcattcgactcccggcataaaccagcttttactgaggaggatgtgctgaacatttttcccgtagtcaagcacgtgaatcctaaggcatcggacgcgtttcatttcttccaaagcggccaggccaaggtgcagcagggtttcctcaaggaggggtgcgaacttataaatgaggctctaaacctgttcaacaatgtgtatggggctatgcacgtggagacatgcgcatgcctacgcctgctcgcgcgtctgcactacattatgggtgactacgccgaggccctgagcaaccagcagaaggctgtcctgatgtcagaacgcgtgatgggcactgagcatcctaataccattcaagaatatatgcacttagctttatactgtttcgcctcttctcagttatccacagcattatccctgctttacagagctagatacctgatgttactagtcttcggagaagatcaccctgaaatggcattgctggacaataatatcgggcttgttctgcacggggttatggaatacgacttatctctccgcttccttgaaaacgccctggccgtgagcaccaaataccatggccctaaggctctgaaagttgccctctcccaccacctcgtcgcacgggtatatgagtccaaagctgagtttcgctccgctctccagcatgagaaggagggatatacaatctacaagactcagttgggcgaggaccatgagaaaacaaaggagagctcagagtacctgaagtgtttgacacagcaagccgtggcactccagagaactatgaacgaaatctataggaatggttcctctgcaaatattcccccactgaagttcacagcacccagcatggcctccgtgttggagcagctgaacgtgatcaatggtattctgttcatccctctgagccagaaagatcttgagaatcttaaggccgaggtggcaagaaggcatcagttgcaggaggcaagtcgcaaccgagacagagccgaggaaccaatggccactgagcccgcccctgccggagctcccggagatttgggcagccagcctcccgccgcaaaggaccccagtccgtctgtccaaggatag

SEQ ID NO: 50088 - DNA, 459 bp, Artificial Sequence
  Description of Artificial Sequence: Synthetic coding sequence
gagggcagcatggacagcctgtacgagcccatccccgagcagcaggccaaccaagaaaacatgtctagccgtaccgattctccgattcctccctttggagaatctgagcagacccccaacaatctgtttgttggagtttccaacctggagaatgccaaaccgaaaaagcgcaagctgttccggcgttttatgtccgaaaataagatctttgaaggcaagaccgtcaacgataagatatggcaggaacactccaagcacaaaaatgactcacatatcaggcgaccgtgtcagctaaaggacttaaatgaaaacgacttcttaagtaataacatccatacctaccagggaaaaacgctccagggaacaagctaccaagttactagtgagtgttggtcaccatttcactaccagagacacgtggagaccactgtggatgagctggctcaggagttcatgtag

SEQ ID NO: 50089 - DNA, 840 bp, Artificial Sequence
  Description of Artificial Sequence: Synthetic coding sequence
atgccccaggaggagctgcacatgaaggagtgcccccacctgaagcctactccatctcaatgttgcggccaccggctcgctgctgacagagtccacgacagccatccaaccaatatgacccctcagcatcccaaaacccatccagaatcatgctcctattgtcgcctatcttgggcatccctcgtgcatggagggggggcactccagcctatagagacactgaaaaaacagatctctgaagaccgcaagcagcagctaatgctgcagaagatggagctggagatagagaaagagaggctgcagcacctgctggcccagcaggaaactaagctcctgttgaaacagcagcagctgcaccagagtcgactggactacaattggctgaaggcccaggctctgtttaaatcacgagaactcgtggcggaaaaacagcttacaaagccccaggaacttaagctggacatgaatggaagcgacagtgggccatccctattaaagtccaattgcgacggatggctcctgggaaccagttccagcatcaaaaagcaccaagacccccccaattcaggcgagaacaggaaagaacgcaaaactgttgggttccatagccacatgaaggacgacgctcagtggagctgccagaagaaggatacctgcagaccccaacggggcacggtcaccggggtgcgtaaggacgcatccacttcaccaatgcccaccggatccctgaaggacttcgtgacaacagcatctcctagccttcaacatacaactagcaggccaggcatctcgacgaagatctgtttcctctcaaaccatttctttatcttatttagctag

SEQ ID NO: 50090 - DNA, 399 bp, Artificial Sequence
  Description of Artificial Sequence: Synthetic coding sequence
atgagcttcgagtaccggcactacaagcgggaggccaagatctgcacttgtcgaggcggctgggcacacgtgctgctttgcattggggtgagccagggtgcttgcgctgagcacttgccacatagaccagcagtcgagaaagacgtgcccggggccggcgaagtccttttcatgtgttcctggagaatcttccctgtggctagcgccagcccgagttcaagcatctccggcctagctggccattcagtgttcctggttcccggtctggctgcgcacccggggtcacattccgatcagccgccaggggtgccgtcccgccggaagtcaagattggagcgctggtcgccaagcgttagccgaagtaccagccctcccacggaggctcccttctgcctgtag

SEQ ID NO: 50091 - DNA, 1254 bp, Artificial Sequence
  Description of Artificial Sequence: Synthetic coding sequence
atgaaggccctggtgcccgtgaccagcagcggcacctggtactgcctggaacggcgccctgcggtctttgttacgagcagcgtaagcagtcctgtaaaatttactcacgatattagtgtcacaggcaacgggattgtcctgcctcccaagccaaaatcaaaggtgaaatggtgccatttctctaccctgccaaagcccaagcctcagctctctcgctcctttgagaagggggatgacttcagcgggaagaagttttgtattcttaccgctatcaaacctaccaacttggaaaaagaaaagctgcgcttctttaagtcagattatacgtataatccccagttcgagtacgctaaccctgctctacctagtgttttagcaaagcactcccatgctagcgatcgcttcctcaagcagtctattaacattatggaacttacactacaaaagtatggaagctacgagaagttcgaacaggccactggagggtcgcttcttagcaagacacgcatttggtcccatgttcgaaagtacatgatgaaagaaggttgcctgggggagattgtggtccatctaacggaggacctgctttctagagcctcaatgacggtcgtaaatgggtgccctacactgactatcaacgtgagcaccgcacgagaacattggctcgaagggatgctccgccatgaaatcggtacccattactttcgagggattaacaatctgcagcagccctggaatagctggactgggcggaaaaagcatgagctgaagccaaacaaccctactgaagaagggctagcaagcatacattctgtgcttttccgcaaggacccctttctgtggagagccgctctcctctattacacagtgtaccaagcgagtcaaatgagtttctgcgaactcttcaaggacataggccggttcgtgaaggatcccaacacacggtgggactactgtgttcgcgcaaaaagaggctggactgacacttctcagccaggctgctttagcaaagatcaagtctatttggatgggatcctgcaaatactgagatatcgcgacaccatcgacttccatctgctcaccgcgttagggaaggtgagctatgaggatgtggatcggctaaagggactagctgtaacagaaaacatgagggtgcctcatttcctgcaagaccacgggcgctacatggagcatctcgagaaaattatggaggttaacgagctgaccgaccgggagctgaaggacctgatctag

SEQ ID NO: 50092 - DNA, 627 bp, Artificial Sequence
  Description of Artificial Sequence: Synthetic coding sequence
atcacccccaccccccccccccccccccggagccgggagaaggagtccccacgagttgctgccagagtggtcgtccccgtgcgcagtagagagagagtgctcacaagtatgggattgactggtgtcgagggacgagggtgccgatattccggctgcaagatgtggcccgtgagggccgtcagtatcttttccacccttattggccggcgtcttgcctggcggaggggttctgaaggcggcactgcatgtaccaagggcctcgtattacccgccggagacgagcctgggcccgggccagaattattcccagaatccgccctcgtgcaggctggaagtgctccgcccccaccccctcccccaccaccgccacccctgtgcctcctgctgctaagagctgagagcgagggagccgtgctcatgacccacccacgggcttgggagcagagaggcggaggtctgcgggaagccagaggaggcctgggcgccgctagaagtcctcgcgagcaggaacagcgcgaggaggaagaactggctcgacgtcccagggccccgtctgccccgtcccgccgcctggaaccagatgcctccaatcccggctggccggccgccgaaccctggccaggatag

SEQ ID NO: 50093 - DNA, 537 bp, Artificial Sequence
  Description of Artificial Sequence: Synthetic coding sequence
atggtgagccagagcaccgtgcggcaggacagccccgtggagccctgggagggcattagcgatcattctggtatcatagacggcagtccacgcctgctgaatacagaccatccaccttgccagcttgacatacgcctcatgcggcacaaggctgtctggattaatcctcaggacgtgcaacagcaaccccaggacctgcaaagccaggtcccagccgccggcaatagtggaacgcacttcgtgacggatgccgcctccccctccggcccatcaccatcctgtctgggcgacagtctggccgaaaccacattaagcgaggacacaaccgatagcgtggggtctgcttcccctcacggtagttccgagaaatcgagttcattctccttatctagcaccgaagttcatatggtccgccctgggtattcacatagagttagcttgcctacatcacccggaattctggctactagtccatatcccgagacagactccgcattttttgagcctagccacctcacttcagctgcagatgaatag

SEQ ID NO: 50094 - DNA, 207 bp, Artificial Sequence
  Description of Artificial Sequence: Synthetic coding sequence
gtggccgccgtgaccgagcggaccagcggcaacctgagcgccagctccgtgaaatgcgatcacaaataccgcgtgcctggctctgcccgcgaccgctctcattacgtggatagagcggggctcaaattgctcgcttctagttcccctcccgccgccacttcacaacagcattggaatgaccgtagaacgccccttaacatccactag

SEQ ID NO: 50095 - DNA, 1554 bp, Artificial Sequence
  Description of Artificial Sequence: Synthetic coding sequence
atgctggagagcatccgggtgaccgagaagctgcactggcccgagcaggagcttgccaagaagtcaatactgaatgctgaggattcactaattatcgataacaagcgcagcatttcacacctctcttcaggagtactgaaagatatatttaccactggcacaagttcctacaatgtcctgctgcagagcaaagaggagaagaagtatcatagccaaaagcaaagcagttctacctactcaaagcgatgcagaaaacccagcaaatctccaaacactagcaggagtaaggatcctagaagaatgaaagcccttgttccggtgacgtccagcggaacatggtactgcctggagcggcgacctgccgtgttcgtcacttcctcggtctcctctccagttaagttcacccatgatatcagcgtgacaggaaatggcattgtcctcccccccaagcccaaatctaaggtcaagtggtgtcatttctcaactctcccgaaacccaaaccacagctgtcacgctcgtttgagaagggagacgatttcagcggcaaaaagttttgcatcctgaccgccattaagcccaccaacttggaaaaggagaaactgcgcttcttcaaatcagattatacatacaaccctcagttcgagtatgccaaccctgctctgccatctgtgctcgctaagcactcccatgcctccgatagatttctgaagcagagtataaacattatggaactgaccctgcagaagtatggatcttatgaaaagttcgaacaggctacggggggctctctgctgagtaagacccgaatctggagtcatgtgcgcaaatatatgatgaaagaggggtgcctgggcgaaattgtagtgcaccttacagaggacctcttgagccgagcctcaatgacagtcgtaaatggctgtcctactctgaccatcaacgtgtctaccgcaagagagcattggctcgaaggcatgcttaggcatgaaatcggcacccattattttaggggcattaacaatttacagcagccttggaactcgtggaccgggcgcaagaagcatgagttaaaacctaacaatcccaccgaagaagggctggcctcgatccactctgtgctgtttcgtaaggatcccttcctgtggagggcagctctcttgtactatacagtgtatcaggcatcacagatgtcattttgtgagctctttaaagacatcggtagattcgtgaaggacccaaatacccggtgggactattgcgtacgggctaaacgtgggtggaccgatacctcacagcccggttgcttcagcaaggatcaggtgtaccttgacggcatcctccaaatcctccggtaccgggacacaattgatttccaccttctgacggcccttggaaaggtgtcatacgaagatgtcgacaggcttaagggccttgctgtcacggagaatatgcgcgtgccccacttccttcaagatcatgggcggtacatggaacatctggagaaaattatggaagtcaacgagcttacagacagagagctgaaggatctcatttag

SEQ ID NO: 50096 - DNA, 438 bp, Artificial Sequence
  Description of Artificial Sequence: Synthetic coding sequence
ggcgagagcgaggacgtgacccagttcctgcagagccacaagaagactctgactaatgagaaattgttccttatggatggtaagcgcacatggttcctcgagatggaatctactcctggagaagacgctatgaatacagtgaagatgactaccaaggatctgaagtacgacagatccctgattgacaaagccggctttgagcgcacggacagcaattttgaaagaagtcatacagttgggaagatgctgagtaactcaataatgtgctatcgcgacattttctatgaacgggaaagtcagcttatgcagcagacctcactcttgagttacgaaattgcaattgccactcctacattcagtaactattatccagattggagcgcaccaatcaacatcgtggcacgtccgtccacctctaaaaaaatcatgacatgctag

SEQ ID NO: 50097 - DNA, 1695 bp, Artificial Sequence
  Description of Artificial Sequence: Synthetic coding sequence
atgctgatgtggccccagccccacctgcccacccacccccacctgccaacacatccacatctgccaacgcatcctcacctcccgacacatcccatgatgtctaaggagactcggcagtcaaaacttgccgaggccaaggaacaactgaccgatcaccacccccagacaaatccgtctgtcggcacggccgctagtgacacaaagaagaagaaaatcaacaatggtaccaaccccgagactaccacaagtgggggttgtcacagcccagaagatgagcaaaaggcaagccaccagcaccaggaagcgctcagacgggagctggaagctcaggtgcacactataagaatcctcacatgccagaaaacagaactgcagatggccctctactacagtcagcatgccgttaagcagctggaaggcgaggctcgagacctcatatctcgtctgcacgactcctggaagttcgcaggcgagctggagcaagccctttcagccgttgccactcagaagaaaaaagctgatcgctatatcgaggagcttaccaaagagcgcgacgctctatccttggagctctatagaaacactattactgatgaggaactgaaggagaaaaatgccaagctccaggagaaactgcagttggtggaatcggagaagtccgaaattcagctgaacgtaaaagaactgaagcgtaaacttgagagggccaagctattacttcctcagcagcaactgcaggcagaggcggaccacctggggaaggaactgcagtctgtcagcgctaaactgcaggcacaggtggaggagaacgagctgtggaacagacttaatcagcaacaggaggaaaagatgtggaggcaagaggagaagatccaggagcgagaagagaagatccaggagcaggaggaaaagatccgcgagcaggaggagaagatgaggcggcaagaggagatgatgtgggagaaagaggagaagatgaggaggcaagaggagatgatgtgggagaaggaggagaagatcagagaactggaggaaaaaatgcacgagcaggaaaaaatccgagagcaggaggagaagcgccaggaggaagaaaaaattcgcgaacaagagaagagacaggagcaggaggccaagatgtggcgacaggaagagaaaatacgggagcaggaagagaagatccgggagcaggaagagatgatgcaagaacaagaggaaaaaatgggggagcaggaggaaaaaatgtgggaacaggaagaagagatgcaggaacaggaggagaaaatgagacgccaggaggaaaagatcagagaacaggagaagaaaatccgtgaacaggaggaaaaaataagagagcaggaagagatgatgcaggagcaggaagaaaaaatgggcgagcaagaagggaaaatgtgcgagcaggaagctaagatgcaggagcaggaggaaaagatgcgcagacaggaagagaagattcgcgagcaggagaagaaaatccgtgaacaggaagaaaagattagggaacaggaggaaatgatgcaggaacaggaagagaaaatgtgggaacaggaggagaagatgtgtgaacaggaagagaaaatgcaggaacaggaagagaaaatgcggcgtcaggaggagaagatgcgcgagcaggaggttcgactgcgacagcaagaggagaaaatgcaagagcattag

SEQ ID NO: 50098 - DNA, 744 bp, Artificial Sequence
  Description of Artificial Sequence: Synthetic coding sequence
ggcatcgtgggcggccacaacgccccccccggcaagtggccctggcaggtatctctcagagtatactcttaccattgggccagctgggcccatatatgcgggggatccctgattcatccccagtgggtcctaactgctgcacactgcatattctggaaagataccgatccctctatctaccgcatccatgctggcgacgtctacttgtacggtggccgggggcttctcaatgttagcaggatcattgtacatccaaattacgtgacagccgggctgggtgccgatgtcgccttactgcagctggagcctcatgacctgtctaacgtccggacggtcaagctgtctccagtctccctcgaactgacccccaaggaccaatgttgggtgacggggtggggggccattcgcatgaaggagtcactgccgcccccctaccggctccagcaagcgtccgtgcaggtcctcgaaaatgccgtttgtgagcagccataccggaatgcctctgggcacactggagacagacagttaatactcgacgacatgctgtgtgccgggtcagaggggagggactcctgctacggcgactcaggtggtccactggtatgcaggctgagggggtcctggcgcttggtaggagtcgtctcatggggctacgggtgcaccctccgggatttcccgggcgtctacacccatgtgcaaatttacgtgctgtggatactgcaacaggttggggagctcccttag

SEQ ID NO: 50099 - DNA, 540 bp, Artificial Sequence
  Description of Artificial Sequence: Synthetic coding sequence
atgggcagctggcactgggagtggtacggcgcccccaccagcaccctgtctttgggctgcttattgctaccaggggaaaagtggactttccttattctaccaagccactatggaaccacgacgcatgcacattctctccaggggtgcgtggagcggcagtggcaagacagtaaacagctcgccatatcacctggaccaacgctgttgcggagtgagtatgtcggtagtctttcgcctgtctgtagcagtttgacgcaggtccaccgagtgccatggggacagcacagggcttgtcccgtgatgctgctagtttttacgaagtggctgcagaggtacctgcattttgagaagcccgctgaacccgcctccgtcggccaggaccctgacttctttggcaagtcagagggcgaaagggctacctgtttgctgagccgctcttgcctatacctcgcgtctgtctgtaacctgagggagaacgattcctgcatggggcgcagcggcggaacaggcaagagcgacttgcctggctcctgcaggtag

SEQ ID NO: 50100 - DNA, 84 bp, Artificial Sequence
  Description of Artificial Sequence: Synthetic coding sequence
ttccccagcttcgacatcagcttcttcctgttcatctacctgttcaactcatctcactcccccgatcgggtgtccctgtgttag

SEQ ID NO: 50101 - DNA, 1161 bp, Artificial Sequence
  Description of Artificial Sequence: Synthetic coding sequence
atgggcgtgggctgcttcaaggacgaccggatcgtgttctggacctggatgttctccacatatttcatggaaaagtgggccccaaggcaagacgacatgcttttctatgtgcggcgaaagctggcctatagtggctcggagtccggagccgacggaaggaaggcagccgaacccgaggttgaagtggaggtctaccgccgggacagcaaaaagctgccgggtctgggcgaccctgatattgactgggaggagagcgtatgtttaaatctaatcctccaaaagctcgattatatggtgacatgtgctgtgtgtacaagggctgatggcggggatatacacatccacaagaagaagtctcagcaggtcttcgccagtcccagcaagcatcctatggacagtaaaggcgaggagtctaaaataagctatccgaacatcttcttcatgattgacagcttcgaggaagtattttcagatatgactgttggcgagggtgagatggtctgtgtagagctcgtggcatcagataagacaaacaccttccagggtgtaatcttccaaggttcaattagatatgaagccctgaaaaaagtttatgataatcgcgtctctgtggcggccagaatggctcagaagatgagttttgggttttataagtattctaatatggagttcgttaggatgaagggcccacagggaaaaggccacgccgagatggccgtatctagggtttctacaggggatacaagcccatgtgggaccgaagaggactcctcaccggcttcccccatgcacgagagagttacctccttctctacacccccaacacccgaacgtaataatcgaccagctttctttagtcccagcctcaaacgcaaagtccctaggaataggatcgccgagatgaagaaaagccattcggccaatgactcagaagagttcttccgagaagacgacggcggagccgacttgcataacgcaactaacttgcgttcacggagtctttcagggaccgggcggtcgctggtaggctcctggttgaagcttaatcgcgccgacggcaatttcctgctttatgcccacctcacctacgtcactctccctcttcaccgaattctgaccgacattctcgaagtcaggcaaaaacccattctgatgacctag

SEQ ID NO: 50102 - DNA, 393 bp, Artificial Sequence
  Description of Artificial Sequence: Synthetic coding sequence
tggaagccccagcacagcttcttcttcctgctgctgctgtggctgcccgacaccaccggggagattgttatgacgcagtctcccgccacactcagtctttcccccggagaacgcgctactctgagctgccgcgcctcacagagcgtgagctcgtcttatttgagctggtaccagcaaaagcccggccaggccccacgtttgttgatttacggggccagtacccgagctacagggattcctgcaaggtttagtggcagtggatcggggacagacttcacactaacaatttcctctttgcagcccgaagactttgccgtttactattgccagcaggactataacttgccacctaccgtgatccagcatgagactaaaacctcaacaaggccctag

SEQ ID NO: 50103 - DNA, 696 bp, Artificial Sequence
  Description of Artificial Sequence: Synthetic coding sequence
atggccaagtgggtgcccgccctgctgctgcggcgggtgcccctgttctcgctccgcttcagacctgccagcagtaccttccttccagttctcgcagccaccgagcccgccgtttctgtgcctagtggcgatctgtccatgcctgtcaaaacaagggccgagggagaggacgacggatttggtgaggctggagatcctcgtcgtttactcgagagaccatggcgctttagggggtgtttacccggcaagggaaatagggacgtgggcttcgagggcaccgaggggcctacgagtactagacccgagtgggtgtggtcttgcaggtgttgtctggggtgtagagctagcacaagagagcgtgtgacatctcccgttcgagcagccggcccacagccacggtttaccgatcgcgaaacagaggctgcagcaggaacgttggcccacatgggcttcgcaccacctacctcattctcacacttcaccgatcaagaacttagagattgctccagtcttgaatgtttaggggtagtggaaggagacccccatgtgctgtgctcaaccctcagtttatcccggccgagcccatccgccactcttactttgctcttagcttccagctgtctgctggcccccgcccctccctctttcattctcctgctcttcacgctcatagcacctgacctaccacactcgtag

SEQ ID NO: 50104 - DNA, 276 bp, Artificial Sequence
  Description of Artificial Sequence: Synthetic coding sequence
atggagatcgcccactacgccaaggtgttcaccgccgacggccacttgggttgctatattctggccactatgaattaccatagcgccaagcactgtggctcatgtcttcagagccagctgtgtaagcggttgaagcaggaggataggcttagtccgggtttccaggggcagctcggccagcatagtgagacatcctccctgaaaacggtgatcgggcctcttgctcctagctgccacctggctgatatgaagaattggaggtggcagcagtggtag

SEQ ID NO: 50105 - DNA, 492 bp, Artificial Sequence
  Description of Artificial Sequence: Synthetic coding sequence
atgtgcaccgtgggcggcaacgtgagcgaggacgcctgctacggcgaacctctggaattccccgaaaataccaagaacagggctacactggggagtagctcccccaccgccggacacacccctcaaagaaaagagattagaatctctaagatgtacctccacattcctatccattgctcaactacatataatggcagagacctggagtctaccagcgttcccataaacaggcggactgataaaaagaatgtcgttcggcggcactctggttattgctccgctcgagaggaaaggaatccggttataagcgccgcatggatgtcactggaggagctgggaaaatctgcgagatgccggaaaacgaatactcctgggtcccacacaagcgtgggtgccaagaaagctgaactgaaagccgtggtgatggactgttggctgccggaatccggcgaaggtgtccgggtacgcgcaagacgagaaaataaactctag

SEQ ID NO: 50106 - DNA, 489 bp, Artificial Sequence
  Description of Artificial Sequence: Synthetic coding sequence
cacaagaacacctacatccggacctacatccacatctgcgtgtacataaggacctacatccatatatgtgtgtatgcttatgtgtatacctatatgtgtgtgtgcgttcggatctacatttacgtgtgcatgcgaacttacattcatatctgtgtatatgcatatgtgtacaagtacatgtgtgtgtgtgtgcgcatttacatccacacctgtatgtatatctatacctacatttgtatgtacattatgtgcatatacgtgcggacttatatttacgtttatatctgtacttgtattcacatctgtgtctatatgtacgtgcatatatacggctacatttgcacttatatccacaggtacggttacatatgtacatatattcatatttatgtgtacacatgcaaatatatccacatctatggctacacatgtatgtatatccatatttacgggtatacttatatgtacatgtacgtttgcatcttttag

SEQ ID NO: 50107 - DNA, 345 bp, Artificial Sequence
  Description of Artificial Sequence: Synthetic coding sequence
gtgctgtgcctgttcttcttcttcttcctgcggcggagcctggccctgttgccgcgccttgagtgttccggcgccatatgggctcattgcaagctctgccttcctgggtctcggcatagcccagctagtccctcgcgagtcgctggcacgaccgggacctgccaccacgcacaacttatctttgtctttttagtggagaccgggtttcatcacattggccaggccggactggagctgctgacatctggtgacccgccagcgttggcaagccagagcgctggaataacaggcatgagccacagggcacagcccatgtgggacctctcgggcctgataagactatag

SEQ ID NO: 50108 - DNA, 273 bp, Artificial Sequence
  Description of Artificial Sequence: Synthetic coding sequence
ggcggcgccaaggaggagcccaagcggcggagcgcccggctgagcgccaaaccccccgcgaaagtcgaggccaaacccaagaaggcagccgctaaagataagagctctgataagaaggtgcagacgaaaggcaagcggggtgcaaagggaaagcagactgaggtcgcaaaccaagagaccaaggaggatttgcccgcggaaaacggcgagaccaaaacggaggagagccccgcctcggatgaagctggagagaaagaagccaagagtgattag

SEQ ID NO: 50109 - DNA, 1026 bp, Artificial Sequence
  Description of Artificial Sequence: Synthetic coding sequence
tgagccgagcggttcgtgcccgccctgagcctgggcgactggccccggagcccccttgcaccaagatgttgggccaggccaggcccagtgtcattcccaggtctaagattttctcccggaaccgctgcattgagcgccccggcaacaccatcgcccggctcacccttgcgtccgagggcgagccctcagccccccgcaggcggccctggcccaggtagtgccggtggagaccccgcccccggcggggcaggcccaatggagctgatgttcgcagagtgggaggatggcgagaggttctccttcgaagactcagacaggtttgaagaagactcactatgcagctttatctctgaagccgagtcactgtgtcaaaactggaggggctggagaaagcagagcgctggccccaattctcctaccggaggaggcggcggagggggtagtggaggtacccggatgcgcgatggattagtgatacctcttgtcgagctgtcggctaaacaagtggcattccatatccctttcgaagtagtggagaaagtgtaccctccagttcccgagcagctgcagttacgaattgcattttggtccttccctgagaacgaggaggacatcaggctttactcctgccttgcgaacggcagtgccgacgaattccaaaggggcgatcagttgttcaggatgcgggccgttaaggatccactacagattggctttcatctttcagccactgtggtgccacctcaaatggtgccacccaaaggagcctataatgtggcagtcatgtttgaccgttgtcgcgtcacatcctgctcttgcacctgcggtgccggcgcaaaatggtgcactcacgttgttgcactgtgcctctttcggatccataatgcctcagcagtctgtctgcgggcaccagttagcgagagcctttcccgactacagcgcgatcagctccagaaatttgcgcagtacctgattagtgagctgccccagcaggtaggcgaagtcggaaccccttcatgtaattag

SEQ ID NO: 50110 - DNA, 426 bp, Artificial Sequence
  Description of Artificial Sequence: Synthetic coding sequence
atgctgcacagcatgcggttcctgcggaccgacagcgccagcgccgaccctggcaaccttaaatatagtagcagtagagatcggggaggttcctcctcttacggcttgcaaccatccaacagtgccgtggtatcaaggcagcggcacgatgacacccgtgtgcatgcggacatccagaacgacgagaagggaggttactcggtgaatggaggttctggcgaaaacacttacggccggaagagtttgggacaggagctcagagtgaacaacgttaccagtccagaatttacatcggtgcagcatggatcacgggccctagctacaaaggatatgaggaaaagtcaggaaaggtctatgtcctactgtgacgagagccgcctatcaaacctcctccgccgcattacgcgggaggacgacagggactag

SEQ ID NO: 50111 - DNA, 321 bp, Artificial Sequence
  Description of Artificial Sequence: Synthetic coding sequence
ctggagtgcagcggccggatcagcgcccactgcaacctgcacctgttgggatccagtgacagccccacatctgcaagccaagtggtggagataactggtacgtatcatcatgttagtctcaacttcgtcttcctcgtgcaaatgggctttaaccacgtagtgcaggctgggctggagcttttaacaagtggcaatcccccctcctccgctagtcagtctgccgggattaccggagtctctcatcacgcctggccctttccctttaacttcgcagagcgtcagggcctaacaatgctcccgcgcctggttagtaattcttag

SEQ ID NO: 50112 - DNA, 324 bp, Artificial Sequence
  Description of Artificial Sequence: Synthetic coding sequence
atgggccgggacgccacccggatcggcgagcggctgcagggcgaggggaacttccagcttaattttgtgactatctcatcaaagctaaaggtttcatggactgagagtggaaagggtgtgactcaggaacggcgatattccacagagactggtgctgggggggaggctcaaatcctgaaagcggcgtgcttcctgagtggcgaagcttggtccctcagacaagttttctcccccgctcatcggttaccagggaataagctcagcgctatcggcgtccattcggaatcagagactagtctgagcgggtgcgtaggtgctgggtag

SEQ ID NO: 50113 - DNA, 354 bp, Artificial Sequence
  Description of Artificial Sequence: Synthetic coding sequence
tgagccggccggcggggccggaccaccccccagaccctggagttccccggagctcaaactctggccattagtagaggctgtcgatgcgcatctcctaggcgcgggcggggagggtggtggtcactgacagcacgagtgttgtacattactaataaagcgggcacatttccttttcttctggggaaatatctggaggagaagctcctggggaactgggtggagacgagattccgacacatcgattgggctggcctggagttgctttcctcctccaaccgtccatccttgacgtcgcagtccgccaggattaccggggtcaatcacagagctcgaccatattttttgtccaagtag

SEQ ID NO: 50114 - DNA, 240 bp, Artificial Sequence
  Description of Artificial Sequence: Synthetic coding sequence
atgaagctggccaagaccgccgtgctggaccccgccacctacaccagcttttctcctggtctttccacttgttcctcctctcagccacctggcgaccgacgaaaggggctgctgggctgtgtggggagcggtcactgtcccctcccaactcccgctcagtttccgaaggttcagcgtcccccaacactgttgggggggaagaatacttccactcagacaaccctgcacccggtgatttag

SEQ ID NO: 50115 - DNA, 783 bp, Artificial Sequence
  Description of Artificial Sequence: Synthetic coding sequence
gtgtgcggcagcacccaggagaagaccgtgttccggctggaggccatgcttgagagaacggcgggagttcaatccaaggaggccgccctggaggaagaggccgtcctcaaggttgaggacatcatggcagaagtcgaagtcgttgttgaggtggagcccgacgtgggttggcagaaagaggggcagcgcgcacagcccggaccagggccctcgacccccggcccttcaatggactcactcgaagttctccatttggaacttgggagcgtaaacgcccccggacatcgagccacgaataagcaaaaaaaaaaaaaggagcgaaaggaaaaccccaatctctggaagccaggctctacactgcagaaacctccccagctgtggcgctgcctgctagcccgccaaaatgaaatgagcgcctgggtcggcaaacatgcagaggtgttgctctgctatgtgatggaccttcaagtggaggaactgtctcaccctggctaccgatggcagatgatcagcttccatcccaatctgtacttccattccgagataatcatgaaagaacactgcgtgggaatcctgggctacagagttagccactcaaccgcagtccagaggttctgggaccatgaaggccaagccagctcatgtagacaatacaccagctatctgtcttcgtttagctgcctggcggagcacgactgtcctggattcggccgaatcgcagaaagtactcgcagctcagcgcgggcctgcggtagcattttctgctccactacacaggggtag

SEQ ID NO: 50116 - DNA, 288 bp, Artificial Sequence
  Description of Artificial Sequence: Synthetic coding sequence
agcctgcccgaggccctggtgcagcccggcggcagcctgcggctgtcttgtgccgccagcggatttacttgtagcaacgcctggatgtcctgggtcagacaggcccccggcaaggggttggaatgggtgggccgcattaaatctaaagccaatgggggaaccaccgattatgccgcccctgtgaagggccggtttactatctcccgggtggatagcaaaaatactctctatctgcaaatgaatagcctcaagactgaggacacagcggtgtattattgcaccacctag

SEQ ID NO: 50117 - DNA, 657 bp, Artificial Sequence
  Description of Artificial Sequence: Synthetic coding sequence
tgacacgtggtggccctgtgcctgttccggatccacaacgccagcgccgtttgtctgcgggctcccgtgtccgagtcactgagccgactgcagcgcgatcaactccagaaatttgcccagtacctgatctcagagctcccacaacagatcctgcctacagctcagcggcttttagacgaacttctgagtagccaatctaccgccatcaacaccgtgtgtggcgctccagaccccactgccggcccctctgcgagtgaccagagcacgtggtatttggacgaatccacgctgaccgacaacatcaagaagacgctccataaattttgtggaccttcccctgtggtgttctctgacgttaactccatgtacctgagctccacagaaccgccagctgccgcagaatgggcctgcctgctgagacctctgaggggccgcgaacctgagggcgtctggaaccttctgagcatcgtgcgtgagatgtttaaaaggagggatagcaacgctgccccattgctcgagattttgacagatcaatgtttaacctacgagcaaatcacgggctggtggtattccgtaagaacttcagcttcccatagcagcgcctccgggcacactggccgctctaatggccagagtgaagtagccgcccatgcctag

SEQ ID NO: 50118 - DNA, 120 bp, Artificial Sequence
  Description of Artificial Sequence: Synthetic coding sequence
cagaagggcggcgtggagggcaagtggcaggccgacgccgtgctgtcatggtgcccgttggcttttgctgtggtgccttccaagcagctgtcagagctttggtacatctgcagtgactag

SEQ ID NO: 50119 - DNA, 2157 bp, Artificial Sequence
  Description of Artificial Sequence: Synthetic coding sequence
atgagccggggctacagcgagaacaacaacttcctgaacaacaacaaccagatggtgctcgacatgatcctgtaccctttaattggcatccctcagactattaattgggagacaattgctcgacttgttccaggtctgacaccaaaggagtgtgccaaaaggtttgatgaattaaaaagtagcggctcctctcccgtcgataaccagtacaattccctgatggcagccggggagtctcccgtcgaaactcttgcaacctacataaaatcctccctgctggatatacacggagaatttcaggagacccctgtagggcatgacgcagtatctaaaaccggcaggcattccattgcttccaccaggaactgtagcagcgagtccgagaattgcacaacacacaatgggggcgaaatgaccgaggaatctgagggccctaatatggtcattcacgtttgtgacgaggcaaagaatctgaaggaagactttacatgtccccgagatctgctaatctccgaaatgaaatactttgccgaatatctctctatggacgcccaacggtgggaggaggtggatatcagcgtacattgcgatgtccatatcttcaactggctcatcaagtatatcaagaggaacacaaaggagaacaaagactgcgaaatgccaacactagaacctggcaatgtcatctcaattctgatttctagcgaatttctgaagatggattccctggtggagcaatgcatccagtactgccacaaaaatatgaatgccatcgtggctactccctgcaatatgaactgtataaacgccaacctactgactagaattgccgatctctttagccacaacgaagtggatgacttaaaagataagaaggacaagtttaagtcaaaattattttgcaaaaagatcgagcgactctttgacccagaatacctgaatcctgattcaagaagcaatgccgccacattgtacagatgctgtctctgcaagaagttactgaccaaggaaaccgaacggcggatcccctgtatcccagggaagattaacgttgatcggcgcggaaacatagtgtatatacatattagggacaagacttgggacgtgcatgaatatctcaattctctcttcgaggagctcaagagctggcgggacgtgtactggaggctgtggggaaccatcaattggctaacctgctcaaggtgctaccaagccttcctgtgcattgagttctcccattgtcagtaccactcagagacagttgtttatcctactgctgcatcatctcttaacaccgttggcactggcatttatccatgctgtaaccagaaagtccttcgattcgaccccacgcaattgacaaaggggtgcaaggtacgagaccatatggtgacactgcgagaccagggagaggggggcgacttgccatcttgcccgaccgcgcgcatgctggacgacctacataaatacagggacgtcattgtggttccattcagcaaggataccgtaagcgacgttggagtgggactttgcgacgaaaaaggaattgagtgtgacgttctgcttgagcccaacactccttggggcccaaagactggagagctgaacgcgtttctttccttgaagaattggacacttcagctgaaacagcagtccttgttttctgaagaagaagagtatacaaccggatccgaggtgacggaagatgaggtaggggacgaggaggaggtttccaaaaagcagcgcaagaaggaaaaacccaaaaaattcactagacaacctaaaaaacaggtcagcagcccttgcgcgcagcgaaaggagaaggccctcgaaaagagcgcgagcagggatgtcagtcccttcgttatgtccatgcagaaaaataaatgggacgccacgaggagtctgagatttaatcaggacgcgcaacgggaggatgaccagaggagaatgaccgagataacaggtcatctcattaagatgagactgggcgatctggaccgggttaagtccaaggaagcaaaggaatttgcaggtgggatttattctaggctggaggcacagatcaaggcctccgtgccagtcagtgcgcgacagtcctcctcagagaaaaacactcgatccaaatcacgctttggtcagggccgtcccgcctag

SEQ ID NO: 50120 - DNA, 537 bp, Artificial Sequence
  Description of Artificial Sequence: Synthetic coding sequence
gagctgagcagccagaagaccggcggcaacctggaccggcacaccgcgtctaagccaaccgccctgctgcagccagggcccggatggcagcggggtgccgcctgttgtcttcaaattttaccagagagcagagtgtgtttcccaactggactacccctagcacgcaaggtgactaaactgtcatgggtgggttataagctgcaaggacgggaattacagtggccggtttatagggaggagcttgagctggaacgcctgctgtggaggcgaagacctggagacagagacttgcgtaggaccggtgatctccggctgggtgaacgggatctactgttgatcagggggggtgatctccgtcatataggaggcggtggcaacatcctcctcggcggccttaacctcctggggggggggctgggtcagggggcctccaccgctgtggcagtcatctcctggccaagcatttgcccccccccaagcatgtgcttctcagccttttcagcctcttcgggcttcagtaattctacctacgcctag

SEQ ID NO: 50121 - DNA, 1713 bp, Artificial Sequence
  Description of Artificial Sequence: Synthetic coding sequence
atgctgatgtggccccagccccacctgcccacccacccccacctgcccactcacccgcatctgccaactcacccccatctgccaacacacccccacctgcccacccatcccatgatgagcaaagagacaaggcagagcaagctggccgaagctaaggagcaactgacagatcaccatccccagacaaaccccagcgtgggcaccgccgcttccgacaccaagaagaaaaagataaacaacggcactaatccagagactacaactagcggcgggtgccactctcccgaagacgaacagaaagcctcacaccaacaccaggaagcactgcgaagagagttagaggctcaggtccaaacaatacgaatcctgacttgtcaaaagactgaactccagatggccttgtactacagtcaacatgccgtgaagcagctcgagggggaggcgcgcgacctgatttcccggctgcatgactcctggaagtttgccggtgagctcgagcaggccctctcagcagttgccacccagaaaaagaaagctgacaggtacattgaagagctaaccaaagagagggatgctttgagtctagagctgtacaggaacacgattaccgacgaagagttgaaagagaaaaacgctaaacttcaggagaagttgcagcttgtagaaagtgaaaaatcagagatccagctgaatgtgaaggagttgaaacgcaagctcgagcgtgccaaactcctgctgccccagcagcagcttcaggcagaagctgatcatctcggaaaggaattacagtcagtgagcgcgaagctgcaggcccaggttgaagagaacgagctttggaataggctgaaccagcagcaagaggagaaaatgtggcggcaggaggagaaaatccaggaaagagaggagaaaatacaggagcaggaagaaaagatcagggagcaggaggaaaaaatgcgtcggcaagaagaaatgatgtgggaaaaggaggaaaaaatgcggagacaggaagagatgatgtgggaaaaggaggagaaaataagggagttggaggaaaaaatgcacgaacaggagaaaattagagagcaagaagagaagcgccaggaggaagaaaagatccgggagcaggagaaacgacaagaacaggaagccaaaatgtggcgtcaggaagaaaagatacgggagcaggaggagaaaatccgggagcaggaagaaatgatgcaggagcaagaagagaaaatgggtgagcaggaggagaagatgtgggagcaggaagaggaaatgcaggagcaggaagagaagatgagacggcaggaagaaaaaatcagagagcaggagaaaaaaatccgcgagcaggaggaaaagattcgggaacaggaggagatgatgcaggaacaggaagagaagatgggcgagcaagagggcaagatgtgcgagcaggaagcgaagatgcaagaacaggaggaaaaaatgagaaggcaggaagagaaaatcagagagcaggagaagaaaatacgcgaacaggaggagaaaatccgtgaacaggaagagatgatgcaggagcaagaggaaaagatgtgggagcaagaggagaagatgtgtgagcaagaggagaaaatgcaggaacaggaggaaaagatgcggcgccaggaagagaagatgagggagcaggaggttaggttgcggcagcaggaggagaagatgcaagagcactag

SEQ ID NO: 50122 - DNA, 399 bp, Artificial Sequence
  Description of Artificial Sequence: Synthetic coding sequence
ttcacccagacctaccggcggagccggcagcacgagcagctgcccggacaaaggcatatggacctcctcacgggctatagtaagctcatacagtctagattaaaactcctactgcaccttgggagccagccccctgtcggcaaaacgttttttttttcctgttggtgccacccactatttcatggctcaaagactacccccaatgtgtggtataagttctccgagaccgcattatcaatcctgaactcatgccaggcgagccagctcggcgtgcgaaagatgcctggggatatgtcttcttccccccgtgtgagagagttcagtgcactcgttgccattaaggagaagatccacattctcccaacaaacgcgaaagtggggagtaaattcggaagttag

SEQ ID NO: 50123 - DNA, 447 bp, Artificial Sequence
  Description of Artificial Sequence: Synthetic coding sequence
atgaacttcaccctgatggtgagcatggagcacaccaccaccatggcctcagcaaccccagccccttggccccaccggagtcaacgttgtaggcaagctgtccctgggcaccccgcatccggttgttgcggaacaggtaccttccggacgcagagaagacccggggacaaatctaggagggcgggctcgcggggccgcggtgcagggcctggtaggcatgaccgcgactctgcccacgcagggtccatgcggggcgcgcgcctcgtgccagctttggtgcgactgcaactgagaccccctgctcttagaggagagcgaacaccaatctctatgccacctgcccgtccgccagccggtgtggcctttccaggcgcatccgctggcccaagcagaaccagaagaggagtggcaaccgcaggggggaggcgggctccagctgttatatag

SEQ ID NO: 50124 - DNA, 1599 bp, Artificial Sequence
  Description of Artificial Sequence: Synthetic coding sequence
atggaccagttcggcgacatcctggagggcgaggtggaccacagcttctttgattcagattttgaggaggggaagaaatgcgagacgaactcagttttcgacaaacagaatgatgaccctaaagagaggatcgataaggatactaaaaatgtgaatagcaacacaggtatgcagaccacagagaattacctgactgagaaagggaacgaaaggaacgtcaaattcccccctgagcacccagttgagaacgatgtaacacagacagtgtcctcattctctcttccagcaagctcgcgaagcaaaaagctttgcgacgttacaacaggattgaaaatccatgttagcatcccaaacaggatcccaaaaatcgtcaaggagggcgaggacgattattatactgacggggaagagtcctcagacgacggtaagaaataccacgtgaaaagcaaaagtgccaagcccagcaccaacgtgaagaagtcaattcggaaaaagtattgtaaggtctcttccagtagttccagctcattaagctcatctagctctggctcaggtaccgactgtctggacgccgggtccgacagccacttgtctgatagttcaccgagttccaaaagctcgaagaaacacgtctcagggattactttgctaagcccaaagcacaaatacaagagcggtattaagtctaccgagacccagccatcatcaactacacccaagtgcggtcactaccccgaagagtccgaagatactgttaccgacgtttcgcctctgtccactccagatatttcaccgctccagagctttgagttgggaattgctaacgatcagaaagtgaagatcaagaagcaggaaaacgtctctcaagagatatatgaggacgttgaggacctgaagaataactcaaaatacctgaaagctgcaaaaaaaggcaaagaaaagcatgaaccggacgtgtcttccaagtccagctccgtgcttgattcaagcttggaccacagacataaacagaaggtcctgcacgatactatggatctgaatcatcttcttaaagcattccttcagctcgataagaaagggccacagaagcaccacttcgatcagccgagtgttgcaccagggaagaattacagttttaccagggaagaggtgaggcagattgatagagagaaccagcgccttctcaaggaactgtctaggcaggcggagaaacctggttcaaagtccaccatcccaagatctgcggaccacccgccgaaactgtaccattctgcactcaaccggcaaaaagagcaacaaagaattgagcgtgaaaatctagcactacttaaacgcctcgaggccgtcaagcccaccgtggggatgaaacggagtgagcaactgatggattatcacagaaatatggggtaccttaactcaagtccactcagtcgccgggctaggtcaaccctaggccagtattcccccctgagggcatcgagaacatctagcgcgacctctggcctgagctgccgcagcgagcgatccgccgtggatccatcaagcggccacccgcggcgcagaccgaagccccccaatgtgcgcacagcttggctgtag

SEQ ID NO: 50125 - DNA, 2085 bp, Artificial Sequence
  Description of Artificial Sequence: Synthetic coding sequence
atggacctgcacaagcagtgggagaacaccgagaccaactggcacaaggagaagatggagctgcttgaccaattcgacaacgaacgcaaagagtgggaatctcaatggaagatcatgcagaagaaaattgaggagctctgtcgagaggtcaaactgtggaggaagattaacatcaatgagtctgccaagatcatcgatctttaccacgagaaaacaattccagagaaagtgatcgaaagttcacctaactatcccgaccttggacagtctgagttcatccggactaaccataaagatggcttaaggaaagaaaacaaacgcgaacagtctctcgtctcaggagggaatcagatgtgcaaggagcagaaagccaccaaaaagtcaaaggtgggcttcctggacccattggccacagacaatcaaaaagaatgtgaggcatggccagatctacggaccagcgaagaggatagtaagagttgctcaggtgccctgtccaccgctttagaggaattagcgaaggtgagtgaggagttatgctcattccaggaggaaatccgcaaaaggtctaatcatcgccgtatgaaatcagatagctttctgcaagaaatgccaaatgtgacgaacatcccccacggagaccccatgatcaacaacgaccaatgtatcctcccaataagccttgaaaaagaaaagcagaagaacaggaaaaacttgtcttgtacgaatgtcctgcagagtaactctactaaaaaatgcgggatagacacaattgatctaaagaggaatgaaaccccccccgtgccccctccacgttcaaccagccggaacttccctagcagcgactcagagcaagcttatgaacggtggaaggagcggctcgatcacaactcctgggtgccgcacgagggtaggtccaagagaaattacaatccccactttccactgaggcagcaagagatgtcgatgctgtaccctaatgagggcaagacatcaaaggacgggattattttctcttcattagttccggaggtaaagatcgattccaaaccaccgtcaaacgaagacgtgggactttcaatgtggtcgtgtgacatcggtataggcgccaagcgatcacctagtactagctggttccagaagacttgctcgaccccttccaaccccaagtatgagatggttatccctgatcatcctgctaagagccaccctgatctgcatgtgagcaacgactgttcttctagcgtggcggagtcgagttcaccactaagaaatttctcttgcgggttcgagaggaccacacgtaacgagaagcttgcagccaagaccgatgaattcaaccggactgtctttcgcacagacaggaattgccaggcaatacagcaaaaccactcttgcagcaagtctagcgaggacctcaagccctgtgataccagcagcacccatacaggatccatctctcagtctaatgacgtgtctggcatctggaaaactaacgctcacatgcccgttccgatggagaatgtgcctgacaacccaaccaagaaatcaacaacaggtcttgtgcggcagatgcagggtcatctgtccccccggtcgtacaggaacatgttacatgaacatgattggcggccgagcaatctatccggaagaccccggtcggcagatccccgaagtaactacggcgtagtcgagaaactccttaaaacatacgagaccgcaactgaatcggccctgcagaactctaaatgctttcaggacaattggaccaaatgcaacagcgacgtctcgggaggcgccacactgtcccaacacctggaaatgctgcagatggaacagcagttccagcagaaaacagccgtgtgggggggccaagaggttaaacagggcattgaccccaagaagatcacagaagaaagcatgtcagtcaacgcctcccatgggaaagggttttctagaccggcacggccggcaaaccggaggcttccctcgaggtgggctagcaggtctccttcagccccccctgctctgagacgcaccacacataactacactatctccctccggagcgaagcactgatggtttag

SEQ ID NO: 50126 - DNA, 447 bp, Artificial Sequence
  Description of Artificial Sequence: Synthetic coding sequence
atgagcgtgcccaagctggtgaaccacggctgggagaccgagccctgtaacccagaccccgcactgctgctcaccggcgctgtgccaggagagggcgagactactctggagcgcgcattacctagagtagtgggtgagcaagagctcgggtcctggagagaaagggctaattctaccccagagcgcagactgtctcccgccctcaaacacgttagcgcccggccgacctccatacctgagacacccggtgaacgtggagctagaaccaggagggaccgcgcaggtcgggctaggaaaggcgagggtgcggccgcatcaacgctaagtagtctccggggggccgctccagaagcaggccgcggcgctgaagcgcccgaatggagcgtgtcaggaggcgccgacgcagtccccctggaaggggcgccggctgtacggagcaaatcttag

SEQ ID NO: 50127 - DNA, 306 bp, Artificial Sequence
  Description of Artificial Sequence: Synthetic coding sequence
atgctggtgggcaaccgggcccgggagcgggagctgaagcaggacaggaggggtcttgaaatcgcctgggatcttatgaaacgacaggattgtttccgtgaagctgcacatgggtctgcatcggaacaagtggcactggaacctattttgtgctgtgacgaggtggccagccaggaacatcatgagggcggtaagggatccccccgcagggagagcacggtgcaggtcccggggggcgaccatggcacattagagctgccctggtgtgtatattttcagattgtcagcggaatcactcttagatag

SEQ ID NO: 50128 - DNA, 213 bp, Artificial Sequence
  Description of Artificial Sequence: Synthetic coding sequence
atgagcctgcccatcggcatctaccggcgggccgtgagctacgacgacacacttgaggaccctgctcctatgacacctccaccctcagatatggggtctgtgccctggaaaccagtgatcccggaaaggaagtaccagcacctcgcaaaagtggaagagggtgaagccagcctgccttcccctgcgatgacattaagctctgcaattgactag

SEQ ID NO: 50129 - DNA, 3702 bp, Artificial Sequence
  Description of Artificial Sequence: Synthetic coding sequence
atgggcacccgggccttcagccacgacagcatcttcatccccgacggtggcgcagagagcgaacagactgtgcaggctatgtcacaggataatattctggggaaagtcaaaaccctgcagcagcaattaggtaaaaacataaaatttggccaaaggagtccaaacgccatacccatgaataaggctaattcgggagaagcatccctcgaagaagacctgtttcttaccagtcccatggagattgtgacccaacaggatatcgtgctgtccgatgcggagaacaagtcgtctgacaccccatcaagtctatccccactgaacctgcccggtgccggcagcgagatggaggagaaggtggctccagtcaaaccatctcgccctaagaggcacttctcatcagcgggaaccatagaatccgtgaacctggatgctatccccttagctatcgccaggttagacaattctgctgctaagcataaattagccgtcaagcccaagaaacagcgggtctctaaaaagcaccgcagactggcccaggatccacaacacgaacagggcgggctagaatcccgcccctgtcttgaccagaatggtcacccaggtgaagataagcctacctggcatgaagaggagcccaaccctctagattccgaggaagaacgccgccggcaggaggactactggcgggaactcgaagcaaaatgcaaacgacaaaaggctgaagcagccgaaaagcgccgcttggaagaacagcgcctgcaggctcttgaacgcaggctttgggaagagaacagacgtcaggagctgctggaggaagagggagagggccaggaaccgccactggaggcagaacgcgcccctcgggaggaacagcagcgatctctggaggctcctggctgggaagacgctgaacgcagggagagggaagaacgggagagactggaggctgaggaagagagacgcagactccaggcccaggctcaagccgaagagcgtcgtagactcgaagaagacgcccggctcgaggagagaagaagacaagaagaagaggagggaagatgcgccgaagagctcaaaagacaggaagaagaggaagctgagggctgggaggagcttgagcagcaagaagccgaggtgcagggccctccagaagcactggaagagacaggcgaggggcggcgaggagctgaggaggaagatctcggcgaagaagaggaggaaggccaggcgcatctggaagactggcggggacagctgagcgagctgctcaacgacttcgaggaacggctggaagatcaagaacggctcaaacctgaaggccagcgcgagcatagcgaggaacccggaatctgcgaagagcagaatcccgaggccgagagaagacgtgagcagcagggtcgttcaggagatttccagggtgcagatcgtcctggccctgaagagaagcgcgaggagggagataccgaaccactattgaaacaggaggggcccgtggaggctgcccagccacccgtggagcggaaggaagccgccgctctagagcagggccggaaagtggaagagctccgctggcaggaggttgatgagcggcagactatgccacgcccatataccttccaagtttcatcgggtggaaagcagatactctttcctaaggtgaatctatctccggtaaccccagccaaagacactgggctgactgcagctccccaggagcctaaagctccaaaggcaagcccagttcagcacgcgctgccatcatctttgtccgtcccgcacactgccatcctcgttaccggcgcccagctttgcggccctgccgtaaatctctcccagatcaaagatactgcctgcaaatcactactgggactggaggaaaagaagcacgcagaggcaccagcaggagagaacccccctcggggacccggagacgcccgggcaggatcaggtaaggcaaaacccagacaggaatcacctagcagcgcttccgccttggcagaatgggcctccattcgatcccggattttaaagaacgccgagtccgacccacgcagttctgaaagggatcaactgaggcctggtgacgagagtactccaaggggacgctgtgactcccgcggcaatcagcgtaagacccctcctgtgaacgctaagttctcaattatgcctgcctggcaaaaattttcagacggcggtactgagaccagcaaacagtcaaccgaagcagaaagcatcagaaaaagaccaatgctcggtccaagcgaggaaactgcaccccaacctccccctgccggtgtgcgcgagctgggcaaggggccagagaagtctgagatgcacagagagcctgcagatactactgaggggtgtaaatttgcaaaggatctgccctcattcctcgtgccatcattgccctacccgccccaaaaagttgtggcccacaccgaatttaccactagtagtgatagcgaaaccgcgaatggcattgcaaaaccagatcctgtcatgccaggaggggaggagaaagcttccccgttcggcataaagttgagaagaaccaactactccctccggtttaactgcgatcaacaggctgaacaaaagaaaaaaaaacgccatagtagtactggcgacagtgcagacgctggcccccccgcggccggttccgccagaggtgagaaggagatggagggcgtagccctgaagcacgggccatccctccctcaggaacggaagcaggcccccagtacacgccgtgacagcgcggagccctcatcttcccgatccgtgccagtagcccatccaggcccgcctcctgcttcttctcaaacccccgcccccgagcatgataaggccgcgaataaaatgccactggcgcagaagcctgcactggcccccaaaccaacctcccagactccaccggctagtcctctgtccaaattatcaagaccctatttggtggaattgttatcacgcagagccgggcgccccgatccagagccttcagagcccagcaaagaagatcaagaatcctcagaccgcagaccgccctcgcccccaggcccagaggagcgcaagggccagaagcgagatgaggaagaggaggcgaccgaaaggaaacccgcttctcccccccttccagcaacacagcaggagaagccctctcagacccctgaagccggacgaaaagaaaagccaatgcttcagtcaagacacagtctggacgggagtaagcttacagagaaagtcgagacggctcaaccgctctggattaccctcgcactccaaaaacaaaaaggtttcagggagcagcaggctacacgggaagaacgaaaacaggcccgcgaagccaaacaggccgaaaaactgagcaaagaaaacgtgagcgtgtcggtccagcccgggtcctctagtgtttctagagccgggtccctgcataaaagcacggctctgcccgaggaaaaacgaccggaaacagcggtgtccaggcttgaacggcgggaacagctgaaaaaggcaaatacactgccgacctccgtcaccgtcgaaatttcagactctgcccccccggcgcccctcgtcaaagaggtcaccaagcggttttctacccccgatgctgcccccgtgtccaccgagcctgcatggctggctctggccaaaaggaaggcgaaggcttggtctgattgtccccaaatcatcaaatag

SEQ ID NO: 50130 - DNA, 198 bp, Artificial Sequence
  Description of Artificial Sequence: Synthetic coding sequence
atgagcctgcccatcggcatctaccggcgggccgtgagctacgacgacacactggaggaccctgctcctatgacaccccccccttcggatatgggctcggtgccctggaaacctgtgataccggagcggaagtaccaacatctcgctaaggtggaagagggcgaggcatctctcccgtcaccagcaatgacactttag

SEQ ID NO: 50131 - DNA, 288 bp, Artificial Sequence
  Description of Artificial Sequence: Synthetic coding sequence
atgagcctgcccatcggcatctaccggcgggccgtgagctacgacgacaccttagaggatccggcacctatgacaccccctccaagcgatatgggctccgtgccctggaagccagtcataccggaaagaaaataccagcacctcgcaaaagtagaagaaggggaggcctccttacctagcccagcaatgacactgagttcggccatcgattcagtagacaaagtccccgtggttaaggcaaaagcaactcatgtgatcatgaacagtttgataactaagcaaacatag

SEQ ID NO: 50132 - DNA, 2130 bp, Artificial Sequence
  Description of Artificial Sequence: Synthetic coding sequence
atggaccagaagctgagcaagctggtggaggagctgaccaccagcggggaacccagattaaatcctgaaaagatgaaagaattaaagaaaatttgcaagtcctctgaggaacagctttcccgggcatatagactcctcatcgcccagctgacacaggaacatgccgagatccgcttgtctgcgttccagatcgtggaggaattgtttgtcagatcacaccaattcaggatgctcgtggtgtccaattttcaggaattccttgagttgaccctggggactgatcctgcacaaccgttgcctccaccaagagaagctgctcagcgcctgcggcaggccaccacccgagctgtagagggctggaatgaaaaattcggagaggcctacaagaaactggcccttgggtatcatttcctgagacacaataaaaaggttgactttcaggacacaaacgcccgttctctagcggagcgcaaaagggaggaagaaaaacaaaaacacctagacaaaatctaccaagagcgcgctagccaggccgagcgggagatgcaagagatgtccggagagattgagtcctgcctaaccgaggtggaatcttgttttcgcttactcgtgccctttgatttcgacccaaacccggaaacagaatctctgggcatggccagcggaatgagcgacgcattacgctcttcttgtgccggccaggtcgggccctgccggagcggcacccccgaccctcgtgatggcgagcagccatgctgttccagggatctgcccgcctcggcaggtcatccccgcgccggaggcggcgctcagcccagtcagaccgctacaggagaccctagcgatgaagacgaagacagcgacctcgaggaatttgtgagatcacatggcttaggctcacacaagtacacgctggatgttgagctgtgcagcgaagggttaaaagtgcaggaaaacgaagacaatctcgccctgattcatgccgccagagacactctgaagctgattcggaacaaattcctccccgcggtttgttcctggatccagcggtttacacgagtgggaacccacggcgggtgcctcaaacgcgctatcgatctcaaggctgaactggaactggtgctgagaaaatacaaggagctcgacatcgaacctgaagggggggagaggagaagaactgaggcgctgggggacgcagaggaggatgaagacgacgaagactttgtggaagtgccagaaaaggaagggtacgaaccgcatattccggatcatcttcgccccgaatatggcctggaagccgctcctgagaaagataccgtggtgaggtgtctgaggacacggactcgcatggacgaggaggtttcagatcccacttccgccgccgcacaactaaggcagttacgtgatcacttaccaccgccaagttcagcctcaccgagtagggcactccccgagcctcaggaagcccagaaactcgcagctgaacgcgcacgcgcaccggtggtgccttacggcgtcgacctccattattggggccaggaattacccaccgccggaaaaatagtgaaaagcgactctcagcaccgcttttggaaaccaagcgaggtcgaggaagaggttgtcaacgcagatataagcgaaatgctgaggagtcgccatattacattcgccggcaagtttgaacctgttcagcactggtgccgcgcccccagaccagacggtaggttgtgcgagcgccaggataggctcaaatgcccctttcacgggaagattgttccgagagatgacgaaggccggcccttggatccggaggatcgggcccgggaacagcggcgccagctccaaaaacaggagcggcccgagtggcaagaccccgaattaatgcgtgatgtggaagccgctacggggcaggacttaggcagctccaggtactcagggaaggggaggggaaaaaaacgaaggtacccttcccttaccaatctgaaagcccaagctgatactgcacgggccaggattggaaggaaggtcttcgcaaaagccgccgtgcgcagggtcgtggccgccatgaatcgcatggatcaaaagaagcacgaaaaattttcaaatcaatttaattatgcccttaactag

SEQ ID NO: 50133 - DNA, 168 bp, Artificial Sequence
  Description of Artificial Sequence: Synthetic coding sequence
gaggtgagcaaccccttcgacggcctggaggagctgggcaagaccctcgaagactataccagagagtttatcaaccgcatcacccaatccgagctgccagccaagatgtgggactggttttcagagacttttaggaaggtaaaggagaagcttaagactgactcttag

SEQ ID NO: 50134 - DNA, 228 bp, Artificial Sequence
  Description of Artificial Sequence: Synthetic coding sequence
atgtaccccatctgcaccgtggtggtggacggcctgcccagcgagtcttcatctagttcttatcccgggcccgttagcgtctccgagatgagcctcctccacgccctgggaccagtccagacatggttgggccaggaacttgagaagtgcggcattgacgctatgatctatacgcgttacgtgctctctcttctgctgcatgactcatatgactacgacctccaatag

SEQ ID NO: 50135 - DNA, 918 bp, Artificial Sequence
  Description of Artificial Sequence: Synthetic coding sequence
atggccagccggcagcccgaggtgcccgccctggaggccagcgccccactaggcaaaatgagcctgccaattgggatttaccgtagagccgtctcttacgacgataccctagaagatccagcgcccatgactccccccccaagcgacatgggtagtgtcccatggaaaccggttatccccgagcgtaaataccagcatttggccaaggttgaagagggcgaggcctccttgccaagcccagcaatgaccctctcctctgcaatcgatagtgttgataaggttcctgtagtgaaagccaaagcgacccatgtcataatgaattcactgattaccaaacagacgcaggaatctatccagcattttgaaaggcaggccgggctcagggatgcggggtataccccccataagggcctcaccaccgaagagacaaagtatttaagggtcgccgaggccctccataaattgaagttacagtccggggaggtgacaaaggaggagcggcaaccagcatctgctcaatctacgccctccaccaccccccactcctcgcccaagcagcgtcccagaggatggtttacgagcggcagcagtacggccctgccagggcccaaccctagtacgatggactcagggagcggagataaggaccgcaatctgtccgacaaatggagcctgtttggccctcggagtcttcaaaagtacgacagcgggtcattcgcgacccaggcatacagaggggcacagaaacccagtccactcgagcttatcagagcacaggctaatcgcatggctgaagatccagctgccctgaaacctccaaaaatggatatccccgtgatggaaggaaagaagcaaccacctcgtgcccacaacctcaagcctcgcgacctgaatgtgctgaccccgactggcttttag

SEQ ID NO: 50136 - DNA, 2130 bp, Artificial Sequence
  Description of Artificial Sequence: Synthetic coding sequence
atggaccagaagctgagcaagctggtggaggagctgaccaccagcggggagcctcggctcaatcccgagaagatgaaagagctaaaaaaaatctgcaagtccagtgaggaacaattatctagggcttacaggctcttgatcgcccaactgactcaggagcacgctgagatccgactctccgcctttcaaatcgtggaggaactgttcgtccggagccaccaatttagaatgcttgtggtatctaattttcaagaattcctagaactgaccctggggaccgatcccgcccaacccctccctcctcctcgggaggccgcccagcgacttcgtcaggctacaacccgggccgtggaaggttggaatgaaaagttcggggaggcttacaaaaaactcgcactgggttaccattttctgcggcataataaaaaagtggatttccaggacacgaatgctcgaagcctggccgagcgcaagcgtgaagaggagaaacagaaacatttagacaagatctaccaggaacgcgcaagtcaagctgagcgtgagatgcaggagatgtccggcgaaatagagtcctgtctcacagaggtcgagtcgtgttttcggctcctggttcctttcgacttcgaccctaacccagaaactgagagtcttgggatggctagcggtatgagcgatgccctaaggtcttcctgtgcaggtcaggtgggtccatgtcgatcgggaactcccgacccacgagacggggagcagccctgttgttctcgggacctaccagctagtgccgggcacccaagggcgggcgggggcgcccaaccatcacaaacagctacaggcgaccctagcgatgaggacgaagatagcgacctggaggagttcgtgagatcccatgggctgggcagccacaagtacaccttggatgtcgagctttgttccgaagggcttaaggttcaagagaatgaagataatctggcactaatccatgcagctagggacacactaaaactgatccgcaacaaattcctcccagctgtttgctcctggatacagaggtttacccgggttggtacccatgggggctgtctaaagcgagcaattgacctaaaggcagagctggaattggtgctcagaaaatataaggagctggacatagaacccgaggggggtgagcgcagaaggactgaggccctaggcgatgctgaagaggacgaagacgacgaggacttcgtggaagtccctgaaaaggagggttacgagccacatatccctgatcatctgcgcccggaatatggactggaggcagcaccagagaaggacacagtggtgcgctgtctgcggactcggacccgcatggacgaagaggtctcagatcccaccagtgcagctgcacagttgagacagttgagagaccatctaccacctccgtcttcggcctccccgagtagagcactccccgaacctcaggaagctcagaagctggctgctgaaagagctcgggctccggtggtgccatacggggtagatctccactattggggacaggagttacccaccgctggaaaaattgtcaaaagtgactctcagcaccggttttggaagcctagcgaggtggaagaggaagtggtgaatgctgacatatcagagatgctgagatccaggcatatcacattcgccggcaaattcgagcctgtgcaacactggtgcagggccccccgtcccgacgggcggctttgtgagcggcaagaccgactgaaatgccctttccatggcaagatcgtaccacgcgacgacgaggggcggcctcttgaccctgaggatcgagccagagaacaacggagacagctccagaaacaggagagacctgagtggcaggaccctgagctcatgagggatgtggaggctgccaccgggcaggacctgggaagttcacgctattctggaaaaggtcgcggcaagaaaaggaggtatccatcccttactaacttaaaggcgcaagctgacaccgccagagcccgcataggaagaaaggtgtttgcaaaggcagccgtgcggcgggtcgtggctgccatgaatcggatggatcagaaaaagcatgaaaagttttctaatcagttcaattatgcgctgaactag

SEQ ID NO: 50137 - DNA, 783 bp, Artificial Sequence
  Description of Artificial Sequence: Synthetic coding sequence
atggacgaggaggtgagcgaccccaccagcgccgccgcccagctgagacagttgagggaccaccttccacccccttcaagcgcgagtccctcaagagcacttcctgagccccaggaagcacagaaactggcagctgagcgcgcccgcgcgccagttgtcccttacggtgttgatttgcactactggggacaggaattacccacagccgggaaaattgtaaaatcggactcccaacaccgtttctggaagccttctgaggtggaggaagaagttgtcaacgctgacataagcgagatgctgcgaagtcgccacatcactttcgccggcaaatttgagcctgtgcagcactggtgccgcgccccccggcccgacgggagactatgcgaacggcaagaccgcctcaaatgcccattccatgggaagattgtacccagggatgacgaaggaagaccactcgacccagaggaccgggcacgtgaacagcggaggcagttgcagaagcaggagaggccagaatggcaggatcctgaactgatgagagacgtcgaggccgcaacaggacaggacctcggcagctcacgatactctgggaaagggagaggcaaaaaaagacgatatccttcattaacaaaccttaaggctcaggccgacacggctcgcgccaggattggtaggaaggtctttgccaaagctgctgtgcgccgagtggtcgccgccatgaataggatggaccaaaagaaacacgaaaaattctcaaatcagttcaattatgcgctcaattag

SEQ ID NO: 50138 - DNA, 783 bp, Artificial Sequence
  Description of Artificial Sequence: Synthetic coding sequence
atggacgaggaggtgagcgaccccaccagcgccgccgcccagctgagacaattgagggatcacctgccacctccgagctcagcatcaccctcccgcgctctgcctgagccccaggaagctcagaaactcgcagcagagcgagccagagctcctgtcgtgccatatggtgttgaccttcattattgggggcaggaactgcccactgccggaaaaatcgtgaaatcagactcccaacatagattttggaaaccgagtgaggtggaggaagaggtcgtgaacgcagacatctccgagatgcttcgctcgaggcatatcacgtttgccggcaagttcgagccagttcagcattggtgcagagcacctcgccctgacggcaggctatgcgagagacaggatagattgaaatgtccgttccatgggaagatcgtgcccagggacgatgagggcagaccactggaccccgaggatcgcgcaagggaacagcgtagacagctccagaagcaggaacggcctgagtggcaggaccccgagcttatgcgtgacgtggaggccgccacgggtcaggatctcggcagttctagatatagtggcaaaggacgcggcaaaaagcggcgatacccatcactgaccaatttaaaagcacaggccgacacagccagggcccgaatcgggagaaaagtctttgccaaagcagccgtccggcgagtagtggcggctatgaaccggatggatcagaagaagcatgagaaatttagtaatcagttcaattatgccttgaactag

SEQ ID NO: 50139 - DNA, 3828 bp, Artificial Sequence
  Description of Artificial Sequence: Synthetic coding sequence
atggactgggacgacgagtacagccacaacagcttcgacctgcactgtctcctgaactcttttcccggcgacttggagttcgagcagatttttagtgacatcgacgaaaaaatcgagcagaacgcagctagcattaaacattgcattaaagaaatccagtccgagatcaacaagcagtgccctggcgtgcagttgcagacaacaacggattgcttcgagtggctcactaactacaactatagcacctctgaatctagtttcatctcccatggcgacctgattaaattttttaagacactccaagacctcctcaagaacgagcagaatcaggaagagatgaccttagatttgctctgggatctctcttgccactcctctgtgagctttccctccaccctgtctggaacttccttccattttctgtcccgaacatcacttcacagcgtggaggacaattcatcaatggacgtaaaaagcatgtgggatgacatacggctccacctgaggagattcttagtcagcaaactccagagtcacaatgagattaataatagccagcagaagatcctcctcaaaaagcagtgtttgcagcagctgttgttcctctatccagagagtgaagttatcattaagtaccagaacatccaaaacaagttacttgccaatttactgtggaactgctttccaagctataacagagattctaacctggatgtgatcgcccacgggtatcaaagcacgatgctgaaactctacagtgtaattaaggaagattttaacaccctatgcgagatcctcgctcctagcagtatggtgaagttcataaaagaaacatacctcgacacagtcacagaggagatggctaagttcctggagaacttctgcgaactccagtttcgagagaacgccgtacgggtggttaagaccagcaaatcttcttccaagcaccgcggagcagttcacgccttggtcactacagagtgtccacaaaagggccgtaatttctctctccccctggataaggtcgagttcttgtctcagctcatcaaatctttcatgaagctggaaaagggcgtccaggaacttttcgatgaaatccttctatcccttaagatcactcgggatacctcgggcatacttgaaaagagtgaccgggaggttgtaatggagaagccgagggctaacgagaccaatattcctagcgagcagtcactgcccggaaaagaggctactcttctggattttggatggaggtcagctttcaaagaggtctccctcccaatggcccactgtgttgtgactgcaatcgagggattttctaccaaaatcctgcagcaggaacaaaatgagcgtagtagcgcagtcagctacgcaatgaaccttgtgaatgtgcagcaggtgtggcaagattctcacatgttcccagaagaggagcagcccaagaagattggcaagttctgctcagacataatggagaagctggataccatgctgccactcgccctagcttgccgggacgatagtttccaggagattcgcgccaatctcgtggaggcgtgctgtaaagtcgcgaccgccgtgcttcagcggttacaggagcgtgccaaagaagttccgtccaaggctccacttaagaacctgcatacctacttgtctacagccgtatatgtgttccaacactttaagagatatgataatctgatgaaagaaatgactaaaaagccgattttcctggtgctggtacagagataccaagaatttataaatactcttcaattccaagttaccaattactgtgtgcgcgtatgcgccacatcaatattacaagacgctgaaagtcaccactgggacgattacaaagctttttacgagggtgaaagatgctctttttctatacaaatgtggcactatttctgctggtccctgcattatgacctttggacgattctgcctccgaaattagcccaggagatccttgtcgaagtgctggaaaaatcactctcactcctcgcctctcggtacgctcgtgctcacccctcacgcaagaggaccccccagctccgcctcgacgtgaccaccattctgatatgtaccgagaatatgctgtggtcagtctgtacctctgtacagaagctgctgaatccgcatcagcacaccgatgataagatttttaagatccacacacattgcaacaatctttttacaacattggtgatactcaccagtccactaaccgagctttacaaaacgtttcagcacggcctggacgagtccgcctccgactccctaaaatccttttttaaacagccactgtactgggtgagctgtatcagccatttctacccgtccctgctcagaactccaagtgctggcggcttaaaagccgaggggcaacttaaacttcttctttctcagccacggtgtaattggaacctcctcttggagacactgctgcatcatgacggcctgctgttgcgcattcttctgaaatcctccaaacaggtgtcagatacagagaacaatctaaaccaggggccaagcctgatggaggccatttttaaaattctctaccattgctcattttctccccagacattcgcaaacgtgttcgtgagctacatggaggaagagcagctgtgggactttctttataatattcccgtttcaacctgcgtggagtacgagttagaggtgattagatgcttacgcttagcattgaccgacgctataaaagatacggtgcaacagattgttagcgtcatgagttcgcggcgcaattgtgagacaaatctgaataaacacattgtccctgactgcctcctggaaagtatgccaaaagaatggaactactcacccaaggaaaccaataggaaggagtcatgtaaatcttttacgaggctgacggcccaggctgtgagcatagtcatatccaagctccctaccgtaatagcctgtctgccacctccagtcaaatatttcttcttcctgtctgaaagaaagatgagcaagaagttcgtggaattgaaaaaagccggactcctagtgtggaacctgatcgtgataatttgtcgtattttcgaagatggaaatacggttgagctgcttactggcgcttctctggatcggtggtccaaagagaaactggggctaatctgcatgtgcctcaaatccataatgggcgatcaaacctctatccacaaccagatgatacagaaagttatccaatctatagaacaacaaaaacccaactggatagaaaggcagctgctgaaggcccgcaaactgagtaccgagtgcgctttcatgacaattgagaaaagcacggccctccaagagggggatgtcgcactggagctgacggaacagaaaattaatacgatggtactcgacctgtgtcataagcctggcggtcgcgagtacctgaggcaaatttaccatatcatgcaactcaatgaggagtatctcaaggagcagctgtttagtatgaacagttctgaagagaagcccctccctatcagacccctcaagacgaccctgcgctccatcgaagaccagccctcggcatttaacccttttcacgtgtacaaggcattttcagaaaacatgttggaccagtcagccatcaccaaatggaactggaattgggctaagctgctgcccaattatctcaggttggacaagatgactttctccgttctgctgaagaacaggtgggagatgaagaaggacgaaacgttggaggaagaggaaaaggctatcctggagcatctgaagcagatttgcacaccccagaactcatcagcttccgacaatattgaggaacagtag

SEQ ID NO: 50140 - DNA, 288 bp, Artificial Sequence
  Description of Artificial Sequence: Synthetic coding sequence
atggccagcagccactggaacgagaccaccaccagcgtgtaccagtacctcggtttccaggtgcagaaaatctacccctttcacgacaattggaataccgcctgcttcgtgatcctgctgctgtttattttcacagttgtgagcctagtggtacttgcctttctgtacgaggtgctcgattgctgttgctgcgtgaaaaacaagactgtcaaggacctgaagtccgagcccaatccccttcgctccatgatggacaatatccgcaaaagggaaactgaagtcgtttag

SEQ ID NO: 50141 - DNA, 354 bp, Artificial Sequence
  Description of Artificial Sequence: Synthetic coding sequence
atggagaccaagaagctgatcggcaagcccctgcagcccgcccggcctgtacgtcacctgacttcccctcccggggccgtgtttccattcaacttccagaacgagtatccctgcaacacacagtgtatccagtccggagttagtcggtgtaagacgaatggaatgcaggccttctcacagggtctcaatgagcagcaacaacagcagtcgcccgttaaaaaggaacggataaagtattctagggacttcttgctgaaattgtccagtgtgtccatttgccgcaagaagcccgatttcctgccagaccatcccattgttctccaaaagcccgagaacaatcagagctttaaatag

SEQ ID NO: 50142 - DNA, 339 bp, Artificial Sequence
  Description of Artificial Sequence: Synthetic coding sequence
ctgcaggaccggatcgccaccttcttcttccccaagggcatgatgctcacaactgcagccttgatgttgttctttcttcacttgggcatcttcatccgagacgtgcacaacttttgtatcacctaccactatgatcatatgtcgtttcactacactgtggtattaatgttctctcaggtaatttccatttgctgggccgccatggggtctctttatgctgaaatgactgagaacaacgcccagcggtctcacgttctgcagccaccagtcctaggagtgagtggacacagggtgccagggggcgcacctctccggcctggggagtccgaacagggatag

SEQ ID NO: 50143 - DNA, 6708 bp, Artificial Sequence
  Description of Artificial Sequence: Synthetic coding sequence
atgcccctgttcttcagcgccctgctggtgctgctgctggtggccctgagcgcgttgtttttgggacgatggttagtcgttaggcttgctactaagtggtgtcagcggaaattgcaggccgagctaaaaatcggctctttcaggttcttctggatacagaacgtctccctgaagtttcagcagcatcaacagactgtggaaatcgacaatttgtggatcagcagtaaactccttagccatgacctcccacattatgtcgccttgtgtttcggggaagtcagaattagaactgatctgcagaaggtgtcggatctctcagcacctttttctcaatcagcaggtgtggatcagaaagagctctcattttcccctagcttgctgaagatcttttgtcaactgttctccattcatgtagacgccataaatatcatggtactgaaagtggacactagcgagtcattgtggcacatccagatctcccgctcaagatttctgctggatagcgacgggaagaggctgatctgtgaagtgagcctctgtaagattaacagtaaggtgctcaaaagtggtcagttggaggacacctgtctagtggaactaagtctggcccttgacctgtgcctcaaggtaggaatttcttcacgccacctcaccgcaataaccgtggacgtctggaccctccacgctgagcttcacgagggtctgtttcaatcacagctgctatgccagggcccatcgcttgctagcaagcccgtgccatgttccgaggtaactgaaaacctggttgagcccacccttcccggcctgtttctgctgcagcagttacctgatcaagtgaaggtgaaaatggagaacactagtgtagtgctctctatgaatagccagaaacgccacctgacttggacactgaagctgttacagtttttgtaccatagggatgaggatcagctccctttaagatcattcactgctaactccgacatggcacaaatgtcaactgagctgctgctggaagacggtttgttacttagtcagagtaggcagcggatcgtatgcctgaacagtctgaaggcgtccgtgcaagtgaccaccattgatctctccgcaagcctggtcttaaacacttgcattattcattacaggcatcaggaattttcacattggctgcacctgctagcccttgagacccaggggagctcttcaccggtgctgaaacagcgcaagaaaagaacgttcccacagattcttgcccctatcattttttctacatcaatctctaacgtaaacatctcgatccaattgggcgacactccccctttcgcattgggttttaattccatcagcctcgactatcagcatttacggccgcagtcaatccatcagcggggggtacttaccgtcgatcacttgtgctggagggtgggtagtgattcccatatccaacgggctccacacccccctaacatgcatgtgtggggggaggcccttgtgctcgattcctttacacttcaaggctcatataatcagccactgggcctgagctcaacccagagtgacacacttttcctcgattgcactatcagaggcctgcaggtggaagcgagtgacacatgcgcgcagtgtctttccagaattctgtctctcatgggaccccaaagtggcaaatccgcagtaagccgccattctagttttggggaatccgtttccctgctctggaaagttgacctcaaagtggaggatatgaacctatttaccctttcagctctggttggcgcctcagaggtccgtttagacactctaacaattcttgggagcgccgagactagcacggttggtattcagggcttggtcctggccctggtgaaatctgttaccgaaaagatgcaaccctgttgcaaagcacctgacattccgaccccagtcctttccctgtcaatgttatcaattacataccacagttctattcggtctctggaggtgcagtgtggtgctgggctgacactgctgtggtctccccccgaccacatgtacctctatcaacacgtattggcaacactccagtgtagggatcttctgcgcgccacagtctttcctgaaactgtaccttccctggccctggagacctccgggactaccagcgaactcgaaggacgggcccccgaacctttgccccccaagcgcctgttgaatctgacccttgaagtgagcactgcgaaactgaccgcgtttgttgccgaggacaaattcattacattagcagctgagagtgtttcattaagtcgtcacggcggaagcctgcaggcctattgtcccgaactggctgcaggttttgatggaaatagcatttttaatttcaaggaagtggaggtgcagctgctaccagaactagaggagatgatacttcacagaaatccattccccgccctccaaaccctccggaatcgagtatggcttctctcattcggcagtgtgtcggtcgaatttccataccaatacgacttttctagaacactggatgaggcggttggggtacagaaatggctgaagggcttgcatcaagggactcgcgcctgggctagtccatcgcccgtgcctctgcctcctgaccttctccttaaggtggaacatttcagctgggttttcttagatgacgttttcgaggtcaagttacatgacaactatgagttgatgaaggatgagtctaaggagagtgccaagagattgcagctcctggacgcaaaggtcgccgctctgcgcaaacagcatggggaactgctgcctgcgaggaaaatagaagaactgtacgcttcactagagcggaaaaacatcgaaatttatattcagaggagccgaaggttgtatgggaataccccaatgagacgggccctgctgacatggtccctcgctggcctggagctagtagcactggcagatgcgagcttccacgggcctgagcacgtggttgaacaggtccaggagttggacccgggcagtccgttccccccggagggcctggatctcgtgatacaatggtgtcgcatgcttaaatgtaatgtcaagtcatttttggtaagaatcagagactaccctaggtatctcttcgagatcagagactggcgactgatgggccggctggtcggcactgagcagtccggacagccttgctcaagaaggagacagatactgcacctgggactaccctggggcaatgtggccgttgaacgcaatatgccaccccttaagttttaccatgacttccactctgaaattttccagtataccgtggtatggggtccatgctgggacccagcatggaccctgatcggccaatgtgtggacctactcactaagcccagcgcggatccctcaccaccattaccatggtgggacaaaagtagactcttatttcatggcgattggcatatggacattgagcaagctaatctgcatcaattagcaactgaagacccatataacacaacagagaacatgcattgggaatggagccatttgagcttccactggaaacctggacagttcgttttcaagggcgacctggatatcaatgtgagaacggctagcaagtacgatgactgctgtttcctccacctgcctgatctgtgtatgactctggatctgcaatggctctgtcatggaaacccccacgaccaccattccgttacactccgagccccagagttcttacctgaagtgcccttgggccaactgcacgattcctatagagctttcagaagtgagaatctgaatctctccattaaaatggacctgactaggcactccggcacaatctcccagccgcgcatactgttatacagttctacactgagatggatgcagaatttttgggcgacgtggacttcagtgaccagacccatctgtcgcggtaagttgtttaacaacctcaaacccagtaaaaagaagctgggtcaacattacaagcagctgtcatatacagccctgtttccacagctgcaggtgcattattgggccagctttgcacaacagaggggtattcaaattgaatgctcccaaggccacgtcttcactagaggcacccagcgactaatcccacaggccggcactgtgatgcggcggcttatttctgactggagcgtcacacaaatggtgagcgatctgtcccaggttacagtgcatctcatggcttctcctaccgaggaaaacgccgaccattgcttggatccccttgtgactaaaacccacttgttatctctttcatccctcacttaccagagacactcaaatcggactgctgaagaggagctcagcgcacgagatggagatcccacctttcacacccaccagttgcacctggtggatctgcgcatctcctggaccaccacgaatcgcgatattgcctttggcctctacgatggctataagaaggccgctgtgctcaagagaaacttgagtactgaagccctgaagggattgaagatcgacccccaaatgccagctaagaagcctaagcgcggcgtgcctacgtctgctagcgcgccacctagggtcaacactccttcattttccggacagcccgacaaaggatccagcggaggagcatatatgctgcagaagctgatagaggagactgaccgtttcgtcgtgttcacggaggaagagtcagggatgagcgatcagctgtgcggcattgcggcgtgccagactgatgatatttataacagaaattgcctgattgagctggtcaattgccagatggtacttagaggcgcagagaccgagggctgtgttatcgtgtccgccgccaaagcacagctccttcaatgccagcaccacccagcctggtacggtgacaccctgaaacagaaaactagctggacgtgcctgttggatggaatgcagtactttgctacgacagagtcctccccgacggagcaggacggtcggcagctgtggttagaagtcaagaacatcgaggagcacaggcagagatccctggatagtgtccaagagctgatggagtctggacaggcggtcggtggcatggtaaccaccaccacggattggaaccagcccgccgaagcacagcaggcccagcaggtgcaacgcatcatttccaggtgtaactgcaggatgtactacatctcgtacagtcatgatatcgatcccgaactcgccactcaaattaagcccccagaagtactggaaaaccaggaaaaggaggatctgctgaagaagcaggagggggccgtggatacctttaccctgatccatcatgaattggagatttctactaaccccgctcagtacgccatgatactggacatcgttaataacctgttactacacgttgagccgaagagaaaggagcactccgagaaaaagcagagggttaggttccagctggagatcagtagtaacccagaagagcagaggtcatcaattttacatctccaagaggcagtccgccagcacgtcgctcagatccgccagttagagaagcagatgtactcgataatgaagtcactccaggatgatagtaagaatgagaatcttttggatctaaaccagaaactccagctccagctcaaccaggagaaagctaatctccaacttgagtccgaggagttgaacatcctgattaggtgtttcaaggactttcagctgcagcgggccaataagatggaactaagaaaacagcaggaggatgtgtccgtggtgaggcggacagaattttacttcgctcaggctcggtggcgactaactgaggaggacgggcagctggggattgcagaactggaactccagagattcctgtacagtaaagtgaacaagtctgacgacacggctgaacaccttctggagctcggctggttcaccatgaacaacttgcttcccaatgccgtgtataaggccatcttacgaccacagagttcctgtcagtctggtcgccagttagctctgaggttgttttccaaggtgcgaccacccgtaggaggtatctccgtgaaggagcacttcgaggtaaacgtggtaccactaaccatccagttgacacaccagttcttccacagaatgatgggattcttcttcccggggcgaagcgttgaggatgatgaggtgggcgacgaagaagataagtccaaactggttacaactggcatccccgtggtgaaacctcgccaattaatagcaacagatgatgccgttcctctgggacctggcaagggtgtagcacagggtctgacccggagttctggtgtccggcgaagctttagaaagtctccggagcatcctgtggatgatatagacaagatgaaagagagagcggctatgaataattcctttatctacatcaaaataccccaagtgccattgtgtgttagttataagggtgagaaaaactccgtggattggggggacttaaatctggtcctgccctgtcttgaataccataataatacctggacctggctagattttgccatggctgtgaaacgcgacagtagaaaagccctggtagcccaggtcatcaaagagaagcttagactcaaatccgccacgggcagcgaggtacggggcaaattagagacaaagtccgatctaaacatgcaacagcaggaggaggaagaaaaagctcgcctcctcatcggattgagtgtgggcgataaaaatccaggaaagaagtctatctttggcagacgcaagtag

SEQ ID NO: 50144 - DNA, 3876 bp, Artificial Sequence
  Description of Artificial Sequence: Synthetic coding sequence
atgccccccaacttccccgagttcgccgagcggatcgaggccagcctcagtgaggtaagtgaagccggagcgtctaatccttccctccaggagaaaaaggaaagttcctctgctttgactgagtccagcggccacctcgaccaccgtgaacctcagtccgaatccgtgacactggaacatgtgtccaagtcaatcggaattccagaagttcaggatttcaagaatttatccggcgactgccaggattttaggttccaacaacactctgctaaccctccccatgaattccagccagttgaaagtgaggccgttgcgaccagcggtaacacagacgtaatgcaagagagtaggttctcaagtgccacctggcccagggcaaccaaatcgttggccaagggaggattcagcgagaaacagcatccacttggagatacagcttgtactgtagagatgccacctctgagcccctgcttatcagaagagcttctggatcctgagctgcacgttctgataaccccctctctgagagagaagactgaaagcgaacttaaattcgaggaggacgaaaggtggataatgatggaggccgaaggggagtgggaagaggaaaagctatctgaccgcgaaaaaacatttctgatggcggacgaaaaaaattcacttgccgatatattcgaggagcgcgagcaggcaaacaccgcagtcgtggaggatggcagtgactgcctcgccgccgtgctgaggacattcggacacctgtctttgggccagatttgttgtccagatgatccccagcctgcaaaggaccagctggcaactgtcccaaaggatataccactggattgtgattgtgtgctgacaggagaagacattctgggtgaggtcgctaaccggacggctcaaggccttgaaggcttggtctctgactccgcctgcactgtagggacaatcgacgccgaacagttgtcagacacagatagtgtccagatgttccttgaattggaaaaggaatgcctctgtgaggaaggggtcaccccacttgttgagctgcagaatcaaatttcctccgagggtctggccgccagccaggatgccgagaacttgctagtcatttcacacttctctggagctgccctggagaaagagcagcacctgggtctcctacatgtccgggcaaaggattatgacacgcggcttgactgcgggtactttaataccctggactcatcccaagtgccaaacgcagttgagctcattgcccatgtcgatatcatgagagacacctccactgtgtccaaagaagagtgcgaaaaggttcctttttctccgaggactgcagagttcaagagccgacagccagctgacttagatagcctggagaagctggaccccggaggcctcttgaattctgaccaccgcgtgagccacgaggaaaagctatcgggcttcatcgcgtccgaactagctaaggacaatgggtctttgtcccagggcgattgctcccagacagagggtaatggggaggaatgcattgaaagagtaacattttcattcgcttttaatcacgaacttacggacgtgacgtctggacctgaggttgaagtcctgtatgagagcaacctgctgacagatgagatccatctggagtcaggcaacgtgacagtaaatcaggaaaacaacagcctcacctccatgggtaatgttgtgacatgtgagttatcggttgagaaagtgtgtgatgaagatggggaagctaaggagctggactaccaggccacccttcttgaggaccaggcacccgcccattttcaccgaaactttcccgagcaagtgttccaggatcttcagcggaagagccctgagtctgagattttgtctttgcatctactggttgaagagttacggcttaaccctgacggagtggaaaccgtgaatgacacgaagccggagttaaacgtagcctcatcagagggaggcgagatggaacgccgcgacagcgactccttcttaaacatttttcctgagaaacaggtgacaaaagccggcaacacagagccagtcctggaggaatggatccctgtgctccaacgcccatctagaactgccgccgtacccacagttaaagatgctttggacgctgcactcccatcccccgaagaaggtacgagtattgctgcggtacctgcacctgagggcacagcagtggtagccgctctggtaccctttccgcatgaggacattctggtggcatcaatcgtctctttggaggaggaagatgttaccgctgctgcagtaagcgcacctgaacgcgcaaccgtaccagccgtgacagtcagcgttccagaagggaccgcagctgtggccgcagtcagttctcccgaggagaccgcacccgcagtggcggctgccattacccaggaggggatgagcgcggtggccggcttctctccggagtgggccgcgctcgcaataaccgtgcctataacggaggaggatggtactcctgagggccctgtaacccctgccaccactgtgcatgcccctgaggaaccggatacggctgccgtgagggtttctacccctgaggaaccagcaagccccgccgccgccgttcccactcccgaagagcccacctccccggccgctgccgttccaacaccagaggagcccacgtcacccgctgctgccgtgccaccaccagaggagccgaccagtcccgcagctgctgtcccaactccggaggagcccacaagccctgcggcagcagtccctacccccgaagagccaacctcaccagccgccgcggtccccaccccagaagagcccaccagcccagcagcggcggtgcccacaccggaggagcccacatcacctgccgctgcagttcctacacccgaggagcctacctcgcccgccgccgccgtcccaacccccgaggaacctgcgtcaccagctgccgccgtccctaccccagaagagcctgcttccccagcagccgcagtccccactccagaggagcccgctttcccagcccctgctgtcccaacacctgaagaatcagcctccgcagcggttgccgttcctactccagaagaaagtgccagtcccgctgccgccgttcctactcccgccgaatccgcttcattcgctgctgtggtcgcaaccctggaggagccaacaagccccgcagcctccgtgcctacccccgctgccatggttgccactctcgaggagtttacctctccggcagcgtccgtcccgacctctgaagagcccgctagtttggctgcggccgtaagcaatccagaggagcccacgagtcctgctgccgcagtccctactctggaggaacccaccagttcggcagccgccgtgctgaccccagaggaactctcttcacccgcggctagtgtcccgactcccgaggagcctgcaagtcctgcagccgcagtgtctaacctcgaggaaccagcatcgccagcagctgctgtcccaactcctgaggtggcagccatccccgccgcctccgtgccaacgccagaggtgcctgccattcccgcggctgctgtgccgcccatggaagaagtcagccctattggggtgccgtttctcggtgttagcgcccatacagatagcgtaccaattagcgaggaggggaccccggttctagaggaggcttcctcaacagggatgtggatcaaagaagatctggactctctggtcttcggaatcaaggaggttacctcaactgtgttacatggtaaggttcctctggccgccacggcggggctgaacagtgatgaagtcatagtgcactttgactccggcaagggacttaagtcaaaggtgcgcttcgcagggctgacttggtggtag

SEQ ID NO: 50145 - DNA, 207 bp, Artificial Sequence
  Description of Artificial Sequence: Synthetic coding sequence
atgtgcctgtactgctgggacatcgagcccagccaggtgaaccccgagggacctcggcagcatcacccatctgaagtgaccgaaagacaactagcaaataagagaattcaaaatatgcagcaccttaagaaagaaaagcgacgtttgaacaaaagatttagcaggcccagtccaatccctgaaccaggcctgctttggtcatcatag

SEQ ID NO: 50146 - DNA, 1584 bp, Artificial Sequence
  Description of Artificial Sequence: Synthetic coding sequence
atggtgcggcccggctacagccaccgggtgagcctgcccaccagcccaggcatactcgccacgtctccttatcctgaaaccgactccgccttcttcgaaccgtcccatcttacttcagctgctgacgagggggcagttcaagtgtcgcggcggacaattagtagtaatagcttttctcccgaggtgtttgtcctacccgttgacgtagaaaaggagaatgcacatttttatgtggctgatatgatcatctctgccatggagaagatgaagtgcaatattctgtctcagcagcagactgagtcatggagcaaggaagtgagcggactcttgggatccgaccagcctgacagcgaaatgaccttcgataccaacatcaagcaggagtcagggagtagtacttcgtcctacagcgggtatgagggctgcgccgtcctgcaggtatccccagtgaccgagacgaggacatatcacgatgtcaaggaaatttgcaaatgcgacgtggatgaatttgtcatccttgagctgggagatttcaatgatattactgagacttgtagttgctcatgtagctcctccaaaagtgtaacttacgagcctgacttcaactccgctgaattgttggccaaggagctgtaccgggtgtttcaaaagtgctggatacttagcgtggtgaacagccaattggctggctccctttccgctgctggctcaatcgtcgtgaacgaagagtgtgtccgaaaggattttgagagttctatgaacgtcgtgcaggaaatcaaattcaaaagtcgtatacgaggtactgaagactgggctccaccgagatttcaaatcattttcaacatccatcctcctctgaaacgagacttggtggttgctgcgcagaatttcttttgtgcgggatgtggcacaccggtcgagcctaaatttgtaaagcgtctccgctactgcgagtatctgggcaagtacttctgtgactgttgtcacagctacgcagagtcatgcatacctgcccgaatcctcatgatgtgggatttcaaaaaatattatgtttcaaacttttccaaacagctgctcgacagcatttggcaccagcctattttcaaccttctgtccattggacagtcactgtatgccaaagctaaggagcttgatcgcgtgaaggagatccaggagcagctgttccacattaagaagctcctcaaaacctgccgttttgccaacagtgccttgaaagaatttgaacaggttccaggacatctcacggacgagttgcacttattttccctcgaagacctggtgcgcataaagaaggggcttctggctcctctgctaaaagacattctaaaagctagcctcgcccatgtggccggctgtgaattatgtcagggcaaaggcttcatctgtgagttttgtcagaatacgacagtgatatttccttttcaaactgccacctgtcgtcgctgttctgcttgcagggcttgtttccacaagcagtgcttccaatcttcagaatgtcctcgttgtgcaaggattaccgctcgccgtaagctgctggagagtgtggcatctgccgctacatag

SEQ ID NO: 50147 - DNA, 462 bp, Artificial Sequence
  Description of Artificial Sequence: Synthetic coding sequence
gtgcggggcgccagcgcccggccccccctgctgggcagcgaggagcccctgtcccctgcttctcaccctgtccgcgaaggcgggggaggggtgagtccaccgccaggacagccaccatgccctggcggacgttggggtggccagcctagtgctaggcccgcggccccgtccggaagggaggtgggtgtctccgctccacgacctgcctccagaccggtgagagaggtgcggggagcatccgctaggcccccgctgttagggagtgaagagcctctctgtcccgcttccaggccagtgagagaaggcggagggggggtttcacctccacccgggcagccacctcgcccagggggtagaggtgccagtgctcgtccccctttgttagggtccgaggagcctctatgtgctgccacgacgcccagtgggcgctgtgctcaacagttaatagagaatggtccgtag

SEQ ID NO: 50148 - DNA, 1290 bp, Artificial Sequence
  Description of Artificial Sequence: Synthetic coding sequence
atgggcctgcccagctggacccggcggagccggaaccacgacgtgtccggagccccactgccactcgagtgcaatcacgtgggggaggctctaccccctgaaatggtcacccgactttatgatgggatgcggcgggtcgacctgactggcaaggccaagggcccgagtgaaaacgtctctcaggagcagtttaccgcttccatgtcccacctactgaagggcaattccgaggagaagtctctcatgatcatgaaaatgatcagtgccaccgaggggcctgtaaaagcccgtgaggtacagaagtttaccgaagatctggtcgggtccgtagtgcacgtcctgagccaccggcaggagttgagaggctggaccggaaaggaggcacctgggccgaacccgcgcgtccaagtgcttgccgcccagctgctgtctgacatgaaattgcaggacgggaaacggctgttaggaccccagtggttggactacgactgtgatagagcggtcattgaggactgggttttccgcgtaccccacgtagccattttcctcagcgtggtaatctgcaagggatttctgattctgtgcagttcgttagatctgacgactttggtgcccgaacgtcaagtcgaccaggggagagggttcgagtctatcctggatgtactttcagtaatgtacatcaatgcacagttgcccagagagcagaggcacagatggtgtctgctcttttcctcagagctgcacggccattcattcagtcagttgtgtggacatattacacatcgcggaccatgtgttgcagttctcgaagatcacgacaagcacgtcttcggcggcttcgcatcttgcagctgggaagtcaaacctcagttccaaggggataataggtgttttctcttctctatctgccccagcatggctgtatacacacatactggatacaacgatcattacatgtacttaaatcatggccagcagactatcccgaatggccttggtatgggtggacaacataactattttggactatgggtcgatgtggatttcggaaaaggacattcccgcgcgaaacccacctgtactacctacaacagtccacagctctcggcccaggagaactttcaatttgacaaaatggaggtatgggctgtaggagacccctccgaagaacagctggctaagggcaataagtccatcctggacgctgaccctgaagcacaagcgctgctcgaaatctctgggcactcccgccattcggaaggcttgagggaggtgcctgacgacgagtag

SEQ ID NO: 50149 - DNA, 2493 bp, Artificial Sequence
  Description of Artificial Sequence: Synthetic coding sequence
atggacgacgacgacgacagctgcctgctggacctgatcggcgacccccaggccctaaattacttcctacacggaccgtctaataaaagcagtaatgatgatctgacgaatgccggatactccgcagctaatagcaacagcatctttgctaattcctccaacgctgacccaaagtcttctctgaagggcgtgtcgaatcaactcggagagggaccatcagatggtttgcccttgagtagctctctgcagtttctcgaagacgagctggagtcttcaccgctgcctgaccttacagaagatcagcccttcgatatcctccaaaagtccctgcaggaagcgaacatcaccgagcaaacactggccgaggaagcttacttggacgccagtattggttcatctcagcagttcgcacaggcacagctacacccaagttcgtcggcatcctttactcaggcgtccaatgtcagtaattacagtggtcagaccctgcagcctattggggttacgcatgtgcctgtgggcgcgtcctttgcgtcaaacacagtgggcgtacagcacgggtttatgcagcacgtaggaatctctgtcccttcccagcacctcagcaattccagccagattagcggctccggccagatccaactcattggaagcttcgggaatcaccccagtatgatgacaataaacaatcttgatggctctcagattatcttaaaggggtcggggcagcaggcaccctctaatgtatctggaggtttgttggtgcatcgtcagaccccaaatggaaattccctatttggaaactctagttctagccccgtggcgcagccagttacagtgccatttaattctacaaatttccagactagtctgccagtgcacaacatcatcatccagaggggtctggcgcccaacagcaacaaagtacccattaacatccaacccaagccaattcagatgggccagcaaaacacctataacgtcaacaacctcggcatccagcagcaccatgtccaacagggcatttcattcgcttccgccagtagtcctcagggcagtgtcgttgggccgcacatgagtgtgaatattgtaaatcagcagaatacaaggaagccagtgaccagtcaggctgtgtccagcacaggaggtagcattgtgattcactcacccatgggccagccccatgcccctcagtcccaatttttaatacctacaagcttgagcgtctcttcaaatagcgttcatcatgtgcagactatcaatgggcagctgttgcaaactcaaccttctcaactgatatctggccaagtcgcatctgaacacgtcatgcttaacagaaattcatctaatatgctcagaacaaatcagccttacaccggccccatgcttaataaccagaacaccgctgttcatctagtcagtggtcagacttttgccgcttccggttctccggtgattgcgaatcatgcctccccccagctcgttggcgggcagatgccactgcaacaggctagccccaccgtgctccatctctcacctggtcagtccagtgtgagccagggacgccctggtttcgcaactatgccttctgtcacatcaatgagtgggcccagccggtttcccgcagtatcatccgcctctaccgcccatcccagtctcggatccgcagtccaaagcgggtcaagcggaagcaatttcactggcgatcagctaactcagccgaatcgtacacctgtccctgtcagtgtgagtcaccggctgcccgtaagttcttccaaaagcacatccacattttctaacactcctggcactggaactcagcagcagttcttttgccaggctcagaagaaatgtttgaaccagacttctccaatcagcgcccctaaaacgactgacgggctgcggcaggcacaaatcccaggcctgctgtctacaaccctgcctggtcaggattccggatcgaaggttatcagcgccagccttggcactgcccagccgcagcaggagaaagtggtgggttcctcacctggccaccctgccgtgcaagtggagagtcacagtggaggccagaagaggcctgctgcaaagcagttaaccaaaggagcttttattctgcagcagctgcaacgggatcaagctcatacagttacacctgacaaatcacatttccggtccctctccgatgccgtccagagattgctttcttaccatgtgtgccagggctccatgcctactgaagaagacctgagaaaagtggataatgagtttgagaccgtggccactcaactgctcaaaagaacccaggcaatgctgaataagtatagatgtttactccttgaggacgccatgcgcatcaatccgagtgcggagatggtgatgatcgatagaatgtttaaccaggaagaacgggcgtccttaagtcgcgataagaggctggcccttgttgatcctgaaggttttcaagcggacttttgttgttacctctatagctag

SEQ ID NO: 50150 - DNA, 1368 bp, Artificial Sequence
  Description of Artificial Sequence: Synthetic coding sequence
atggtggagcagggcgacgccgcccccctgctgcggtgggccgaggggcctgccgtaagcctaccgcaggcccctcagccccaggccggcggatggggccgaggaggaggaggcggtgccaggccggccgccgagcctccccggaggagggagccggaggagccagctgctcccgaagtgctgctgcagcccggccggttggaacttggggacgttgaggaagaccaagtggtggctgttttcgtagtcacattcgacccccggtcaggaaacatggtcgagtggtgcctgccacaggacatagacctggaaggggtggagttcaaatctatggcctccggatcccacaaaattcagtcagactttatctactttcggaaagggccgtttttcgggttagcctgttttgctaatatgcctgtcgagtcagaactggaaagaggcgctcggatgaaatctgtgggcatcctcagcccgagttacacactactgtaccgttacatgcacttcctagagaaccaggtgcgccaccagctagagatgcccggacattacagccatctggctgcattttatgaggacaaaaagggagtgctccatgccgggcctggaaggggatcctctctgcccccagtttattggcttccaagcattcacaggtatatgtacccagagatgaagatcacccatcctgctggatgcatgtcccagtttatcaagttcttcggcgaacaaattctaattttatggaaattcgcacttttgagaaagcggatcctcatctttagcccgccaccggttggagtagtctgttatagggtttattgctgttgttgtttagcgaatgtaagcctgccagggatagggggcacgattcccgaatccaagccattcttttacgtgaatgtggccgatatcgaatccttggaagtggaggtatcctatgtcgcgtgcacgacagaaaagatctttgaggagaaaagagaactttatgacgtgtacgtggataaccagaatgtgaagactcatcacgatcacctccagcccctgctgaagattaactctgctgacagggagaaatacaggagactgaatgagcagcggcagatgcttctgtattcacaggaagtcgaggaagactacaacccttgcgaagaagacctcttcgtgcttttcttccttgagcagaacaatagaatcttccagacactgttggaggtgtcagccagccaggacaagacccttacagccgagcacgcaagaggcatgggtctggacccacagggagaccgaagctttctcttggatctgttggaagcctacggtattgacgtaatgctggtgattgacaacccgtgctgtccttag

SEQ ID NO: 50151 - DNA, 2235 bp, Artificial Sequence
  Description of Artificial Sequence: Synthetic coding sequence
atggaggactgcctgcacaccagcagcgagaacctgagcaagctggtgagctgggcccactctcatggaaccatttgctcgcttattcctaacctgaagcaccttctctccgaaggaagccacgggaatcttacggctatgtgggggtgttccgctggtcatgcataccattggcccttgacagcgacttgccgtgcaggctctcaggagagggtctgttttcaggataacaggtcttttaattccgacagcccgtccatcatcggcgtccctagtgaaacccagacaagcccagtagagaggtatcctggcagacccgtgaaagctaagctcgactgcaatagaacacgcgatagctgtgacttctcctattgctccgagccatcggagcttgatgagacagtggaggagtacgaagacgagaacacactctttgacatggtgtgcgaatctagcgtgactgacgaggacagcgatttcgagcctcaaactcagcggcctcagtcgatcgcacggaaacggccgggagttgtaccatccagcctgcactcctcttctcagacacaaatggttgacgagtgctcaaacgatgtgataataaaaaagattaagcaagaaatccccgaggattactacatcgtagctaacgccgaactgacaggtggtgtcgacggtcccgctctgagcctcacccagatggcaaagccaaagccccaaacgcacgcagggcccagctgtgttggctccgcaaaactgattcctcacgttacctcagctatatccaccgaacttgacccacatggaatgtctgcctccccttcagtgatttctaggcccatcgtccaaaaaactgcccgggtgtctctggcttctccaaatagggggcccccaggcacccatggtactaatcagcaggtagcaatgcaaatgcccgtgagcacatcccacccaaataagcagatttcaatccccctgtcggccctccagctccccggccaggatgagcaagtagcttccgaggaattcctttcccatctgcctagtcaggtgtcaagctgtgaagtagcactgtcaccaagtgtaaatacagagcctgaggtgagctcgagtcagcagcaaccaccagttgctcccgccattaccacagaagctacggcacaatgcattcctgaccaggatgaacgggccgcagaactgagcagggagcaaaatgagaagactatccgctcaacacagactgccttgcggaattttccatatagcaccaaactgaataaattcccagtgtttaatattaatgatgacctcaacgacctgtgtacaagtgctgtaagtcccaacacaaccaaggccactagatacgccctgaatgtgtggagatactggtgtatgactaatgggctgaaagatcatacagatattactaagattcctgccgtaaagctcaatgagctgctggagaacttctatgtgactgtcaagaagtctgacggtagtgatttcctagcgaccagcttgcacgcaatcaggaggggcctggacagaattctcaagaacgctggtgtgggcttttcgattacatcctccactttctcaagcagtaccaagaagttgaaagagaagctgtgggtgcttagcaaagccggaatgtccggggcccgctctagaaatatcgtgtatttctcccttagcgacgaggaagagatgtggcaggcaggctgccttggcgacgacagccctatcacactgctcagcactgtcgtaaaatataacagtcagtaccttaatatgcggactcttcaagaacacgctgacctcatgtacggtgatattgaattgctgaaggatccacagaaccagccttatttcgctcgcacagacagtgtcaagagggagtctcggagcggctcaacacgcgtttgtcatgggaagatctatcacgaacacagccgcgggcataaacagtgtccgtactgtcttttgtacaagtacatgtacatccaccgcccccccacccaaatggaagccaagtctcccttttatctaaccgctaggaaggaggctaccgacatgggatccgtttggtatgaagaacagcggatgggactgcggagcctccgcggaatcgtaccaaatctggccaagaaagttaaattggagaactgcgaaaattttacctttgtgtcattcacgcaagtctcaagaaggctgggatctcactcctgctgtcaatag

SEQ ID NO: 50152 - DNA, 111 bp, Artificial Sequence
  Description of Artificial Sequence: Synthetic coding sequence
aaggagaagaaggaggagcggaagaaggagcggaagaaggaggagaggaaaaaagaacgaaagaaggaaagaaaaaaggaaaaggagcgtaagaaggagaaggaacgatag

SEQ ID NO: 50153 - DNA, 462 bp, Artificial Sequence
  Description of Artificial Sequence: Synthetic coding sequence
gtgcggggcgccagcgcccggccccccctgctgggcagcgaggagcccctgtgccctgctagccgacccgtgagagagggcggaggtggggtgtctccaccccctggacagcctcctcgacctggtggccggtggggtggtcaaccaccagctagacctgctgcgcctagcggacgtgaggttggcggagggcagcccccatgtcctgcgtcccgacctgtcagggaggtgagaggggcgagcgcaaggccacctctactgggtagcgaggaaccactttgccctgcatccaggcctgttcgtgagggcggcggtggtgtgtcaccaccacctggccaaccacccagacctggacgcggcgcttctgctaggccgcctcttctgggtagcgaggagcctctttgtcccgctacaacacctagtggacgttgtgcccaacagctgattgaaaatggcccatag

SEQ ID NO: 50154 - DNA, 267 bp, Artificial Sequence
  Description of Artificial Sequence: Synthetic coding sequence
atgcccggcgtggtgagcgccgccggcacccaggtgcggcggctggatgaggttccagctagcctccggctccagcaccatctgcagctcagggaagggctagcagtgccactccctccactggttattcagtctccagccgctcatcacgtcgctggcggatctttctccgatttcaccctggacattgctctgggcgcaagaaggattaggctcgccctcgtcagacaggttactcaggacggacccgtggcgttcctggcttag

SEQ ID NO: 50155 - DNA, 456 bp, Artificial Sequence
  Description of Artificial Sequence: Synthetic coding sequence
atgctgcggtggttcgtgcagcagcccaccagctgcagccacgcccagcccctgcctccacctcatggtacagcctccctttccccactcgttcccagctgtggatcagccgcatggccatccctacattacctggggtctcctgccgattccgggtgtagtcgaggacagcgggctctgcctgcggtttggccaccatcatgttatagccagtgtccgcaagggcgccccccacatcccgttccaagatccccccgaagaggctcccgtgatctaggtaaggagcccggcgaagaggctgcaccctggcccagcccctgtgactctagactgcacagacacccaatgcctagaaccccattgagcgcaagcgcgggctgtgatcccagcctcattcagcccagcccacaccccaccccaccccaacagggctgtgtgactcccttccacaggtag

SEQ ID NO: 50156 - DNA, 2757 bp, Artificial Sequence
  Description of Artificial Sequence: Synthetic coding sequence
atgaacgagaacatgcgggccaccctggccaccagcaagaacgtgttccagctgaaattggaggaaacccagaagttactagaagaccagcacttatctaatcttcaaaaattcggagacgaggtcaatcaaattactaattctgagacgctatcttctatcgactccctggaagccaccgagcacgaagagatttacttgacacttaataaggagcactctacgtcgattcagcgtaacacaatctccttgaagccggccaacatgcagagcactaacctatcctgtttcgatgaagacaagctcgctttttcgaagacccagcacatcaataattggctcactaatctcgacgcatctaatacccagaatgtaactgcgttcagcgatatcctctctaaaagtaacgtattgccttcatgggagtattttaatagcaaagaacaaaatccatcaccactaaacggaaccgtggagcgcgccacaaatacggctaataacagcgtgccttttgtctccagtccccccatgttcgtgcttgataagaaatgtgagaagactagtgagactagcaccatgcgcaccactgacagcacctccggcgcatttaagagggaaaggccgctggtgacagagtccccaaccttcaaatttagcaaatcacaatctacaagtgacagtttgacccaggaggttgccactttccccgaccaggaaaagtattccgaactgaatcaggagaatggaacaacatcgattccgacgagttgcgtgcctgtcgctacacctctggttctcccctccaatattcagagcgcccgcccgtccgctaagaacagtattcacatcaaagaaattgatgccgtgcagtgctcggataagctagatgagctgaaagatggcaaggaagaagagatcaagtactttaactgtaacaaggaagagctccccctcttctctgattcctttcaggacgcctatataccccacaatccagactcaaaagatgagaagcagaagcttgccgaaacgtcctctctctcaaacgttacctcaaactacgacttcgtgggtcaacataagaagatgaagtacaacattcacgagcggaatggcgttagattcttgaagagcatactgaagaaggaaagtaagtacgagcacggatacctgaaagctttgatcatcaatcagtctttcaaatttgggaaccagaaggcagctgccatacgagattccattgagttaactaaggaaaaaggcgctgagattcccaagaccataaaaaaattaagatggtttgacgaaacgtccaatattgagaacaacgcggagaactctcatagcctgaaaaacaagacagggactacccagcaacatagccagcagttccacattcaaagcggagctggttcaaatataatcagcgtgagtacatgcgccgtgaattccgctgatacaaagaagtccagggaagactccattagcgagaacgttaccaccttgggtggtagcggcgcggaccacatgcctctgaattgcttcattccctctggctataacttcgctaagcacgcgtggccagcaagtaagaaggaagaatctaagatcccagtccatgacgatagcaaaacaaagcaggggaaaccgcagcgtgggagggcaaagatcatccgtaagccgggcagcgccaaagtacaaagtggcttcatttgcaccaatcgtaaaggagcagttatccagccacagtcagcctctaaagtgaatattttcacacaggctcagggcaaattaattattccgtgtccccccccccagagtacctccaatatcaggtcaggcaaaaacatccaggtctcccagtgccagcctgtgacacccgaaaatccacagaacataatcacccataacagctttaacagcaaacatgtcctacccactgagcactctctcaatcagtggaaccaggagtcatcttcccccctctccaacgcatgcagcgacttggttacagtgattccaagcttgccgagctactgcagctccgagtgccagacctttgccaaaattaaccactccaatggcacacaggccgtagctcgccaagacgcaacgttgtactgtacccagagatcacccgtctgcgaagaatcataccccagtgtaaccctccggaccgccgaggaggagagtgtccctctctggaagcgggggcccaacgtactgcatcaaaacaaacgagcaacgggctccacagtgatgcgcagaaagaggatcgcggaaacgaagaggagaaatatcctcgaacagaaaaggcagaacccagggtccgtcggtcagaagtactcggaacaaatcaataactttggccagtccgtgctgctgtccagttcagaaccaaagcaaacaacccgcgggacctcttacatcgaagaggtatccgacagcacgagtgaatttttgatggccgaaaatctcgtgaaggcttccgtgcctgaggatgagatcctgacagtgctgaattccaagcagatacagaagagtaatttgcctctgaacaaaacacagcagttcaacatttgtacccttagcgcagaggaacagaagatcctggaaagcctgaatgatctgtccgaacgtttacactatatccaggaatccatttgcaagaatccatctataaaaaatactctacagattatcccattattggagaagcgcgaggacaggacgagttcctgccgggataagcgctag

SEQ ID NO: 50157 - DNA, 459 bp, Artificial Sequence
  Description of Artificial Sequence: Synthetic coding sequence
ctgcccctgttctgcagcagcggcatcctgcagaaggagttctggcgcaacagaattcagtataaccagtcgcagaaggatatcttgcaatcttggtttcagcatgatccatttccggataaagctgcacgcgaacagctcgccaaggaaattggtgtcccagagagcaatattcaagtgtggtttaaaaactatagggtgaaacagcgcaagttagactacaagtgtttcagcgagaaagaccagacacaggggcacgaccagtctcaacacttgactcaggagtacctgcctaaagaggcacgccagaaacagactttcattacttggacccagaagaatcgactcgtgcaggcattcgaaagaaatccttttcccgatatcgcaacaaggaaaaaattggctgaacaaacaggactccaggaaagtcggatacaagtatcaagtatgtgtgtatag

SEQ ID NO: 50158 - DNA, 3930 bp, Artificial Sequence
  Description of Artificial Sequence: Synthetic coding sequence
atgctgctgaacggcgactgccccgagagcctgaagaaggaggccgccgctgcagaacctcccagagaaaacggactggacgaggccggacctggtgacgaaaccacaggccaggaggttatcgtgattcaggatacgggcttcagcgtgaaaatactggcgccaggcattgagccttttagcctccaggtctctccccaggagatggtccaggagattcatcaggttcttatggaccgggaagatacctgtcatagaacatgtttcagcctgcacctggatggtaacgtgttggaccacttcagtgagcttcgctccgtggagggcctgcaggagggttcagtcctgagagtagtggaggagccctacactgtccgcgaagcaaggatacatgttaggcatgttagggatctgctcaaaagcttggatccatccgatgcgtttaacggcgtagactgtaattcacttagcttcctcagcgtctttactgatggggatctcggagactcagggaagaggaagaaaggcctggaaatggaccccatagactgcacccctccagaatacattctgccaggatctagagaacgtcctctatgccctttgcagccgcaaaatcgggactggaagcctttgcagtgtctgaaggttctgacgatgtctggctggaacccgccccctggtaaccgcaagatgcatggcgacctcatgtacctctttgtcataaccgcagaggacagacaggtgagtattacagcatccacccggggcttctacctgaatcagagcaccgcataccatttcaacccaaaaccggcttcacctcggttcctgtctcattcactggtagagctccttaatcagatttctccaacattcaaaaagaatttcgcagtgctgcagaaaaagcgcgtccaacgccacccctttgagcgcatcgctacgccctttcaggtgtactcttggacagccccccaggccgagcacgccatggattgcgtgcgggcagaggatgcatacacctctcgtctggggtacgaggaacacatcccaggccagacgcgggactggaacgaggagctccaaaccactagggaactgccgaggaaaaacctacccgaacggctcttgcgagagcgggctatctttaaagtgcatagcgactttaccgctgccgctacccgtggcgccatggccgtgatcgatggaaatgtgatggcaatcaacccaagcgaggagaccaagatgcagatgttcatctggaataacatctttttcagcctaggcttcgatgtcagagaccattataaggactttggcggagacgtggcagcatacgttgcacccaccaatgacctaaatggggtgcggacatacaacgctgtggacgtggaaggactctacacattaggaacagttgttgtggattaccgcgggtacagagtgacggcacagagcataatcccagggatcctggagcgggatcaggaacagtcggtcatctacggctctatagacttcgggaaaaccgtggtaagtcaccctcgctacctggaacttctggagagaactagccgaccacttaaaattttacgccatcaagtgttgaacgaccgcgacgaggaggttgaactgtgttcatccgtcgaatgtaaggggataataggtaatgacggccggcattatattttggacctgctgagaaccttcccacctgacctcaattttctgcctgtgcctggcgaagagcttcccgaggagtgtgcacgggccgggttcccacgggctcacaggcataaactgtgctgccttcgacaagaactagtagacgcttttgtggagcatcgatatctcctgttcatgaaacttgcagcccttcaactgatgcaacaaaacgccagtcaactggaaactccttctagcttggagaatggaggaccatccagcctggaaagtaaatcggaggatcccccaggtcaggaggctggttctgaggaggaggggtcgtcagctagtgggctggccaaggttaaggaactggcagagactatcgcagccgatgatgggacagatccccggagcagagaggttattcggaacgcctgcaaagctgtcggatctatatcatcaaccgcttttgacatccgtttcaatcccgacatattcagcccaggagttcgtttccccgagtcttgtcaagacgaggtgagagatcagaaacaactattaaaagacgccgccgcctttctgctgtcatgccaaattccaggcctcgtgaaagattgcatggaacacgccgtgttacccgttgatggtgcaaccctggcggaggttatgcggcagcgaggtatcaacatgcggtatctgggaaaagttttggagcttgtcctgcgatctccggcaagacaccagttggaccacgtctttaaaatcggtattggtgaacttattactagatcggcaaagcacatcttcaagacctacctccagggagtcgagctcagcgggttgtcagcagcgatttcacactttctgaattgtttcttatcaagctatcctaaccctgtcgcgcacctgcctgccgatgaactggtgtcaaagaagaggaacaaaaggaggaaaaacagaccacccggagccgcagacaacaccgcctgggccgtgatgactccacaggagctttggaagaacatttgccaggaggctaagaactatttcgattttgatctcgagtgtgagacagtggaccaggctgtcgagacttatggattacagaagattactctgctgcgcgaaatctcgctgaaaacagggattcaggttcttctgaaggagtatagctttgacagccgccacaagcctgcgttcacggaggaggacgtcctcaatatctttcccgtggtgaagcacgtgaacccaaaggccagcgacgcatttcacttcttccagagtggccaggcaaaagtgcagcaaggcttcctgaaggagggatgtgaactgattaatgaagccctgaatttatttaacaatgtgtatggggccatgcacgttgagacatgtgcctgtctcagactgttggccagactgcattacatcatgggcgactacgcagaggccctaagcaaccagcagaaggccgtgctgatgtccgaacgtgtgatggggactgagcaccccaacacgatccaagagtacatgcacctggccctgtattgctttgcttcctcccagctttcaactgctttatctctgctctatagagccaggtacctgatgctcttggtgttcggagaggatcatccggaaatggcgctcctcgacaataatattgggcttgtgctgcacggggttatggaatatgatttatctctgcggttcctggagaacgctttagcagtaagtaccaagtaccacggccccaaggcactcaaggtcgcactgtcccatcatctggttgcaagagtgtacgagtctaaagccgaatttaggagcgctctgcagcatgaaaaggaaggatacacgatctataaaacccaactaggggaagaccatgaaaagaccaaggaatcatctgagtatttgaagtgtcttacccagcaggcggtggccttacagcgtacaatgaacgagatatatcgaaacggctctagtgccaacatccccccactgaagtttaccgcgccatcaatggcttctgtgcttgagcagctgaacgttattaatggaatcctttttatcccgctctcacagaaagatctcgagaatctgaaagcagaagtggcccgtcgccatcaactgcaagaagcctcccgcaatcgtgatagggcggaggagcctatggctacagaacctgcgcctgccggcgcccctggagatctcggctctcaaccccccgcagcaaaggatccttcacctagtgtgcaaggatag

SEQ ID NO: 50159 - DNA, 3681 bp, Artificial Sequence
  Description of Artificial Sequence: Synthetic coding sequence
atgggcgagcagaaggtgagccggcagttcaagcagtgccaccggaccaccagctgggccaagtctaagcttttcagcagactgtcgtccatgttcctgcagcaactgggaaaaaatatcaagttcggccagcggtcccctaatgcgataccaatgaacaaagccaattctggtgaggcaagcctagaagaggatctattcttgacctcacctatggagatcgtgactcagcaagatattgttctttccgacgcagaaaacaagagcagcgatacgccctcaagcctgtcaccactgaatctgccaggtgccgggagtgaaatggaagaaaaggtagcgcccgtcaagcccagtagacccaaaagacacttctcctctgccggaacaattgagagtgtgaacctggatgcaataccactggctattgccagattggacaattccgcagcaaagcataagctagctgtgaaacccaagaagcagagggttagcaaaaagcaccgtagactggctcaggatcctcagcatgaacaggggggcctcgaatcccggccttgcctggatcagaacggtcaccccggcgaagataagcccacttggcacgaggaagagccaaaccccctggattccgaggaagaacggagacggcaggaagactactggcgggagctcgaggccaaatgcaaacggcagaaagccgaggcagctgaaaaacggagactggaggagcagcggctgcaagcgttagaacggaggctgtgggaggagaaccgacgccaagagctgcttgaagaagagggcgagggccaggagcctccactggaggccgagagggcacctcgagaagaacaacagaggtccctcgaagccccaggttgggaggacgctgaacgacgcgagcgcgaagagcgagaaagattagaggccgaggaggaacgaagaaggctgcaggctcaggcacaagccgaggagcgtcggcggctggaggaggatgcccgtctcgaggagcgcaggcggcaggaagaagaagaaggtcggtgcgctgaagagctgaaacggcaggaggaagaagaagctgaaggctgggaagaactcgagcagcaggaagccgaagtacaagggccacccgaggcgctagaagaaaccggggaaggtcgtcgcggcgccgaagaagaggatcttggtgaggaggaggaggaagggcaggcccacctggaggattggagaggacaactctcggagctgctcaatgacttcgaggaacgcttagaggatcaagagcgcctcaagcctgaagggcaaagagagcatagcgaggagcccggaatctgcgaggagcagaaccctgaagcagagaggcgcagagagcaacagggcaggagtggagactttcaaggtgccgatcgtccaggacctgaggaaaagagagaggagggagacactgagcccttgctcaaacaggaaggaccagtggaggccgcccagccacctgttgagcgtaaggaagcagcagctctcgaacagggcaggaaggtggaggaattaagatggcaggaagttgacgaaaggcaaaccatgcccaggccttacaccttccaggtctcttcaggcggaaagcagatcctgttcccaaaggtcaacctgagcccagtgactcctgccaaggataccggtctaaccgcagctccccaagaacccaaggccccaaaagcttctcctgtgcagcacgccctgccgagcagtctctcagtgccacataccgccatcctcgtgaccggtgcccagctgtgtggaccagccgtcaatttgtcacagatcaaagatacggcgtgtaaaagcctcctgggcctggaagagaagaaacacgccgaggcacccgctggggaaaatccccccagagggcccggtgacgccagggccggcagtggaaaggctaaaccccggcaggaaagcccatccagcgcctccgccctggcagaatgggcttcaataagaagcagaattctgaaaaacgccgagtctgaccctagatcttccgaaagagaccagcttagaccaggcgatgagagcaccccccgtgggcggtgtgatagtcgggggaatcagaggaagacaccacccgtcaacgcaaaattcagtatcatgcccgcgtggcaaaaatttagcgatggcggaacagagaccagcaaacaatcaactgaagcggaaagtatccgaaaacggccgatgctgggaccatccgaagaaactgcgccccagcccccccctgccggtgtgcgagagctcggtaaagggcccgagaaatcagaaatgcatagagagcccgccgacacgaccgaaggctgtaagtttgcaaaggacctgccctcttttttggtcccttcccttccataccctccccagaaggtcgtggcccacaccgagttcacaacatcgtccgatagtgaaactgcaaacgggatcgcgaagcctgacccagtgatgcccgggggagaggaaaaggcctcccccttcggtattaaacttagacggaccaattatagtctgagatttaattgcgaccagcaagcagaacagaagaagaagaagcggcactctagcacgggtgatagcgcggatgctggcccacccgcggctggctcagcaaggggagaaaaagaaatggaaggcgttgccctcaagcacgggcccagtctgccccaggagaggaagcaggcaccaagcacaagaagagactccgcagagccttctagttcaagaagcgttcctgtcgcccaccctggccctccaccagcctcctcccagacacctgctccggagcatgataaagcagcaaataagatgcccctcgctcagaaaccggccctggccccaaaacccacatcacagactcctccagcttcccccctctctaaactgagtcggccctatttagtggaacttctgagccgtcgcgctggaaggccagaccccgaacccagcgagccatcaaaggaggaccaggagtcatctgaccggagacccccctcaccgcctgggccagaggagagaaaggggcagaagagagacgaagaagaggaagcgactgaacgaaaaccagccagcccaccattacccgccacacagcaggaaaagccttctcagaccccagaggctggcagaaaagaaaagcccatgttgcaatcacggcacagcttggacgggtcaaagttgactgaaaaagtcgagacagcgcagcctctgtggatcactctcgccttacagaagcagaagggttttagggaacagcaggccactagagaggagcggaaacaggctagagaagctaaacaggccgaaaagctgtctaaagaaaatgtgtctgtgtccgtgcagccaggttcatcatctgtgtcccgggcgggctcgctacataagagtacggcccttcctgaagaaaagcgccccgagactgccgtgagccgcctcgagcgtcgagagcaattgaagaaggccaacacactccccacctccgtgacagtagagatctcagactcggctccacccgcccccctggttaaagaggttaccaagcgcttttccacccctgacgccgcgccagtgtctacggagccggcttggttagctctcgccaaaaggaaggctaaggcatggagcgactgtcctcagatcataaaatag

SEQ ID NO: 50160 - DNA, 2538 bp, Artificial Sequence
  Description of Artificial Sequence: Synthetic coding sequence
atggcccaggtgtggcggcgggtgagcgagcacttctgggagagcgagactacaaccagtaagtcaaccagtgggctaaccgacattacatggagttcaagcgggagcgacctttctgatgaagacaaaacactcagccagctgcagagagatgaactgcaatttattgactgggagatagatagtgacagagccgaggcttccgactgtgacgagtttgaagacgatgagggggctgtggagatttcggactgcgcgagctgcgcgagcaaccaatccttaaccagcgatgagaagcttagcgagcttcctaaaccctccagcattgaaatcctggagtatagttcagactcggagaaagaagacgatctagagaatgtgcttctcatcgatagcgaaagtccacataagtatcacgtccagttcgccagtgacgcgcgccagatcatggaaagacttattgatcctagaacgaaatcaaccgagaccatacttcatacccctcagaagccaaccgccaagtttcccagaacacccgagaattccgcgaaaaagaaactgttgagaggcggactagctgagcgcctgaatggactccaaaacagagaacgaagcgcgatcagtctgtggcgccatcagtgcattagttaccagaagaccctgagcggccgcaagagtggggttctaacagtcaagattttggagctgcatgaggaatgtgccatgcaggtagccatgtgcgagcaactgctcggcagccccgccacctcaagcagtcagtccgttgccccgcgacctggagccggcctaaaggtgctgttcacgaaggaaacagccggctatttgaggggccgcccccaggacaccgtgcggatttttccaccatggcagaaactgatcataccctctggcagctgccccgttattctgaatacatacttctgcgaaaaagtggtggccaaagaagacagtgaaaagacatgtgaggtctattgccctgatattccactcccccgccgcagtatcagtctcgctcagatgttcgtaataaaagggttaacaaataactctccagagatccaggtcgtgtgctcaggtgtcgcaaccactggtacagcctggacgcacggccataaggaggccaagcagaggattccaaccagtacccccctccgggactccctgttagatgtggtggagtcacagggggccgctagctggccaggtgcaggcgttcgagtggtcgtccagcgggtctattcactgccttctagggactcaactcggggccagcaaggcgcaagcagcggacacaccgatcccgctggcacccgagcctgtcttctcgtccaggacgcctgtggtatgttcggcgaggtgcacctggagtttacaatgtctaaggctcggcaactcgaagggaagtcttgctccctcgtcggcatgaaagtcctgcagaaggtgacaagaggcagaacggctgggattttctcgctcatcgacaccttgtggccacctgccatccctcttaagacccctgggagagaccagccgtgcgaggaaatcaaaacgcatctgccaccccctgccctgtgttacatcctcactgctcatccaaatctgggccaaattgatatcattgatgaggacccaatctacaaactgtatcagccgcccgtcacccgttgtttgcgggacattttacagatgaatgaccttggaacacgttgttctttctatgccacagtgatttaccagaagccccagctgaagagcctgttactgttggagcagcgggagatttggctgctggtgacagacgtaactctccagacgaaagaagagcgcgacccccgtttaccaaaaactttgctcgtctatgtggcgcccctgtgtgtgcttggctctgaagtcctggaggccctcgccggagcggccccccattcccttttctttaaagacgccctgcgcgaccagggccgaatcgtttgcgctgaaagaactgtgctgctgctgcagaaaccgctgctgtcagtggtcagcggtgcgagctcatgcgagctccccgggcccgtgatgttagattctctggatagcgccacacccgttaactctatttgcagcgtacaggggaccgtcgtcggagtcgacgagtctaccgccttctcttggcctgtgtgtgatatgtgtggtaatggtcgattggaacaacgccccgaggatcgcggcgccttctcctgcggcgattgctcaagggtcgtgactagcccagtgcttaagcgacacttgcaggtgttcttagactgtagatctcgcccccagtgtagggtgaaggtgaaactcctgcaaaggagcatctcctcacttctgagattcgccgccggtgaagacggcagctatgaggttaagtcagttctgggcaaggaggtgggcctgctcaattgtttcgtgcagagcgtgacggcacatccaacaagctgcatcggacttgaagagattgaactgttgagtgcgggcggagcgtccgccgagcactag

SEQ ID NO: 50161 - DNA, 324 bp, Artificial Sequence
  Description of Artificial Sequence: Synthetic coding sequence
atgctgagcaagggccggagcccccggcggaagcaggtgcagacccaacggaaggccgctctcgtgctgtccgtgacgccaatggttcctgtaggctctgtgtggctagccatgtctagtgtgctctcagctttcatgcgtgaattgcctgggtggtttctgttctttggtgtttttctgccagtaaccttattgctgttgctgctgatagcttacttcaggattaagctcattgaagtgaacgaggagctgtctcaaaattgcgataggcaacataatcccaaggacgggtcttctctttaccaaagaatgaagtggacatag

SEQ ID NO: 50162 - DNA, 876 bp, Artificial Sequence
  Description of Artificial Sequence: Synthetic coding sequence
atccggcccttcagcagcgtgaacagcctggtgctgaacgaggccagcactctggccaagcggctgtccactttcacgacatttataaggcctttcagcagcatgaagtcacctgtgctaaatgaagcgagggcgctgagcaagagatttgcaaccttcaccgcacttatccgatcatgcgcttcgatgaactcacccgtcctcaacgaggtccggttcgccggcaaagggtttagcactttcacagcctttatccggtcttttagcagtgtgaactcattggttctaaaccaagataaattcgctgcaaagggattcctgaccttcacggctctgatccgaccaataactagcgtgaatgccgccgtgtcgaacgaggtgcgagaactctcaaaaggattcccgacctttagtgccttcatccggagcttttcaaccgtcaattctctggtcctgaacgaattcagattcgctgctaaacggtttcccaccataacggccctgatccggcacttctctagcgttaatagctctatgtccaacgagattgaggacctttctaaagggtttccgacgctgaccgcactgatccgaccatttagccgggtaaactctctggtttccaagaaggcccgtgcattgtcaaaaggtttccccgcactggccacgttcattcgtccattcagcagtgttaacagcttggtgttcaacgaagttaggtttgttgccaaagggttcccaaccttcaccaccctgatgacccattcaagtagtgtgacctctctggttgtgaatgagttcagatttatggacaaagggttcctgaccatcaccgcttttatacggcccttttcctcagttaactatctcgtgtag

SEQ ID NO: 50163 - DNA, 672 bp, Artificial Sequence
  Description of Artificial Sequence: Synthetic coding sequence
aagccctacgcctgcaacgagtgcgtgaagagcttctgcgtgaagtcatcactgataatacaccagcgcactcatacaggggagaaaccttataagtgtaacgagtatgggaagacctttcaccacaagtctaccctcacagtccaccagcgcacacacggcgagaaaccatataagtgcaatgagtgtcggaagtctttctacatgaagtcagcgctgagtcagcaccagcggatccacatttgggaagagcactgtgagtgtaaggagtgtgggaagacgtatcagcgcagtcatctggctaagcaccaccgcaagtatacaaagaaaccgtatgaatgcaagcagtgcggcaaaacgtttcagaagagtcatctgatcgagcaccagagaactcaccctggggaaattccccacgagtgtaataaatgcggcaaatcattttgttataagagccccttaaccatccaccagcggactcatattgaagaaaagccttacaagtgcagtaaaagcgtcacatatttttgcatgaaatcacacttgacagttcaccagaggccgcatacccgcaagaacccattcgaatgtaatgagtgccgaaaaatgttttatgtcaagagtaatctgatcaaccaccagcggactcataccggagaaaaaccctactag

SEQ ID NO: 50164 - DNA, 621 bp, Artificial Sequence
  Description of Artificial Sequence: Synthetic coding sequence
atgaaggccggcttccacctgaaccccaaggccatcgaggccagcctccaaggctgctgtagcgaagccgaggctcaacaaaccgggagaagacagaccccgcctcagcctatgcaatgtgagctccccacggtgccagtgcagattggaagccatttcctgaagggagtctcttttaacgagtccgctgccgacaatctgaaactaaagacacatacgatgctgcagctgatgaaggaagcaggatgttacaacggcatcacatcgagagacgactttccagtgactgaagtcctgaaccaagtctgcccctccacatggagaggagcgtgtaagactgcagtgcagctgctcttcggccaagcgggcctcgtagtggtagacaccgcacagattgagaataaagaagcctacgcgcctcagatttctctcgagggcagccgcatcgtcgtgcaggtgccttcaacttggtgtctcaaggaagatccggctactatgtccttactgcaacgttctctcgatcccgaaaagacattgggccttgtcgacgtcttatataccgcagtgctcgacctgaaccgatggcgagcaggcagactagtatatctgagcttcttctag

SEQ ID NO: 50165 - DNA, 3945 bp, Artificial Sequence
  Description of Artificial Sequence: Synthetic coding sequence
atggagaagcacaacgccctgcggtgcctgcccggccggaaccggaaagaaagcacatctgaacagatgccctctttccctgagatggtttactacattcaggagaaagcctcccataggatgaaaacccccgtcaagtacatgaccggcaccacagttctgccttttaatccagctgcctttggcgagattgttctgtatctcagaatgtgtctggcgcacagtgccggcgtggtcccaacctctcagagcctggcagatatgcaggatcatgcccccgccataggtcggtacatccggaccctgatgtcctccggacagatggcaccaagtagctccaacaagtccggcgagaccaatcctgtgcaaatctacatcggtctgttacagcagctgctggcgggcgtggggggactgcctgtgatgtattgccttttggaagccgtttctgtctatcccgagaaattagctaccaagttcgtggacaaaacggagtggataaagtcccttatgaacaattccaaggaggagatgagggagttagcagctttgttctatagtgtggtcgtttcgactgtatccggcaacgagctaaaatccatgatcgagcaacttattaagaccacgaaagacaaccacagcccagaaatacagcacggatcattgctggcattaggcttcaccgtcggtcggtacctcgccaagaaaaaaatgcggatgtctgaacagcaggacctggagagaaatgccgacacccttccagaccaggaggaactgattcaatctgccacagagactattgggtcattcctggatagtacgagccccctactcgccatcgcggcttgtactgccctgggagaaatcgggagaaatggtcccctgccaattccttctgaaggctccggtttcaccaaactgcacttggtggagtccctgctctctcggatccccagctccaaagagactaacaagatgaaggaacgggccatacagacgctgggttatttccccgtgggagacggcgattttcctcaccagaagctgctcttgcaaggcctgatggacagcgtggaggccaaacagatcgaactgcagtttacgatcggggaagccatcactagtgcagcaattggcacctctagtgtggcagctagagacgcatggcagatgacagaggaggagtacacgccccctgccggcgcaaaggtaaacgacgtcgtaccctgggtgctggatgttatactcaacaaacacataatttcccccaatccacacgtacgtcaggcagcctgtatttggctgctcagcctggttcggaagttgtctacacacaaggaggtaaagtcgcatctcaaggagatccagtctgcttttgtttcagtgctgtcagagaatgatgaactgtctcaggatgttgcctccaaaggtcttggcctagtgtatgagctgggcaacgaacaggatcagcaagagctcgtgtccaccctggtggaaacactcatgacaggaaaaagagtgaagcacgaagtgtctggggagacggtcgtctttcaggggggtgccctcggcaagacacctgacggtcagggccttagcacatacaaagaactttgcagtctggcatctgatttgagtcagccagatcttgtctacaagttcatgaatctcgccaaccaccacgctatgtggaacagccgaaagggcgccgcttttggattcaacgtaatcgcaactagagcaggcgagcagctcgcgccattcctgccacagctggttcctagactgtatcggtaccaattcgatcccaaccttggtatacgtcaggccatgacctccatttggaatgccctggtgaccgacaaatcgatggtcgacaaatacctgaaagagatcctgcaagacctggtcaagaatctcacgtctaacatgtggagagtgcgggaaagttcttgcctggcgttgaatgacctcctgcgcggaaggcctcttgacgatattatcgataagctgcccgaaatttgggaaacgctttttagggttcaggacgatataaaagaatccgttaggaaggccgccgaactagccttaaaaacactgagcaaggtgtgtgtgaaaatgtgcgaccctgcaaagggagccgcggggcagagaaccattgctgctctcctgccttgcctcttggataaggggatgatgtcaactgtaactgaggtccgggcactttcgattaatactctggtgaaaataagtaagtcggcaggagcaatgctgaagccccatgcccccaaactgatccctgctctactggagtcgttgagcgtgctggagccacaagttctcaattatctgtctctgcgcgctacggagcaggagaaggccgcaatggactccgcccggctatccgcggcgaaaagcagcccgatgatggagaccattaacatgtgcctacagtacttggacgtctcagtattgggtgagctggtaccacgtttgtgtgaattaattagaagcggagtgggcttgggaacaaaagggggatgtgcaagtgttattgtgagtctgacaacccagtgcccccaggatttgactccgtacagtggtaaactgatgtccgcattactgtccggtctgaccgaccggaattccgtcatccaaaagagttgcgcatttgctatgggccacctcgtgcgaacctcaagggactcctccaccgagaagctgcttcagaagctgaatggctggtatatggaaaaggaagaacccatctataagacgtcttgtgcattgactattcacgcgatcggacgttatagccccgacgttctgaaaaatcacgctaaagaggtgctgcccttggctttccttgggatgcacgaaatagcagacgaagaaaaatcggagaaggaggaatgcaatttgtggacggaagtgtggcaggagaacgtgccaggctctttcggtggaatacgactttacctccaggagttgatcaccattacgcagaaagccctccagtctcagtcttggaaaatgaaagcacagggcgctatagccatggcatcaatcgcgaaacagaccagttctttagtgcccccttatctcggcatgattctgacagcccttctgcagggtctcgccggcagaacatgggcaggaaaggaagagttgctgaaggctattgcctgcgtagtgacagcctgctccgctgagttagagaagagcgtgccaaaccagcctagtacgaatgagattctccaggccgtcttgaaagagtgctccaaagagaacgtgaaatacaaaatcgtcgcaattagctgtgctgctgatatactgaaagctacaaaagaagacagattccaggagttctcaaacatcgttattccactgataaagaagaacagcctagagtcttccggtgtgcggacaacaaaaaacgaggaggagaatgagaaagaaaaggaactgcagctcgagtacctgcttggcgctttcgaatccctgggcaaggcttggcctcgtaacgccgagacccaaaggtgctatagacaggagctttgtaaactcatgtgtgaaaggctgaaattgtccacatggaaagtccagttaggagttctgcagagcatgaatgcatttttccaaggcctcatgctgctggaagaagagcatgcagacccagaagctcttgcagagatccttctcgaaacctgtaagagcatcacatacagcctggagaataagacctactcgtctgttcggacggaggccctgtccgtgatcgagctactcctcaaaaaactagaggagtcaaaacagtgggagtgcctcacaagcgagtgcagagtgctcctgattgaatcactggctaccatggagccagacagtcgacccgagttgcaggagaaagctgccctgctgaagaagactctggagaatcttgaatag

SEQ ID NO: 50166 - DNA, 618 bp, Artificial Sequence
  Description of Artificial Sequence: Synthetic coding sequence
atggaggacggcggccagcgggaggaggagacccggcggaacgccacctgtggagcagccgcaaagtctgaaaacagagggaagcgccacgctagtgcaggtaaaaagggggccgggggtactagtcccaccgcacctagcactaagcgcccattgcccggactttccgctcctctgggggcaggctctgcctcaagcccccctctgcgggcacccgttcctaggagcgaatgccctggacgaaggcgcccagtgctggctgcacgctcggatgccctagaatcctcgcctatctctctacccgccaccccagttcgcagacctttactgagctactcagctcccacacatttggggactcccgggggcgccaggggccaccttcagggcgaagggttacgcggccaaggaaaaccacctgtgtggcgggtacggagagctttacccccggggtggactcagcaggccgaggcccaggagcaggggagtgcgactcgcgccggtttgggagccaggcgcggggtgggcactgccagctggggctggacatgggctacctgtggcaggaagggagcaaggaaccgaaaacgcagcgatgaaaggcctcggcccccatag

SEQ ID NO: 50167 - DNA, 1353 bp, Artificial Sequence
  Description of Artificial Sequence: Synthetic coding sequence
atgaaccgggtgagcgaggagaaggaggtgaccgaggagcggctgaaggctgaacaagagtccttcgaaaaaaagattaggcagctagaggaacagaacgaactgatcataaaagaacgcgaagcgttgcaactgcagtatagagagtgtcaagaactattatccttatatcagaagtacctgagcgagcagcaggagaagctcaccatgagcttgagcgaactgggagccgctagaatgcaggagcagcaggtgtcatcacgcaagagcactttacagtgtagctctgtggaattagacggctcatacctttcaatcgctcgtcctcagacctactatcagaccaagcagcgacccaaaagcgctgtacaagactcagccagcgaatccctcattgctttcagaaacaattctttgaaaccagtcaccctgcaccaccccaaggatgaccttgacaagatcccaagcgaaactactacatgtaactgtgaaagtcccggaaggaaacctgccgtgccaacagagaaaatgccgcaagaggagctccatatgaaggagtgcccacacctgaaacccaccccgtctcagtgctgtgggcatcgcttggccgccgacagagtacatgactcacatcctaccaacatgacacctcagcaccctaaaactcaccccgaatcttgttcttattgtcgccttagctgggcgtccctcgttcacggtggtggtgccttgcagcccattgaaacactgaagaaacaaatttccgaggatcggaagcagcaactcatgctccagaagatggagctagagattgaaaaagaacgcctgcagcacctgctggcacagcaggagaccaagctgctgctgaaacagcaacagctgcaccagtcacggctggattacaactgtctgctgaaaagtaattgtgacggctggctgttaggaacgtccagctcaattaaaaaacaccaggaccccccgaattccggagagaaccgaaaggaaaggaagacggtgggattccattcccatatgaaagacgatgctcaatggagttgtcagaaaaaggacacttgcaggccccagagaggaaccgtaaccggcgttcgtaaagacgcgtcaacaagtcctatgcctacaggaagcctgaaagactttgtgacaaccgcctctccttcgttgcagcacacaactagcaggtacgagacttcactcttagatctcgtgcagtccctgagccccaactcagcccctaaaccgcaaaggtatccttccagagaggcgggcgcctggaaccatgtgaatctccaagaggtgagctcaccatccagacgtggcggcttgcacctgtag

SEQ ID NO: 50168 - DNA, 1257 bp, Artificial Sequence
  Description of Artificial Sequence: Synthetic coding sequence
atgaagaagcggaaggagctgaacgccctgatcggcctggccggcgactctaggagaaagaaaccaaaaaaagggccgtcctcccacaggctcctgcggactgaaccccccgatagcgattctgagtcctcttcagaagaagaggaggagtttggagtggttggcaatagaagccggttcgcaaaaggagattacttgcgctgctgtaaaatttgttacccattatgcgggttcgtcatattggccgcatgcgttgtagcttgcgtcggcctggtatggatgcaagtggccctgaaggaggaccttgatgctttgaaagagaaatttcggacaatggagtcgaaccagaaaagttcctttcaggagattccaaaactcaacgaagaactgctgagcaaacaaaaacagctggaaaaaattgagtccggggaaatgggactcaacaaggtctggattaatataaccgaaatgaacaagcaaatttctctgctcacaagcgcagtgaaccatctcaaagcaaacgtcaagagcgccgctgacctgatctcattgccaaccaccgtagagggcttacagaaaagcgtcgcttccatcggcaacacacttaactcagtccacctcgcggttgaagctttacagaaaactgttgacgagcataaaaaaacaatggaacttcttcagtccgatatgaaccagcactttcttaaagaaacacctggtagcaaccagatcatcccttctccatccgccacgagtgagctagataacaagacccactcagagaacctgaagcagatgggggacagaagtgcaacattaaaacggcagtctctggaccaggtaaccaatagaaccgacacggtaaaaatacagtccatcaaaaaagaggattcctcaaatagtcaagtgagtaaattgagggaaaaattgcagctcattagcgcactcactaataaacctgaatcgaaccgaccacctgaaacggcggatgaagagcaggtggaatcttttacgagcaaaccctcagcccttccaaaattttcacagttccttggagaccccgtcgaaaaagcagcccagctacgtccaatatctctccctggcgtatcctctacagagggccaaacccagctactgctttctccagcctggcgaaacgccgtgaacttcgggtcatcccaatggggcatccctggcaaggttattctgtccaacgtgtggaatagacgtcaaatgccttggggcaactcgctgtag

SEQ ID NO: 50169 - DNA, 1203 bp, Artificial Sequence
  Description of Artificial Sequence: Synthetic coding sequence
atgggcgtgctgatgagcaagcggcagaccgtggagcaggtgcagaaggtcagccttgccgtctcggcctttaaggatgggctgcgcgaccgaccatctatccggcggaccggcgaactgcccggctcccgccgaggtactgtggaaggcagtgttcaggaagtgcaggaggagaaggaagcggaggcagggacatccgttgtccaggaagagagctcagccggacgagcagcttgggagagattgcgcgatggacggggcgtggaacccgaagagtttgatagaactagtaggtttacacctccagcctttattagaccaacacgaaagctggacgacgataagccccctgagatttgcctggaacccagggaaccagtggtgaacgacgaaatgtgcgacgtgtgcgaagtgtggaccgctgaaagtctgttcccttgtagagtttgcactcgtgtatttcacgatggctgtctgcgcaggatggggtacattcagggtgactctgcggccgaagttacagagatggcacacaccgagacaggttggtcttgccactactgcgataacatcaacctcctcctgaccgaagaggagatgtatagcctcaccgaaacatttcagaggtgtaaagtgatccccgattgctccctgacgctggaggacttcctacgctataggcaccaagctgccaagcgtggtgaccgagaccgggccctgtccgaggaacaagaggagcaggccgctaggcagtttgcagcgctggaccccgaacatagaggacacatcgagtggccagacttcctcagccacgagtcactcctgcttctgcagcagttacgcccgcagaactctctccttaggttgctgactgtgaaggagagagaacgtgcccgcgcagctttccttgcgagaggatctgggtcaactgtttccgaagctgaatgtcgtagggcccaacatagctggttttgtaaaaggttcccagaggcacctagctgctctgtgtcaatctcacacgttggcccgatagcagactctagccctgcctcgtcctcatctaagtcacaggataagaccctgttgccaacagagcaggagtcaaggtttgtcgactggcccaccttcctgcaggaaaatgtactctatatcctggccgcgcgtcccaattccgctgctatacacctgaaacctcccggatag

SEQ ID NO: 50170 - DNA, 210 bp, Artificial Sequence
  Description of Artificial Sequence: Synthetic coding sequence
atgatggtgctgacccccttctggctgggccgggactgccccagccgaggacagcctaccctgagagagggcaaggggttatcggtgccatttacatgtaagttgaataacccacagcgttatctcctgtatctgactcacactccccgaaggcaatatagtcctgcatggtaccttcctgggaagctgggaataactttgactgtgtag

SEQ ID NO: 50171 - DNA, 1173 bp, Artificial Sequence
  Description of Artificial Sequence: Synthetic coding sequence
tgcgagaagagcaccttcttcaagcaccagaagcggacccacaccgtagagaaaactttcgaatgctctcacggcaaaaaatccttttgtcaagagtcgcatttcacagaacatcatcggacttgtacccgtgagaagccctgtgaatccaacaagtatggcaagacgttccatcagaaacgtagcttcattcatcatcagcggacccacacaggggaaaaaccttacgaatgtaaagaatgtaggaaatctttccacgtcaagcctaacttaacaaaacaccagaaaacacacatcggtgagaaacctttcaagtgcacggcttgcggcaggacctttttccaacaaagtacccttaacgttcaccaaggcaagcacaccgaagagaaaccctacaaatacactgagtgcgaaaagtctttctacaagagtgtgctgattatccacgagcggacccatacaggagaaaagccatgtggctgtaatgaatgcgagaagtctttcgaggtgctaacaacgctggtcatccaccagagaacccacactggagaaaagccttataagtgcaatgaatgtgaaaaatcctaccttaacctaaaatctcatcttaatatccacctcagaaaccacacgggaaaaaggccacacgtgtgcaatgagtgtgggaaggccttttctatgaaaagtaactttaccgaccatcagaggacccactgtggggagaaaccgtataaatgcaatgagtgccggaagtctttttatatgaagagcgcgttgagtcaacatcagcgaatccacatttacaaaaagccatacgaatgtaaacagtgcggcaaaacatttcagaaaagtcacttgattgagcatcagcgcacgcatccaggtgaaatcccccatgagtgtaataagtgtggcaagagcttctgctataaatctcccctgacgattcaccagcgtactcacatcgaggaaaagccttataagtgctctaaatcagttacgtatttctgtatgaagtctcatcttactgtccaccagagaccccatacgagaaaaaacccattcgaatgcaacgagtgcaggaagatgttttatgtgaagagtaatttaatcaaccaccagcggacacataccggcgaaaagccctatgaagggaatacctgtggtaaatag

SEQ ID NO: 50172 - DNA, 6279 bp, Artificial Sequence
  Description of Artificial Sequence: Synthetic coding sequence
atggtgctgaaggtggacaccagcgagagcctgtggcacatccagatcagccgatcccggttcctgctcgactcggacgggaagcggctgatttgcgaggtatcattatgcaagatcaactctaaagtcctaaaaagcggacaacttgaggacacatgtcttgtggagctgagtttggcgctcgatctctgcctgaaggtgggaatctccagccgacatctgacagccattaccgttgatgtttggaccctacacgccgaattacatgaagggttgttccagagccaactcttatgccaaggtccatctctggccagcaagcctgttccctgctcggaggtgacagagaacctagtggaaccgacattgcccggccttttcctattgcagcagcttcccgaccaagtgaaggtgaagatggaaaataccagtgtcgtcctgtccatgaactcccagaagcgccatctcacttggactctgaaactgctgcaattcctctaccatcgggacgaggatcagcttcccctacgctcctttactgcgaattccgatatggcacaaatgtccacagaactgttactcgaagacgggctgctcctgagccaatcccggcagcggatcgtctgtttaaattctttgaaagcttctgttcaggtgactaccatagacctctctgcttcactggtgctgaatacgtgcatcatccactatagacatcaggagttcagccactggttgcatctcctcgcactcgagacccaggggagttctagccccgttctgaagcagaggaagaagcggacattccctcagattctcgctccaatcatcttttcaaccagtatctcaaatgtcaatatcagcattcagcttggcgacaccccgcccttcgcactcggctttaattctatttcactcgattatcagcatctgcggccccagtcaatccaccagcggggagtgctgacggtggaccacttgtgttggagggttggcagtgacagccatattcagagggcccctcaccctcccaacatgcacgtgtggggcgaagcactggtcctggactcattcacgctgcagggaagctataatcagcctctaggcctcagctcaacgcagtctgacacattgtttctcgactgcactattagaggccttcaagtcgaggccagtgatacttgcgcacagtgtctctcaaggatactctcactgatgggaccccagtctggaaaatctgcagtgtcacgccactcttcattcggcgaaagcgtgtcgctactgtggaaggtcgacctcaaagtcgaggacatgaacttgtttaccctcagcgctctcgtcggcgcatcagaggttagactcgacaccctgactatccttggctcagcagaaacctccactgttggtatccaaggccttgtcctcgctctggtaaaatctgtcaccgaaaaaatgcagccctgctgcaaagcacccgacatcccaacgcccgtgctgtccctaagcatgttatccattacataccactcttccattcgatccctggaggtccagtgcggagccggcctaacgcttttgtggtcaccaccagatcacatgtacctttatcagcatgtgctagctactttacagtgtcgcgatctcctgcgtgccaccgtgttccctgagacagtgccatctctggccctcgaaacctccgggaccacgagtgaactcgagggtcgggctcctgagcctttgcccccaaaaagactccttaacttgaccttggaagtgagcactgccaagttgacagccttcgtcgccgaggacaaattcataactctcgcggctgagtctgttagcctgtccaggcacgggggaagcctgcaggcatactgtcccgagctggctgcaggtttcgacggcaattccatttttaacttcaaggaagtggaagttcaactgctgcccgagctcgaggaaatgatcttgcataggaacccgtttcccgccttacaaaccttgagaaacagggtgtggttactctctttcggctccgtctctgtggaattcccataccagtacgatttttctcgtacactcgacgaggcagtgggagtgcagaagtggctgaagggcctccatcaaggaacaagggcttgggcctccccttccccagtgcccttgcctcccgatctgctcctgaaagtggagcatttctcctgggtatttttggacgacgtgtttgaggtgaagctccatgacaactatgagctgatgaaggatgaaagcaaggagtctgctaaaaggctccagctgcttgatgccaaggtggccgctctgcgaaaacagcacggcgagctgttgcccgcacgtaagattgaagagctgtacgcttcccttgagcgtaaaaacattgaaatatacatccagcggtccagaagactttacggaaacaccccaatgcgccgagcgctcctgacctggtccctggctggtttggaactggtggccctggcggacgcgtcgttccacgggccagagcacgtggtggaacaagtacaggaactcgacccaggctctccttttccccccgagggactcgacctcgttatccagtggtgtcgcatgttgaaatgcaatgttaagagcttccttgtgaggatacgagattaccctcgctacctgttcgagattagagattggagattgatggggagactcgttgggaccgagcagtccggccagccctgctctagacgacggcaaatcctgcaccttggcctgccgtggggcaatgtcgctgtcgaacgcaatatgcctcccctgaaattctatcacgattttcatagcgagatttttcaatacaccgtagtgtgggggccttgttgggatcctgcgtggacacttattgggcagtgtgtggacctactgactaagccgagcgcagacccatccccacctctgccttggtgggacaaaagtaggctgttatttcacggtgactggcacatggatatcgagcaggcaaacttgcatcagctggccacagaggatccatataacactactgagaacatgcactgggaatggagccatttgagcttccactggaagccaggtcagtttgtatttaaaggggatctggatatcaatgtgcggacagctagcaagtacgacgactgctgctttttgcatctccccgatctgtgcatgactctggatttgcaatggttatgccatggtaacccccacgaccatcactctgttactctaagagcccccgagttcctccctgaagtccctctggggcagttgcatgactcatatcgagcatttagaagcgaaaacctgaacctgtctatcaagatggacttgacaaggcatagcgggacaatctcacagccaagaattctcttgtatagcagtacgctccgttggatgcagaatttctgggccacctggacttccgtgacccgccccatttgtcgcggcaaactattcaacaatctgaagccatctaaaaagaagttggggcagcactataagcagctatcttatacagccttgtttccacagttgcaggtgcactactgggctagctttgctcagcagcgaggaatccagatcgaatgtagtcagggccatgtgtttacccggggtacgcagcgcctgatcccgcaagctggtaccgtaatgcgccgtctaatttctgactggtccgtcacacagatggtctccgacctcagtcaagtcaccgtccacctcatggcaagtcctaccgaggagaacgctgaccactgccttgatccacttgtgacgaagacgcatttgctaagcttatcatctctgacatatcagagacattccaaccgaaccgcagaggaggagctgagtgccagagacggagatccgacatttcatacccaccaactgcacctggtagacttaaggatcagctggaccaccactaaccgcgatatcgctttcggcttatacgacggctacaagaaggcagctgtgctcaaacgcaacttgtctacagaggccctgaaaggcctcaaaattgatcctcagatgcctgccaaaaaaccgaaaaggggagttccgacgtcggccagcgccccgcccagagtgaacactcccagtttctccggccagccagataaggggtcaagcggcggcgcatacatgctacagaagctgatcgaagaaactgacagatttgtggtctttacagaagaggagtctggcatgtcagaccagctctgcggcatcgcagcttgtcagaccgatgacatttacaacaggaactgcctcatagagctcgtcaattgtcagatggttttaagaggggctgagacagaggggtgtgttatcgtttcggcggcaaaggctcagcttctccaatgccagcatcaccctgcctggtatggggacacactgaagcagaaaacatcatggacatgtctccttgacgggatgcagtacttcgctaccactgaaagttcaccgaccgagcaggatgggcgacagctctggctggaagtgaaaaatattgaggaacaccgacaacgaagcctggattccgtccaggagttgatggagtccggccaggccgttggaggaatggtcaccaccactacggattggaatcagccagctgaagctcagcaggcccaacaggttcagcggattatttctcggtgcaactgtagaatgtactatatcagttattcccacgacatcgacccagaacttgctactcagataaagcccccagaagtccttgagaaccaagaaaaggaagatctccttaaaaaacaggagggagccgtcgatacttttacattgatccaccatgagctagagatttccacgaacccagctcagtacgcgatgatcctggacattgtgaataaccttctgctgcacgtggagcccaaacgtaaggaacactctgagaagaagcagagggtgagattccagctcgaaatctcctccaaccctgaggaacagaggtcttcaatcctgcacctgcaggaggccgtgagacagcatgtggctcagattcggcagctcgagaagcagatgtattccattatgaaaagccttcaagacgattcaaagaatgaaaatctgctggatctgaaccagaagctgcaattacaactgaatcaagagaaagcaaacttgcagctcgaaagcgaagagctaaatattctgatccgctgcttcaaagactttcaactgcagcgagctaataagatggagctgcgcaagcagcaagaggatgtgagcgtggtgcgacgaacggagttctacttcgcgcaggccaggtggagattaaccgaggaagacggccagctcggaatcgctgaattagagctgcagagattcctgtacagcaaggtcaacaagtctgacgacactgccgagcatttgctcgaattgggatggttcactatgaataatctgcttccaaatgccgtatacaaggtagtgctgcgtcctcaatcctcctgtcagtcaggccggcagctggccctgagattatttagtaaagtccggcctcctgttggcgggatcagcgtgaaggagcactttgaggtaaacgttgtgccgctgaccatccagctgacccatcagtttttccaccggatgatggggttcttcttcccggggagaagcgttgaggatgatgaagttggagatgaggaagataaatcaaaactggtgacgacaggcatacccgtcgttaagccgcggcagctcatcgctactgatgacgctgtgccactgggcccgggtaaaggggtagcccaggggcttacacggtcctcaggcgttagaagatcctttcggaagagtcctgagcaccccgtggatgatatcgataaaatgaaggagcgggctgcgatgaataattcattcatttatataaagataccccaggtgccattgtgcgtctcttataaaggtgagaagaatagcgttgactggggtgacttaaacctggtattgccttgtctcgagtatcacaataacacgtggacatggcttgatttcgctatggctgtgaagagggattcccgaaaagctctggtggcacaggtgatcaaggagaagcttcggctgaagtctgcaacagggtctgaagttcgcggcaagctggaaactaagagcgatctgaatatgcagcagcaagaggaggaggagaaagctcgactcttaatcggactatctgtcggagataaaaatcccgggaagaaatccattttcggccgcaggaaatag

SEQ ID NO: 50173 - DNA, 2571 bp, Artificial Sequence
  Description of Artificial Sequence: Synthetic coding sequence
atgagcggcgagctgcagcggaagatcggcctgaaggtgctggagatgagggggaacgcggttgtgggatacctgcagtgtttcgacttagagggagagtctggacttgtggttcgggcaatagggacagcttgcacattagacaaactgagctcccctgctgctttcctgccagcatgcaatagtccgtctaaagaaatgaaagagtcgccactggtacaccctcccagtcacgggtgtcgctccacacataatagcccaattcacacggctacaggcagtcgcctgacacagaacttctccgtatccgtgcccactttgatctacacaggcatgggcagtggctccgccggcaaagaggggggcccttttaaagcattgctgcgtcagcaaacacaaagcgcactggagcagcgggagttccccttcttcacactaactgcgttcccgcccgggtttctggtgcacgtgggcggggtggtgagcgcccgcagtgttaagctattagataggatccataatcctgcctttgttggaatcatgggtaacacccgaagttacaagctactggattggaactcatttaattcagatgagccagaaactagggacgcatggtgggccgaaattagacaggagattaagagccacgctaaggcactgggatgccacgccgtcgtcggttatagcgaatctacctctatctgcgaggaggtctgtattttatctgcctcgggcacggccgctgtgttaaaccctagattccttcaggatggcacagtagaaggttgcttagaacagcgactcgaggagaatctacccacacgctgcggattttgccatattccgtacgacgagttaaacatgcctttccccgcccatcttacctactgctataactgtagaaaacagaaggttcctgatgtgctcttcactaccatcgatctcccgacagatgctacggtgatcggaaagggttgtctgatccaggctcgtctctgcaggttaaagaaaaaagcccaggcagaggcaaacgctactgcaatcagcaacctcctcccatttatggagtatgaggtgcacactcaacttatgaataaactgaaactgaagggtatgaacgcactgttcggactacggatacagataacagttggtgaaaacatgctcatgggtctggcatcagcgactggagtctatttagcggctcttccgaccccaggcggtatacagatagcggggaagactcccaatgatggctcatacgaacagcatatctcccacatgcagaagaagatcaatgatactatcgctaagaataaggaattatatgagataaaccctcctgagattagcgaggagatcatcggtagtcccattcctgagccacggcagaggtcaagactgttaagatcacagagcgagtcatcagacgaggtaaccgaattggacctctctcacggcaagaaagacgctttcgtccttgagatcgacgatactgatgcaatggaggatgtgcattcgctcctgacggatgtcccgcccccgtccggtttctacagttgtaacaccgagataatgcccggaataaacaattggacgagcgaaattcaaatgttcacatctgtccgcgtgatccggctcagctccctgaacctcacaaatcaggctcttaataaaaatttcaatgacctgtgtgagaatctgcttaaaagtctgtacttcaaacttaggagcatgatcccgtgctgcctctgccacgtcaattttaccgtttcccttccggaggacgagctgatccaggtaactgtgacggcggtggcaattaccttcgataagaaccaggcacttcagacaaccaagaccccagtggaaaaatccctgcaaagagcgtctaccgataacgaggaattgcttcagtttcccctggagctgtgcagtgactctctgccatcccatccctttccacctgctaaggaacacttggaaagcgcgagcagcaacagtggaattcccgccgctcaacgcgatcggtgcagttcatggatcgaactgatcaagttgaaagcgcagactatacggcggggatccatcaaaacaaccatgacggtcgagaaggcatccccagtgggtgatggcaattttcggaatcggtccgccccaccttgcgcaaactcaacagtgggagttgttaaaatgacgcctctgtccttcattccaggtgcgaagataaccaagtacttgggaataatcaacatgttctttatccgtgaaaccacttccctgcgtgaagaaggaggggtttctggttttctgcacgcctttatcgctgaggtttttgcaatggtgcgcgcccacgtggctgccctgggaggaaacgcagtcgtgtcctacatcatgaagcagtgtgtgttcatggagaatcccaacaagaaccaggcccaatgtctgataaacgtttctggggacgccgtcgtttttgtgagggagtctgatttggaagtcgtgtcctcacagcagccaacaaccaactgccagtccagttgtacagaaggagaggttaccacctag

SEQ ID NO: 50174 - DNA, 1545 bp, Artificial Sequence
  Description of Artificial Sequence: Synthetic coding sequence
atgatggaggacctgggccggaaggagaaccaggacaagaagcagcagaaggacccccgcttgacaatggagatgcggcacaagcaagtgaaggaaaatagactgagacgtgagaaggagctggaataccagcggattgagaagacccttaagaaaagcgcgttcctggaagctcagtgcctggtccaggaagaaaagaaacgcaaagccctagaagccaaaaaggaggaagaagaaatccaaagggagatggtcaaactccgccgggagattatcgaaaggcgccgcaccgtgaaggctgcgtggaaaattgagaaaaaaagacaggaggaaaactcccagaatagcagcgagaaggtgatgttccagtcgactcacatccttcccgacgaagaaaagatggttaaggaacgcaaaagaaaactgaaagaagtactgatacaaaccttcaaggagaaccagcagtgccagaaaaggtatttcgcggcttggcacaaactgattctggaccacagaatcaagctcgggaaggccggcaccttaagcgattggaagatccagttaaaggtgctgcgcgcttggagggactataccagattccagaaacttgaaagagagacccaggcacttgaaaatgatttgcgggaggagaatcggaagcagcagctggctactgaatataataggaaacaggttctgaggcactgtttcaccgaatggcaacactggcatggagcagaactccttaagagggagttagccctcacaaaggaagagactagaaagaagatggacgccctcctgcaggcagcttcactcgggaagctaagcgctaatggcctcagtggaatctctctgcccgaggaagccactgccatggttggtccccctgtaaagaatggccaagagacggcggtgccgccgctttgggagaagccccccctcggctcttctggatgtatgttaagcccccccctcggcagaaccaccaccggcaatctgcagggctcactgcagaacgtgtcattgagtgcacccgggaataaacagcataagacgctgggcgcagagccttctcagcagccgggctctaacgagactttaaggaccacaagccagaaggcggaacccctgtgcctgggtcattttcacaatcggcatgtgtttcagcaacagttgatagagaagcagaaaaaaaagttacaggagcagcagaaaactatcctggagttgaagaagaacctgcaacttgctgaggcacagtgggctgccgagcatgcactagctgttacggaagcacagtcccatctgctatcaaagccacgagaagaggagcctcgcacgtgccaaatgcttgtgaattcccctgtggcctctcctgggacagagggaagatctgactctagaaacagcctttctggattgagacgaaagccgaagcaattaatgacgccacatcctattctcaaagggcgcgccgtgagtgtggtcgccctcgttgtggtgatttttagtccccgggtcgagtgtgttcattgggactag

SEQ ID NO: 50175 - DNA, 2283 bp, Artificial Sequence
  Description of Artificial Sequence: Synthetic coding sequence
atgggcgaccccggcagcgagatcatcgagagcgtgccccccgccggaccagaagcatctgagagcaccaccgatgagaacgaggacgacattcagtttgtatccattctattccccaagatgccaaagcggcagggtgacttcctgcatttcctcaacgtaaagaaggtcaagacggataccgagaataacgaggtgtccaaaaaccactgccggctatctaaggccaaggagccccactttgagtatattgaacagcctataattgaagagaagccctctttgagttcgaaaaaagaaatagataacttggttcttcccgactgctggaacgagaaacaggcattcatgtttactgaacagtataagtggttggaaattaaggaggggaaactgggatgtaaagactgtagcgccgtgcgacacctagggtcaaaggctgagaagcatgtacacgtgtctaaggagtggatcgcatatttggtcacccctaacggctccaacaaaactactcgccaggcttccctgaggaaaaagatcagagaacacgacgttagcaaagcccacggaaagattcaggacttactgaaggaaagcacaaatgattccatctgtaaccttgtacacaaacagaataataagaacatagacgccactgtgaaggtattcaacaccgtttacagtcttgtaaagcacaatcgaccgctgtcagatattgagggagcacgggaattgcaggagaagaacggcgaggtgaattgcctgaacacgagatacagcgcaaccaggatcgctgagcacattgctaaagagatgaagatgaaaatattcaagaacattattgaggagaatgcaaagatttgcattattatagacgaagcgtctactgtgtccaaaaaaaccacactggtaatttatttacagtgcactattcaaagcgctcccgctcccgtgatgctattcgtcgcgctcaaagaactcgtaagcacaatcgcggaatgcattgttaataccctgttaacaaccttgaacgattgtggatttacaaacgagtaccttaaggccaatttaatcgctttttgttctgacggggccaataccatcttgggacggaaatcaggagtggctaccaagctgctggaaaatttcccagagatcatcatttggaattgcctaaaccaccgccttcaattatccctcgacgatagcatctctgagatcaaacagatcaatcatctcaaaattttcattgacaagatctattcaatctaccatcagcctaacaagaaccaaaccaagctgcttggaaccgtggccaaggagctggagacagaaattatcaaaattggccgtgtgatgggcccccgatgggctgcctgctccctccaggccgcaaccgcggtgtggcacgcctatcctatcctgtacatgcacttcagtcacagttattcgggcctggccaaaagactggccaatatcaacttccttcaggacctagccttgatgatagacattctggaggaattctcagtcttgagcactgctctgcagtcgaggtcaaccaacataaagaaggcccaaaagctgattaagcggaccatccgggccttggaaaacctcaagattggcactgggaagtacgagtcccagatcgaggatctgatcaagagtgataagtttaaggacatccccttcaacaaaaacaataagttcaacgcactgccacggagcatcttgcttgataatatcatccagcacatgaatctgagacttctgtctgacagaaatcacgaggatatatttaattacttcgacttgttggaaccgtccacctggccatatgaggagatcacgtctccgtggatcgccggcgaaaagacgttatttcatctgtgtaaaatcctgaagtatgaggttgatctgaacgacttcagggagtttgtgaacaataatatcaaatctaacaatgtgagcatccctacgacaatttacaaggctaaaaagattgtatcgactattgctattaacagcgctgaagcagagcgcgggttcaacctgatgaatataatatgtacgagggtgcggaacagcttaaccattgatcatgtctctgacctgatgactataaacctgttgggcaaggagttagccgactgggacgccacgcctttcgtgaagagttggtccaactgtaaccaccgactcgccacggatactcgtgttcgacagaagtccacgaaggtgttccacgagaaccagctggccatatggaacctgaaatag

SEQ ID NO: 50176 - DNA, 1230 bp, Artificial Sequence
  Description of Artificial Sequence: Synthetic coding sequence
atgaccctgagccggggcaaggtggacttcgccaccatccagtgcgggcaatgcctgatggagaccatccagttgtccaatcatcttcaggttccatgcgaatggtttgtgcagtctcagaaacccgttgataagttggagaaacatatgccaaagtacctcagacagaaattgagagcagagttgaaacccaaaacgcgcatcttcgaaatccaacctattagcggagttctcgatcctggcgagaaatctaatgtgcaggttaaatttatgccaaaggaggagaagttttattcacaaactctcgtgttccagattgctcaaagcgcccagaagctgacccttctggcaagaggccagggactggaacccaggctggagttctcaccatctgtcctggacctgggacctcttttgctgtgcgccccaggagacgaggcagaggtgattgtcaaaaatccatgcaactttccgatagagttctatagtctggagttcgatcagcagtatctgatcgaggagaaaatcctcaggaaattgaagggttacgactcttataacacactactcctgcccccaagaaaccctggcgaaaagctcccaccagaactttacgagtactttaaagagattaagaagagcaaggaggagcagatgcgggctaagtatctagagaatctcgcccaagaaaacgaggaggaagacatcactagtagcgaccaaggaacatccaatagcactaagcgaacaagtctcagtcgcgggatcagcgtaacttctaatctggaggaatggcacgcgctcttggtggaaagcaagacttacctggaggaggaagaggacgaggagtccctcgaaaagatcatattccagactgacaaacttcaaagcattgatagccactccatggaagaagttggcgaggtggagaacaacccagtgtccaaggccatcgcgaggcatttgggcatcgatatttccgcggagggcagactagctaaaaatagaaagggaatcgctatcattattcacggcacgccactcagtgggaagtccgccaacgccgtgtccgtggccaagtactacaatgccgcctgtctcagcatcgactctatcgtgctcgaagcagtggcgaacagcaataacatccctggaatccgggcctgtgagctgtgtattcgggccgccatagagcagtctatgaaggaaggcgaggaggcggcagagtag

SEQ ID NO: 50177 - DNA, 375 bp, Artificial Sequence
  Description of Artificial Sequence: Synthetic coding sequence
atggccgtgtacacccacaccggctacaacgaccactacatgtaccttaaccatggtcagcaaaccataccgaacggtctggggatgggcggacagcacaattattttggcttatgggttgatgtcgatttcgggaaaggacattcacgcgccaaacccacttgcaccacatataacagcccacaactgtccgctcaggagaactttcaatttgacaagatggaagtctgggccgtgggcgaccctagcgaggagcagctggccaagggcaacaaatccattttagatgctgatcctgaggcgcaggccttactggagatctccgggcattctagacatagtgagggactgcgagaagtccctgacgatgagtag

SEQ ID NO: 50178 - DNA, 2607 bp, Artificial Sequence
  Description of Artificial Sequence: Synthetic coding sequence
atgggcatcaccgagagcagcgacacccccagcagcctgagccccctgaatttgcctggagctggctccgagatggaggaaaaggtggctccagtgaagcccagtcgccctaaaagacacttcagctccgccggcacgattgaatccgtgaacctggacgctatcccgctggctatcgcaaggctggataacagcgcagccaaacacaaactggccgttaaaccaaagaagcagcgggtaagcaaaaagcatcggcggctagcccaggatccccagcatgagcagggcggcttggagtcaagaccctgtctggaccaaaatggccatcctggcgaggacaaacccacttggcacgaagaagagcctaaccccctcgactcagaagaagaaagacgccgacaggaagattattggagagagctggaggccaaatgtaagcggcaaaaagccgaagcagcagagaagagaagactcgaagagcagagattgcaagccttagaaaggagactgtgggaagaaaatcgacgccaggaattattggaagaggaaggcgaagggcaagagccccccctggaagcagaacgtgctccacgggaagagcagcaacgctcactggaagctccaggttgggaggatgctgagcgcagggaaagggaagagcgagagcggctggaagctgaggaggagaggcgaaggctccaggcacaggcacaggccgaggagaggaggcgccttgaagaagacgctagactggaagagcggcggagacaggaggaggaagaaggccggtgtgccgaggaactaaaacgccaggaagaggaagaagcagagggatgggaagaactggagcagcaggaagccgaggttcaggggccgcctgaggctcttgaggaaactggtgaggggcgacgcggagcggaggaggaggacctaggtgaggaggaagaggaaggacaggcccatctagaggactggcgcggtcagctgtccgaacttttgaatgacttcgaggagcggctggaagatcaggagagactcaagcccgagggacagcgcgaacattcagaagagccagggatatgcgaggaacaaaatccagaggcagagagacgaagagagcaacagggacggtcgggtgattttcagggggcagatagacctgggccggaagagaaaagggaggaaggcgacaccgagcctctgctgaagcaagaaggcccggtcgaagcagcacagcccccagtggaacgcaaagaggcggccgcactcgaacagggaagaaaggtggaggaactccggtggcaggaggttgatgaaagacagacaatgccacgcccatatacatttcaagtatcctccggcgggaagcagatcctatttcctaaagtgaacctctctccagtgacacctgctaaggatactggactgacagccgcacctcaggaacctaaggcccccaaggcgagcccagttcagcacgctctaccttcttctctgagcgtcccacacactgcgattcttgtcacgggcgctcagctgtgtggccctgctgtcaatcttagtcagataaaggatacggcatgtaaatcccttcttggtctggaagagaagaagcacgccgaggctcccgccggcgagaatcctcccaggggccccggcgacgccagagctggatctgggaaggccaagccacggcaggaaagccccagctcggcttcagcactcgctgaatgggcttctatccggtcgaggatcttaaagaatgcagagagcgacccccgcagctctgagagagatcagttaaggccaggcgatgaaagtactcctagaggacgttgtgatagtcgaggcaatcagcgcaagacaccccctgtcaacgctaagtttagcatcatgcccgcttggcagaagtttagcgatggaggcaccgaaaccagcaaacaatctaccgaagccgaaagcattaggaaaagacccatgctcggaccttcagaagagactgcaccccagccacctccagccggagtccgcgaactggggaagggaccggagaagagcgagatgcaccgggagccagctgacactactgaaggttgcaaattcgctaaagaccttcctagctttctggttccctccctaccatacccaccccaaaaggtggtggcccatacagaattcacaacttccagcgactcagagaccgccaacggcatcgccaagcctgatcccgttatgccaggaggcgaggaaaaggccagtccctttggtatcaaactccggcgtacaaactacagccttagatttaattgcgatcagcaggcggagcagaaaaaaaaaaaacggcatagtagcacaggggactccgctgatgcaggacccccagcggccggttccgccagaggggagaaggagatggaaggagtggctttaaagcacggaccttctctgccacaagaacggaaacaagcaccatctactcgccgggacagcgccgagccctcaagctcgcgctcagtgccagtggcccaccccgggccgccgcccgcctcatctcaaactccaggacctcccgtgcgtccccaccagcacccacacttcccaaattag

SEQ ID NO: 50179 - DNA, 309 bp, Artificial Sequence
  Description of Artificial Sequence: Synthetic coding sequence
gtgctgctgtgctgccccggctggagcgccgtggtgcggagctggctcacagcaacatcagcctcttggcagcttgctggcattaccgggatgtgccaccacgcccagcttatcttcgtgttctttatcgagaccgagtttcaccacgtgggtcaggcaggacctgagctgctgacctccggtgatccatctgcctccgcttctcagtccgccggtattacaggggctagccacccacgccgagccaacttctgcattttcggaagagacggcgtgagtccctgttggcccggttggagttccacttag

SEQ ID NO: 50180 - DNA, 396 bp, Artificial Sequence
  Description of Artificial Sequence: Synthetic coding sequence
agcgcctgcatgtgcgtgtgcgtgtgcgtgtgcatgtacatctacatctacatatacattttctttttcttctttttttttttctttctgaacattttcaaacaggctcccccccgtcagaatcaggtgcggagacccggagccgtcgcgcatacatgcaatccttccacagtaggcggccatggcggacaaatcacaaggggccaagagttcgagacgtctttggcaaacatgggcgagactccctctcttttaaagatccagacttggccaggagtagtggcacacgcctgcaatcccagttactcaggcggacgcctgagacaagagaattgtctcaatctgggcggtggggggtgtggcgagattgctttgcagccaggtcagcaggaatag

SEQ ID NO: 50181 - DNA, 309 bp, Artificial Sequence
  Description of Artificial Sequence: Synthetic coding sequence
gaggtgggccggtggctggagcccggcaagcagcggctgcagtgcgcagaaatggcaccactccactctagtctgggcgataaagcacgtccatgtctcacgaagaaaaagaagatgttggatatgaatccaacacttgtatgttatcggcaaggactcgcactgctacccaggctcggatgttccggtgcaatcctggctcactgtaatctgcggcttctcggatcaagtgatagccccgcgtctgcctcccgagtggctggtatcaccggagcacgccatcacgcgcagcttattttcgtgttctag

SEQ ID NO: 50182 - DNA, 288 bp, Artificial Sequence
  Description of Artificial Sequence: Synthetic coding sequence
ttcttcttcttcctgcggtggagcctggccctgctgccccgggtggagtgttctggcatgattagtgcccactacaacctgcatcttcccgggtccagcgattctccggccagtgcctctagggtcgccggtaccacaggcgtccatcaccatgcttggctgatcttctgtatcttctcccgcgacggagtgctgctctgttgccctggttggtccccaacacccggcctaaagcggtcctcctgtctgggctttcgcaagtgctgggactaccgtcatgagccatag

SEQ ID NO: 50183 - DNA, 345 bp, Artificial Sequence
  Description of Artificial Sequence: Synthetic coding sequence
tggtgcacccccctgatccccgccaccgaggtggagaccggccggtgggtcgaaccccgctcctcacgtctcggattctttctggtggaattgttgagcttcgatctggggaacagagccaggctgcacttgaaaaaaaagaaaaagaagaaatcccttgggaaaatctatttctttctgcggtggagtcttgcactgttgccgcggcttggctgctccggcgcgataagcgcccactgtaaacttcacctgctgggaagccaccactcccccgcaagcgcctcgcgggttgccggcattaccggcgcaagacatcatacaagactgatatttttttttttgtag

SEQ ID NO: 50184 - DNA, 396 bp, Artificial Sequence
  Description of Artificial Sequence: Synthetic coding sequence
agcgcctgcatgtgcgtgtgcgtgtgcgtgtgcatctacatctacatatatatctacatattctttttttttttctttgagttcctaaccaaactcatcaagcagctggtcatgattaagaaccaggtgcgtcgcccgggcgccgttgcacacacgtgcaacgcaagcaccgtaggggggcacggcgggcagattactagggggcaagagtttgagacctctttggccaacatgggggagaccccgtcactcctgaaaatccaaacatggccaggcgtagtggcgcacgcctgcaatcctagctactccgggggcagattgcggcaagagaactgtttaaacttgggaggcgggggatgcggggaaattgctttacagccgggtcagcaagagtag

SEQ ID NO: 50185 - DNA, 384 bp, Artificial Sequence
  Description of Artificial Sequence: Synthetic coding sequence
atcctggcccactgcaacctgcacctgcccaacagcagcgacagcccggcctcagcctcacaggttgcggggatcaccggtacctgctatcacacccagctcattttcgtctttctagtggaaactgggttccatcacgtgggccaggacggccttgaactgctgaccagcggtgatctgcctgcttccgctagccaatccgcgggtatcactggcgtgactcattgtgcacaaccttcttctctccttacctctgagggccggaaagaaacagtttctacctttttcttcttcttcctgcatgaaacagtgtctcactccgttgcccaggcccgagtgcagtggcacaacctctcctctctgcaaccccccccttcccggtag

SEQ ID NO: 50186 - DNA, 288 bp, Artificial Sequence
  Description of Artificial Sequence: Synthetic coding sequence
ttcttcttcttcctgcggtggagcctggccctgctgccccgggtggagtgctccgggatgatctcggcgcactacaacttgcacctccctggctccagtgactcccctgcttcggcgagcagggtcgccggaaccacaggcgtgcatcatcacgcttggctcatcttctgtatcttctcccgagacggggtgctgctttgttgtcctggctggtcccctacccctggcttgaaacgatcgagttgtctgggatttcgcaaatgctgggattaccgacacgagccatag

SEQ ID NO: 50187 - DNA, 96 bp, Artificial Sequence
  Description of Artificial Sequence: Synthetic coding sequence
gccaagccccggctgcaccagcccggccagagcggcgagacccccagcctcttaaagatccaaaagctagctaggagaggcggcgttcacctgtag

SEQ ID NO: 50188 - DNA, 264 bp, Artificial Sequence
  Description of Artificial Sequence: Synthetic coding sequence
agcgtggcccaggccggcgtgcagtggcacaacctgggcagcctgcagccacctcctccgagatttaaccggttctcttgcttgtctattccatcgagttgggactatagacatagtcctcctctgttagcagatttctgcatttacctggtcgaaacaggcttccatcacgtgggccaagccgggctggaactactgacaagctcagacctgcccacgtcagcctcccagagtgcacgtattaccggcgtgagccaccggtag

SEQ ID NO: 50189 - DNA, 195 bp, Artificial Sequence
  Description of Artificial Sequence: Synthetic coding sequence
ccccggcggtggagcctgcaggtgtaccccaccgcccccaagcggcaaagaccttcaagaatgggccacgatgataatggtagcttcgtcgagaagaagcgaggaaaatgcggcgaaaagaaggagagaagtgactgttattatgtttgtgtggaaaggagcaggcaccgccggctccactttgtactgtattag

SEQ ID NO: 50190 - DNA, 456 bp, Artificial Sequence
  Description of Artificial Sequence: Synthetic coding sequence
cggttctacatcggctgcgacctgtgcaccaactgctactacggcgaatgcgttgggatcgccgagaaagaggccaaaaagatggacgtctacatctgtaatgattgcaaatgggctcaggaaggtagttctgaagaactgtactgtatctgtcgcacaccagctggctcctgtcgattctttataggccatgacaggtgtcagaattggtatcacggctgctgcattggtatcctacaaagcgaggctgagttgatagacgaatacgtttgtccacagtgtcaatcaacagaggatgcgatggcagtcctgacgcccctgaccgagaaagacgatgaggaactcaaaagagttctgtgtagtctccagactcataaaatggctcaacctttcctggaacctgtggatcctaacgacgccccagattactacggcgtgatcaaggagcccatgtag

SEQ ID NO: 50191 - DNA, 411 bp, Artificial Sequence
  Description of Artificial Sequence: Synthetic coding sequence
ggcaccatcagcgcccactgcaacctgtgcctgctggacagcagcgactctcccgcaagcgcctcccgggtggctggcatcataggcgctcatcaccatgcccaacttatattcgtgttcctggtggagatgggcttccaccatgtgggccaggccggtttgaaacttcttacaagcgacccaccagcttctgcctctcagagtgcaggaatcactggagtgtcgcatcacaattggctccacggcggacctgaccgcgtaaagaggccacctgtttttttcttctggtttttcttcttcgaaatggagagctattcagttgctcaagccggggtccaatggagggatttatcgagcctccaaccgcccccccctagacatacaatcttgcttccccagcctcctgagtag

SEQ ID NO: 50192 - DNA, 279 bp, Artificial Sequence
  Description of Artificial Sequence: Synthetic coding sequence
ctgacccccgacggcttcttcttccgggtgcacatgctggtgctggacagtagcagctgtaataagccgtgccctgagttcaagcccgggtctagatacattgtgatgggccatatataccacaaaagaggtcagctgccaacagccttgctgcaggttctcaggggccacctgtgtcccggcgatggtctgctgaggtctagttcatcttatgtcaagcgctttaatcctaagcgcgaaggacagatccagggcgccatccatacccagtgcatttag

SEQ ID NO: 50193 - DNA, 378 bp, Artificial Sequence
  Description of Artificial Sequence: Synthetic coding sequence
agcttcttcttcttcctgcggcagagcctgagcctgagcgcccggctggagtgctccggcactatctcagcccattgcaagctgcgcctgttggggtcgcatcacagcccagcttcggtctcccggatcacccgcagcggcgtccaagaccagcgcggtcaacatagtgagacactatccctgctgaaaatccagaagctggccggccatgggggccgacatctgcagagccagctgctcggtcgtgttcgacaggagaatagactgaatccggggggtaaaggatgttctgagccccggccatgccattgcacatccgcctggacaacgtcgcgcaaaattaaaaaaaagaagagaaagagaaaaaagaaaaaatag

SEQ ID NO: 50194 - DNA, 399 bp, Artificial Sequence
  Description of Artificial Sequence: Synthetic coding sequence
tgcatgtgcgtgtgcgtgtgcgtgtgcatctacatctacatctacatttacatcagccaacccatttatatttttctcttacttctgctactcctctttcttcgacaaagccttatgattaagaatcaagtaagaagaccaggagccgtggctcacacttgtaacccctccactgtcggtggccatggggggcagattacccggggtcaggaattcgaaacatcactcgctaacatgggcgagacaccaagccttttaaagattcagacttggccaggagtggttgcgcacgcctgtaatccatcctacagcgggggtagacttcggcaagaaaactgtttaaacctcggcgggggcggctgtggagagattgcactccaaccagggcagcaagaatag

SEQ ID NO: 50195 - DNA, 111 bp, Artificial Sequence
  Description of Artificial Sequence: Synthetic coding sequence
ggccgggacgactggcaggccgccccccccgccgcccccgtgcgggatcctctgggagaagctagttgggcccctgagtgcggtggggatctggaaaatctgtatgtgtag

SEQ ID NO: 50196 - DNA, 321 bp, Artificial Sequence
  Description of Artificial Sequence: Synthetic coding sequence
ttcttcctgagcttcctgcacagcttcttcctgcggcagagcttcgctctggtggctcaagctggggtccaatggcacaaccttggaagcctgcagccccccccccccggattcaaacagttctcctgcctcagtcttctctcctcttgggattacagacatgtacctccgtgtcctgccaatttcgtgtttctcgtggagatggggttcctacacgttgggcaggctggcctggaacttcgcacttccggggatcctcccacactcgctagccagtctgcagggattacaggagtctcacacagggctcagccatcctag

SEQ ID NO: 50197 - DNA, 276 bp, Artificial Sequence
  Description of Artificial Sequence: Synthetic coding sequence
ttcttcctgcggtggagcctgaccctgagcagccggctggagtgctcaggggctacatccgcacactgcaatgtgcgtctgccaggttctagacactcccccacttctgctagccgggtcgccggcacgaccggcgccagacacctgtctagacttatctttatattttcgagagatggcgtgtcaccttggtctcggtctcctgacttggcaataaggccacccaggcctcccaaaaagttggggctgcaagcacccgcgactatgcctggctag

SEQ ID NO: 50198 - DNA, 381 bp, Artificial Sequence
  Description of Artificial Sequence: Synthetic coding sequence
cggcaccaggcccagctgatcttcctgtacgacctgttcctgtacgtgtattttctgaaggatcgtgtgctcttatgtcaccctggttggtctgctatgacaaggagcaggttgaccgccaccagcgcctcccaggtcgccggaactataggtatgtgtcaccatgctaggctgatcttctttttcttcttcgtctttctggtggagacaggattccattgcgtgagccagcatggcctcgaactactgaccctggaccctcctgctagcgcaagccagtccgccagaattatcggcttgaaccactgcactcagccaaccttttgtatcttctctcgggacggagacagcccatgctggcctgattggtcccgtacttag

SEQ ID NO: 50199 - DNA, 327 bp, Artificial Sequence
  Description of Artificial Sequence: Synthetic coding sequence
cagatcaagagcaagttcttcttcttcctgcggcggagcctggccctgtctccacgacttgaatgttctggaggcatctcggcccattgtaaactgcgtcttccaggaagccgtcactccccagcaagcgccagccaggtggccgggaccaccggagctcggcactacgcgcggctgatcttcctgttcctgatcgaaaccggcttccattacgttggccaggctggactggagctgcttacctccggcgacttgccaacctctgcgtcccagtctgcagggattacgggtgtgtctcactgcactcagcctgaagacattttttag

SEQ ID NO: 50200 - DNA, 369 bp, Artificial Sequence
  Description of Artificial Sequence: Synthetic coding sequence
tgggactacagcttcttcttcttcctgcggcagagccacagcgtgccccaggcaggggtacaatggtgtaacttatcatctttgcagccaccaccctcccgctttaagagattctcttgcctatctcttctgtcttcatgggactacagacatacgccaccctgtcccgccaacttttgcattttcagaacctttttcttcttcctgcgctggtccttcgcattaagcccacgcttggaatgcagtggggctatcctggtacactgtaatctctgcctgcctggctcttcagactcttgtctgagcctcccgatttcttgggactatcgctgcgccccgccttgtctggccaatttttgcatcttttag

SEQ ID NO: 50201 - DNA, 372 bp, Artificial Sequence
  Description of Artificial Sequence: Synthetic coding sequence
tgggactacagcttcttcttcttcctgcggcagagccacagcgtgccacaggccggcgtgcaatggtgtaatttgtcctcgctccagccacccccatctcggtttaagagattcagttgcttgtccctgctgtccagctgggattataggcacactcctccatgtcccgctaattttctgtatacattcgagctttttttcttcttcctgcgttggtcctttgccttaagtccaaggctggaatgttccggagccattctggtgcattgcaatctgtgcctacctggctcttcagattcatgtctgtccctgccaatctcatgggattacaggtgtgctcctccatgtctcgctaatttttgcattttctag

SEQ ID NO: 50202 - DNA, 372 bp, Artificial Sequence
  Description of Artificial Sequence: Synthetic coding sequence
tgggactacagcttcttcttcttcctgcggcagagccacagcgtgccacaggctggagtgcaatggtgcaatctgtcatctttacagccaccgccctcccgctttaagcgcttcagctgcctcagcctgcttagtagttgggactatcgccacacccccccatgtccagccaacttcttgtatactttcgagttgtttttcttctttctccggtggtcgttcgcccttagcccgagactcgaatgctcaggcgccatcttggtgcattgtaacctgtgtttgcctggatcttctgacagctgcctgtctctacccatttcatgggattaccgatgtgctcccccctgcctggcaaatttttgtattttctag

SEQ ID NO: 50203 - DNA, 81 bp, Artificial Sequence
  Description of Artificial Sequence: Synthetic coding sequence
ttcctgatggacaagagcagcctgaccggcgccctgtgcagcatcaccctggccagcccctgtggaaccccaggaatctag

SEQ ID NO: 50204 - DNA, 318 bp, Artificial Sequence
  Description of Artificial Sequence: Synthetic coding sequence
gagaccggccggtgggtggagccccggagcagccggctgggcttcttccttgtggagctgctttcctttgatctcggaaaccgggctagactgcatctgaagaagaaaaaaaagaaaaaaatacccggcaagcattgtgtctgtttcatgagatggtctctcgccctgctgcctcggctgggctgtagtggcgccatcagcgctcattgtaaacttcatttgctaggctcccaccattcacctgctagtgcgtcaagagtggcaggcataactggcgcgcggcaccatacacggctgatcttcttctttttcgtgtag

SEQ ID NO: 50205 - DNA, 228 bp, Artificial Sequence
  Description of Artificial Sequence: Synthetic coding sequence
tgcttcagccacagcttcttcttcttcttcttcttcctgcggtggtccctggctctctcgcctcggctggagtgttctggagcaatctccgcccactgcaagttacgcctgctggggtctagacactccccagcctctgcctccagggttgctggtactaccggcgcctgtcaccatgcccggctcttcttctgtatatttagtcgcgatggcgtaagtccatgttag

SEQ ID NO: 50206 - DNA, 324 bp, Artificial Sequence
  Description of Artificial Sequence: Synthetic coding sequence
gtgctgaacggcgcccaggccggcgtgcagtggcgggacctgggcagtctccagccccctcccccttcacacttgcccaggccttcgaaggtgccccgggtacagcccttgcccgggcgccaccctgtctgggaggtgaggggagtctctgcgtggcctccaatcgtctgggacgtgagatcccctagtgcctggctgccttccctggaaagcgaggaaagactgtgccccgctgctatcccctcccgcaagtggggggctcctgtgccgaggcgccctatttgggacgtgagatcagtgagtgcacagccaccccgcctgtag

SEQ ID NO: 50207 - DNA, 288 bp, Artificial Sequence
  Description of Artificial Sequence: Synthetic coding sequence
ttcttcttcttcctgcggtggagcctggccctgctgccccgggtggagtgctccggaatgatttcagcccattataacctacatctgccagggtcctctgattcacctgcctcagcctctcgagtagccggaaccaccggggtgcaccatcacgcttggctgatcttttgtatattttcccgggacggtgtccttctgtgttgcccagggtggtctccaacaccgggtctgaagaggtcaagttgtctcggatttcgcaagtgctgggattatcgacacgagccttag

SEQ ID NO: 50208 - DNA, 399 bp, Artificial Sequence
  Description of Artificial Sequence: Synthetic coding sequence
tgcatgtgcgtgtgcgtgtgcgtgtgcatgtacatctacatctacatttacatctcccagcctatttacattttcctgctccttctgctactcttgtttctccgtcaaagtctcatgattaaaaatcaggtgcgacgcccaggcgcagttgcccatacctgtaatccatcaaccgtgggcggacatggcggccaaattactagagggcaggaatttgagacatccctagcgaacatgggggagaccccctcccttcttaagattcagacttggccgggggtggtggctcacgcctgtaacccctcttattccggcggccgacttaggcaagagaactgcttgaacctgggtggcgggggctgcggcgagattgctctacaacccggccagcaggagtag

SEQ ID NO: 50209 - DNA, 282 bp, Artificial Sequence
  Description of Artificial Sequence: Synthetic coding sequence
agcgtggcccaggccggcgtgcagtggcacaacctgggcagcctgcagccaccacctccccgtttcaaccgcttcagctgcttgtcaattccaagtagctgggattaccgacactctccccctagactggcggactttctgttccttgttgaaaccgaattttgccatgttgggcaggccgcgttagagctactgacaagcggcgaccttcctacatcagctagtcagagcgcaaggatcacaggcgttagccatcggacaagaccgagcctcttttactag

SEQ ID NO: 50210 - DNA, 423 bp, Artificial Sequence
  Description of Artificial Sequence: Synthetic coding sequence
ggcaccatcagcgcccactgcaacctgtgcctgctggacagcagcgactctccagctagtgcctctagagtggccggtattatcggggcccatcaccacgcccagctgatcttcgtgttcctcgtcgagatgggctttcaccacgtaggtcaagctggccttaagctgcttacgtcagatccacccgtcagtgcctcacagagtgctggaatcactggagtgtcccaccaccgtgaaccgcagcatccgttcttgttatccgtcgagtcacgcgatagaccattcttctttttcggattttttttcttcgagatggaatcatactccgtggcacaggccggagtgcaatggcgagacctcagctcattgcagcccccaccaccaagggctcaggcaatccttcccccacagcctccgaagtag

SEQ ID NO: 50211 - DNA, 396 bp, Artificial Sequence
  Description of Artificial Sequence: Synthetic coding sequence
tgcaacctgtgcctgctgggcagcagcgacagccccgccagcgcctcccaaattgcggggataaccggcgcccatcaccatacttggctgtttagcgtgttcctggttgagtcaggattccaccatgttgggcaagccgggctggagctcctaacgtcaggcgatcctgcctctgcctcccatagtgctggcatcacgggggtgtcacactgcgcctggccacgcttagaggctacaagcgtcccaaatttcttctttttcttcttttttttctttttcttcctacggaggtctctggctgttgcccaagcaggagtgcagtggcggaatctgggctccctgcaggccccacctcctggcgtacacgcaatacttctccctcagccacccgagtag

SEQ ID NO: 50212 - DNA, 153 bp, Artificial Sequence
  Description of Artificial Sequence: Synthetic coding sequence
cccagcttcctgctgttcttcctgcccagcttcctgcccttcagcctgagctctctatcttttctcccctttttactgtcctttctgaccggtagccacttgttttccatcacccatactcacacacatacacacactcacacacatacctag

SEQ ID NO: 50213 - DNA, 423 bp, Artificial Sequence
  Description of Artificial Sequence: Synthetic coding sequence
ggcaccatcagcgcccactgcaacctgtgcctgctggacagcagcgattcacccgcctccgcctcaagagtggcaggcattattggtgcccatcatcatgcacaactgatatttgtgtttctcgtagaaatgggtttccatcacgttggacaggccgggctgaaactgctgactagcgatcctccagtctctgcatcgcagtctgccggaatcacaggcgtgagtcaccacagggagccccagcatccattcctgctgtcagtggaatcccgagatagacccttttttttcttcggtttctttttttttgagatggaatcatattcagtggcccaagccggggtccagtggagagatctctcttctctgcaaccgccccccccaagagctcaggcaatactcccaccacagcccccaaaatag

SEQ ID NO: 50214 - DNA, 396 bp, Artificial Sequence
  Description of Artificial Sequence: Synthetic coding sequence
tgcaacctgtgcctgctgggcagcagcgacagccccgccagcgcctcccaaatagcgggaataaccggcgcacaccaccacacgtggctgttctctgttttcctagtcgagagcgggttccaccacgtcgggcaggcaggtctggagctgctcacctccggggatcctgctagtgcctcccacagcgctgggatcaccggggtgtcccactgtgcctggccacgcctggaggcaactagcgtccccaacttcttcttcttcttttttttctttttcttttttcttaggagatctctggccgtggcacaagccggcgtgcagtggagaaatctaggcagtctgcaggctccaccacccggcgtgcatgctatcctgctgccgcaaccacccgaatag

SEQ ID NO: 50215 - DNA, 279 bp, Artificial Sequence
  Description of Artificial Sequence: Synthetic coding sequence
ttcttcttcttcttcttcgagaccgactgccggagcgtgacccggctcgaatgctccggaattattagtgcccattgtaaattgtgtctgcctggaagcagcgactcccccgcaagcgcctcacaagcagccaggacaatcggcacctgtcaccatactcagctgattttcgtcttcttcgtggaaactgggtttcatcatgtcggccaggacggactgaacctatcactggttatccatcctccgcgcccacctaaggtgcttggcctgcaggtttag

SEQ ID NO: 50216 - DNA, 228 bp, Artificial Sequence
  Description of Artificial Sequence: Synthetic coding sequence
tgcttcagccacagcttcttcttcttcttcttcttcctgcggtggagtctggcactgagccccagactagaatgcagcggggcgatcagtgcgcattgcaagctccgattgctgggtagccggcactcccctgccagcgcaagcagagtcgccgggacaaccggcgcttgtcaccacgcgcggctgttcttttgtatcttcagccgtgatggggtctcaccatgctag

SEQ ID NO: 50217 - DNA, 177 bp, Artificial Sequence
  Description of Artificial Sequence: Synthetic coding sequence
cccggcggcgccgccgccgccgccagcgtgatggccccccggcggagccgctgtttctgtacatcaatatgtggcggtcggggagctcggcctcagttgcctaggacctgcggagacggcacacagcactgcgggagaggcaaacccgccctcgccgctgccgaggagtggccctag

SEQ ID NO: 50218 - DNA, 372 bp, Artificial Sequence
  Description of Artificial Sequence: Synthetic coding sequence
gtgtgcgtgtgcgtgtgcgtgtgcgtgtgcgtgtgcctgttcatctactttagcgtgttttggtccttcttgtacctgttcgtgtttttgctgaaaatctatgaaaaaagaccctgcgccgtcgcccatgcctgtaatccacccggtgtggtggctcacgcctgcaatcccagcacactaggcggcagagggggacaaataagttggtcacaggaatttgaaaccagcctggcgaatatgagcaaaaccccatcgaggaagaaaagaaagggttggtcaggggtcgtggcccacgcttgtaatcacagttatagcggcttgcgccaggaaaattgtttaaaccctgttgggggcggttgtgttcagccatag

SEQ ID NO: 50219 - DNA, 288 bp, Artificial Sequence
  Description of Artificial Sequence: Synthetic coding sequence
ttcttcttcttcctgcggtggagcctggccctgctgccccgggtggagtgttccgggatgattagcgcccactataatctccatctgcctgggtccagcgattcacccgctagcgctagccgcgtggcaggaaccaccggggtgcatcaccacgcctggcttatcttttgcatcttttctcgggacggcgtgctgctgtgttgtcctggatggtctcctactcctggattaaaaagatcttcatgcttaggatttagaaagtgctgggactatcgtcatgagccctag

SEQ ID NO: 50220 - DNA, 261 bp, Artificial Sequence
  Description of Artificial Sequence: Synthetic coding sequence
ggcaccatcagcgcccactgcaacctgtgcctgctgggcagcagcgacagccccgccagcgcgagtcaggtggctgctggaataactggggcatgccacctcgcccagcttatttttatatttctcatcgaaacaggcttccaccacgcagtgcaggccggcctcaagctcctcacgcttagcgacctccctgcgtctgcatcacagagcgtgggaattaccggagcgagccacagggccgaccccaaagtatttctgtag

SEQ ID NO: 50221 - DNA, 66 bp, Artificial Sequence
  Description of Artificial Sequence: Synthetic coding sequence
aaccggaagaaggagggcaagaagaaccagagccccccccccaccgtttcccctctcgctacttag

SEQ ID NO: 50222 - DNA, 303 bp, Artificial Sequence
  Description of Artificial Sequence: Synthetic coding sequence
ttcctgcggcggagcctggccctgagcccccggcagtggcacgacttgggaagcctacaaccgccccctcctgggttcaaaccattctcgtgcctctcactcttgtcctcctgggactataggtgtgcaccaccctgtccggctaatttttgcatcttagtggagatggggtttcaccacgtgggacaagctggactggaactgctgacgtcagatctgccaactagcgcaagccaaagggccgggatcactggggttaatcaccacgcgtggccaagagacgcattctctatttcttactag

SEQ ID NO: 50223 - DNA, 282 bp, Artificial Sequence
  Description of Artificial Sequence: Synthetic coding sequence
agcgtggcccaggccggcgtgcagtggcacaacctgggcagcctgcagccacccccgcccagatttaaccgcttctcttgcttgtccattccgagcagttgggactaccggcacagccccccccttctcgcagattttctgttcctcgtggagactgaattctgtcacgtcgggcaagctgctctcgagctcctgaccagcggggatcttccgaccagcgcttcccagtctgctaggatcactggagttagccatagaacccgacctagcttgttttactag

SEQ ID NO: 50224 - DNA, 111 bp, Artificial Sequence
  Description of Artificial Sequence: Synthetic coding sequence
aagcggaagaagaaggagcggaagaaggagcggaagaagaaggagcgtaaaaaagagaggaaaaaggaaagaaagaaagagaaggaacgcaagaaagagaaagagagatag

SEQ ID NO: 50225 - DNA, 234 bp, Artificial Sequence
  Description of Artificial Sequence: Synthetic coding sequence
atcaactgctacagcttctacagcctgttcctgttcgtgtgcatcaccgacggtgtgtccctgagtccacgaccagaatgctcaggagcaatttctgcacactgtcgcttgagacctagaggctcgaggcatagccccgctagcgcatcacgggtggcagggactaccggtgcacgccatttagctcagcttattttctgtattttcagccgtgacggcgtttcattatgttag

SEQ ID NO: 50226 - DNA, 222 bp, Artificial Sequence
  Description of Artificial Sequence: Synthetic coding sequence
cggcgggagcggcccctgcccgagccccacagccagttcttcttcttctttttcttttactatactctgtcctttcgcgtacacgtgcatatagtccaagtgtcatacatctgcatccacgttccatgctggtgcgcggcaccgacaaatgtgtcttcttcaatccgttacattagtcagtgctacccatctcccctgccaagaccgcaccattctccttag

SEQ ID NO: 50227 - DNA, 123 bp, Artificial Sequence
  Description of Artificial Sequence: Synthetic coding sequence
agcccccccccccccggcggcggcgagaagcccctggccccccccccgggctgggtggagcctcccaagtggctgggactgcagggcccttctgggggtcccggggctggtcctggactttag

SEQ ID NO: 50228 - DNA, 318 bp, Artificial Sequence
  Description of Artificial Sequence: Synthetic coding sequence
tacttctacttcctgcggcagagcctgaccctgagcccccggctggagtgctccggcacaattagtgctcactgcaatctgtgcctccctggaagttctaactctccggctagtgcctctcaagtggccggtattactggtgtgtgccatcacacacaattgatctttgtgtttctggtggagatgggtttctgtcatgttggacaagccggactggaacttctcaccagcgggaatcctcctgctttagcttttcaaagcgccggaattaccggcatgtcacaccacgcatggcccggccacatgttctttaagtag

SEQ ID NO: 50229 - DNA, 216 bp, Artificial Sequence
  Description of Artificial Sequence: Synthetic coding sequence
ctgaccagcttccgggtggtgcacaccatccccatgatcaagagcttcttcaattacttgtctcccaaacaccttaaatttcaggtggactgcaacaagggggtgaccggaaccatctacgagtatggcgcgttgactctgaatggcgaagagtatatccagtttaagcagttcgctgggaagcacgttttgttcgttaacgttgctgcctattag

SEQ ID NO: 50230 - DNA, 168 bp, Artificial Sequence
  Description of Artificial Sequence: Synthetic coding sequence
gtgatcggctgggtgtggtggctgacccccgtgatccccgccctgtgggaagccgaggccggaggatccccagaaatccggtcatccaggcccgcatggcctacctggggcaatccatctttgctcaaaatccaaaagcttgctcgaaggggaggtgcccacttgtag

SEQ ID NO: 50231 - DNA, 366 bp, Artificial Sequence
  Description of Artificial Sequence: Synthetic coding sequence
ctgccccccgccgacctgttcatcttcatcttcatcgacaaggtgagcctcctgtcccccaggctagagtgtaacggcaccatttctgcccactacaagctccacctgccttttaaaagattctcctgtctcagtctcctgaagacaggttttcaccacgttggacagttgatatttgtcttcctggtggaaatggcatttcatcatgttggccaggcaggcctggaacttctgacttcaggtgatctgttcgaagtcgaattccattcatgctgtttgggctggtccgctatggcaaggtccaggctcactgccacctctgcatcccgagtgcaggccattttactgcctcagccacctgaatag

SEQ ID NO: 50232 - DNA, 420 bp, Artificial Sequence
  Description of Artificial Sequence: Synthetic coding sequence
atctgccaccacacccagctgatcttcgtgttcctgggcttctacctgtttatatatttgtttatcgacggtgtcctgctctgctgtccagggtggagtgccgtcgtccagtcttggttgaccgcaacctcggcgtctcaggtggccgggatcaccgggatgcaccaccacgcgcaactcattttcgtctttctcgtcgagatgggtttccaccatgtgggccaagctgggttagagctgctgacatctggtgacccacctgcatccgcttcccaatccaccggaataactggggtctcccattgcacaagacccaatttctgtatcttctcccgcgacggcgtgagcccttgttggcccgggtggtctcggacacccgacctggtcatttcggctcatctgggcctgcctaaatgctag

SEQ ID NO: 50233 - DNA, 228 bp, Artificial Sequence
  Description of Artificial Sequence: Synthetic coding sequence
tgcttcagccacagcttcttcttcttcttcttcttcctgcggtggtccctcgcattaagcccccgactagaatgtagcggcgcaatatcagcacattgtaagctgcgcttgcttggctccagacactctcccgccagtgcaagccgcgtggcaggcacgacaggagcttgtcaccacgcccgcttgtttttttgcattttttcccgggatggtgtctcgccctgttag

SEQ ID NO: 50234 - DNA, 303 bp, Artificial Sequence
  Description of Artificial Sequence: Synthetic coding sequence
ttcctgcggcggagcctggccctgagcccccggcagtggcacgacctgggctctctccaacctccagctccaggtttcaaaccattctcctgcctctctcttttgtcttcctgggattaccgctgcgcacccccctgcccagcaaatttctgtatcttggttgaaatggggtttcaccacgtgggccaggctggcctcgaacttctgacttccgacctaccggccagtgcttcacagcgggccggtataacaggggtgaatcaccacgcttggccgagggacgcattttcgatctcttattag

SEQ ID NO: 50235 - DNA, 1251 bp, Artificial Sequence
  Description of Artificial Sequence: Synthetic coding sequence
atgaagatgcagaagggcaacgtgctgctgatgttcggcctgctgttgcacttagaggccgccacaaactccaacgagacgagcacatcagccaacactggaagttccgtgatcagcagcggcgccagcaccgccactaactcaggatcctccgtgacctcttcaggggtgtctacagccactatctccggaagttccgtcacaagtaatggagtctccatcgtcacaaattccgagttccatactacatcctctggcatcagcacagcaacaaattccgaattttctaccgtgagcagcggaatatccatcgcaactaattccgagtcctccacaacaagcagtggagcaagtaccgcaactaacagtgagtcatctactccatctagcggggcatcaacagctacgaattctgatagttctaccaccagcagcggggcttctactgcgacaaactccgactcctctacaaccagcagtgaggccagcacagcaactaactctgaaagttcaaccacgagttccggagcaagcactgccactaattccgaaagcagcactacttcaagcggggcttcaaccgctactaactccgagtcctctactacctcatctggggccagcactgctaccaattcaggtagttctactacttcttcaggaacatcaacagcgaccaactccgagagctccactgtgagctcaggggcctctaccgccaccacaagcgagtcctctacgaccagctcaggggcatccaccgccaccaatagcgaaagttctaccgtgtcttctggtgcgtccactgcgacgaattcagaatctagcacaaccagcagtggcgcaaacacagccacgaatagtggatcttctgtaactagcgccggttccggtacagctgccttgacgggtatgcacactaccagccattctgcaagcacggcagtgtcggaggccaagccaggaggcagcttggtgccctgggagatcttcctgatcaccctggtgtctgtggtggctgcagtggggctgtttgctggcctgtttttttgtgtcaggaatagcctcagcttgagaaacaccttcaacacggccgtgtatcatcctcatgggctgaatcacggcctcgggccaggccccgggggtaaccacggggcccctcataggccacggtggagtccaaactggttctggaggcggccagtttcctctatcgctatggagatgagtggacggaattcaggtccatag

SEQ ID NO: 50236 - DNA, 372 bp, Artificial Sequence
  Description of Artificial Sequence: Synthetic coding sequence
tgggactacagcttcttcttcttcctgcggcagagccacagcgtgccacaggcaggcgttcagtggtgcaatcttagttcactgcagccacctccatcaaggttcaagaggttcagctgcctctccctcctgtctagttgggactaccgccacaccccaccatgccccgcgaatttcctgtacacctttgagctattcttcttctttctgcgatggtcttttgccttatcccctagattggagtgctccggcgctatattagtccattgcaacctatgcctccccgggtcgagtgattcttgcttgagcctgcccatcagctgggactatagatgcgcgcctccctgcctggctaatttttgcatcttttag

SEQ ID NO: 50237 - DNA, 309 bp, Artificial Sequence
  Description of Artificial Sequence: Synthetic coding sequence
gtgctgctgtgctgccccggctggagcgccgtggtgcggagctggctaacagcgacctcggctagctggcagttggccgggatcacaggagtctgccaccatgctcaactgatcttcgttttcttcatagaaaccgaattccaccacgtaggtcaggccgggccagagcttctcacctcaggagatccgtccgcgagtgcctctcagagtgctgggattactggcgcatcacatccaaggagggccaacttctgcattttcggcagggacggcgtttctccttgctggccaggctggagttccacttag

SEQ ID NO: 50238 - DNA, 381 bp, Artificial Sequence
  Description of Artificial Sequence: Synthetic coding sequence
cggcaccaggcccagctgatcttcctgtacgacctgttcctgtacgtttatttcctgaaagatagagtcctcctctgccaccctggttggagcgctatgacacgcagccgattgactgcgacctccgcaagtcaggtcgcagggaccatcggaatgtgccaccacgcccgccttatattctttttcttctttgtgttcctagttgagatggggttccactgcgtgtcccaacacgggttggaactgctaaccctggatccgcctgcgtcagcctcacaatcggctagaatcatcggcctgaaccactgtactcagccaaccttctgcattttttcgcgcgatggagattccccttgttggcctgattggagccgcacctag

SEQ ID NO: 50239 - DNA, 153 bp, Artificial Sequence
  Description of Artificial Sequence: Synthetic coding sequence
cccagcttcctgctgttcttcctgcccagcttcctgcccttcagcctcagctccctcagttttcttcccttcctgctgagcttccttaccgggtcattcggtcaggataaagtcttctccatcacccacacacatactcatacccacacatag

SEQ ID NO: 50240 - DNA, 372 bp, Artificial Sequence
  Description of Artificial Sequence: Synthetic coding sequence
tgcgtgtgcgtgtgcgtgtgcgtgtgcgtgtgcctgttcatctacttctcagtgttttggagttttttgtacctgttcgtgttcctgctgaagatttatgaaaagcggccgtgcgcagtggcacacgcatgcaacccgccgggcgtggtcgctcacgcctgtaatcccagcactttaggcggtaggggcggccaaatctcctggtcacaggagtttgaaacctcccttgccaatatgagtaagactccttcccgaaagaagagaaaagggtggagtggggtggtcgctcacgcctgcaatcactcatacagcggattgcgccaggagaactgcttgaatcccgtcggtggcggttgcgtgcagcctcgttag

SEQ ID NO: 50241 - DNA, 279 bp, Artificial Sequence
  Description of Artificial Sequence: Synthetic coding sequence
ttcttcttcttcttcttcgagaccgactgccggagcgtgacccggctggagtgctctgggatcataagtgcccactgcaaactctgccttcctggctctagcgactcccccgcatccgcaagtcaagctgccagaaccatcgggacctgtcatcacacgcagctgatatttgtcttctttgtggagactggctttcaccacgttggccaggacggcctgaatctctctttggtgattcaccctccaagaccaccaaaggtgctagggctgcaggtctag

SEQ ID NO: 50242 - DNA, 384 bp, Artificial Sequence
  Description of Artificial Sequence: Synthetic coding sequence
atcttcttcttcctgcggcagggcctgctgctgagcccccggctgctcgaatgcaacggaacaatatcaacacattgtaatctgcatatcccaggatcaagtgatagtcctgcttccgccagtcaggtcgccggcatttaccggagcagagaccaacctgaccaacatggcgagactccatccctgctcaagatccagaagctcgtaggtcgaggcggatttcatttcttttcccagctgctgggacgccccagacaggaaaacggggtgaaccccggaggcagagcgtgtagcgaactcaggctgagacattgtacgccagcatgggccacggaggcaagactgtgcctgaagaaaaaaaaaaagaaaaaaaagaaaaagtag

SEQ ID NO: 50243 - DNA, 312 bp, Artificial Sequence
  Description of Artificial Sequence: Synthetic coding sequence
ttcttcttcttcctgcggcggagcctggccctgagcccccggctggaatgcagtggtggcatctctgcgcactgtaagttgagactcttgggctcacggcactcacccgcctctgcttctcaggttgcaggtacaacaggtgctagacattatgcccgacttatcttcctgttcctgatcgagacaggcttccattacgtaggccaggctggccttgagttgctgacctccggggaccttccaacgagcgcctcacaatccgccgggatcactggcgtgtcccactgcacgcaaccagaagacatattctag

SEQ ID NO: 50244 - DNA, 243 bp, Artificial Sequence
  Description of Artificial Sequence: Synthetic coding sequence
gcccaccacctgcggagcggcgccggcgaccagcccggccagcacggagagactcctagccttttgaagatcgagaagctggcagagcacggcggatcctgttttagcttccaagtgcttggaaggttgcgccaggaaaattgcctgaacccagggggcggtggctgctctgaacctcgactttgtcattgcaccccagcctgggctactgaacaggggagtgtgtccaggaagaaagaatag

SEQ ID NO: 50245 - DNA, 420 bp, Artificial Sequence
  Description of Artificial Sequence: Synthetic coding sequence
atctgccaccacacccagctgatcttcgtgttcctgggcttctacttgtttatttacttgttcatcgacggagtgcttctgtgctgtccagggtggtctgcggtcgtgcaatcttggcttacagcgacctcagcttcccaggtggcaggaatcactggtatgcaccaccacgcccagttgatattcgtgtttcttgttgaaatgggcttccatcatgttgggcaggccggactagaacttttaacctctggggatccccctgcatccgccagccaatcgactggcatcaccggagtgagccattgtacgcgtccgaacttctgcatcttcagtagagatggtgtgagtccatgctggccagggtggagtagaacaccagaccttgtgatcagtgcccatctcggcctgcccaaatgctag

SEQ ID NO: 50246 - DNA, 318 bp, Artificial Sequence
  Description of Artificial Sequence: Synthetic coding sequence
tacttctacttcctgcggcagagcctgaccctgagcccccggctggaatgttccgggatgatttcggcccactgcaacctgtgcctgccaggatcaagtaactcaccagcctctgccagccaggtggcgggtatcactggtgtgtgtcatcacacccagctcatatttgtgttcctcgtggaaatggggttctgccatgtcgggcaggcgtctctggagctcctgacttccggaaatccccccgcactggcttttcagtccgccgggattacgggcatgtctcaccatgcatggcccggtcacatgttcttcaagtag

SEQ ID NO: 50247 - DNA, 462 bp, Artificial Sequence
  Description of Artificial Sequence: Synthetic coding sequence
gtgcggggcgccagcgcccggccccccctgctgggcagcgaggagcctctcagcccagcctccagaccagttcgcgagggaggcggcggtgtctcacctcctccaggtcagcccccatgtcctgggggacggtggggcgggcagccatctgcaaggccagctgcacctagcgggcgggaggtgggcgtctccgcgccccggcccgcctcgcggcccgtaagggaagtgcgcggggcaagtgcccgcccacctctgctcggttcagaagagcctctgtgtcctgctagtcgcccagtgcgcgagggcggtggcggagtctcgccccctcccggccagcctcccagacccgggggccgcggtgcatcagccaggccccccctcctgggatctgaggagccactttgtgccgccaccacaccaagtggaagatgcgcacagcagcttatcgagaacggcccatag

SEQ ID NO: 50248 - DNA, 348 bp, Artificial Sequence
  Description of Artificial Sequence: Synthetic coding sequence
atgaacgtgtgctgcagcagccaccccgtgaacgagaaggtgtggaaacccagttcccgcaaatggagtagcaaggtctggagcatggacgagttcgacttacagaccgcatgttactggtttatgacaagatgtcaaaaagaggctggtaagttcggcactcatcgcgggaagccgatgtgctttgtccgttccctgcttagagtgcagctcctcccccgtacgtttcccgcaaactcctttgtaatcagttttttccctagtttaatatatccgctgcaggtctaccaactacacttcgagagttcagacaaacaacgtgctatgcagtttgtgacagaaggatag

SEQ ID NO: 50249 - DNA, 318 bp, Artificial Sequence
  Description of Artificial Sequence: Synthetic coding sequence
tacttctacttcctgcggcagagcctgaccctgagcccccggctggaatgctctggaactatcagtgcccattgtaatctgtgcctcccgggaagctcaaattccccggcctctgcatcacaggtggccggcattacaggggtttgccaccacacccagctaatctttgtgttcttggtggaaatgggcttttgtcatgtcggacaagccggtttggagctgctgacttccggcaaccctcctgccctggcctttcagtcggcaggaatcacaggcatgtctcatcacgcctggcccgggcacatgttctttaaatag

SEQ ID NO: 50250 - DNA, 111 bp, Artificial Sequence
  Description of Artificial Sequence: Synthetic coding sequence
aagcggaagaagaaggagcggaagaaggagcggaagaagaaggagcgaaagaaggaacgaaagaaggagagaaagaaagaaaaagagagaaagaaggagaaggagaggtag

SEQ ID NO: 50251 - DNA, 420 bp, Artificial Sequence
  Description of Artificial Sequence: Synthetic coding sequence
atctgccaccacacccagctgatcttcgtgttcctgggcttctacctgtttatttacctcttcattgatggcgtgcttttgtgttgtcccgggtggtccgcagttgtccaaagctggttgactgccacttcggcttctcaagtggccgggatcaccggtatgcaccaccatgcccagctgatcttcgtatttctggtggaaatgggatttcatcatgtaggtcaagcaggactggagttattgacttccggcgaccctcccgccagtgcatctcagtcgaccggaataactggcgtgtcccactgcacccggccaaatttctgcattttttctagagatggtgttagcccctgctggcccgggtggtcacggacacctgatttggttattagcgctcaccttggccttcctaagtgttag

SEQ ID NO: 50252 - DNA, 111 bp, Artificial Sequence
  Description of Artificial Sequence: Synthetic coding sequence
aagcggaagaagaaggagcggaagaaggagcggaagaagaaggagagaaagaaggaaagaaaaaaagagagaaaaaaagaaaaggaacgcaaaaaagaaaaggagcgctag

SEQ ID NO: 50253 - DNA, 108 bp, Artificial Sequence
  Description of Artificial Sequence: Synthetic coding sequence
agccccaacaagctgctgttcgacccccgggtgggcggccgggtgtcccatgtctttttcctgtttcccccctttgtgctgctgcccggccccccaggtcttccctag

SEQ ID NO: 50254 - DNA, 303 bp, Artificial Sequence
  Description of Artificial Sequence: Synthetic coding sequence
ttcctgcggcggagcctggccctgagcccccggcagtggcacgacctcgggagcttgcagcccccagcccctggctttaagcccttcagctgcctgagtctcctatctagctgggattataggtgcgcccctccatgccccgcgaacttttgcatcttagttgaaatgggattccaccatgtgggtcaagctggcttagaactcctgacctccgatctgccagcgtccgccagccagagagcggggatcaccggcgtgaatcatcatgcatggccccgagacgctttcagcatttcctattag

SEQ ID NO: 50255 - DNA, 399 bp, Artificial Sequence
  Description of Artificial Sequence: Synthetic coding sequence
tgcatgtgcgtgtgcgtgtgcgtgtgcatctacatctacatctacatatatatatcccagcccatctacatcttcctgctgctattgctcctcctcttcctgcgccaatccctcatgattaagaaccaagtgagacggccgggagccgtcgcccatacttgtaacccgtctacagtcggaggtcacggcggccagatcacgaggggccaggaattcgagacatccctggccaatatgggtgaaactcccagtctgcttaagattcaaacttggccaggtgttgtcgcgcacgcttgtaaccccagctactccggtgggagactcagacaggagaactgccttaaccttggtgggggggggtgcggggaaattgccctccagccggggcagcaggaatag

SEQ ID NO: 50256 - DNA, 111 bp, Artificial Sequence
  Description of Artificial Sequence: Synthetic coding sequence
ggccgggacgactggcaggccgccccccccgccgcccccgtgcgggaccctcttggcgaagcctcctgggctcccgaatgcggcggcgacctagagaatctgtatgtttag

SEQ ID NO: 50257 - DNA, 228 bp, Artificial Sequence
  Description of Artificial Sequence: Synthetic coding sequence
tgcttcagccacagcttcttcttcttcttcttcttcctgcggtggtccctggccttatcaccccggttggagtgtagtggcgctatttccgcccattgtaaacttcgcctcctcggctcccggcattcccccgcatccgcctctagggtcgcgggcaccaccggagcctgtcaccacgccaggctcttcttctgcattttttctcgcgatggggtctccccttgctag

SEQ ID NO: 50258 - DNA, 336 bp, Artificial Sequence
  Description of Artificial Sequence: Synthetic coding sequence
ttcttcttcttcttcttcctgcggcacaccctggccctgctgcccaggctcgagtgctccggcgcaatcctcgctcactgtaacatccccctcagttcgagctcaaattcaccggcttcagcgagtcaggtggccggtattactggagtgtgtcatcatgcacagctcatctttgtgttctttattgagaccgaattccaccatgttggacaagccggacctgaactgcttaccagtggcgatcctagcgcttcagccagccagagcgccggtattacgggcgcctcacatagggctcaaccactaagcatcttgttctttttcttcgaggcttag

SEQ ID NO: 50259 - DNA, 462 bp, Artificial Sequence
  Description of Artificial Sequence: Synthetic coding sequence
gtgcggggcgccagcgcccggccccccctgctgggcagcgaggagccattgtctcccgcatctaggcctgtgagagaaggcggtggtggagtctcaccacctcctggtcagcctccctgtccagggggtcgttggggaggtcaacccagcgctagacctgctgcaccatccgggcgcgaggtgggagtatcagccccaaggcctgcttctaggcctgtcagggaggtgaggggagcttctgccagacccccccttctagggtctgaggagcccctctgtcctgcctcaagacctgtaagagagggcggaggcggggtgagtccccccccaggtcaacccccaagacctggtggacgaggggcaagcgccagacccccccttcttggcagcgaggagcccctatgcgccgccacgaccccaagcgggcgctgcgctcagcagcttattgagaacggaccctag

SEQ ID NO: 50260 - DNA, 273 bp, Artificial Sequence
  Description of Artificial Sequence: Synthetic coding sequence
cagtggagcgacctgggcagcctgcagccccccccccccggcttcaaacggtttagttgtctgaacctcccgacctcatgggactaccgacatgtccccccccggcccgccaacttttgttttttcatagaaatgggttttcttcacgtggggcagacaggtcttgaactcccaacatcaggcgatcctccggcaagtgcctctcagtctgcaggcattacaggagtatcacaccatgcttggcctcactttatcatcctgttgatgatctag

SEQ ID NO: 50261 - DNA, 387 bp, Artificial Sequence
  Description of Artificial Sequence: Synthetic coding sequence
tggcgggcccccgtgatccccgccacccgggaggccgaggccggcgagtggtgtgagccaagaagtacaaggatccaggaaaaggacatcgcattcctcgcgttttcccttggcgatagagttaggctgtatctgcagaaaaagaagaaaaagaaaaaaaaaaatcagtcgcggctatttctgaggctcagcctggcactatcccctaggcttgagtgcagcggtgcaatctctgcacactgtaacttacatcacctcgggtcctccgactcacccgcatccgcttcccgtgtcgcaggcatcaccggtgctagacatcacacccgtttcatcttcgtgttcctggtcgaaacctcttgctggaaccttttggtatctaatagttag

SEQ ID NO: 50262 - DNA, 357 bp, Artificial Sequence
  Description of Artificial Sequence: Synthetic coding sequence
tggtgcgcccccgtggcccccgccacccgggaggtggaggtgggcggcagccttgagcctaaccgttcaaggctgcagagtgctaagatcgcacctctccactacagtctaggcaaccgtactaggctttgcctgaagaagaagaagaaaaagtccctgttcaataaggtgtgcctgttcttgagacggtctcttactttgtccccacggctcgaacacagcggcatgatctctgcccactgtaacctgcgcctgcccggctccagttactcacctgtgagcgccagccaggtagcgggaataaccggagcttgtcaccatacgcagctgatattcgttttcttggtggagacgtag

SEQ ID NO: 50263 - DNA, 318 bp, Artificial Sequence
  Description of Artificial Sequence: Synthetic coding sequence
tacttctacttcctgcggcagagcctgaccctgagcccccggctggaatgtagcggaaccatttccgcccactgcaacctgtgcttgccaggctcttctaatagccctgcgagcgcttcacaggtggcgggtatcacaggggtatgtcaccacacccagctcattttcgtgttcctggtggagatgggtttttgtcatgtcggccaggccggcttagagctcctgacatcaggcaatcctcccgctctggcatttcagtcagcagggatcaccggaatgtctcaccatgcttggccaggccatatgttctttaagtag

SEQ ID NO: 50264 - DNA, 354 bp, Artificial Sequence
  Description of Artificial Sequence: Synthetic coding sequence
gaccgggtgctgctgtgccaccccggctggagcgccatgacccggagtcggctgacagcaacatctgcctcccaactggccggcataaccggaacgcatcaccacgtttggctcagtttcgtgttcttggtggagatgggcattcaccacgtgggccagactggactggagctacctacttctggtgatctccctacatcggcaacccagtctgcagggattactggcgtcgggcactgttccagacccgaggaggtgctgtttttcagagatggagtctccccctgttggagtgggtggtctcagaccccaggcttgaaaccaagcagccacctcgggctacccaaatgttag

SEQ ID NO: 50265 - DNA, 111 bp, Artificial Sequence
  Description of Artificial Sequence: Synthetic coding sequence
aaggagaagaaggaggagcggaagaaggagcggaagaagaaggagcgcaagaaagaaaggaaaaaggagaggaaaagggagaaagagcgtaaaaaagaaaaagagcggtag

SEQ ID NO: 50266 - DNA, 306 bp, Artificial Sequence
  Description of Artificial Sequence: Synthetic coding sequence
ttccacctgttcctgttcatctgcttcttcctgttcctgcggcggagcttggcactcagtccccgcctggagtatagtggtaccatctcagcccactgcaagctgaggttaccaggtagccggtactcagccagcgctagcagagtcgcaggtacaaccggcgccagacatcacgcccggctgattttctgtatattctatcgtgacggcgtgagcccatgctggagccgcatacctgacctgatttgcttgccctggccacccaaggtcctcggattacaagcccctgcaacaatcccaggatag

SEQ ID NO: 50267 - DNA, 423 bp, Artificial Sequence
  Description of Artificial Sequence: Synthetic coding sequence
ggcaccatcagcgcccactgcaacctgtgcctgctggacagcagcgatagcccagcttccgctagtcgggtggccgggattatcggcgcccatcaccatgcacagctaatattcgtgtttctcgtggagatgggatttcaccacgtggggcaggcaggcctgaagctcctgacttctgatcctccagttagtgcctctcagagcgcaggaatcaccggggtctcccatcatagagagccccaacatcccttcctgctatcggtggagtctagagatcggccattctttttttttgggttcttcttctttgagatggagtcttattctgttgcacaggcgggcgtacaatggcgggacctcagttcccttcagccccctccacccagagcccaggctattctgcctccccagccaccaaaatag

SEQ ID NO: 50268 - DNA, 387 bp, Artificial Sequence
  Description of Artificial Sequence: Synthetic coding sequence
tggcgggcccccgtgatccccgccacccgggaggccgaggccggcgagtggtgtgagccccgctccacccggatccaagagaaagatattgcttttctagccttttccctgggagaccgcgtgcgactgtacctgcagaagaagaaaaaaaagtctaaaaacaacaaaacctctctgttcctcaggttgagccttgccctctcaccgcgacttgagtgttccggcgcaattagtgctcactgcaacctgcaccatctggggagctctgactcgcccgcgtccgctagtcgggtagcaggtatcacgggagcccgacaccacactagattcatcttcgttttcctggtcgagacctcttgttggaatcttctggtgtccaatagttag

SEQ ID NO: 50269 - DNA, 306 bp, Artificial Sequence
  Description of Artificial Sequence: Synthetic coding sequence
ttccacctgttcctgttcatctgcttcttcctgttcctgcggcggagcctagccctgtctccccggctggaatacagcggtacaatcagcgctcactgcaaactccgactgccgggcagcagatacagtgcttcagccagccgagttgctggcaccaccggcgcccgtcaccacgcgaggctgatcttttgcatcttctatcgggacggagtgagtccctgctggagtaggattcccgatctcatctgtctcccctggccccccaaggtactgggattacaggcacctgctacaatacccggctag

SEQ ID NO: 50270 - DNA, 111 bp, Artificial Sequence
  Description of Artificial Sequence: Synthetic coding sequence
aagcggaagaagaaggagcggaagaaggagcggcggaagaaggagagaaaaaaagaacgcaagaaagaacggaagaaagaaaaagagcgtaagaaagagaaggagcgctag

SEQ ID NO: 50271 - DNA, 279 bp, Artificial Sequence
  Description of Artificial Sequence: Synthetic coding sequence
ttcttcttcttcttcttcgagaccgactgccggagcgtgacccggctggagtgttctgggattatatccgcacactgcaaactctgcctcccaggcagtagcgatagccctgcatctgccagccaagccgctcggactatcgggacctgtcatcacacgcagcttatctttgtctttttcgttgagacaggtttccatcacgttggtcaggatggcctgaatctgtctctagtgatccatccccctcgacctcccaaggtcttgggcctgcaggtctag

SEQ ID NO: 50272 - DNA, 111 bp, Artificial Sequence
  Description of Artificial Sequence: Synthetic coding sequence
aagcggaagaagaaggagcggaagaaggagcggaagaagaaggagcgcaagaaggagcgaaagaaagaacgaaaaaaggaaaaggagaggaaaaaggagaaggaacgctag

SEQ ID NO: 50273 - DNA, 333 bp, Artificial Sequence
  Description of Artificial Sequence: Synthetic coding sequence
tgcacccggtacttctacttctacctgttctgcttcatcttcatctacctgttcttcttcctcaggtggagcttagcactgtctcctcggcttgaatgctcgggagccatctcagcccactgcaagctgcacttgccaggatcttgtcattatccggcaagtgcttccagggtggccgggaccactggggcgaggcaccatgcatggctgatattctgcatgttttccaaggatagggtgtcgcggtggtcacagtctcccgatatcgcaatctgtctgccttggcccccaaaggtcttgggactacaggcccctgcgacaacaccaggatag

SEQ ID NO: 50274 - DNA, 357 bp, Artificial Sequence
  Description of Artificial Sequence: Synthetic coding sequence
tggtgcgcccccgtggcccccgccacccgggaggtggaggtgggcggctccctcgagccaaaccgctctcgccttcaaagcccgaagatcgccccgttgcactattccctgggcaatagaactcggctgtgtctgaaaaaaaaaaagaaaaaaaaaaagatcaataaggtctgccttttcttaaggcgaagtctgaccctgagtccaagattggaacactctggaatgatttccgcccattgtaaccttaggctgccaggctcaagttattctcccgtgagtgcttcccaggtggccggcatcaccggggcgtgtcatcatacccagctcatcttcgtcttcttggtcgaaacttag

SEQ ID NO: 50275 - DNA, 177 bp, Artificial Sequence
  Description of Artificial Sequence: Synthetic coding sequence
cccggcggcgccgccgccgccgccagcgtgatggccccccggcggggaagatgcttctgtacttccatttgtgggggacggggcgccagacctcagctgccgcggacatgtggcgatggaactcagcattgcggtagaggcaaacccgccctggccgccgcagaggagtggccttag

SEQ ID NO: 50276 - DNA, 129 bp, Artificial Sequence
  Description of Artificial Sequence: Synthetic coding sequence
aaggaggagaacgaggaggagaaggtgaaggagaaggagaagaacaaaaagagaaaaaaaagaaagaagtctcaaagccggcgggtgtaccatcaggagaaaacacacatcctgtgggtatccacatag

SEQ ID NO: 50277 - DNA, 309 bp, Artificial Sequence
  Description of Artificial Sequence: Synthetic coding sequence
gtgctgctgtgctgccccggctggagcgccgtggtgcggagctggctgactgccaccagtgcatcatggcagctcgccggaattactggcgtttgccaccatgcacaactgatttttgtgttcttcatcgaaacggagttccatcacgtgggacaagctggaccagagctgctcacgagcggagatccttctgcttcggcctctcagtccgcaggaataacgggggcttcccatccgcgacgcgccaatttctgcatttttggccgggacggcgtctccccctgctggccgggctggtcctcgacctag

SEQ ID NO: 50278 - DNA, 333 bp, Artificial Sequence
  Description of Artificial Sequence: Synthetic coding sequence
ttcttcttcttcttcggcaacggcgtgtggctgtgccaccccggctggtcggctgtcgtccagtctcgccttactgccacatccgcctcctggcaactcgcgggcattaccggcgtttgtcaccatgcccagcttatctttgtctttttcatcgaaactgaatttcaccacgtgggccaggcgggacctgaactcttgacgtcaggagatccttctgcgagcgcatcacaatcagccgggatcacaggggcaagccaccctcgaagagctaatttttgcatcttcggccgtgacggtgttagtccgtgctggcccgggtggtcttctacgtag

SEQ ID NO: 50279 - DNA, 75 bp, Artificial Sequence
  Description of Artificial Sequence: Synthetic coding sequence
cgggagaccgagcggaccatcaccgacgacggctggatggacggctggatggatggctggatggatggctggtag

SEQ ID NO: 50280 - DNA, 372 bp, Artificial Sequence
  Description of Artificial Sequence: Synthetic coding sequence
ttcatcttcctgcggtggagcctgagcctgagcccccggctggagtgtagcggcactatcagcgcccattgtaacctatgcctgcctggctcctcccattcatctgcgtctgcctcccaggtagcgcggattactgacgtgggatacgcccccggacaacatggagagacgccttcactgctgaagatccagaaactggctggatacggtgtcgccaacgtgtacagtcaattgttgggtaggctcagacaggaaaacggagtgaaccctggtggggggacctgcagcgagccgcgcagtcgacactgcacaccggcttgggcaactgcccgactgcgcctcaagaagaaaaagaagaaaaagaagaaatag

SEQ ID NO: 50281 - DNA, 459 bp, Artificial Sequence
  Description of Artificial Sequence: Synthetic coding sequence
agccggttctacatcggctgcgacctgtgcaccaactgctactacggcgaatgtgtgggaatagccgaaaaggaagccaagaaaatggatgtttacatctgtaatgactgcaagtgggctcaagaagggtctagtgaagaactgtactgcatctgtcgcaccccagcaggcagttgcaggtttttcataggacacgatagatgccaaaattggtaccatggctgctgcatcggaattctgcagtccgaggccgaactgatcgacgaatatgtgtgccctcaatgtcaatctacagaggacgttatgacagttctgacccccctgacagagaaagatgacgaagagcttaaaagggtcctccgctcccttcaggcacataagatggccaggccgttcctggagccagtagatcctaacgatgcgccggactattatggtgtcataaaggaaccagtctag

SEQ ID NO: 50282 - DNA, 123 bp, Artificial Sequence
  Description of Artificial Sequence: Synthetic coding sequence
agcccccccccccccggcggcggcgagaagcccctggccccccccccagggtgggttgaaccaccaaaatggctcggactgcagggcccaagcggcgggcctggggcaggtccggggctgtag

SEQ ID NO: 50283 - DNA, 96 bp, Artificial Sequence
  Description of Artificial Sequence: Synthetic coding sequence
gccaagccccggctgcaccagcccggccagagcggcgagacccccagtctgttgaagatccaaaagttggccaggaggggcggagtgcacctctag

SEQ ID NO: 50284 - DNA, 417 bp, Artificial Sequence
  Description of Artificial Sequence: Synthetic coding sequence
ggcaccatcagcgcccactgcaacctgtgcctgctggacagcagcgattcacccgcatccgcgtcccgggtcgccggcatcataggtgctcatcaccacgctcagcttattttcgtctttctggtcgagatgggcttccaccacgtgggacaagccggtcttaaacttttgacttccgatccccccgcctccgcttcccagagcgcagggataacaggtgtctctcaccataattggctcttttttagcatatttcttaaaaacagccaggaaacagcccgcttctttttctggttcttcttctttgagatggaatcttatagcgtggcccaagccggagtgcaatggcgggatcttagctctttgcagccacctccaccccgacataccatcttactgcctcagccgcctgagtag

SEQ ID NO: 50285 - DNA, 108 bp, Artificial Sequence
  Description of Artificial Sequence: Synthetic coding sequence
agccccaacaagctgctgttcgacccccgggtgggcggccgggtgtcgcatgtgttctttttattcccccctttcgtgctattacctggaccccccggcctcccatag

SEQ ID NO: 50286 - DNA, 369 bp, Artificial Sequence
  Description of Artificial Sequence: Synthetic coding sequence
ttcatcttcctgcggtggagcctgagcctgagcccccggctggagtgcagtgggaccatcagcgcccattgcaacttatgcctcccggggtcttcgcacagctcagcttcagcgagccaggtggcccgcatcacggatgtcgggtatgcacctggtcagcacggagagactccatctctcttaaagattcagaagctcgcaggatacggcgttgcaaatgtgtactcccagctgctaggaagactgaggcaggagaatggggttaaccccggcggaggcacgtgcagtgaaccccgatctaggcactgcacccctgcatgggccacagccaggctgcgcttgaaaaaaaaaaaaaagaagaagaaatag

SEQ ID NO: 50287 - DNA, 462 bp, Artificial Sequence
  Description of Artificial Sequence: Synthetic coding sequence
gtgcggggcgccagcgcccggccccccctgctgggcagcgaggagcctctgagccccgcgtccagaccagttcgggagggcggaggcggggtgagccccccccccggtcagcccccatgtcccggagggcgctggggaggtcagcccagcgctcggcccgccgcaccctccggacgcgaggtgggcgtctccgctcctcgcccagcatcgcgacccgtgagggaggtgcggggcgcctccgcccgccctcctctcctgggctcggaagagcccctgtgccctgcctcaagaccagtgcgcgagggaggcggtggagtgagcccacctcctggtcaaccccctaggcctgggggcagaggcgcaagtgcccggccccctttgctcgggtcggaggagcccttatgcgccgcaactactccctctggccggtgtgcccagcagctgatagagaacggcccttag

SEQ ID NO: 50288 - DNA, 213 bp, Artificial Sequence
  Description of Artificial Sequence: Synthetic coding sequence
atcagcgcccactgcaacctgtgcctgctgggcagcagcaacagcttggctagcgcttcccaggtagcgggcataaccggagctcatcatcaggcacaacttatattcgtcttcctagtggagacagagtttcaccacgtgggacaggccgggttaaagcttctgacgaacgaatggttgcctgtgtgtctgcccaagtgttgggactattag

SEQ ID NO: 50289 - DNA, 366 bp, Artificial Sequence
  Description of Artificial Sequence: Synthetic coding sequence
tgcgtgtgcgtgtgcgtgtgcgtgtgcgtgtgcgtgttcatctacttctctgtgttttggtcatttctgtatctgttcgtattcctcatttgggccaaggaacaagacagcgtgagcaaaaaaaaaaaaaagaagcctggcgtggttgctcacgcctgtaacccatctactctcggcggccgcggcggacagattacaaagcaggagttcgaaacatctctgtccaacatggcgaagcccccaaaggtcctgggcctgcagaactggcctggcatggtcgcaagcacctgtaacccaagctacgggcggttaaagcaagagaaccatctaatccgggggggacgcgggtgctccgaaccacggtag

SEQ ID NO: 50290 - DNA, 276 bp, Artificial Sequence
  Description of Artificial Sequence: Synthetic coding sequence
accttcttcttcttcttcttcgagaccgactgccggagcgtgacccgtctggagtgctctgggataatatccgctcattgcaaactgtgtttgccaggatcctcagactcacccgcctcagcttcgcaggcagcccgaacaataggtgcgtgccatcacgcgcaattgatattcgtgtttttcgaaaccgggtttcatcatgtagggcaggatggcctattagacctggtgattcatccgccgagaccccccaaagtgttaggattgcaagtgtag

SEQ ID NO: 50291 - DNA, 372 bp, Artificial Sequence
  Description of Artificial Sequence: Synthetic coding sequence
tgggactacagcttcttcttcttcctgcggcagagccacagcgtgccccaggctggagttcaatggtgtaatctcagctccttgcaacctcccccaagcagattcaagagattcagctgtctctccctgctctcctcctgggactaccggcatactcccccatgtcctgctaatttcctttacacgtttgaattatttttcttttttctcagatggagcttcgccttatccccaagacttgagtgctctggagccatcctggtccactgcaacctttgtctgccgggcagctctgacagttgtctcagtctacccatttcctgggattataggtgcgcacctccttgcttggccaacttttgcattttctag

SEQ ID NO: 50292 - DNA, 765 bp, Artificial Sequence
  Description of Artificial Sequence: Synthetic coding sequence
aaggtgagccacgtgtacttcttcctgcaccggcacggcaaccaccccatctcacaatcctttccgcacctaagtcggctgtccataccacagtctaggcattgtcaccccgggcctttttcgatgtcttgctgggcccacttacctgacggagccgtggccggacaaagggggtcaagccttccatccagggggggacgcgccgaggcaccactaacttcacgaacggggagattggcaggccaaggagcgcctccaacaagcctaccagactgggtcgcagctgggcgacggagatcatccctgcccagatggggtggctgccgcgccgaacggcttctcacttcacaaacaggtcagctgccagggggcggggctccacattttagcgatggcgtggttgcccgccaaagggttagcagtcttctgaggagaggcggtcgtgcagagacactgctcacttcccagactgggagccgtccgggcaggggggccccacatatcccagatggagccgccggccagcggaggagtccccacctgcggaggtgggctgccgggcaaaggcgcagctctttgccccggtgggatgggggtcgcgccgagacattgctgactttccagacgggccagcctggccggggggccccccacatacccgacgacgggcgtcctggaagagacactccgcacttccccgacggcgtggcggcgggacagcggctgcagtccaggcactttggccggccccggcaggcagcttag

SEQ ID NO: 50293 - DNA, 456 bp, Artificial Sequence
  Description of Artificial Sequence: Synthetic coding sequence
atggagcggaagaaccccagccgggagagcccccggcggctgagcgctaaggtcggtaaaggaacagagatgaagaaagtggcccgacagctgggcatggcggctgcagagtctgataaagactcaggtttcagtgacggaagctctgagtgtctctcgagcgcagaacagatggagagtgaagacatgcttagcgccctgggatggagccgggaagaccggccacgtcagaactccaagaccgcgaagaacgcctttcctacactttctccaatggtggtaatgaagaatgtgctggtaaagcaagggtcctcttcttcacagctacagtcttggactgttcagccttcgttcgaagttatctctgcacagccccagctgctgttccttcacccccctgtaccttcccctgtgagcccctgccatacgggggaaaaaaagtctgacagccgatag

SEQ ID NO: 50294 - DNA, 408 bp, Artificial Sequence
  Description of Artificial Sequence: Synthetic coding sequence
atggagcggaagaaccccagccgggagagcccccggcggctgagcgccaaagtcggcaaaggcactgagatgaagaaagttgcgcggcaattggggatggctgcagcagagagtgacaaggactccggctttagtgacggtagcagcgagtgcctgagttctgcagaacagatggagtctgaggatatgctttccgccttaggatggtctagagaggacagacctaggcagaactccaaaaccgctaagaacgctttccccacgttgtctcccatggtcgtcatgaagaatgtcttggttaaacagggatcctcttcatcacaactccaatcatggactgtccagccgagttttgaagtcatttctgctcagccccagctgctgttccttcaccccccagtcccttag

SEQ ID NO: 50295 - DNA, 426 bp, Artificial Sequence
  Description of Artificial Sequence: Synthetic coding sequence
atggagcggaagaaccccagccgggagagcccccggcggctgagcgcgaaagtgggtaaaggcacggagatgaaaaaggtggccagacagcttggcatggcggccgcagaaagtgacaaggactctggcttttctgatggatcatctgagtgtctatcctcagccgagcaaatggagtccgaggacatgttaagtgccttgggctggtccagggaggatcgcccaaggcagaatagcaagactgccaagaatgcatttccaacccttagcccaatggtcgtcatgaaaaatgtgctggtgaaacagggcagcagtagctcccagctgcagtcatggacagtgcaaccatctttcgaggtgatatctgcacagccccagctgctcttcctgcaccctcccgtgccttcaccagtttctccttgctag

SEQ ID NO: 50296 - DNA, 474 bp, Artificial Sequence
  Description of Artificial Sequence: Synthetic coding sequence
atggagcggaagaaccccagccgggagagcccccggcggctgagcgctaaagtcggcaaggggaccgagatgaaaaaagtggcccgtcaactcggaatggccgcggctgagtcagacaaggattctggattcagcgacggctccagcgagtgtctcagtagcgcggaacagatggaaagcgaagatatgttgtctgccttaggatggtccagggaagatcgacctaggcagaactctaaaactgctaagaacgcttttcctaccttaagcccgatggtcgttatgaaaaacgtgctggtaaaacaggggtcatccagtagtcagctgcaatcctggactgtacagccgtctttcgaggtcatcagcgctcagccccaactgctttttttgcaccctcctgttccttccccagtgtccccttgccacacaggcgaaaagaaaagtgattctcggaattacctaccaatcctctag

SEQ ID NO: 50297 - DNA, 1752 bp, Artificial Sequence
  Description of Artificial Sequence: Synthetic coding sequence
atgaccttctacctgttcggcatccggagcttccccaagctgtggaagagcccttatttggggctcggacctggccactcgtatgttagcctctttttggccgatcgttgcggcataaggaaccagcaaagacttttctcgctgaagaccatgtcgccccagaataccaaggctaccaacttaattgcaaaggctcgctacttgaggaaggacgaaggcagcaacaaacaggtctactcagttcctcattttttcctggccggcgcagccaaggagaggagtcagatgaattctcaaactgaggaccacgcgctggccccggtgaggaatactatccagctgcccactcaacccctgaattcagaagagtgggacaaacttaaagaggaccttaaggagaacacagggaagacttccttcgagagctggataatcagccagatggccggctgccacagttccatcgacgtcgcaaagagccttctggcatgggtggcagccaagaacaatggaatagtgtcttatgacctactggtaaagtatctgtatctttgtgtctttcatatgcagacatccgaggttatcgatgtttttgaaattatgaaggcacgctataaaaccctcgagccccgagggtactccctcctgatccgtgggcttatccattcagataggtggcgcgaggcgttgctcttgctggaggacatcaagaaggtgatcactcccagtaagaaaaattataacgattgcattcagggagctttgctccaccaggatgtcaacactgcttggaatctctatcaggagcttctgggccacgacatcgtgccaatgctggagactctgaaggcattttttgatttcggcaaggatatcaaggacgataactatagtaacaagttgcttgacattctgagctacctgagaaataaccagctctatccaggagagtccttcgcccactccattaagacatggtttgaaagcgtccccgggaagcaatggaagggtcagttcactacggtgcggaaatctggccagtgctccggctgcgggaagaccatcgaatccattcagttgtccccggaagaatatgagtgcctcaaaggtaagattatgagggacgtgatcgatgggggagaccaatatcgcaaaactacaccccaggagctgaagcggtttgaaaattttattaagtcccgccccccctttgatgtggtgatcgacggattgaatgtggccaaaatgttccctaaagtgcgtgagtcgcagctactattaaatgtggtgtcacagctggccaagaggaacctgaggctgctcgttttggggagaaagcacatgctgaggaggagctcacagtggtcaagggacgaaatggaggaagtccaaaaacaggcaagttgcttcttcgcagatgatattagcgaggacgaccccttcctgttgtatgcaacgctacacagtggtaaccattgtagatttataactcgagatctgatgcgagaccataaggcctgtttaccagatgccaagacgcagagattgtttttcaagtggcagcagggtcatcaactggcgattgtcaatcggttccctgggtctaaactgacctttcaaagaatcctttcttacgacacagtcgtgcagactactggtgattcgtggcacattccttatgacgaggacttggtggaaagatgctcctgtgaggttcctacgaagtggctttgcctgcatcagaaaacttag

SEQ ID NO: 50298 - DNA, 309 bp, Artificial Sequence
  Description of Artificial Sequence: Synthetic coding sequence
gacatcgtgatgacccagagccccctgagcctgcccgtgacccccggcgagcctgcttccatctcttgtcggtcgagtcagtcccttctgcattccaacggatacaattacctggactggtacttgcagaaacccggacagtcaccacaactgctgatctaccttggcagcaatcgggcaagcggagtcccggaccggtttagtggttccggctccgggaccgattttaccctgaagatcagtcgcgtcgaggccgaggacgtcggagtgtactactgcatgcaggctctgcagacaccacccacctag

SEQ ID NO: 50299 - DNA, 348 bp, Artificial Sequence
  Description of Artificial Sequence: Synthetic coding sequence
aagatgagccccagccagctgatcggcttcctgctgctgtgggtgccagctagccgcggggagattgtgttgacccagtcccccgatttccagtctgtgactcctaaggagaaggtcacgatcacatgtcgggcaagccagagtataggtagctcattgcattggtatcagcagaaacccgaccagagccccaaactgctcataaagtatgctagccagtctatatccggcgttccttctcgcttcagtggttctgggtcaggaacagatttcacgctgacaatcaactcacttgaggctgaggacgcagctgcctattattgccaccaatcctcctccctgccatag

SEQ ID NO: 50300 - DNA, 396 bp, Artificial Sequence
  Description of Artificial Sequence: Synthetic coding sequence
atgggccccgccgtgctgggccagggccaggagggccagcccgaggccagagcctgctcaggcctcttgcaaccacccaaacggccgattgttttcaaagagaaactgactatgaaaacagactccctgatggaagagaagctggaatgttctctttggtgctgcctaagtgacccaagcataccaggcagatgctgcgtgctggagagaaggatcgtgccatggatgcagcaggaatcatactcctcaagcagtcctatttggtctgttgactctgacgagccaaatctgaccagcgtacttgaaaggctggaagataccaaagagaatagttcagtccgaaaagaaactaagttattcagcctcttcctaatgaatataatatttaggaattag

SEQ ID NO: 50301 - DNA, 411 bp, Artificial Sequence
  Description of Artificial Sequence: Synthetic coding sequence
atgggcgacagccggcgggacgtgctgcacgagcccgccatcgccctcttgagttccccgcaaacacaatcccgactgcagattgacgcctttatagctaggcgatgctggggctcacagtgggacattaccggatacatccatcaacaagattttccaaccgctgttttcataggtttttccaacgagttcaacatctgcataccccaccctttcacagaatggttgcagtgcgtgcgtaagtactcacagtcttggggtgttcggaagggccagcgccacattcggtatggcatgtgttccgagaggactcatcacctgtcccgcacctattcttctctgctggaacgggaagagaagcttgccttctacggggtgctcaccatgtgccagatctggtgcgagacctag

SEQ ID NO: 50302 - DNA, 315 bp, Artificial Sequence
  Description of Artificial Sequence: Synthetic coding sequence
gaggacatcgtgatgacccagacccccctgagcctgcccgtgaccccgggcgaacctgcgagcatcagctgccgaagctcccagtccttgcttgactcagatgatgggaacacatacctggactggtaccttcagaagccaggacaaagcccccagctgctgatttacaccctctcctatagagcctccggggtccccgatcggttttccggtagcggctccggcaccgacttcacactcaaaatctcaagggtggaggcagaggacgttggagtctactattgcatgcaaagaatcgaatttcccagcacatag

SEQ ID NO: 50303 - DNA, 345 bp, Artificial Sequence
  Description of Artificial Sequence: Synthetic coding sequence
atgggcacccggctgctgtgctgggtggtgctgggcttcctgggcacggatcacactggagcgggagtgtcccaaagcccacggtataaagtggcgaagaggggccaggatgtcgccctcaggtgtgatcctatctccgggcatgtttctcttttttggtaccagcaggccctgggccaagggcctgagttcctgacctactttcagaacgaagcacagctggacaaatccgggctcccatccgatcgcttctttgccgagcgccccgagggctctgttagcacccttaaaatacagagaacccaacaggaggactcagccgtatacctttgtgccagctcctag

SEQ ID NO: 50304 - DNA, 372 bp, Artificial Sequence
  Description of Artificial Sequence: Synthetic coding sequence
atgtgcggccagtgccagagcagcagcggccacatggaggaggaggctcaccctgagctgtgtccccactggcccttacagtttagccctcagtcccattgtcggcaagcctatgggagagacactcacgccgggggtccgggtgcacgcgtagactccggtcatcacttgggtctcttcccaggactgctgagtacatgccccgatggcctgtgcgtgttccctgtaccttcccctactttcagcacctctctccacgttttaatggagtgcaaggtccatcaacccgggcctcttcccggacgaggctcagcagacgctggcctccgcggactgccacagggccggaccctgtgtgtgcttacagcgtag

SEQ ID NO: 50305 - DNA, 528 bp, Artificial Sequence
  Description of Artificial Sequence: Synthetic coding sequence
atgcacggcgagaagagccacggccggggccaggccggccggcaggtccccctgaagcagcagagtgtatccggcgaaagccaacagggtgctaggcaaggagcaggtcaatctacgtgctacctgtcttccgcatttctgtgcaatgggtcatttccagccggcagcatgagtctctgggacccacagcccaagcaggcttttccttcagtgctgtggtgctcgtgggctggagtgcctgggcgcagaactgggcagcgggacccccgtgtacaggagcgtcgcggggatttcgtaagtaagctgggtgctgccgtgggtggggaacccttagccctgtttggaccccattcttggcccgggatgggacaccgggtgccaggattgggcgcgggtttcttactgtttgccgggttcgccctggaaccttgggattcatatcatgtggtttttgagggctggaccatcgacatgcggcgcaatgagccagaacgcaccagaagtctgtctgccccaggcccattatag

SEQ ID NO: 50306 - DNA, 1671 bp, Artificial Sequence
  Description of Artificial Sequence: Synthetic coding sequence
atgcaccccatggccctgcacatggtgctgcccgcccacctgcccttcctgtcgcccgaagttttaagactgttggaggtacacgtcaaaaaatggatgcatttccagcgctggggcttgccacgtcgggttgaagaatccctcagacaattgatgcctaaccctccactttactaccagccaggcaacgaccaacccgtctcattcaatctaaataacaccagccaggtttcattgcataggagcgagaccatctcactgcaaacctggtgcagttgcgtcgccggccagccaattcagactttttgggtgagcgaatggagcactatgaacccagaacagcgacatcattgtcagcaaacacccaatccaatggctctcgccttaccgtcccctgctcttaaggctctaagtgggccgcaccctcagtctggaggacaggataacgattccgggtctgacctgcagcagaagtactcacaactgttttgtgggctcccgtcattgcactctgaaagcctcgtggccacctttatgggctcccaggggctgcctaaaatcgaaaacgtgccgaagcccccccttaaggacccatttctgtttaacgatctgagctttccacagctgcttcctaagacaagcccacagtccgcccccccgtctagccccctgtcccctaattgggtgagccccagtgaccatcagagagcccaaatcaacgtgccgtttctgactcttgctgagtatgaagcattagagtggcatctcctgcaacggcagttgcagctccagtggggatggccagcggcactgcaaagatctcagcatactcaatgtctcatgcagcacgagccctgtggtaaagctcagtctcccgagaccacgacagccagccagacaggcaagtctatctccgtattgacccgtgagttactgtttttcccagaacatgcccggaagctgctggagttccacattcagaagcagtcaatcaggcaccggtggggactcccacaaaagatacagcagtctattcaactcctgctcaccagtactgatcagcagacagtaagctcgagcagcacagccctggctaacgtgtccatcccacaacctgtggccctcgaagcgaacggggcgtgcgatgtcctttctccaatcgctgcacccgtaagtatcccacgcccccacctcctcacgcaggtcaaggcaatacttcagagtcatattgattctaagtgtggacaaattcatcagggcaagattcccgcctgcgtgcatcgctcctgggactgcaggatcagcggcgtcctggcagtggccccgttcccatgcattcccgagtctcagttcctggtcctgcagacagcatcagaccctgaccttcaccataaggtgatgccgtggatgcccactgcgctggatcagcaacagcaggcactccccgggacggttactgagcacccaaaacttctgagggtgctctctgtcgaagcaatcgagaagctggagaccaccctccgccacaagcatctggccttcttgtcaggccttcctgccctttactacgtagcgttacctcgagcccttgctcccgcagtgacctctcagtcggtgatcaccgagatggaaccttctcccgtggagatacctgccgagccacttatctag

SEQ ID NO: 50307 - DNA, 624 bp, Artificial Sequence
  Description of Artificial Sequence: Synthetic coding sequence
atgggcatgcggctgcagctgctgcgggaccggcggatcagcagcagaggcccaggtctccatcgggccaaagctgaccctcagcaacaaaaaagactgaccaccgggttgatgacccaggcagagactcaaaaggaggcgcagcaacggcaggccgcaatgagaaagacagccttgtggcacacaggccatctgcagccgaaaacgcatacccataccggaatgcacacgcaaacacatagagaacgtgagcgaaacacccagcgtctgcgtgatcgcgaacgccgcgagaacggtaggcacacccaccggcacacccatactctcacacatactcatacccaccgagacacccacacagcctcatatcgacgtggaatagagacacacacaacacgacaacctctgaggctcaggggatcggctcacgatgagaatgatcctagggtccgcgaacagccacggggcacacaagcagacttgtcctcacgctctaggatggccgcccgcctgcttggccggctcactcccacgaatacggtacgagccggtttgcggctgggctcaagagcagcaagccctgaccctgcgtgggggttcctgatagtagttgggccactctag

SEQ ID NO: 50308 - DNA, 381 bp, Artificial Sequence
  Description of Artificial Sequence: Synthetic coding sequence
atgggcatgcggctgcagctgctgcgggaccggcggatcagcagcagaggccccggtcttcatcgcgcaaaagcagaccctcaacagcagaaacgcttgaccacggggctcatgactcaggcggaaactcagaaggaagctcagcagagacaagccgctatgcgtaaaactgctctgtggcataccggacacctgcaacccaagacccacacccacacagggatgcacacacaaactcatcgcgagcgcgagcgcaatacccagcggctgcgtgaccgggaacggcgggaaaatggccgccacacacacacccacacggagactcatacccaacgccacactgaagaggccctaaaacataccccaccgggcaacccttag

SEQ ID NO: 50309 - DNA, 693 bp, Artificial Sequence
  Description of Artificial Sequence: Synthetic coding sequence
atgcggctggccggccccctgcggatcgtggtgctggtggtgagcgtgggggtcacctggatcgtcgtttccatcctgcttggggggcctggtagcggcttccccagaatccaacagctattcacaagccccgagagctcagtgacggcagcacccagggctcgcaagtacaagtgcgggctaccgcagccgtgccccgaagagcacctggcctttcgcgtggtctcaggagcagccaatgtcattggacccaaaatttgcctagaagacaagatgctcatgagctctgtaaaagataatgtcgggagaggcttgaatattgctttggtgaatggggtaagtggcgagctcattgaagcccgggcattcgacatgtgggctggggacgttaatgaccttttgaagttcatccgtcccctgcatgaaggcactcttgtgttcgtggcttcgtacgatgatcctgctaccaaaatgaacgaagaaaccaggaaactgttctccgaactcgggtcgcgtaacgcgaaggagttagcgttccgggacagctgggttttcgtgggagcaaagggtgtgcaaaataaatctcctttcgagcaacatgtaaagaattccaagcattcgaacaagtatgagggatggccggaggcgctggagatggagggctgcatcccgcggcgatccactgctagttag

SEQ ID NO: 50310 - DNA, 840 bp, Artificial Sequence
  Description of Artificial Sequence: Synthetic coding sequence
atgggcaagggcaacgaggacagcgacctgcactgcagcagcatccagtgcagtactgaccagccaccatttcagcagatcagcttcaccgagaagggttctgatgagaagaagccgttcaaggaaaaggggaaaaccgcctttagccattccagcgagaagcatatccagcgccaggccggtagtgaacctaatcccaacaaagagaactccgaggaaacgaagttaaaggccggtaactctaccgccgggtcagagccggaatcttcaagttacagagagaactgtagaaaacgcaagatgtcatcgaaggattcctgtcaggacaccgccggtaattgtcctgaaaaggagtgctcgctgtccctgaacaagaagagtcggtctagtacagctgtacacaattccgagatccaagagacctgcgatgcacatcaccgggggcatagcagagcttgcaccggacactctaaaaggcatcggagccgagcccttggggtccagacaccgtcgattcggaagagcttggtaaccagcgtgagggccatgagcgaagctgtctatcaggaccttgcacaagtttgggctcagcagatacactccccgctaacttgcgaacagctgactctgctcactaggttgcgcggtcccttatgcgcccaggtgcagacgttgtattcaatggcgacccaagccgcctatgtgtttcctgcagagtcctggctggtgccggcaactctgccgggacccggagaatctgctctggatagggaggctcatccttttcccggccaggagattactgaaaccgtttccggaagtgacgaggctaaactgtag

SEQ ID NO: 50311 - DNA, 849 bp, Artificial Sequence
  Description of Artificial Sequence: Synthetic coding sequence
atgggcaagggcaacgaggaccccgacctgcactgcagcagcatccaatgctctacagatcagccgccctttcagcagatctcgttcactgaaaaaggcagtgatgaaaagaagccttttaagggtaagggaaaaacggcttttagccattcgtcggaaaagcatacccagaggcaggccggtagtgacccaaacccgaacaaagagaactctgaggagacaaaactgaaagcgggtaactcgacagccggctctgagccggagtccagcagctaccaggaaaattgccgaaaaaggaagattagttcaaaagacatctgccaagatagagctggtaactgccccgaagaagaatgcaacttgactcttaacaagaagtcccgctccagtactgcagtgcacaattccgaaatccaggaaacatgtgacgcccatcacaggggttcttcacgggcctgtaccggccgtagcaagagacacagaagtagggcccttgaagtgcagactccatctctccggaagtccctggtaacatcagttcgggcgatgtcagaggccgtttaccaggacctggcccaggtctgggcccaacagatccactctcctcttacctgtgagcagctgactttgctgacacggctgaggggtccactgtgtgcacaggtccagacactctactctatggctacccaggcagcctacgtgttcccagccgaatcttggcttgtaccagctacactgcccggtcccggcgactccgctctggaccgcgaggcccacccttttccaggacaggagattacagagcccgtttcgggctcggacgaggcgaagcttggcgctccgtag

SEQ ID NO: 50312 - DNA, 903 bp, Artificial Sequence
  Description of Artificial Sequence: Synthetic coding sequence
atggccgccaccgaggacgagcggctggccggcagcggcgagggcgaaaggctggacttcctccgggaccgtcacgtgagattctttcagaggtgcttacaggtgcttcctgagaggtacagctcactggagacatccagacttacaattgcattctttgccctgtccgggctagatatgctcgactccttggacgtagtcaataaagatgacattatcgaatggatttacagcctacaggtgctgcccactgaggatagatctaacttaaaccgctgcgggttccgcggatcctcatatctgggtattcctttcaacccatcgaaggctcccggcacagcacacccttacgactccgggcatattgcaatgacttacaccgggctcagctgtctcgtgatccttggagacgacctctctagggtcaacaaagaggcttgcctagcaggactacgtgcgctgcagctcgaagatggcagcttttgcgccgttccagagggtagcgaaaacgatatgaggttcgtgtattgtgcttcctgtatctgctacatgctgaacaattggagtggcatggacatgaagaaggccatcacttacatcagacggtctatgctccttaaaattttccaatacacaaacttcgagaagaaccgaaactacatcctgtctacccaagaccgcctggtcggaggcttcgcaaaatggcctgacagtcatcccgatgctcttcatgcatattttggaatatgtgggctctccctgatggaggagtcaggcatttgtaaggtgcaccccgccctcaatgtgagcacacgtacaagtgagagactgctcgacctacaccagtcctggaagaccaaggacagtaagcagtgttctgagaatgttcatatttctacatag

SEQ ID NO: 50313 - DNA, 1134 bp, Artificial Sequence
  Description of Artificial Sequence: Synthetic coding sequence
atggccgccaccgaggacgagcggctggccggcagcggcgagggcgaacgactggatttcctgcgtgatcgacacgtccggtttttccagaggtgcctgcaggtcttgccagagcgctatagcagcttggagacatctcgtttgacaatcgcgttcttcgccctttcgggtctagacatgcttgacagcttggatgtcgtgaacaaagatgatattattgaatggatctatagtctgcaggtactgccaacggaggatcgcagcaaccttaaccggtgcggctttcgggggtcctcctacctaggtatccccttcaacccctctaaggccccaggaaccgctcatccatacgactccggtcacatagccatgacatacactggcctgtcctgcctggtgattcttggcgacgatctgtctagagttaataaggaggcgtgtctggctggcctgcgagccctgcagctggaagacggttccttctgcgctgtgcccgaagggtccgaaaatgatatgcgattcgtatattgtgcctcttgtatttgctatatgctgaataattggtcagggatggatatgaaaaaagccattacgtacattcgacggagcatgtcctacgataatggcctggcccagggcgctggcttggagagccatggtgggtcaactttttgtggcattgcatctctttgtctgatggggaagcttgaggaagtgtttagtgagaaggaactcaaccggatcaagagatggtgcattatgagacagcaaaatgggtaccacggcaggcccaacaaaccggtagacacttgttactccttttgggtgggcgcaacacttaagcttctgaaaattttccagtatacgaacttcgagaaaaatagaaattacatcctctcaacacaggaccgattggttggtggttttgctaagtggccagactctcaccccgatgccctgcatgcatacttcgggatatgcggtttgtctctaatggaggaaagtggaatttgcaaggtccaccctgctctgaacgtgagtacacgcacctccgaacgattgttggatctgcaccaaagctggaagactaaagatagtaaacagtgttcagaaaacgtgcacatatccacctag

SEQ ID NO: 50314 - DNA, 1011 bp, Artificial Sequence
  Description of Artificial Sequence: Synthetic coding sequence
atgtgggtgcggaccaccctgaccatcgagcggtggaccaaggagaaaactgaacccaaagcgaggtcctgggatgaaagtcgttgtcggggtgactgtaaagaaccagacaagtgctgctggcggcataagcagtgcaccggccatatcatctaccccttcgcaagtgactgtgtgcggcattctttgcatctgcactctgtgaaccactgtaattgcaactccaggctgaaagactcaagtgaagattcatctagcagcagaggcgccgggccaacatgctcacatgtcatcgagtctccctgtttcgagctcacgcctgaggaagagcacgttgagcgattcagatatggctggtgcaagtcttatagacctgtgagcgttgcggtgatccatcatccattatatcatgaatgcggagctgatgaccttaatgaggaggaggaggaagaagaggaagaatctaagccccctattccgacccaggtgggcccagctaccgccagtccagatctgggaacgtcgatggccacgggcacacctgacagcaccgcccccattacaatctggaggtcagaaagtccaaccgggaaggggcagggctccaaggtgattaaaaaagttaaaaagaagaaagaaaaggaaaaggacaaggaagagatggacgagaaagccaaactgaagaaaaaggccaagaaaggacagcttacgaagaaaaagagccccgtgaaacttgaaccttcaccccctgatgtgtcgcgatccctctctgcaagacagctggctaggatgtctgagagtagccctgaaagcagagaggagctcgagagtgaggactcctataacgggcgaggccagggggaactgtctagcgaagatatcgtagaatctagcagtccccgaaagcgcgaaaataccgtccaggccaaaaagacaggcgccaagccgtcgcaagctaggaaggtgaacaagagaaagtcacctcccggatcaaacccaaatctctcttag

SEQ ID NO: 50315 - DNA, 1095 bp, Artificial Sequence
  Description of Artificial Sequence: Synthetic coding sequence
atgtgggtgcggaccaccctgaccatcgagcggtggaccaaggagaagactgagcctaaggcccgtagttgggacgaggccctcagcgacgtgaaccggctgccttcctgggaacgggggcacctcctggccggagtagcgtctagtacagacgtctcaacattttctgaggcaggggattgcaaagagccagacaaatgctgctggaggcacaaacagtgcacaggtcacattatctatccattcgcttcagattgtgtgcgtcattccctccaccttcactccgtcaatcattgtaactgcaactctcggctgaaagacagttcagaagactccagctccagccggggagcaggcccgacctgctctcatgtcattgaaagtccttgttttgagctcaccccagaagaagagcacgtggaacgcttcaggtacggatggtgtaagagctacagacctgtaagcgtggccgtaatacatcacccactgtatcatgagtgcggtgctgacgacctcaacgaggaagaggaagaggaggaagaagaaagtaaacccccaatacccacacaggtcggacccgccactgcaagccctgatctgggtacctcaatggcaaccggaacgccagattctaccgccccaatcaccatttggcgttccgagtcacctactgggaagggtcaggggtccaaggttattaaaaaagtcaagaagaaaaaggaaaaggagaaggacaaagaggaaatggatgagaaggccaaactcaagaagaaggcgaagaaaggtcagctaactaagaagaagagccctgtgaagctggagcccagcccacccgatgtgtccagatctctttccgcccgccaactcgcccgtatgagcgaaagcagccctgaatcccgggaagagctggagtcagaggattcctataatggccggggtcagggcgagcttagctccgaagatatcgtggagagttctagtccgcggaaacgcgaaaataccgtacaggctaaaaaaactggcgcaaagccctctcaagctcgaaaggtaaacaaaagaaagagccctcccggatctaacccgaatctgagttag

SEQ ID NO: 50316 - DNA, 462 bp, Artificial Sequence
  Description of Artificial Sequence: Synthetic coding sequence
atgagcatcacctacgtgaaccggctgcccagctgggagcggggccatctactcgccggggtcgcatctagtacagacgtctcaacgttttcggaaggcgattgcaaggagcctgacaagtgctgttggcgtcacaagcaatgcaccggacatatcatctatcccttcgcaagtgattgcgtgcggcacagtctgcatcttcactctgtcaatcattgcaactgtaacagccgcctcaaagactcctccgaggactcctctagcagtaggggggcagggccgacttgcagccatgtgatagagtccccatgctttgagctcaccccggaggaggagcatgttgagcggttcaggtatggttggtgcaagtcgtaccgacccgtcagcgtggcagtcatacatcaccctctctaccatgagtgcggagcagacgacctaaatgaggaggaggaagaggagtag

SEQ ID NO: 50317 - DNA, 1017 bp, Artificial Sequence
  Description of Artificial Sequence: Synthetic coding sequence
atgagcatcacctacgtgaaccggctgcccagctgggagcggggccatctgctcgctggcgtggcctcatcaactgatgtcagcacattctctgaaggcgactgtaaggagcccgacaagtgctgctggaggcacaagcagtgcaccggccatatcatatacccattcgcttctgactgcgtacgacacagcctccacttgcatagcgtgaaccactgcaactgcaattccagactgaaggattccagcgaggattcctcctcatccagaggtgcaggccccacttgttcacacgtaattgagagcccatgttttgagctgacgccggaagaggaacatgtggagcgctttaggtacggttggtgtaaatcgtaccggcccgtgagcgtggctgtaatccatcatcccctttatcatgagtgtggggccgacgatcttaacgaagaggaggaggaggaagaagaagaatcgaagcctcctatacccacacaggttggtccggctacagcctcacccgacctcggcaccagtatggctacagggaccccagactccacggcaccgattacaatctggcggtcggagtcacccacgggcaaagggcagggaagtaaggtgatcaagaaggtaaagaaaaagaaagagaaggaaaaggataaagaagagatggacgagaaggcaaagttgaaaaagaaagcaaaaaaaggccaacttacgaagaaaaaatctcctgtcaagctcgagcccagcccacccgatgtgtcacgaagcttgagtgccagacagctcgcaaggatgagcgagagtagtcctgagtcccgggaggagctggagagtgaggattcttacaacggacgagggcagggggagctatcttccgaggatattgtagaaagctctagcccccgtaagcgcgaaaatacagtgcaggctaaaaaaacgggtgcaaaacccagccaggctaggaaggtcaataagcggaagtcaccgcccggttccaacccaaatttgtcctag

SEQ ID NO: 50318 - DNA, 303 bp, Artificial Sequence
  Description of Artificial Sequence: Synthetic coding sequence
atgggcatcagcgaggagggcaacctgctgagcaccgtgagccccacagtaaaagctctttttggcaaaacgagagtctcacccatttttccctttagcccccgctccccattccaaccgctgatacctcgaacacccgggagtccttggggccccgtaggaccggcctctccacttggtccaggcttccccataggacctatgggccctggtaagccggtcggacccaagggtccaatgctgcctctgggaccaagcggcccggttggccccaccagtcccctcttcccattctgcccctag

SEQ ID NO: 50319 - DNA, 315 bp, Artificial Sequence
  Description of Artificial Sequence: Synthetic coding sequence
atgatgagcaccgagcagatgcagcccctggagctgagcgaggaccgcctggataagcttgatcctcgctgtagtcacttgggcgtatttagcgagcacctgatcaaacgttacgatgtacaggagcgtcaccccaaagggaagatgattcccgtgttgcacaatactgacctcgaacagaagaagcctaggcggaaagacaccccagcattacatatgagcccttttgcagccggcgttacactgctcagagatgaacgccccaaagctatcgttgaggatgatgagaaggatggggataagattgccatctag

SEQ ID NO: 50320 - DNA, 2400 bp, Artificial Sequence
  Description of Artificial Sequence: Synthetic coding sequence
atggcccggaccgcccccgtggagccccccctgcggcacagcgcccctccatctcccgctgccggggagcccaggacatccgttgaggcggctgtggctccccgccgagtgttgtttgctgatgaagcccttggccttccattggctcagctgaggcggtaccggccttggggaggcccaggagcggggaaaatggccgccgcagccggccaggatggggggggcggggggggtgcagatgaagacgatgacggagaggacggcgacgagggggaggaggaagaggaggcatgccccgaaccttcccccttgtgcccggtgccagccggtgggggattctacctagtgccgacgttcagcctacctcctgcacccggacgcctggaacggctgggtagagtaatggtggagctggaagccttactgcccccccctggagccgtcccaggaggagctggtgtatgggtcccgggcggtcggccccccgtcctgagggggcttgtccgagtgctcaatcgatccttcgaaaaggccgtccacgtacgggcctcacatgacgggtgggcctcattctgtgatcaccccgctcgatatgtccctcgcagccctccatgggcgggggccggcggaacaggcgctggggaccctattctggatcccggattgggactgggacccgggcaggctagtgccagcagtcctgacgatggaggccggaccgaccggttcgcctttcagctgccctttgcggaaggtgcaggagatggtgcgcggctggactttgttgtgcgctacgaaactccggaagggacattttgggctaacaaccacggacgcaactacacggtcctcctgaggattgcccccgctcctactccaacagatgccgagggactgccccagcagcaacagctgcctcagctcgagcctcagcccgaatgtcagggccccgtagaagccgaggctcggcagctgaagagttgtatgaagcccgtcagacggaggcctgccgaggaggaacttaaaactaagaacatggacgataatacctttgccatggccgagcaccccgatgtccaggaaagcgtgggccccctggtggccccaacgccattgcgcccttggccacagatgaccctgcaggtcagcgatgttcccatgactggtaatccagctgaagaaggagatgtgccccggtctagtcctccagtggcattcacagaggtcctccaggcgccagccatccgaattccgccctcatcaccgctctgcgggcttgggggcagccctcgggatcaagcttcaggcccagatgcgtctgaaggcgcaacaggaccattcttggaaccaagccagcagcaggcggaggcaacctggggcgtttctagcgagaatggaggcggcctggaagcagtgtccggttctgaggagcttctgggagaggacaccatcgaccaggagctggagcaactgtacctgagccatctttcaaggttacgggccgccgtggctgcaggaggcgctggtggaggaggagaaggatccactgatggggggatgtctccctctcacccccttggcatcctcaccgatagggatctgatcctgaagtggccgggcccagagcgtgctttgaattcggccctggcggaagagataactctccattatgctcgcttgggtaggggcgtagagctgatcaaggacacagaggatcccgacgacgagggtgagggagaggaaggtctctccgttaccccctcctccccagagggagatagtcccaaggagtcaccacctgaaattctgtccggcgcgcgaagcgtagtagcaaccatgggggatgtttggctgccctgggcagaaggctctgggtgtgatggtcccgttgtgctggggacggaaggccagtttatcggtgaccccgagaaaggaatgggcaaggacactagctctctccatatgaatagagtcatagccggcgtaaccgagtcgctgggcgaggccggcaccgaggcacaaatcgaagttacatcggagtgggccggttctctggacccaatctcgggtaaagagccagcttcaccagtgttgctgcagggccagaacccgactctgctgtccccgctcggcgcagaagtctgcttgtcctctgtcgctagaccccacgttagcagccaggatgagaaggacgctggcccttctctggaaccccctaagaagagtcccacacttgccgtgccagccgagtgtgtgtgtgctttgccgccacaactcaggggccctttaactcagactttaggtgttctcgctggactggtggtggtgccagtcgctcttaattccggagtgtctctgctggtgctcgcactctgcctgtctctggcctggttcagctag

SEQ ID NO: 50321 - DNA, 468 bp, Artificial Sequence
  Description of Artificial Sequence: Synthetic coding sequence
atgatgagcaccgagcagatgcagcccctggagctgagcgaggaccggctagataaacttgatccccgctgctctcacttggacgatctgtcagaccagtttattaaggactgcgatcttaagaaaaagccgagaaaaggaaagaacgtccaagctacactgaatgttgagtctgaccagaagaaaccaaggcgcaaggacactccggctctgcacattccaccattcataccaggagtgttcagcgagcacctgatcaaaaggtatgatgtgcaggagcgccaccctaagggcaaaatgatccctgtgctgcataacactgatctggagcagaaaaaacctagacgcaaagacacccccgcactccacatgtctccatttgccgctggggtcaccctactacgcgacgagcgacccaaggccattgtcgaagatgatgagaaggacggagataagatagccatttag

SEQ ID NO: 50322 - DNA, 1842 bp, Artificial Sequence
  Description of Artificial Sequence: Synthetic coding sequence
atggccaccatccccgactggaagctgcagctgctggcccggcggcggcaagaggaagcctctgttcgcgggagggagaaggcggaaagggagcgtttgagccaaatgcctgcctggaaacggggcctgctcgagcggcgtcgtgcaaaactgggactctcacccggtgagccgtcacctgtccttggaactgtcgaggccgggccccccgaccctgatgaaagcgcggtgctgctggaggctatagggcccgtccaccagaatcggtttataaggcaggagcgacaacaacagcagcaacagcagcagagatccgaggaactgttggccgagagaaaacctggtccccttgaggcccgggagcgacgtccctcacctggggaaatgcgggatcagagccccaaaggccgggagtctagagaggaaaggctgtcgccccgggaaaccagggagagaagactcggtatcggaggagcacaggaactgtccctccgcccactcgaggccagagactggcgtcagagcccgggcgaggtgggggacaggtctagcaggctctccgaagcctggaaatggcgactatcccccggcgaaacaccggagcggagcttacggctggccgaaagccgggagcaatcgccacggagaaaggaggtggaatcaggtttatcgcctggagaatccgcataccagaagcttggactcacagaagcccacaaatggcgaccagatagtcgggagtcccaagaacagagtctggtccagctggaggccacggaatggagactgcggagcggggaagagcgccaggactattctgaagaatgtggaagaaaggaggagtggcctgtgccgggtgtggctcctaaggagactgcagaactgagcgaaacgctgacccgggaggcacaggggaacagctctgcaggcgtggaggctgctgagcagcgccccgtcgaagacggagaaagaggcatgaaacctaccgaaggctggaaatggaccctgaactccgggaaagcacgcgagtggaccccacgggacattgaagcccagacccagaagccggagcccccagagagtgccgagaagctactggagtctccaggcgtagaggcaggagagggggaggctgaaaaggaagaagcgggtgcacaagggagaccactgcgagctctccaaaactgctgttctgtaccgagcccacttcctcctgaagacgccggcactggcggtttaagacaacaggaggaggaggccgttgaactccagccacccccccctgcaccactgagcccaccacctcccgccccaacggcaccacagcctccgggtgacccactgatgtcaaggctcttctatggagtcaaagccggacctggggttggcgctcctcgcagaagtgggcacactttcaccgtgaaccctcggaggtcggttccgccggccacgcctgcaaccccaacctctcctgcgactgtagatgcagccgtgcccggcgctggaaagaaaagatatcccaccgcagaggaaatcctggtgctcggcggatatttaagattgagcagatcttgtctggcaaaagggtctccagaacgccaccataagcagttgaagattagcttctccgagactgcgcttgaaacaacttaccagtatccatccgaaagctccgtcctggaggagctcggccctgagcccgaagtgccgtccgccccaaatccaccagccgcccagccagacgatgaagaagacgaggaggaactattgctgctgcagcctgagctgcagggtgggcttcgaaccaaagctttgatcgtagacgagtcttgccgacgatag

SEQ ID NO: 50323 - DNA, 1842 bp, Artificial Sequence
  Description of Artificial Sequence: Synthetic coding sequence
atggccaccatccccgactggaagctgcagctgctggcccggcggaggcaggaggaagcgtccgtccgcggaagggaaaaggctgaaagggagaggctgagccagatgccagcttggaagaggggactgctggagcgccgacgagctaagcttggattaagccctggcgagccctctcctgttttaggcactgtggaagccggccctccggacccagatgagtccgcggtgctgctggaggcgatcggccctgtgcatcagaatagattcattcgccaggagcgacagcagcagcagcagcagcagcaacgttccgaagagttgctcgctgagagaaaaccagggccactcgaggcccgcgagcggcggccctcccccggagagatgagagatcagagtccaaaggggagggaatcccgggaagagagactatccccacgggagacccgggaaaggagactgggcatcggcggcgctcaggaactttccctccgtccgcttgaggctcgcgattggcgacaaagtcctggtgaggttggagataggtccagccggctgtccgaagcatggaagtggaggttgtccccgggggaaacccctgagaggtcactgcgccttgccgagtcccgagaacagtcccccaggcggaaagaggtggaaagcggcctgagtcccggcgagtccgcttaccaaaaattggggctcaccgaggcccacaagtggaggcccgactccagggagtctcaggagcagtctctcgtgcagcttgaggctaccgagtggcggttgcgcagcggtgaggagagacaggactattcagaggaatgcggccgtaaggaagagtggccggtcccgggggtggcacccaaagaaacggctgaattgtcagaaacgctgaccagggaggcccaaggtaactccagcgcaggggtagaggccgctgagcagagacccgtagaggatggagagaggggaatgaaaccgaccgaggggtggaagtggacactgaattccggcaaggcacgggaatggacccctcgcgacattgaagcccagacccaaaaaccagaaccccccgagagcgccgaaaagctcctggagtcccctggcgttgaggcgggagagggcgaggccgagaaagaagaagcgggggcgcaggggcgcccactccgagcattacaaaactgttgtagcgtgccatcccccctgccaccagaggatgccggcaccgggggcctgcgccagcaggaagaggaggctgtggaattgcagccaccgccacccgctcctctctctcctccgccacccgctccgacggccccgcagccgccaggtgacccactgatgagcaggctgttttatggtgtaaaagccggacctggagtgggggctccacggaggtctgggcacacgtttaccgtcaatcctcggaggtccgtcccccccgccactccagccacacctacatctcccgctaccgtcgacgcggctgtgccaggcgccggtaaaaagagatatcccacagccgaagaaatcctagttcttggagggtacctgcgattatcaaggagttgtcttgccaaggggtcacccgagcggcaccacaaacagcttaaaatttcttttagcgaaactgcgctggagacgacctatcagtacccctctgaatccagcgtgctggaagagctgggccctgagccggaagtgcccagcgctcctaacccaccagcagctcagcccgatgacgaagaggacgaggaggaactccttctgctgcagccagaactacagggaggcttgaggactaaggcacttattgtcgacgaatcctgccggcggtag

SEQ ID NO: 50324 - DNA, 1842 bp, Artificial Sequence
  Description of Artificial Sequence: Synthetic coding sequence
atggccaccatccccgactggaagctgcagctgctggcccggcggcgccaggaggaagccagtgttaggggtcgagaaaaagctgaaagagagcgcctgtctcagatgccagcatggaagagggggcttctggaacgcagaagagccaaactgggtcttagtccaggagaaccctcccccgtactaggtactgtggaggcagggcctcctgatccagacgagtcagctgtgctgttagaagccataggtcctgttcatcagaaccgctttatcaggcaggagcgccaacaacaacaacaacagcagcaacggtcagaggaattactagccgagcgcaaacctggaccactggaagctagggaacggaggccaagtcccggcgagatgcgtgaccagtctcctaagggaagagaatcaagggaagagcgcctgtccccaagggagacgagggagaggagacttggcattgggggcgcccaggagcttagcctgcgacctcttgaagcccgggactggaggcaatcaccaggtgaggtcggcgaccggtcatccaggctgtccgaggcttggaagtggcgcctgtcgcctggcgagactcctgaacgctccctgcgtctggcagagagtcgggagcagtccccaaggcggaaggaggtggagtcaaggctgagcccaggggagagcgcataccagaagctggggctgacagaagctcacaaatggaggccggattctagggaatcccaggaacagagcctggtccagttggaagccacagagtggcgcttaaggtccggagaggagaggcaagattactccgaggagtgcggtcgcaaggaggaatggcctgttcccggtgtcgcccctaaggagacagcagaactcagcgaaacactgaccagagaggcccagggtaatagcagcgccggtgtggaagccgcagagcaacgcccagtggaggatggggagcgaggcatgaaacccacagagggatggaaatggacactaaattccaggaaggctcgtgagtggactcctcgggacattgaagcccaaacccaaaagcccgagccacccgaatcagctgagaaactgttggaaagccccggcgttgaggcaggggagggcgaggccgagaaggaagaagctggggctcagggtcgacccctgagggccctgcagaactgttgcagcgtgcctagcccactccccccagaggatgccggcacgggggggctgcgccagcaagaggaggaggctgttgagctacaaccccctcctccagctccactttccccacccccccccgcccccactgccccacagccccctggcgacccgctgatgagcaggctgttttacggggtgaaggctggtcccggcgttggggctccgaggcggtctgggcatacatttacggtgaatccaaggcgctctgttcctcccgcaactcccgctacaccgacttccccagcaaccgtcgatgctgcagtgcccggggccggcaagaaaaggtatcccaccgccgaggagattctggtcctgggcggttacctccggctatctcgctcatgccttgctaagggatcaccagaacgccaccataaacagctgaaaatctcctttagtgaaacagctctggagaccacttaccaatatcctagcgaaagcagcgtcctggaggaactgggcccggagccagaggtccccagtgctcccaatccccctgcagcacagcccgatgatgaagaggatgaagaagagttacttctgcttcagcccgagcttcagggaggactgaggacaaaggccctgatcgtggacgagtcctgccggagatag

SEQ ID NO: 50325 - DNA, 231 bp, Artificial Sequence
  Description of Artificial Sequence: Synthetic coding sequence
ctgaagatcagcttcagcgagaccgccctggagaccacctaccagtacccttccgagtcgtctgtgcttgaagaactgggcccggaaccagaggtgccttcagccccgaatcccccggccgctcagccagacgacgaggaggacgaagaggaactcctgttgctgcagcctgagctgcaaggggggctgcgcacgaaagctctcattgtcgacgagagctgcagaaggtag

SEQ ID NO: 50326 - DNA, 1842 bp, Artificial Sequence
  Description of Artificial Sequence: Synthetic coding sequence
atggccaccatccccgactggaagctgcagctgctggcccggcggcggcaggaggaagcatccgtccgaggcagagaaaaggctgagagagagcgcctctctcaaatgccagcttggaaaaggggtctcctcgagcggagaagagccaagctcgggctgtctcccggcgaaccgagcccagtattgggaaccgtagaagccggtccacctgacccagacgagagtgcagtcttgctagaggccatcggccccgtgcatcagaatagattcattcgacaggagaggcagcaacaacaacagcagcagcagaggtctgaggaactgctagcggaaaggaaaccggggcccctagaggcccgggaacgcagaccttcccctggcgaaatgagggaccaaagtccaaaagggagggaaagtagagaggaacgcctgagtccacgagaaacaagagagcggaggctggggatcggcggtgcccaggagctttctctccggcctctggaggcccgtgattggaggcagagcccaggggaggtcggggatcgctcatcacgattaagtgaggcctggaaatggcggctgagcccaggagagactcccgagcgctctctgcgccttgccgagtcacgtgaacagtcccctaggagaaaagaagttgagtcacgcttgagtcctggcgaaagtgcctatcaaaagcttgggctgaccgaggcccacaagtggcgccccgactcgcgcgaaagccaggaacaaagtctggtgcagctggaagcgacagagtggaggttgcggagtggagaggagcggcaggattactcagaggagtgtggacgcaaagaagaatggcccgtccccggggtggcccccaaggaaacggctgaactctcggaaaccctgacaagggaggctcaaggaaactcttctgccggggtggaggctgccgagcagcggcctgttgaggacggggaaaggggcatgaaacccactgaagggtggaaatggaccttaaattcacggaaggcgcgcgagtggacccctagagacatcgaagcccagacacaaaagcccgaaccccctgagtccgcggagaagctgctggagtcaccaggagttgaagcgggagagggagaggccgagaaagaggaggcaggagctcaaggtcggcctctcagggcgcttcagaattgctgtagtgtgcctagtcctctgccccccgaagacgccggcaccggcggtctgaggcagcaggaggaggaggctgtcgagttacaacctcccccgccggctccactgagcccgcccccaccggccccaaccgccccacagcctccaggggatcctctgatgtctaggctcttctatggagtcaaagccggaccaggagttggggccccgcgccgctcaggccacacttttactgtgaacccaaggcgcagcgtccccccagctactccggcaacccccacatccccggcgacggtggatgcggctgttcccggggccgggaagaagcgttaccccaccgcagaggaaatcttagttctgggaggatatcttagacttagcaggtcctgtctggcaaaggggagccccgaaagacaccataagcagcttaaaatttccttctctgaaacggctctggaaactacttaccagtaccctagcgaatcctcggtgctggaggagttgggcccggagcctgaagtcccttccgctcctaacccccccgccgcacaaccggatgacgaggaggacgaggaagagctcctgctgctacagccagaactgcaaggagggctgagaacgaaagctcttatcgtggacgagagttgccggagatag

SEQ ID NO: 50327 - DNA, 231 bp, Artificial Sequence
  Description of Artificial Sequence: Synthetic coding sequence
ctgaagatcagcttcagcgagaccgccctggagaccacctaccagtatccatctgagtcctctgtgctggaggaactgggccctgagccagaggtgccatccgctccaaatccacctgccgctcagccggacgacgaagaggatgaggaggagctgctcttgctccagcccgagctccagggcggtttgaggactaaagctttaattgttgacgaaagttgtcgcaggtag

SEQ ID NO: 50328 - DNA, 1134 bp, Artificial Sequence
  Description of Artificial Sequence: Synthetic coding sequence
atggccaccatccccgactggaagctgcagctgctggcccggcggagacaggaagaagcctctgtccgaggccgggagaaagctgagcgggagcgactctctcagatgcctgcctggaaacgggggctgctggagaggcgcagggctaagttaggactgtctcccggggagccctcccccgtgctcggaactgtggaagccggtcctccagatccggatgaaagcgctgtgctgctggaagccatcggaccagttcatcaaaaccggtttatcagacaggaaaggcagcagcagcaacaacagcagcaaagatcagaggaactgctggccgaaaggaagcctggaccactggaagccagggaaaggagacctagccctggcgaaatgcgcgatcagtccccgaagggtcgggaatcgagggaggagagactgagccctagagagacgcgagaacgaaggctgggaattggaggggctcaggagttgtccttacgtcctttggaggcccgtgactggcgccagtctccaggggaagttggagatagaagtagccgactttctgaagcatggaagtggcggctttcgcccggcgagactcccgagcgttcgctgaggctcgctgagtcacgtgagcaaagtccccggaggaaggaggttgagtcccgcctgtctcctggcgagtctgcttatcagaagctcggactcacagaggctcacaagtggcggcctgacagccgggagtcacaggaacaaagtcttgtccaattagaggccaccgagtggcggctgcgaagtggagaggagcggcaggactacagtgaggagtgcggacggaaagaggagtggccagtgcctggcgttgccccgaaagagaccgccgaactgagtgagacactgactcgggaggcacaaggtaactcatcagctggagtcgaggctgcagaacagcgacccgtggaggacggcgaacgaggtatgaagcccactgaaggctggaagtggacgctgatcatgagcctcgccggcaaggggaaccagcacctcgttacatgctttcctcaccccgtctcaggaggtagggctaactgtcccatcagtacccttatacagtcaccatggtgtggctggggctag

SEQ ID NO: 50329 - DNA, 1134 bp, Artificial Sequence
  Description of Artificial Sequence: Synthetic coding sequence
atggccaccatccccgactggaagctgcagctgctggcccggcggcggcaagaagaggctagcgtacggggcagagagaaggccgaacgggaaagactatcccagatgcctgcctggaagagaggtctccttgagcgtaggcgggctaaactgggcctaagccctggtgaaccctctccagttctgggaacagtggaagcgggtcctccagaccccgacgagtcggcagttcttctcgaggctatcggtcccgtccaccaaaatcggttcattcgccaggaacgccagcagcagcagcagcaacagcagaggagcgaagaactgctggcagaacgaaagcctggacctctcgaggccagagaacgccggccatctcccggcgagatgagggatcaatcccccaagggcagagaatcaagggaggagcggctgagccctagagagaccagagaaaggcggttgggcataggaggcgcacaagaattgtcattaagaccactggaagcgagagattggaggcaatcccctggtgaggtgggcgaccgttcttcacgcctgtctgaggcttggaagtggcgcctgtctcctggagagacccccgaaagaagcctgaggctggctgagtcccgcgagcagtccccacgtagaaaagaggtcgagtccggactgagtccaggcgagagtgcataccagaagctggggcttacagaagcccataagtggagacctgatagcagggaatcccaggagcaatccctcgtgcagttagaggctacagaatggcgtctgcgatccggggaggaaaggcaagattacagcgaggaatgcggtcggaaggaagaatggccagttcccggtgtagccccaaaggagactgcagaactctccgagaccttgactagggaagctcagggcaactcctccgccggtgttgaggccgctgaacagcgtcctgtggaggatggcgaaagaggcatgaaaccaacagaggggtggaaatggaccctgatcatgagcctcgcgggcaagggaaaccagcatttagtgacctgctttccccacccagtcagcggaggtagagccaattgccccatcagcactctgatacagtctccctggtgcggttggggttag

SEQ ID NO: 50330 - DNA, 2310 bp, Artificial Sequence
  Description of Artificial Sequence: Synthetic coding sequence
atggccagcgccgagctgcagggcaagtaccagaagctggcccaggaatactccaagctcagagcccagaaccaagtcctgaaaaagggcgtggtggacgaacaggctaatagtgccgcattgaaagaacaactaaagatgaaagaccagagcctgcggaaattgcagcaagaaatggacagcctcactttccggaatcttcaactggctaaacgtgtggagcttctgcaggatgagctggccttgtctgagcctcgcggtaagaagaataaaaagtccggagagtcttcttcgcagttgagtcaagagcagaaatcagtattcgatgaagacctgcagaaaaagatcgaagaaaacgaaaggctgcacatccaattctttgaagctgacgagcagcacaagcacgtagaggcggaactgagaagccgtttggccacgctcgaaacggaagcagcccagcatcaggctgttgtagatggactcacccgcaaatatatggaaaccatcgaaaagctgcaaaatgataaggcgaaactggaggtcaagtctcagacactcgagaaggaggcaaaagagtgccgcctccgtactgaggaatgccagctccaacttaaaaccctgcacgaagacctgtccggccgactggaagagagtttatccattattaacgagaaggtgcccttcaatgatactaagtacagccaatacaatgcgctgaatgtgcctctgcataatcgcaggcatcagttaaaaatgcgtgatatcgcagggcaggcactcgcgttcgttcaggacctggtaacagctctcctcaacttccacacttacacagagcaaagaatacagatctttcccgtagactctgctatagacactatttcacccctcaaccagaagttttctcagtatctccacgagaatgctagctacgtgcgcccgttagaggagggaatgctccacctcttcgagagcataacagaggacacagtgacagtccttgagaccacagtgaagctgaagacgttttcggaacacctgacttcatatatatgtttcctgaggaagattctgccttatcagctcaaaagtctcgaggaagagtgcgaatcaagtctttgcacatccgctctcagggccagaaatttggaactgtctcaggatatgaaaaaaatgacggccgttttcgaaaaactgcagacatatatagccctgctagccctgccttccaccgaacctgacggcctattgcggacaaattacagcagcgtcttaaccaatgtaggggcagcactacacggtttccatgacgtgatgaaagacatatccaagcactatagtcaaaaggccgcaatagaacacgagctgcctacagctactcaaaaactgatcactaccaatgactgtatcctatcttccgtggtggcattgacaaacggggccggcaagatagcctcctttttctcaaataatctcgattacttcatcgcaagcctaagttatggacccaaagcggctagcggctttattagccctctgtctgccgaatgtatgttacagtacaagaagaaagctgcagcttatatgaagtccttgcgcaaacctttactagagtctgtcccatatgaggaggcactggctaataggcggatcctgctgtctagcacagagtcaagggagggactagcccaacaagtacagcagtcccttgaaaagattagtaagctcgaacaggagaaagaacactggatgttagaggctcaactcgccaagatcaaactcgagaaggagaaccagcgtattgcagacaagctcaagaatacaggctccgcccagctagtcggactcgcccaggagaatgctgccgtcagtaatacagccggacaggacgaggctacagccaaggccgtccttgaacccattcagtcaacatcactcgtcccagatgtcgagagcagagaagatctaatcaagaatcactacatggccagaatcgtcgaacttacgtctcaattgcagttggctgattccaaatcagtccatttttacgctgaatgccgcgcactgtccaagagattggcgctggctgagaaatccaaggaggcgctgaccgaggaaatgaaactggcctcacagaacatttcccgcctgcaagacgaactcaccaccacaaagaggtcttatgaggatcaactgtcaatgatgtccgaccatttatgctctatgaacgaaaccctgagtaagcaacgggaggagatcgatacacttaagatgagttccaagggaaactcaaaaaaaaataagtctaggtag

SEQ ID NO: 50331 - DNA, 2343 bp, Artificial Sequence
  Description of Artificial Sequence: Synthetic coding sequence
atggccagcgccgagctgcagggcaagtaccagaagctggcccaggaatactctaagttaagagcacagaatcaggtccttaagaagggagtcgttgatgagcaagcaaattctgctgcattgaaagaacagctcaaaatgaaagaccagtctctgcgcaagctccagcaggaaatggattcactcacgttccggaatctccagttggctaagcgcgttgagctgttacaggacgagctggccctgtcagaacctagggggaagaagaacaagaaaagcggggagagctcttctcagctctcccaagaacaaaaatctgtgtttgatgaagatctgcagaagaaaattgaggagaatgaacgcctgcacatccaattctttgaggcggatgaacagcataaacacgtggaagcggagctcagaagccgattagccacattggagactgaagcggcgcaacaccaggcagtcgtggacgggctcacccggaaatatatggaaaccatagaaaagctccaaaatgacaaggctaaactagaggtaaagtctcagactctggaaaaagaggccaaggagtgccggctgcggacagaggaatgtcagctgcagctcaagacccttcacgaggatctttccgggagactcgaagagagcctgtctatcattaatgagaaggtaccattcaatgataccaaatactcccagtacaacgcactgaacgtaccactacataatagacgccatcagcttaaaatgagggacattgcaggtcaggccctcgcgtttgtccaggacctggtgactgctctgctgaattttcacacctacaccgagcagaggatacagattttccccgtggactctgcaatcgacacaatttcccctttaaaccagaagttcagccagtatctgcacgagaacgccagttacgttcggccgcttgaggagggaatgttacacttgttcgaatcaatcaccgaggacacagtgaccgtcctcgagaccactgtgaagttgaagacattttccgagcatctcaccagctacatctgtttcctgcgcaaaatattgccttatcagctcaagtcactcgaggaagaatgcgagtcctcactctgcacaagcgcactccgggcgcgcaacttggagttgagccaggacatgaagaagatgaccgcagtgtttgaaaagctgcagacctacatcgctctgctagccttgccttcaactgagccggacggcctgcttagaaccaattatagtagcgttcttacaaacgtaggagcagcactccatggttttcatgacgtaatgaaggacatttccaagcactactctcagaaagcggctatagagcacgagcttccaaccgccacacagaaattgattacaactaatgattgtatcctgtctagcgtagttgcccttaccaacggagcaggaaagattgcgagcttctttagcaataacctggattacttcatcgcgtcgctctcctatggcccaaaggcggccagcggcttcataagcccactgagcgctgagtgcatgctccaatataaaaagaaagctgctgcatacatgaaaagtctccgtaagccactgttagagagcgtgccttacgaggaagccctggcaaaccgtaggattttgttatctagcacggagagtagggagggcctcgcccaacaagtccagcagtctctcgaaaaaatctcaaagctggagcaagagaaggaacactggatgttagaggcacagctcgctaagatcaagctggaaaaagaaaatcagaggatagcagacaaacttaaaaacaccggaagcgcccaactagtgggactggctcaggaaaatgccgcagttagcaacactgctgggcaggatgaggctactgcgaaggccgttctcgagccaattcagtccaccagtttgatcgggactctgactagaacaagtgacagcgaagttcccgacgtggagtctagggaagacctgatcaagaaccactacatggcccgcatcgtagagctaacatctcagctccagctggctgattccaagtcagtacatttttatgcagagtgccgtgcactgagcaaaagactggccctggcggagaagtctaaagaagctcttacagaggaaatgaagttggcgtcacagaacatatctagactacaggatgagcttacgaccacaaaacgcagttatgaggatcagttgagcatgatgagcgaccacctgtgctccatgaacgaaacactttctaaacaacgcgaggagattgatacgctgaagatgtcctccaagggcaactccaagaaaaataaaagccgttag

SEQ ID NO: 50332 - DNA, 2217 bp, Artificial Sequence
  Description of Artificial Sequence: Synthetic coding sequence
atggccagcgccgagctgcagggcaagtaccagaagctggcccaggagtattcaaaactccgagcgcagaaccaggtgttgaagaaaggagtggtggacgagcaggccaatagcgcggcgctcaaggaacaactgaaaatgaaagaccagagccttcggaaacttcagcaagagatggattcccttactttccggaacctccaacttgcaaaaagggtggaactgttgcaggacgagctggccctgagcgagcctcggggcaaaaagaataaaaagtcaggtgagtctagcagccagttgtcccaggaacagaagtctgttttcgatgaggacctgcagaaaaaaatcgaggaaaacgagcgtcttcatatacaattcttcgaggcagatgagcagcacaagcacgtggaagccgaactgaggtcccggcttgcaaccctggaaacagaggccgcccagcatcaggctgtggtggacgggctgacccgcaaatatatggagacaattgagaaactacagaacgacaaagctaagctcgaagtgaagagccagactttagagaaggaggccaaagaatgccgccttcgaacggaagagtgtcaactccaattaaagactttgcacgaagacttgagtggcagactagaggaaagtttgagcattatcaacgagaaggtcccattcaacgacactaaatatagccagtacaatgcactgaatgtgccattacacaaccgacgtcatcagctcaaaatgagggatatcgccgggcaagcgctcgctttcgtacaggatttggttaccgctctactgaatttccacacgtataccgagcagcggattcagatctttccagtcgacagcgccattgatacgatttctccgctgaatcaaaagttttctcagtatctacacgaaaacgcctcctacgtcagaccccttgaggagggtatgcttcacttgttcgagtcgatcactgaggatacagtgacagtgctcgaaacaacagtcaaactgaagacgttcagtgagcaccttacgagctacatttgtttcctccggaaaattctgccctaccaactcaagagcctggaggaagaatgcgaaagctccttgtgtaccagcgccctccgcgcgagaaatctcgaactgtcacaggatatgaaaaagatgacggcggtgtttgaaaagctccagacatatattgctctgctggctctgccatccacagagcctgatggcctactgcgcaccaattatagttcagtcctaacaaatgtcggcgccgctctgcatggatttcacgatgtaatgaaggacatttccaaacactacagccaaaaagcagcgatcgaacacgagctgcccacagcaacacagaagttgataactactaatgattgcatcctgagctcggtggttgccctcaccaatggagctggtaaaatcgcttcatttttctctaataatcttgattattttattgcttctctcagttacggtcccaaagctgcctccggctttatatcacctctgtctgcagagtgtatgctccaatataagaaaaaagcggccgcgtatatgaaatccctaagaaaggttcaacaatccctggaaaaaatctccaagctcgagcaggaaaaggaacattggatgctcgaagcccagttagctaagattaagttggaaaaagaaaatcagcgtattgcagacaagctgaaaaacacaggctctgcccagctggtaggccttgcacaggagaatgctgccgtcagcaacaccgccgggcaggacgaagctaccgccaaggccgtgctagaacccattcagtcaacctcccttgtaccggacgtcgagtccagagaggatctgatcaagaatcattacatggcccgtatcgttgagctgacatctcaactccagttagccgattcaaaaagtgtgcacttttacgccgagtgcagagcactgtcgaagaggctagcgcttgccgagaagtcaaaggaggcgttaacagaagagatgaagctggcctctcagaatatctctcgattgcaagacgagttaacaacaacaaaaagatcttacgaggatcagttgtctatgatgtccgatcacctctgcagcatgaacgagacactgtccaagcagcgagaggaaattgacacacttaaaatgtccagtaagggcaactcaaagaagaataagtcacgatag

SEQ ID NO: 50333 - DNA, 465 bp, Artificial Sequence
  Description of Artificial Sequence: Synthetic coding sequence
atgcccagccggaccgcccggtacgcccggtacagcccccggcagcgccggcggcggatgctcgcagaccgatctgtaagatttcctaacgatgtcctgtttctggatcatataaggcagggcgacctggagcaggttggaagatttatacgtaccaggaaggtgtcactggcaaccattcatccttctggactcgccgcattacacgaagcagttttgagtgggaacctggagtgcgtgaaattgctcgtgaagtacggggcggacattcatcagagagacgaagccggttggacccctttgcatattgcctgttccgacgggtaccccgacattgctagatacctgattagccttggagctgaccgcgacgccaccaatgatgatggggacctgccctcagatcttatcgaccccgactataaagagcttgttgagttattcaaaggtactacgatggactag

SEQ ID NO: 50334 - DNA, 1278 bp, Artificial Sequence
  Description of Artificial Sequence: Synthetic coding sequence
atgatgggcaagctgcccctgggcgtggtgagcccctacgtgaagatgtcttcaggggggtacactgatccccttaaattctacgcgacatcttactgcacagcctacggccgggaagacttcaagccacgggtcggctctcacgtcgggaccggctacaaatctaattttcaacccgtggtatcttgtcaggctagcttagaagcattggataacccagcccgtggcgagcaggcacaagaccattttcagagtgttgcatcccagagttacagaccattggaggtgccggacggcaaacatcccctgccatggtccatgcggcagacctcctcggggtacggacgggagaagccttcagccggaccaccgactaaggaggttcgcaaagtgcacttcgatactcaagagcacgggcctcaggccattaccggactggaaccaagggaagtgccactgctccaccagcagcagggccaggatccccttgagagagaaaatttcagacacggaccccgttttatgacatccgaatataacagcaaatacctgcgagacccacttgatcaacctgactttcttcaaaagaaatctattggagcgaaggaagggtctggctttacgaaacagtcccatcaatcacctatcgttttccagccaccttcacaagccctccctggcgatcctgccctgctgcccggtcagagcgtgaccaagagcgactttctgcctaagacacatcttcacggggatgagttcctgcccgtcctggcccggggatcaaagcgggagaccgctttctcgagaggaaatgaacgtatcctgaacccccgagtcccccctccttgtccagagcccagtagcgtgagtcatcaacagttccagcctctgcacagaatgcagcagactaatgtagccctcttgggcagagagaccgtgggtaagaaggaacccacggggttttccctcaataaccccatgtatgtgcgttctccctgcgatcctgatcgtgaccagaggtatctcaccacctataaccaggggtacttcgagaacatccctaagggactcgatcaggagggttggactcgggggggcatccagccacaaatgccagggggctacgcactgtcacagccggtttcttgtatggaggctacacccaaccccatggaatcccttaggcacctacatccccatgtgggcagaaccctgaccagcgccgatcctttttaccagaacacacctcattcctctagatgcgtggcccacagttag

SEQ ID NO: 50335 - DNA, 1218 bp, Artificial Sequence
  Description of Artificial Sequence: Synthetic coding sequence
atgatgggcaagctgcccctgggcgtggtgagcccctacgtgaagatgtctagtggtggatacacagatcctctgaagttctacgctactagctattgcactgcatacggtcgcgaagatttcaaaccaagagttggaagccacgtgggcaccggctacaaatcaaattttcaacctgtggtctcctgtcaggcttcactcgaggctctcgataacccggcccggggagagcaggcccaagaccatttccaatcagttgcgtcccagagttacagaccactagaagtgccggacggaaagcatccgctgccttggtcgatgagacagacttctagtgggtacggccgcgaaaaaccttcagccggaccacccactaaggaggttaggaaagtacacttcgatactcaggagcacggccctcaggccattacaggacttgaaccccgggaagtgccactcttgcaccagcagcaggggcaggacccccttgagagagaaaactttcgacatggaccacgattcatgacgtccgagtacaacagcaagtatctgcgagacccgctcgaccagcctgattttctccaaaaaaagtccattggcgctaaagaggggtccggcttcacaaagcagagtcaccagagtcccatcgtgttccaaccaccaagccaggccctgcctggggatccaggggatgaatttctcccagtcctcgccagggggtccaaacgagagaccgcttttagccgaggaaacgagcgcatactgaacccccgggtccctcccccctgccccgagccctcgagcgtgagccatcagcaattccaaccactgcaccggatgcagcagacaaatgttgccctgctgggcagagagactgttggcaagaaagagcccacaggcttttcgctcaataaccctatgtatgtgaggagtccctgtgatcctgatcgggaccagaggtacctgacaacatacaatcaaggttatttcgaaaacatccctaaagggctcgaccaagagggctggacacgagggggtattcagccgcagatgcccgggggatatgccctgtcccaaccagtttcgtgtatggaagctactcctaaccccatggagagcctgcgccacctgcatcctcacgtgggacgaaccttgactagtgctgatccattctaccagaatacccctcattcttctcgctgcgttgcccatagttag

SEQ ID NO: 50336 - DNA, 762 bp, Artificial Sequence
  Description of Artificial Sequence: Synthetic coding sequence
atgatgatgggctgcggcgagagcgagctgaagagcgccgacggcgaagaagctgctgccgttccaggccccccacccgagccacaggtgccccagctgagggcaccagttcctgaaccgggcctggacctaagccttagtccacgccccgattcgcctcagcccagacacggaagccctggacggagaaagggccgagctgaacgcagaggtgcagccaggcagcgcaggcaggtgcgctttagactcacacctcccagtcccgtccgttcggagcctcagccagctgttccccaggagttggaaatgccggtcttgaagtcatctctcgcgctgggtttagagcttagggcggcggccggatcgcatttcgacgccgccaaggccgttgaagagcagctgagaaaatcttttcagataagatgcgggttagaggaaagcgtctccgaggggttaaatgtgccacggagcaagagactgttcagggacctcgtgagcttacaggtgcccgaagagcaagttctgaatgcagccttgagagagaagctggcattgctgcctccacaggcgcgggccccacacccgaaggaaccccctgggcctggaccagacatgaccatcttgtgcgaccctgaaaccctgttctacgaatctccacatctgacactcgatggcttacctccgctgcgcttgcagctaaggccaaggccttcagaggataccttcttgatgcaccggactctaagaaggtgggaggcctag

SEQ ID NO: 50337 - DNA, 1269 bp, Artificial Sequence
  Description of Artificial Sequence: Synthetic coding sequence
atgtaccgggtgcccgagttctacgcccggcggaagcggctgggcgggcagaccccctacttgatggatcaactgggcctcaggttaggcatgtggtactggaaagacgagactaggaccctggagttccgcaggttcgcggctgaggattccgtgcagtggctgctgaaacatcacccccacttcaccccagccgccgaagtcaaagagaagggcaagaaaggaaaggccgttcatttcgccgagacagacgggccagctagtgacaggcttaccgataaacgcctcgccgctaaagacgataagtctgccaaagcggtggaaaagagaggccagcagggaacgatcaccttggacgatgtcaagttcgtgacacttctgctgttacaggatacagagatgcagcgtatttgctcattcaccacattcatgaggaacaagaacctggataacttcctgatggcacttttatactacctttcccactatttggaaaaaaacagtctggagaaaaaacccaagagttatatggtcggactggtagaaaagaaggaaatggaattagtcttatctgaactcgaagcagcgcaacgatacttggctcagaaatattgtatccttgtactggggctggctgtccccgataagcatcatatgtgttgtggaaaggagaaaatcagcgatactcaaaaggattggaagttcttcgagtctttctacaccttttgcacctacgtggcttggatcgtctttcggcgacagcatctgacggagattgaggaggaggtgggcaggttgtttcgcaccaatatgttcaatattcctcgccgtagacgggaagacgaggagtcagggggcgagaaaaagcggatgacgtttgttcaattcagacgaatgatggcgaagcgccctgctatcaagaaggctatcaatatgaggagtcccgtcatgagtactctccttccctccctgagggagaaagcccaaaacgtgtttgaaaagaagtatcaccaagtcgacgtgcggtttcccgctgaaatgcagaaacacgtgggtaccctcgactcagtgcctatgcctgtggttggaattctcggcgagccacgttgtctgttcaatcctcatacccttcatccactcgaccctgaggaaaacacaaaatcttttggaaggtacccgtccctcatggaaaataacaatatgaggattcaggacacccttgacctcgtgatgaaaaccctttctagccacacatcatgtcctaaatag

SEQ ID NO: 50338 - DNA, 624 bp, Artificial Sequence
  Description of Artificial Sequence: Synthetic coding sequence
atggccgccctggtggagcccctgggcctggagcgggacgtgagccgagcagtagagttgttggagagactgcaacggtccggggagctcccgccccaaaagctgcaggccctccaacgggtgctccagtcaagattttgttcagcaattagagaggtgtatgagcagctgtatgacaccctggacattacgggttctgcggagatccgggcacatgcaaccgctaaggcgaccgtagcagccttcaccgcctcagagggccacgcgcaccccagagtagtagagttgccaaaaactgatgagggcctcggttttaacatcatggggggtaaggagcagaactccccaatttacatttccagggtgatccccggaggcgtggcggaccggcatgggggattgaaacgtggcgaccagctcctgtccgtcaacggtgtgtcggtggaaggcgagcagcatgagaaggcagtagagctcctgaaggccgcgcaaggtagcgtcaaactagtagtccgatacacaccacgcgtgctggaggaaatggaagcacgttttgagaaaatgcgcagcgccagacgcaggcagcagcatcaatcatatagcagtctggaaagccgcgggtag

SEQ ID NO: 50339 - DNA, 2064 bp, Artificial Sequence
  Description of Artificial Sequence: Synthetic coding sequence
atggagatcgccccccaggaggccccccccgtgcccggcgccgacggggacattgaagaagctccggctgaggccggcagtccatctccggctagcccacctgctgacggcaggctcaaagcagcagccaagagagtcacatttccaagcgacgaggatatcgtgagtggagcagtcgagcctaaagacccttggcgacacgctcagaatgtgaccgtggacgaagtgattggtgcctacaagcaggcatgccagaagttgaattgtagacagattcctaagctactgagacagctacaggaattcacagatctcgggcataggctggattgcctggatctgaagggcgagaagctcgattacaagacgtgcgaggcgctcgaggaagtgtttaagcggttgcagttcaaagtagtcgaccttgaacagacgaatctcgacgaagacggcgcgtccgcactctttgatatgatcgagtactatgagtccgctacccacctgaacataagctttaataaacatatcggcactcggggatggcaggccgctgctcacatgatgaggaaaaccagctgtcttcagtaccttgacgcgaggaatacaccactgctagaccatagcgcaccttttgtggccagagctctgaggattcgtagctcattggccgtacttcatctcgaaaatgcaagtttgagcggcagacctttgatgttattagctacagcattaaagatgaatatgaatctgagggagctgtacctggctgacaacaagctaaacggcctacaggattctgcacagcttggcaatctcctgaagtttaactgcagtcttcaaatcctggacctgcgaaataatcacgtcttagacagcggtctcgcttatatctgtgaaggcttgaaggaacaaaggaaaggcctcgtgaccctggtcctgtggaataaccaactcacacacaccgggatggccttcctgggcatgaccttatccctcgagacccttaacctcggccacaacccaattggcaatgagggcgtgaggcatttgaagaatggactaatcagcaatcgcagtgtcctacgtctggggctggccagcaccaagctaacgtgtgagggggcggtcgcagttgccgagttcatcgctgagtctccaagactgctgcggcttgatctgcgcgaaaacgagatcaagaccgggggactgatggcactctctcttgcactcaaagtcaaccacagtttgctgcggcttgacttggatcgggagccaaagaaagaggctgtcaaatctttcattgaaactcagaaagccttactggccgaaatccagaatggctgtaaacggaacctcgttctggcccgagagcgtgaagaaaaggagcagcctcctcagctcagcgcaagtatgccggagaccacagccactgagcctcagccggacgacgagcctgcggccggagtacagaatggagcccccagtccagcaccatccccagactctgatagtgatagcgactctgacggggaggaagaagaggaagaggaaggcgaaagagatgaaactccttgcccggccctcgtgccgcccactgattctctcggccccggagataggtccccaccgggttctcccagtacgcccacggagcaaaggatcagcgtgagttcccctggccgcggacataaggtgtttgtcgtgacaagggtggagagtcctccggaacgggctgaaccacccgcttcacccacgcccccatctcctccacctcctccctcacctccagctagcccctctctgccacccgccggcgctatcgatacccgggataccggatcgagcgagccacagccgccccccgagccacccagaagtggccccccactgcccaacggcctgaagcccgaatttgctctagctctcccccccgaaccacctcctggccctgaggtgaaggggggctcgtgcggcctggaacatgagctttcgtgctctaagaacgaaaaagagctggaggaacttcttttggaggcctctcaagaaagtggacaggagaccctgtag

SEQ ID NO: 50340 - DNA, 858 bp, Artificial Sequence
  Description of Artificial Sequence: Synthetic coding sequence
atgatggccgtggacatcgagtaccggtacaactgcatggccccctctctacgccaggaaaggttcgcctttaagatctcgcccaagccctcaaaacctcttagaccgtgcatccaattatccagcaaaaatgaggcctccgggatggtagccccagccgtacaggaaaaaaaagtgaaaaagcgagtcagctttgccgacaaccaggggctggcactgaccatggtgaaggtctttagtgaatttgatgatcctctggacatgccattcaacatcacagagctgcttgataatatagtgtccctgactactgccgagtcagagagctttgtgctagacttcagccaacctagtgccgactatttagactttaggaacaggctccaggcagatcacgtctgcctggagaactgtgtgttgaaagataaagctatcgccggaaccgtcaaggtgcagaacttggcctttgaaaaaaccgtcaagatccgtatgacatttgatacatggaagtcatatacagatttcccctgccaatacgtcaaggacacttatgccggctctgacagagacacatttagcttcgatattagtctgcctgaaaaaattcagtcatacgaaaggatggagttcgccgtgtactacgagtgcaacggccaaacgtactgggacagtaatcggggtaaaaattaccgaattattagggcagaactcaagagcactcaagggatgacgaaaccccactctggccctgatctggggatctcctttgaccagtttggatcgcctcgatgctcctatggcttgttcccagagtggccgagctacttaggatatgagaaattggggccttattattag

SEQ ID NO: 50341 - DNA, 858 bp, Artificial Sequence
  Description of Artificial Sequence: Synthetic coding sequence
atgatggccgtggacatcgagtaccggtacaactgcatggcccccagcctgcggcaggagaggttcgcttttaagattagccctaagccttcaaaacctctaaggccttgtatccagctgtcctcaaaaaatgaggcaagcggtatggtggccccagccgtccaagaaaagaaggtgaaaaagagggtctcctttgccgacaaccaaggcctggccctcaccatggtgaaagtgttctctgaatttgacgatcccttggatatgccgtttaatatcacagagctgctggataatattgtcagtctgactaccgcagagagcgagtctttcgtcctcgatttctctcagccatccgcagactatttggacttccggaacagacttcaggccgaccacgtgtgcctcgaaaattgcgtgctcaaggacaaggctatcgctggtaccgtcaaggtccagaatcttgccttcgagaagacagtgaagattaggatgacctttgacacttggaaaagctacaccgattttccatgtcagtacgtgaaggatacctacgccggcagcgacagagatacattctcattcgacatctccctgccggagaagatacagtcctatgagagaatggagttcgcggtgtactacgaatgcaacggacagacctattgggatagtaatcgcggcaagaattaccgcattatccgcgcagaactgaagtctacccaagggatgactaagccacattccggaccggatctgggaatctcatttgatcaatttggcagcccccgctgctcctacggcttatttccagaatggccaagctatctgggatatgaaaagctcggcccttactattag

SEQ ID NO: 50342 - DNA, 687 bp, Artificial Sequence
  Description of Artificial Sequence: Synthetic coding sequence
atggtgcggctgaccctggacctgatcgcccggaacagcaacctgaagcccaggaaggaggaaacaatttcacagtgtctgaagaaaataacacacattaacttcagcgacaagaatattgatgccattgaagaccttagcctttgcaaaaacttaagcgtactgtatttgtatgataattgtatttcccagattacgaaccttaattatgcgactaatctcacccatctttacctccagaacaactgcatctcctgcattgagaacctgcgttcccttaaaaagctggagaaactgtatttgggggggaactacatagcagttattgagggattggaggggttgggcgagctcagagagttgcatgtcgagaaccagagactgccactcggggagaaactgctgttcgacccccgcacgctgcactcacttgcaaagtccttgtgcatcctgaatatcagcaataacaatatagacgatataaccgatctcgagctgctggagaacctgaatcagttgatcgcagtggacaatcagctgttgcatgtaaaagatctggagttcctgcttaataaattgatgaaactgtggaagatcgacctgaatggcaatcccgtgtgtcttaagcccaaatatagagatagactcatactcgtcagcaaatcccttggaacatacctatattag

SEQ ID NO: 50343 - DNA, 1068 bp, Artificial Sequence
  Description of Artificial Sequence: Synthetic coding sequence
atggtgcggctgaccctggacctgatcgcccggaacagcaacctgaagcccaggaaagaagaaaccattagccagtgtctcaagaagattacgcacattaactttagtgacaaaaacatcgacgcaatcgaggatctctctctctgcaaaaacctctccgtgttgtacctgtacgacaactgtatcagtcagataactaatttgaattacgcaacgaatctgacccacctgtacttgcagaataactgcatcagctgcatagaaaacctaaggtctctgaagaagttggagaaactgtacctcgggggcaactatattgccgtcatagaaggcctcgagggtctgggcgaactgagggaattgcacgtagagaatcagagattgccacttggcgaaaagctactgttcgacccaaggacactgcacagcttagctaaaagtctctgtattttgaatatctccaacaataatattgatgatatcactgatttggaactgttggaaaacctaaaccaactgatcgccgtggacaaccagctccttcacgtaaaggacctggaatttctgctgaataaactcatgaagctttggaaaatcgatctcaatggaaatcccgtctgcttgaaacccaagtatcgcgatcgcctgattttagtttcaaagtccctggaatttctggatggaaaagagattaagaacatcgagaggcagttcctgatgaattggaaggccagcaaggatgcaaagaaaatcagtaagaaacgcagctcaaagaacgaggatgcctccaactccttgatctctaattttaaaacaatgcaccacattgtacctgtctactatcctcaggtcgggaagccaaaacttgctttcttttccgagatccaacggtatcccgtgaatgcaaacgcttcaccggaatctagttgtccattctggcccaacattgagcgcaaaaatcttagcttgaagcaaagcgagtccctgttgactaaaaacgatgtccacgagccacatctgttccacaatcccgaagagaaggaaaatctgttcgtggagaatgagtag

SEQ ID NO: 50344 - DNA, 930 bp, Artificial Sequence
  Description of Artificial Sequence: Synthetic coding sequence
atggtgcggctgaccctggacctgatcgcccggaacagcaacctgaaacctcggaaagaggagacgatatcccaatgcctgaagaagataacccatatcaacttctccgacaagaacattgatgctattgaggatttaagtctgtgcaagaatctgagtgtcctgtacctctacgacaattgtatctcccaaatcaccaatttgaactacgcgactaacctgactcacctatacctgcagaataactgcatctcatgcatcgagaatttaaggtcactcaaaaagctggaaaaattgtatctgggtgggaactatatcgctgtcatcgaaggactagaaggcctcggggaacttagagagctgcatgtcgagaaccagagacttcctctgggtgaaaaacttctgtttgacccacgtactctccacagtcttgccaaatccctgtgtattttaaatatctcgaacaataatatcgatgatatcaccgacttagaattactcgaaaatctgaatcagcttatcgctgtggacaaccagctgctccacgtgaaggatctcgagtttctcctgaataaactgatgaagctgtggaagattgacctgaatgggaatcccgtttgcctgaagcctaagtaccgagaccggttgatcctggtgagcaagagccttgagttcctggatggtaaagaaataaagaatatcgagcggcagtttttgatgaactggaaagcatccaaggacgcaaagaaaattagtaaaaaaaggagtagcaagaacgaggatgctagtaacagtctgatcagtaacttcaagacaatgcaccatatcgtccccgtttattatccccaagtgggcaaacccaagctggccttcttctctgaaatccagcggtatccggtgaacgctaacgctagcccggagtctagttag

SEQ ID NO: 50345 - DNA, 1245 bp, Artificial Sequence
  Description of Artificial Sequence: Synthetic coding sequence
atggacatcgaggagcagaaggccgacatctacgagatgggcaagatagccaaagtctgtggctgccctctctattggaaggctccaatgttcagggccgctggcggtgaaaaaacagggtttgtgactgcacagtcctttattgccatgtggagaaaattactgaacaaccaccacgatgatgcatccaaattcatttgcctcttagccaagcccaattgtagctctcttgaacaagaggacttcatacccctcctccaggacgtggttgatactcatccaggtctgacctttctgaaggatgcccccgaattccacagtaggtacatcacgaccgtgatccagaggatcttttatactgtgaaccgctcctggtcgggtaaaattacaagcacagaaatcaggaaaagtaatttcctccagacgcttgccttactagaggaggaggaagatattaatcaaatcactgactatttttcttacgagcacttctatgtgatctattgtaagttctgggagctcgacaccgaccacgatctatacatatctcaggctgacttgagcagatacaatgaccaggcctcctcctctagaataatcgagagaattttctctggcgccgtgacacggggaaagactatccaaaaggaggggcgaatgagctatgctgactttgtgtggtttctgatttccgaggaggacaaacgtaacccaacgagcatcgagtattggttccgatgcatggatgttgacggggatggagttctgtcaatgtatgagctggagtatttctatgaagaacagtgtgaaaggatggaggctatgggtatcgagcccttaccgtttcatgacctcctgtgtcaaatgctggacctggttaaacccgccgtcgatggaaagattacactacgggatctgaaacgatgcagaatggctcacatcttttacgacactttttttaaccttgaaaagtacttggatcatgaacagcgcgaccccttcgctgttcagaaggacgttgagaatgacggaccggagccgtcggattgggacaggttcgccgctgaggagtacgaaacccttgtggctgaagagtctgcgcaggcccaattccaggagggatttgaggactacgagaccgatgaacctgcctcaccatccgagttcggaaataaaagcaacaagatattatccgcaagccttccagaaaagtgtggaaagctccagagcgttgacgaggagtag

SEQ ID NO: 50346 - DNA, 3453 bp, Artificial Sequence
  Description of Artificial Sequence: Synthetic coding sequence
atggccgccacctaccggctggtggtgagcaccgtgaaccactactcatctgtggtcatcgaccgccggttcgaacaggctattcactactgcacaggcacatgccacacctttactcacggcattgattgtattgtcgtgcatcattccgtctgcgccgacctactccacattccggtgtcccaattcaaggatgccgaccttaacagcatgttcctcccccacgagaacggcctctcctcagcagagggagattacccccagcaggccttcactgggattcccagagttaagagagggagcacctttcagaacacctacaacttgaaggacatagcgggtgaggccattagctttgcctccgggaagataaaggagttcagtttcgagaaattgaaaaacagtaaccacgcggcctatcgaaagggcagaaaagtcaagagcgattcattcaatcgccgctcagtagacctcgatcttctctgtggccactacaataacgatgggaatgcgccttccttcggtctgctgcgatcaagtagcgtggaagagaagccattatctcatcggaacagcttggatacaaacttgactagtatgttccttcagaacttttccgaagaagatttggtcacccaaatccttgagaagcacaagattgacaacttttcgtccggtaccgacatcaagatgtgtctcgacattcttctgaagtgttcagaagatctcaagaagtgcaccgacattattaagcagtgcataaagaagaaatcgggctcctctatctcagaaggtagcggaaatgacaccatttcttcaagtgaaactgtttacatgaatgtgatgacgcggctggcttcttatctgaagaaacttccatttgagtttatgcagtcgggcaacaacgaggcacttgacctgacagagctcatttccaacatgcctagcctccagcttaccccgttcagccccgtctttggaaccgaacagccgccaaaatacgaggatgtggttcagctgagcgcctctgatagcgggcggttccaaactattgaactgcagaatgacaaacccaactctaggaagatggacactgttcaatccatcccaaacaattctacaaattctctgtataacctggaggtgaacgatccccgcaccctcaaggccgttcaggtgcaaagccagtctctaactatgaatccactggagaacgtgtcatccgacgatctgatggagaccctgtacatcgaagaggaatctgacggaaaaaaggcactggacaaaggtcaaaaaaccgagaatggcccaagtcacgagcttctgaaagttaatgagcatcgcgcggaattcccagagcacgccacccaccttaaaaaatgccccactcccatgcaaaacgagattgggaagattttcgagaagagcttcgttaatctgccaaaagaggactgtaagtccaaagtctcaaagtttgaggagggggaccagagagactttacaaactctagtagtcaggaagaaatcgataagttactaatggaccttgagtcattttctcagaaaatggaaacctccctgagagagcccctggctaagggcaaaaacagtaacttccttaatagtcactcacagctgactggccagaccctggtggatctcgagccaaagtctaaggtctcctcgccaatcgagaaggtctcccctagttgtctcaccaggattatcgaaacgaatggtcacaagatagaagaggaggacagggcgctgcttctcagaatcttagaaagcattgaggactttgcacaggaattggtagaatgcaagagcagtagaggctcactgagccaagagaaggagatgatgcaaatactccaggagacgttaaccacaagcagccaggcaaatctgtcggtatgccgtagccctgtgggggacaaggctaaggacaccactagcgcggtgctcatacagcaaactcccgaagtcatcaagattcagaataagcctgagaagaagccagggacaccactccctcctcctgccacctcaccgtctagtcctagaccattatctcccgttccacacgtgaataacgtggtgaacgcccccctgtccatcaatattcctcgtttttacttccccgaaggcctgccagacacctgtagcaaccacgagcagacactatctcggattgaaacagcctttatggacatcgaagaacagaaggccgatatctacgaaatggggaagatagccaaggtctgcggatgtcctctctactggaaggccccaatgtttcgggcagccggcggcgagaaaacagggtttgtcacagctcagagttttatcgctatgtggcggaagctccttaacaatcaccatgatgacgcatctaaattcatttgcctgctcgcaaaaccaaattgttccagtttggaacaggaagatttcatcccccttctgcaggatgttgttgatacacacccgggactgacctttcttaaggatgctcccgaatttcacagtcgttatatcactactgtgatccagcggatattctatactgtgaacaggtcttggtccgggaaaatcacatcgaccgaaataagaaaatctaattttctacagaccctcgccctgttagaagaggaagaggatattaatcagataactgactattttagctatgagcatttctacgtgatttattgcaagttctgggaactagataccgaccatgatctgtacatctcccaggctgacctgagcagatacaatgaccaggcttcatcctctcgtattatcgagcgtatattctccggtgcggtcacccggggcaaaaccatccaaaaggagggtcgcatgtcttatgccgattttgtatggttcttgattagcgaggaggataagcgcaatccgacgagtatagaatactggtttcgctgtatggatgtagatggcgacggcgtgcttagcatgtacgagttagagtatttctatgaggagcagtgcgaacgcatggaagcgatgggaatcgaacctttaccctttcatgatctcctgtgtcagatgctggacctagtgaagccagctgttgacgggaaaataaccctgagggacctcaagcgctgtagaatggctcacatcttttatgatacctttttcaacctggagaagtatctcgaccatgaacagagagacccatttgctgtccagaaagatgtggagaacgatggtccagaacccagcgactgggatcggtttgcggccgaggaatacgagacactggtcgccgaggagtctgcccaggctcagtttcaggaaggcttcgaggattacgaaacggacgagcccgcaagcccctcagagttcggcaacaagtccaacaaaattctctccgcatcattaccagaaaaatgcggtaagttgcagtctgtggacgaagagtag

SEQ ID NO: 50347 - DNA, 1590 bp, Artificial Sequence
  Description of Artificial Sequence: Synthetic coding sequence
atgatgatcaaggagaccagcctgcggcgggaccccgacctgcggggagagctggccttcttggcccgggggtgcgattttgtgttaccaagtagatttaagaagcgcctgaagagttttcagcagactcagatccaaaataaacccgaaaagaagcctggcactcccctcccacccccagctacatctccttctagccctagaccattgtcaccagtcccccacgtgaacaacgttgtcaatgcacccctgagtattaatatcccacgattctattttccagagggtctgccggacacctgctcaaaccacgaacagaccctctccaggattgagacagccttcatggacattgaagaacagaaggctgacatatacgagatgggtaagatcgctaaagtgtgcggctgtcccctgtactggaaagctccgatgttccgtgccgctggaggggaaaaaactgggtttgtgactgctcagtccttcattgcaatgtggaggaagcttcttaataaccaccacgacgatgcaagtaagttcatctgtctgctggcaaagccaaactgcagcagccttgagcaggaggacttcatacccctacttcaggatgttgtggacacacaccctgggctcacctttctaaaggacgcccctgaattccactcgcgatacattaccactgtcatccagcgaatcttctatacggtaaaccggtcatggtctggtaagattacctcaacagaaattagaaagtccaattttctgcaaaccctcgcgctgctggaggaagaggaggatatcaatcagattaccgactattttagctatgagcacttctacgtaatatactgcaaattctgggaactggacaccgatcacgacctatacatttcccaggctgatctatctcgatacaacgaccaggcaagctcatccaggattatcgagcgaatattcagcggagcagtcacgaggggcaagaccattcagaaggaaggcaggatgtcttacgctgactttgtttggttcttgatctctgaggaggacaagcgcaatccaacctctatagagtactggtttcgctgtatggatgtcgatggcgacggagtcctctccatgtacgaactggaatacttctacgaagaacagtgcgaaaggatggaagccatgggaatagagcctctgccctttcacgacctgctgtgccaaatgttggacctggttaagccggctgtggacggcaagattacactccgagacctgaaacgctgtagaatggcacatattttttatgatacattttttaacctagaaaaatacctggatcatgagcaacgcgatcctttcgccgttcagaaagacgtagagaatgacggacccgaacccagtgattgggatcgattcgccgccgaggagtatgaaaccctggtggctgaagaaagcgctcaggctcaattccaggaaggatttgaggactacgagaccgacgaacccgcctcccctagtgaattcgggaacaagtccaacaagatactgtccgcttctctgcctgagaagtgcggtaaattacagtctgttgacgaagaatag

SEQ ID NO: 50348 - DNA, 486 bp, Artificial Sequence
  Description of Artificial Sequence: Synthetic coding sequence
atggacatcgaggagcagaaggccgacatctacgagatgggcaagatcgcgaaggtttgtggatgccctctctactggaaagccccgatgttcagagccgctggcggcgagaagactggcttcgttacggctcagagcttcattgcaatgtggcgcaagctgctgaacaaccaccacgacgatgctagcaagtttatctgtctgctggcgaagcctaactgtagcagtcttgaacaggaagacttcattccccttttgcaggacgtcgtagatactcaccctggcctcacatttctcaaggacgcccccgagtttcacagccgctacataaccacagtgattcagaggattttttatactgttaatcggtcttggtccggcaaaattacatcaacagagatccgaaagtccaatttcttgcagagtaatgaagacttagcgaagctcgccgtccacgacggctacaccaatatctttctattctag

SEQ ID NO: 50349 - DNA, 1893 bp, Artificial Sequence
  Description of Artificial Sequence: Synthetic coding sequence
atgagcaccaacaacgccctgcgggtgttctggaagagccgggagtggaacatgaaaaccagcacctttgacagcgacgaagatattctgttactccccaagcgaaagaggttcagaaaaaagaagtcaaggccagtgagacataccaagaggcacgaagaagagcaggtttatgaacagggtactactttgccatgctccatctgcaagcacgagatcgacttgacggggattttccttcacaagaagcagcacgtggccctggccactctcggcttccagtggatgggaagaaaaaagccccaaccttcagttatcgcagtgcagagacagttcatgatcagtaaactgcttagcagcttcatgtttacagagaagacactccagagtattaacaatgcctttgaactgctgtggaaaaaacagattcctgcctactataaaatcttcgacaacatagatcgcagcgtcatatacagccagaagatctgccaccttctgattaaaggagtcggcatctgcgaggacaggaacagcacctggaaagcggacatgaatgacaagttcacggtggtgtccaattttggcaacaaaccaaacgtgtgcttctttgggcttttcgacggccatcacggcgcgtcggcagcagagcttacaagcatggagctgcctgtccttttgctgcaccagctgagcaaatttgaccccagctaccagatgaccacagacgaacagcagatcataaactccttctacacagtctttagggaggagtatgccgccatcgaggatctgttctccgccatcaacaaaacagaggctgtccgctgcgaatacgaggatacacacaaagcattcgctaaggctttctggcgcatggaccgactgctgggtctgggcagaaaggaggtaagccgggtgcagtggtctggctgttcagcagtgacttgcatcttggaaggcaaacctaagagcccttacgcccataagaactggaagcgcaaaaacacgcatgacggcctggccgagtcaagcccaagtcaggaaatgccaaaaattatctcaggcattctccacgtggcgaacacgggcaacgtgcaggccgtgctctgtaggaacgggaaaggtttctgcctcacaaaggagcatacaaccaggaacaccaatgaacggagacgtattttacagaatggcgcagtgataagcagtaatgagccgtacgggctggtggaaggacaggtgaaaaccaccagaggcctgggctttcatggcaatctcaaactgaagaagagcatcattcccgcacctcagacaatctccgtacctatcgacgatctatgtcagttcctaatcgtagctaccaatggcctctgggaggtgctggacaaggaggaggtgacagcattggctatgactacttttcacatgtacaaagagacttactgtcctattatccccaataagagcccgagtaaggggcctctgctttttagtaccagcgagcctaatttaacgaaatctcagagtaacattcatgtgctgttccagtataagagtgtctcggaggtccgggtcagcactactaattctaaagaaaatcttagtgactcaaactattcgaaatactgcatctacaatccagagaatgtggagacctttcctgccgagactacgcacagaaagccttgttctgaaaaggtgacagatcgaccaacgtccgtgaatgacgtcgccacaaatgaaaaggaaagcgataccaagtccttctacgagggggctgcagagtacgtatctcacgaactggtcaatgccgccctcctggcgggttcccgagataatattaccgtcatggtcatatttctgaatgggtccgaataccaactcctgacttag

SEQ ID NO: 50350 - DNA, 1248 bp, Artificial Sequence
  Description of Artificial Sequence: Synthetic coding sequence
atggccgagatccccctgtacttcgtggacctgcaggacgacctggatgattacggttttgaggattacggcaccgattgcgacaacatgcgcgttacggcttttctggatatccccgggcaagacaatctccccccccttacaaggcttgagaaatatgcattctcggagaataccttcaataggcagattattgcccgaggattgcttgatatcttccgggatttcggtaataatgaagaggattttttgacagtgatggagattgtcgtgcgcctctccgaagacgcggaaccaactgtgaggaccgagctgatggagcaaattcctccgatcgctattttcctgcaggagaataggagtaacttcccagtggttctttcagaatacctcattcccatcgtggtgaggtaccttacagatcccaataaccagattatttgcaaaatggcttctatgctgtcaaaatcaacggtagaacgcttactgctgcctcgcttctgcgagctctgcggggatcgtaaactcttccaggtgcgaaaagtgtgcgccgccaacttcggcgatatctgccacgctgtcggtcaggaggccactgaaaagttcttaatccccaaattttttgagctctgtagcgacgcagtatggggcatgcggaaggcttgcgcagagtgcttcacagctgtgtcacactcctcttcacccggcgtcaggaggacacaactgttccctctgttcatcagactagtgtccgatccctgccgatgggtacaccaggcggcctttcaatcccttggaccctttacctccacctttgccaacccttccagggcaggcctttatctccgagaggatggggccctctccatatggcctctcacccaggacctggatagcgggttcgcgagcggaagccctgcaccttctagcggcggcaacactagcccagcaagcttaactagatccgccaagcccgtcagaagtgaaccagagcttccagttgaagggaccagcgccaagacctcagattgcccccattcttcatcttcatccgacggacccgctgagtcccctgtagagtcctgtgttagcgctggggcggagtggacccgcgtgtcgcctgagacctccgcgtgttcgaagctgagcgatatgaatgacttacccatttcgtcgtatcctggttccgatagctgggcctgtcctggtaacaccgaggacgttttcagccacttcctgtactggtag

SEQ ID NO: 50351 - DNA, 1365 bp, Artificial Sequence
  Description of Artificial Sequence: Synthetic coding sequence
atgagcagcggcgccccccagaagagcagccccatggccagcggcgcggaagagacacccgggttccttgataccctcctgcaggacttccccgccttattgaatccagaagaccctctgccatggaaggctcccgggacagtgctttcccaggaggaagttgagggggaacttgctgaactcgcaatgggatttctgggatctcgcaaggcaccgcccccactcgcagccgctctcgcacacgaagcggtgagccaactcctgcagactgatctgtctgaattccggaagctgcccagagaggaggaagaggaagaagaggacgatgatgaggaagagaaggcccccgtcactctgttggacgcccagtcactcgctcaatccttctttaaccgcctctgggaagtggccgggcagtggcagaagcaagtccccctcgcggccagagcctcccagaggcagtggctggtatccattcacgccatccgcaacacccgccgcaagatggaagatcgccacgtctccctgccttcttttaaccagctgtttggattgtccgaccctgtgaacagggcttatttcgctgtgttcgacggccacggaggggtggatgctgcacgctatgccgctgtccatgtgcataccaacgcggcccgacagccagagctcccgaccgacccggagggagcattacgtgaagccttccggcggaccgaccagatgtttctgaggaaggctaagcgcgagcgcctgcagagcggcaccaccggagtctgcgcccttattgctggggctactttgcacgtggcttggctgggggattcacaggtgatcctcgttcaacagggacaagtggtcaagctgatggaaccacaccggccagagcggcaggatgagaaagcacgcatcgaagctctaggaggctttgtgagccatatggattgttggagggtgaatggaactctggccgtttctcgcgcgattggggacgtttttcagaagccttatgtgagtggagaggccgacgccgcgtccagagccctcacaggctcagaggactatctcctgttggcctgcgacggattttttgatgtggtgcctcatcaggaagtggttggtctagttcagagccacctcacccgccagcaggggtccggccttagagttgcagaagaattagtcgctgcagctcgcgagagagggtcacatgataacatcaccgtgatggttgtcttcttgcgcgacccacaggaacttctggagggaggcaaccagggcgagggagatccacaggcggagggcagacgacaggatctgcccagtagtctgccagagcccgagacacaggcccccccacgcagttag

SEQ ID NO: 50352 - DNA, 1086 bp, Artificial Sequence
  Description of Artificial Sequence: Synthetic coding sequence
atgagcagcggcgccccccagaagagcagccccatggccagcggcgctgaggagacccccggttttctggacactctcttgcaggatttccccgcccttctgaaccccgaagaccctctaccatggaaggctcccggcactgtcctgtcccaggaagaagtggagggcgaattagcagaattagccatgggttttttaggatctcgcaaagctcctccccccttagccgccgccctggcacatgaggctgtgagccagctcctgcagactgaccttagcgaatttcgaaaactcccgcgagaagaagaagaagaggaggaggatgatgatgaggaagagaaggccccagtgacactgcttgatgcacaatccctcgcacagtcttttttcaaccggctttgggaagtggctggccaatggcaaaagcaggtccctctggcggctagagcctcacaaaggcagtggctggtctctattcatgctatcagaaacacgcggagaaagatggaggaccgccacgtgtcacttccctcatttaaccagttatttgggctgtccgacccagtcaatagggcctactttgccgtgttcgatggtcacgggggagtcgacgccgcccgctatgctgccgtccacgttcacacaaatgccgcacggcagccggagctgccaacagatcccgaaggggccttacgcgaggcctttcggaggacggaccaaatgtttttgcgaaaggcaaaaagggagcgccttcagtctggaacgaccggcgtgtgtgccttgatcgcaggggccacattgcatgtggcctggttaggcgatagtcaagtgatactcgtccaacaggggcaggtggtcaaattgatggagcctcaccgcccagagagacaggacgagaaagccaggattgaggccttggggggcttcgtaagccatatggactgctggcgcgtgaatggaacattggccgtatcacgggcaatcggggagtctcagcgcgggcgcccgaaatgggaaaaggtgtcaaggaagcctcgaccacgggtgtggcctgccgcacatcagggcttccgtgaggccgtttag

SEQ ID NO: 50353 - DNA, 861 bp, Artificial Sequence
  Description of Artificial Sequence: Synthetic coding sequence
atggaggaccggcacgtgagcctgcccagcttcaaccagctgttcgggttaagtgacccggtgaaccgagcctattttgcagtgtttgacgggcacggcggcgtcgatgctgcaagatacgcagcagtgcatgtccatactaatgccgcccgtcagcctgaactgccaactgacccggagggtgcattgcgggaggccttccgtagaaccgatcagatgttcctcagaaaagccaagcgcgaacgccttcagtctggtactacaggagtgtgcgcattgattgctggtgcgacattgcacgtggcctggttgggcgacagccaagtcatcctggtccagcagggtcaggtggtcaaactgatggagcctcatcggcccgagcgacaggacgagaaggccaggattgaagccctaggtggtttcgtgagccacatggattgctggcgggtgaatggcacactagcggtgtcaagagccattggtgatgtttttcagaaaccatatgtgtcaggagaagctgacgcagcctctcgagccctgactgggtccgaggattaccttcttttagcatgtgatgggttttttgatgtggtaccccaccaggaagtggttggattggtccagtctcacctgacccgccagcaaggctccgggctgcgggtggcagaggaattggttgccgcagcgcgggagcggggaagccatgacaacatcacagttatggtcgtgttcttgagggaccctcaggaactcctagagggggggaaccagggggagggcgacccacaggccgagggacgccggcaggatctgcccagctcgctgcctgaacccgaaacccaggcccctcctcgatcctag

SEQ ID NO: 50354 - DNA, 861 bp, Artificial Sequence
  Description of Artificial Sequence: Synthetic coding sequence
atggaggaccggcacgtgagcctgcccagcttcaaccagctgttcggactgtcggatcctgtgaatagggcctacttcgcagtttttgacgggcatggtggggttgacgccgcaagatatgccgctgtacatgttcacacaaacgcagcacgtcaacccgagctgccaactgacccggagggggccctgcgggaggcatttcggaggaccgaccagatgttccttaggaaggctaagagagaaaggttacagagcggcacaactggtgtgtgcgcactgatagctggggccactcttcacgtcgcatggctgggagattctcaggttatcctggttcaacaggggcaggttgtcaagctcatggagccccaccgaccagagcggcaagacgaaaaagccagaattgaggccctcggtggatttgttagccatatggactgttggcgcgtaaacggtaccctcgccgtctctcgagctatcggagacgtcttccaaaagccctacgttagcggcgaggcagacgcagccagccgtgcactgacaggttctgaagactatctcttactggcttgcgatgggttcttcgatgtcgtgccacaccaagaggtcgtgggcctggtgcagtcacacctaacgcggcagcaggggtcaggcttaagagtggccgaagagttggtcgctgcggcacgggagagagggtcacacgataacatcacagttatggtagtgttccttcgcgatccccaggaactgctggaaggggggaaccagggcgaaggagatccccaggccgagggcagacgccaggatttgccttccagccttccagaaccagagactcaagcgccacctcgcagctag

SEQ ID NO: 50355 - DNA, 1053 bp, Artificial Sequence
  Description of Artificial Sequence: Synthetic coding sequence
atgggcctgtgccccagcacccgggagaccgccccccccgccgtgctggacgcacagtctttggcacagagcttctttaacaggctctgggaagttgctggacaatggcaaaagcaagtgccactcgcggcccgagcctcgcaaagacagtggctggtaagcatccacgcaatccggaacactcgaagaaagatggaggatcgacacgtgtccctgccctcgtttaatcaattgtttgggctctccgacccagtgaatcgagcttattttgcagttttcgacgggcatgggggcgttgatgctgccaggtatgcggccgtgcacgtgcatacaaatgccgccagacagcccgaactgccgacagatccagagggcgcccttcgggaggcattccggcgcaccgaccagatgttccttcggaaggcgaagagggaacgcttgcagtctggtaccactggcgtttgtgctctaatagctggagccaccctgcatgttgcgtggctcggagactctcaggttatcctggtacagcaaggccaagttgtgaagttaatggagccacatcgtccagaacggcaggatgagaaggcaagaatcgaggccctcggtggattcgtgagccatatggactgctggagggtcaatggcaccctcgccgtgtcccgagccattggagacgtttttcaaaaaccctacgtatctggcgaggccgatgccgcatcgcgggccttaaccggttccgaggactacctcttactggcctgtgacggcttttttgatgtggtgccacaccaggaagtggtcggtttggtccaatcccacctaactaggcagcagggctctggcctgagagttgccgaagagcttgtcgcagctgcccgcgagcgcggaagccacgacaacataaccgtcatggttgtgttcttacgcgaccctcaagagctgttggagggaggaaatcagggggagggggaccctcaagctgaaggacgtcgccaggacctcccctcttcccttccggagcctgagacccaggcaccgccccgctcctag

SEQ ID NO: 50356 - DNA, 3321 bp, Artificial Sequence
  Description of Artificial Sequence: Synthetic coding sequence
atgttcaacagcatgacccccccccccatcagcagctacggcgagccatgttgcttgcggccgcttccatctcagggagctcctagcgtgggcaccgaaggtctgagcggacccccattctgtcatcaggcaaatctgatgtctggtccccactcgtacggaccagcccgcgaaaccaattcctgtaccgagggaccattattctccagtccccgaagcgcagttaaacttaccaagaaacgcgccctgtctatatccccattgtctgatgcatcacttgatctacagactgtgatcaggacgtcaccctcaagcctggtcgcttttattaacagtaggtgtacaagcccgggaggctcctatgggcatctgagcatcgggacgatgagtcccagcctgggattccctgcgcaaatgaatcatcagaaaggacctagtccctcttttggtgtgcaaccttgtggcccccatgatagcgctcgcggcgggatgatacctcacccacagtctcggggcccgtttcctacgtgccagctcaaatccgaacttgacatgctggtggggaagtgcagggaggagcccctggaaggggatatgagtagtcccaactccactggaattcaggatccactgttgggaatgctcgatggaagagaagatctggagagggaagaaaagcgcgagcctgaaagcgtttatgaaaccgactgtagatgggacggctgcagccaggagttcgatagtcaggagcagctcgtgcatcatattaattcagagcacatccatggggagagaaaggagttcgtgtgtcactggggtggctgtagccgagagttaaggcctttcaaagctcagtacatgctggttgttcatatgaggaggcacaccggcgaaaagcctcacaaatgcacgttcgaggggtgtcgtaagtcttacagcaggctggagaatctgaaaacccatctgcgatcacatactggcgagaagccctatatgtgcgagcacgagggttgttctaaagcattttccaacgccagcgatagggctaaacatcagaacagaacccattcaaacgaaaaaccttacgtctgtaaattgcccggatgcaccaaaaggtacaccgacccctcgagtttgcgtaagcacgtgaaaacagttcatggccccgatgcacatgtgaccaagcgacacagaggcgacgggccccttccacgcgccccctccattagcaccgtcgaaccgaaacgtgagcgagagggaggacccatccgtgaagaatcacgcctcacggtgcccgagggcgccatgaagccccagccaagtccgggtgcccagtcatcatgtagttcagatcactctccggcaggatccgctgctaataccgattccggagtcgagatgacgggaaatgcaggcggaagtactgaggatctgtcatccttagacgaggggccctgcattgccggcaccggcctcagtacactacgcaggctggagaatctcaggctggaccagctacaccagttaagacctatcggaacccgtggcctgaagctgccctctctgagccacacaggcacaaccgtgtcacgccgagtgggacctcctgtttcactggagcgacgctcctcatcctccagcagtattagctctgcatacactgtttccaggagaagcagcctcgcatcccctttcccccctggttcacctcccgagaatggcgccagtagcctgcccgggcttatgcctgcccagcactatctgctgcgggcacgatacgcttctgctagaggtgggggaacttcccctactgcagccagctcactggacaggatcggagggcttcctatgcctccatggcgcagccgcgccgagtatccagggtacaacccaaatgccggtgtcacccggcgcgccagcgatcctgcacaggccgcagaccgtccagcccccgcaagagtccagagattcaaaagccttggctgcgtgcatacccctccaaccgtggctggtgggggtcagaacttcgacccttacctcccaacctcagtttactccccccagccccctagtatcactgagaacgcagcaatggatgcacgcggcctccaggaggagcccgaggtgggaacaagcatggtgggttctggactcaacccctatatggactttccaccaactgatacactgggctatgggggaccagaaggagcagctgctgaaccgtatggtgcaaggggccccggatctctacccctgggccccgggccccctactaattacgggccaaatccttgcccacagcaggcaagttaccctgatccaactcaggagacatggggggaatttccatcgcactccgggctgtaccccggacccaaagccctcggtgggacgtacagccaatgtccacgcctggagcactatggccaggttcaagtgaagccagagcaggggtgccctgttggatctgacagtactggactggcaccctgtctaaatgctcatccatccgaaggtccaccacatccacaacccctgttcagccactatcctcaaccctctcccccccagtacttgcagtcaggaccatatacacaacccccacccgattacctgccaagtgagccacgcccatgcctggacttcgacagtcccactcacagcactggccagctgaaggctcagttggtttgcaactatgttcagagtcagcaggagctcttgtgggagggcggtggtcgggaagacgctccagctcaagagccatcttatcagagccccaaattcctggggggcagccaagtatcgccatctcgagctaaggcccctgtgaacacatatgggccgggttttggccctaacctccccaatcataaaagcggatcgtaccccactccatctccctgccacgagaatttcgtagttggtgctaaccgcgccagccatagagcagctgcccctccccgactcttgcctccattgcctacttgctatggccccctcaaggtcggaggcactaacccttcatgcggacaccccgaggttggcaggctgggtgggggtccagcgctttacccaccaccggaagggcaagtctgtaaccccctagacagtttagaccttgacaacacacaactggacttcgtggccattcttgacgaaccacagggcctatctcccccaccaagccatgaccagcgcggcagctctgggcacacacctccaccctccggccctcctaacatggccgtagggaacatgagtgtcctgctccggtctctgccgggcgagacggaattcctgaactccagtgcatag

SEQ ID NO: 50357 - DNA, 1023 bp, Artificial Sequence
  Description of Artificial Sequence: Synthetic coding sequence
atggaggacgcccactgcacctggctgagcctgcccggcctgccccccggatgggctctgtttgccgtgctggacggacacggtggagctcgggctgcgagatttggtgcccggcaccttccagggcacgtgctgcaggagctggggccagagccatctgaacccgagggggtgagggaggcgcttcgaagagcttttctgagcgctgacgagagactgaggtccttatggccacgtgtcgaaaccggaggttgtacagccgttgtgctcctcgtatcaccccggttcctctacctggcccactgtggggatagtcgagctgtgctctccagagccggggcagtggccttctctaccgaggaccaccggccattgagacctagggagcgggaacgcattcacgccgccggcggtacgataagacgacggagagttgagggtagtctggctgtcagcagggccctgggagatttcacatataaggaggccccgggacgtccccccgagctccagctggtctccgccgaaccagaagtggcagccttggcgcggcaggctgaagatgaatttatgcttctggcatccgacggcgtctgggacactgtgagtggcgccgccctggctggccttgttgcgagtaggttgagactgggcctggctcccgagttgctttgtgcccaactactagacacctgcctctgcaaagtcttaggagcttggcgggggacattcggggcatggtgtagcagggggagagaaccacggggtttcggagaggagggctttgatcgagaagctcgtgtgaaactcgccaaggaagggatcggcctgaagcgccgcgcctggcctgaagttggcagagctaaaatacagggccgaagtttgagggatgccctcagacatggccgggtctccggcagggatctgcgcgagagggcctggagtttcggaaagggccgcttctgggtggtgggcgcaggccctgaggtgcttattagtgccgggagatggaagtcaaggtag

SEQ ID NO: 50358 - DNA, 1293 bp, Artificial Sequence
  Description of Artificial Sequence: Synthetic coding sequence
atggccgtgctggcccggcagctgcagcggctgctgtggaccgcctgtaaaaagaaagagagagaaaaagaaggccgggaagaggaggaggaagaagaagccggccgaagagcccccgaagggccccggtcactcctgacagccccacggagggcacagcggcctcacggaggggccgaggcaagcgggggcttgcggtttggcgcgtctgccgctcaaggttggagggcacggatggaagatgcacattgtacatggttgagtctgccaggattaccacccgggtgggcactgttcgctgtgctagatggccatggtggcgccagggccgcccgcttcggggctagacaccttcctgggcacgttctgcaggagctgggacctgagccttcagaacctgagggcgtccgtgaggcgctccgtcgggctttcttatcagcagacgaaaggctgcgatctctgtggcctagagtggagacaggcggctgcacagcggtcgtcttgctcgtgtcacccagatttctctacctggcccattgtggtgactctagggcagtgctgagccgggcgggcgcagttgcgttttctaccgaagatcaccgtcctttgagacccagggagagagagagaatccacgcagctgggggaactatccggcgccgccgcgtggaagggtctctagcggtgagccgggctcttggagatttcacctacaaagaggcacccggcagacctcccgagctgcagctggttagcgccgaacccgaggtggcagcattggcccgacaggccgaggatgagtttatgttgctggcctcggatggggtgtgggatactgttagcggagccgccctcgccggccttgtcgcttcacgccttcggctgggtctggcaccagagttactttgtgcccagctgctggatacctgtctgtgtaagggcagcttggacaacatgacctgtatcttagtgtgcttccctggggctcccagaccaagtgaggaggccatcaggcgggagcttgcactggacgcagcactcggctgtcggatcgcagagctctgtgccagcgctcagaagcccccctctttaaacacagtctttcgcacccttgcctccgaagacattccagatttaccccccggaggaggcttggattgtaaagcgaccgttattgctgaggtttactcacagatctgccaggtgagtgaggaatgcggcgaaaagggccaggatggggccggaaaaagcaaccccacacatcttgggagtgcactggacatggaggcatag

SEQ ID NO: 50359 - DNA, 1209 bp, Artificial Sequence
  Description of Artificial Sequence: Synthetic coding sequence
atggccgagaccagcgaggaggtggccgtgctggtgcagcgggtggtgaaagacatcactaacgcatttcggaggaacccacatatcgatgaaatcggcctcattccatgcccggaggcccgctacaaccgctctcccatagtcctggtcgagaataagcttggcgttgagtcttggtgtgttaagtttttgctcccctacgtccacaacaagcttctgctctatcggacgaggaagcaatggcttaatagagatgagctcattgatgtcacgtgcacactcttgttgctcaatcctgacttcactaccgcctggaatgtacgcaaggagttaatactgtctggcaccctgaatccgattaaagacctccacctcggcaaactggccttgaccaagttccccaagagccctgagacttggatccaccgcaggtgggtgctccagcagctgattcaggagacttctctcccttcgttcgtcactaaggggaatctggggactatacctacggagcgtgcccagaggctaattcaggaggagatggaggtctgtggcgaggccgcagggcgttatccatcgaattataatgcttggtcgcacaggatctgggtgctccaacaccttgcaaagctggacgttaagattctccttgatgaactcagttctactaagcactgggccagtatgcacgtgtcggaccatagtggctttcattatcgccaatttctcttgaagtcactaattagccagaccgttattgacagctccgtgatggagcagaatcctctccgtagcgaacccgcactcgtgccgcccaaggacgaggaagcggctgtcagcaccgaagagccccggattaatcttccccatctgttggaagaagaggtggaatttagtacggatctaatcgattcgtaccccgggcatgaaaccttgtggtgccatcgaaggcatatcttttatctgcagcatcacttgaacgccggcagccagctgtcacaggccatggaagttgacgggttgaacgacagcagcaagcagggttactctcaggagactaaaaggctgaaacggaccccagtgcctgattcccttggtctcgagatggaacaccggttcatagatcaggttctcagtacatgtagaaatgtcgaacaggcccgctttgcctctgcataccgcaaatggttagtaacgctgtcacagtag

SEQ ID NO: 50360 - DNA, 1158 bp, Artificial Sequence
  Description of Artificial Sequence: Synthetic coding sequence
atgggctgcggcgccagccggaaggtggtgcccggcccccccgcccttgcttgggccaagcatgagggacagaaccaggctggagttggtggggccgggcccggccctgaagccgccgctcaggccgcccagcggatccaagtcgcccgatttcgggctaagtttgatcctcgagtcctagccagatatgatattaaagctctgatcggcactggatcatttagcagagtggttcgggtggaacaaaaaactaccaaaaaaccattcgccataaaagtgatggagactagggagagggagggcagggaggcctgcgtctcagagctgtccgttctccggcgggtaagccaccgctatattgttcaactcatggaaattttcgagactgaggaccaggtgtacatggtcatggagctggccactgggggagaactgtttgaccgcctgatcgcccagggctccttcaccgaacgggatgcggtgaggatattacagatggtcgctgatggaatccgctatttacatgcactccagatcactcatcggaatttgaagcctgaaaaccttctctattatcacccgggagaggagagtaaaatcctcataaccgattttggactggcctattctggcaagaagagcggggactggacaatgaaaacactgtgtggaaccccagagtatattgctcctgaagtgctcctccgcaagccctacacatctgccgtggacatgtgggccctgggcgtaatcacatacgccctgctgtccggattcctgccttttgacgacgagtcccagacgcgattatatagaaaaatcctcaaaggcaagtacaactatacaggagagccttggccctcaataagccatctggcgaaggacttcatcgataagcttctgattctcgaggccggtcatcggatgagcgcaggtcaggccctggatcacccctgggtgataaccatggccgcgggaagctccatgaagaatttgcagcgggccatctctcggaatttgatgcagcgtgccagcccccactctcaaagcccgggcagcgcacagtccagcaagagccactattcccacaagtcacgccacatgtggtcaaaaagaaatctgaggattgttgagagtcccctgtcagctctcctgtag

SEQ ID NO: 50361 - DNA, 2265 bp, Artificial Sequence
  Description of Artificial Sequence: Synthetic coding sequence
atggccgccggcgtgctgccccagaacgagcagccctacagcaccctggtgaataactccgaatgcgttgctaacatgaaaggcaacttagaacgcccgacccccaaatacactaaagttggagagcgcctacgccatgtgatccctgggcatatggcatgtagcatggcctgcggcggtcgtgcgtgcaagtatgaaaaccctgccagatggagcgagcaggaacaagctattaagggggtgtactcaagttgggtgaccgataatatcctcgcgatggctaggccttcatctgaacttttggaaaagtaccatatcatcgaccagtttctttcgcatggaatcaagaccataatcaatcttcaacgaccgggcgaacacgccagttgtggcaaccccttagaacaagagagcgggttcacctacctcccggaagcattcatggaggccgggatatacttctataacttcggctggaaagactatggagtcgcctctttaacaacaatcctggatatggtaaaagtaatgacattcgcacttcaagagggaaaggtcgctatccattgccacgcaggcctgggccgtacgggtgtacttatcgcatgttacctagtattcgctactagaatgacagccgatcaagccataatctttgtgcgggcaaagagacccaatagcatccagacgagaggccagctactgtgtgtgagagaattcacgcaatttctgacccctctccgcaacatcttcagctgctgtgaccctaaagctcacgccgtaaccctgccgcagtatctcatccgacaaaggcatctcctgcacggatacgaggccaggctgctgaagcatgtgccaaaaatcatccacctcgtttgtaagctgcttttggacctggcagaaaataggcccgtcatgatgaaagatgtgtccgaaggcccagggttgtcagccgagatcgagaaaacaatgagcgagatggtgaccatgcagcttgacaaggaactgctgagacatgattcagacgtcagcaacccccctaatccaacagctgtggccgcagacttcgataatcgagggatgatttttagcaatgaacagcagttcgaccctctctggaaaagaaggaacgtggagtgtctccaaccacttacccacctcaagcgtaggctgtcatatagtgatagcgacctcaaacgggccgagaacctgctcgagcagggcgagacgccacagactgtgcctgcccaaatcctcgttggccacaaacctcgtcagcaaaagcttatctctcactgttacatcccgcagagtcccgagcctgatctccacaaggaggctctggtacgatccaccttgtctttttggtcacagtctaagttcggtgggttggagggtctaaaggataatggttctccaatcttccacgggcgcatcatacctaaagaagcccagcagagtggggccttctccgcggatgtcagcggaagccactctccaggagagcctgtctcacccagcttcgcaaacgtgcataaggaccctaatcccgcccaccaacaggtctctcactgccagtgtaaaacccacggcgtgggtagccctggctcagtgaggcaaaactcaagaacaccacggagcccgttagattgcggatccagccctaaggctcagtttctcgtggaacatgagactcaggactcaaaggacctgagcgaggcggcatcccattcagccctccagtcggaattaagtgcagaggcccggaggatccttgctgccaaagcactggcaaatcttaatgagagcgtagaaaaagaggaacttaaaaggaaagttgaaatgtggcagaaagagctaaactcccgggatggagcttgggagagaatctgtggtgagcgtgatccctttattctttgctccctgatgtggtcctgggtggaacagctgaaagagcccgtgataaccaaagaggacgttgacatgctcgtggaccggagggccgacgccgcagaagctctcttcttgctggagaaaggccagcatcagactattttatgtgtgttgcattgtatcgtcaacttgcagaccattcctgtggacgtcgaggaagctttcctggcccatgccattaaggcgttcactaaggtaaattttgacagtgaaaacgggccaactgtttacaacaccctgaagaaaatttttaaacacaccttggaagaaaaacgcaagatgaccaaggatggaccaaagccagggctttag

SEQ ID NO: 50362 - DNA, 2421 bp, Artificial Sequence
  Description of Artificial Sequence: Synthetic coding sequence
atgcaggtgcaggacgccacccggcggcccagcgccgtgcggttcctgtcttccttcttgcagggccggaggcattccaccagcgatccagtactccgcttgcagcaggcgaggcgcgggagcggccttggcagcgggagcgcaaccaaacttctgtcctcctcatctctccaggtcatggtcgctgtgagcagcgtttcgcacgctgaaggcaatcctacttttcccgagcgaaagcggaatttggaaagaccaacccctaagtacaccaaagtaggcgaaaggctgcgtcacgtaattccaggccacatggcgtgttccatggcctgcggggggcgcgcctgcaagtacgagaatcctgctcgatggtccgagcaagagcaagcgatcaaaggcgtctactcaagttgggttaccgataacatcctcgccatggcccggccttcctccgaattgcttgaaaagtaccatatcatagaccaattcctgtcacatggaattaaaaccattataaatctccaacgtcccggagagcacgcatcttgcggtaacccattagaacaagaatccggttttacttatcttccagaagcgttcatggaagccggcatttacttctacaattttgggtggaaagattacggggtggcctcactgacaacgatcctggacatggtgaaggtgatgacatttgccttacaggaaggcaaagtggccatacactgccatgcgggtctggggcggactggtgtgttgattgcctgttatttggtgttcgcaacccggatgaccgctgatcaagccataatcttcgtgcgggccaagcggcctaatagcattcaaaccaggggccaactcctctgcgtgcgggagtttactcagttcttaacccctttaaggaacatcttctcttgctgtgacccgaaagcacatgccgtcacacttcctcaatacttgataaggcagcgacatttattgcacgggtatgaggcacgcctgctgaagcacgtgcctaagattatccatctggtctgtaaattactccttgatctggccgagaacaggccggttatgatgaaagatgtctctgaaggccccggtctatccgctgagattgaaaaaactatgagtgagatggtgacaatgcagcttgacaaggaactgctcaggcacgattccgatgtttccaacccacccaatcctacagcggtggccgcagactttgacaacagaggaatgatcttcagcaatgaacaacaattcgaccccctttggaaacggcgcaacgtggaatgcctgcagccgttaactcatctcaaaaggcggctgtcctactctgattccgacttaaagcgcgcagagaatctcctagagcaaggcgagaccccacagacagtacccgcgcaaatcctggtgggccacaaacctcggcagcagaagttaatctcccactgctacataccacagtctcctgagccggatttgcacaaggaagccctggtgcggagcacactgagtttctggtctcagagcaagtttggaggcctggaaggtctgaaagacaacgggagtccaatttttcatggaaggataattccaaaagaggcccagcaatctggcgcgttctctgcagacgtgagcgggtcacatagtcctggcgagccggtctcaccctcatttgcgaacgttcacaaggacccaaatcctgcccatcaacaagtctcccattgccagtgcaaaacccatggcgtgggcagccctggtagcgtgcgtcagaacagcaggaccccgaggagtccgcttgattgcgggagtagcccaaaggcccagtttttggttgagcacgaaacccaggatagtaaggacctgtctgaagccgcctcccacagtgctcttcagagtgagctgtctgccgaagcgagacgtattctcgctgcaaaagctctcgcgaacttgaatgagagcgtcgaaaaagaagagctgaaacggaaggtggagatgtggcagaaggagctcaactcccgggatggggcctgggaacggatctgtggggagcgggaccccttcatactgtgttctttgatgtggtcatgggtggaacaactgaaggaaccggtcatcactaaggaggatgtggatatgctggtggaccggagagctgacgcagcagaggcactgtttctcctcgaaaaggggcagcaccagacaatattatgcgtactccactgtatcgtaaatctgcagactataccagtggacgtggaggaggcatttttggcacatgctattaaagccttcaccaaggtgaacttcgattcagaaaatggacccacggtctataacactctgaagaaaattttcaagcacaccctcgaggagaagcgcaagatgacaaaggacggtcctaaaccaggactgtag

SEQ ID NO: 50363 - DNA, 438 bp, Artificial Sequence
  Description of Artificial Sequence: Synthetic coding sequence
atgtggaccgcccggggccccttccggcgggaccggtggagcagcgaggatgaagaagcagctggtccaagccaagcactcagccctctactgtctgatacacgcaaaatcgtgagcgagggcgaactggaccaattagctcaaattagaccccttatcttcaactttcatgagcagaccgcgatcaaggattgcctgaaaattctcgaagagaagacagccgcgtacgacatcatgcaagagttcatggccctcgagctgaagaacctgccaggtgagtttaattcaggaaatcaacccagtaatcgcgagaaaaacagataccgcgatattctgccattccagcaccacgggtactcaggacctaacgaaagaacaactttctggcatggcagtaacgagggcgccgtctcgctcttgttaagatactgcgcttag

SEQ ID NO: 50364 - DNA, 681 bp, Artificial Sequence
  Description of Artificial Sequence: Synthetic coding sequence
atgagcagcccccgggacttccgggccgagcccgtgaacgactacgaagggaatgacagcgaagccgaagaccttaacttccgggagaccctccctagttcttcccaggagaacactccccggagcaaggtattcgaaaataaggtgaatagcgaaaaagtaaagctcagcttgcggaattttccgcacaatgattatgaggacgtattcgaggaacccagcgaatcgggaagtgacccaagtatgtggacggcgagagggccatttaggcgggaccgctggtcctcggaggacgaggaagcagccgggccatcacaggccctaagccccctcctatcagacacccgaaaaattgtgtccgagggagagctggatcagctggctcagattcggccacttatatttaactttcacgagcagactgccatcaaagactgtctcaagattctagaggaaaaaacggccgcctacgatattatgcaagaattcatggcgctcgagctgaagaacctccccggggagttcaacagcgggaaccagccatccaatcgagaaaaaaataggtacagggacatcctcccatttcagcatcatggctacagtggccccaacgagagaactaccttttggcatggttcaaatgaaggcgccgtgtcattgctactgaggtattgtgcctag

SEQ ID NO: 50365 - DNA, 1020 bp, Artificial Sequence
  Description of Artificial Sequence: Synthetic coding sequence
atgtggaccgcccggggccccttccggcgggaccggtggagcagcgaggacgaggaggcagcggggcccagccaggcgctgagtccactattgtcagatactcgaaaaattgtgagtgagggcgagctagatcagctcgctcagatacggccgttgatctttaattttcatgagcaaactgccattaaagactgcctcaaaattctggaggaaaaaacagccgcatatgacattatgcaggaatttatggccttagaactgaagaacctgcccggtgaatttaactccggtaatcagccttctaatagggagaaaaaccggtaccgtgatatccttccatatgactcgacacgagtgccgcttggtaagagtaaagactatattaatgcatcctatattaggatagtcaactgtggggaggagtacttctacattgccactcagggacccctgctgtccactatcgatgatttttggcagatggtgttggagaataactcaaacgtgattgcaatgatcacacgcgaaattgagggtgggattatcaaatgttaccactactggccgattagcctcaagaagccgctggaactaaaacactttagagtctttctcgaaaactatcaaattctgcagtactttattattagaatgtttcaggtggtggaaaagagtactgggacttcacactcagtgaagcagctccaattcactaagtggccagaccatggcacacctgcatccgcagactcctttatcaagtacataagatacgcccggaaaagtcacctcactgggccaatggtggtccactgctccgccggtatcggccggaccggcgttttcctctgtgtggatgtcgtgttctgtgccatcgtcaagaactgttcattcaatattatggatattgtcgcacaaatgcgcgaacaacgaagcggtatggtccagacaaaagagcagtatcatttttgctatgacatcgtgttggaggtcttaagaaaactgctgacacttgattag

SEQ ID NO: 50366 - DNA, 1137 bp, Artificial Sequence
  Description of Artificial Sequence: Synthetic coding sequence
agcttcagcccccggctgtgcagcgtgaacgactacgagggcaacgatagcgaggctgaagacctgaacttcagagaggctcttccttcatcatcgcaggagaatacaccaaggtctaaggtcttcgagaataaggtgaacagtgagaaggtcaagttgagcttacggaactttcctcacaacgattatgaggacgtatttgaggagccatcagaatcaggatctgacccctcaatgtggaccgcacggggccccttcgggcgggaccgttggtccagtgaggatgaagaagcagccgggccctctcaggcactgtcgcccttactaagcgacactcggaaaatagtatccgagggcgaactcgaccagctcgcacagattagacctttgatctttaacttccacgagcaaaccgctattaaggattgcttaaagattttggaagagaagacggccgcctatgatataatgcaggaattcatggctctggagttaaagaatctgcccggggagtttaactcagggaatcagccttccaacagggaaaaaaaccgatatagggatattctgccctacgactccacaagagtgcccctgggtaagtcaaaagactacatcaatgcaagctatatacgaatcgtgaactgcggagaggaatacttctatatagctacgcaaggcccgctgctttcgaccatagacgatttctggcagatggttctcgagaataacagcaatgtcatcgctatgattactcgggaaattgaaggcggtattatcaaatgctaccactattggccaatcagtctcaagaaaccattagagctgaaacatttcagagtttttctggaaaactaccagatcctacagtattttatcatccgcatgttccaggtcgttgaaaaatctactgggacatctcatagtgtgaaacaacttcagttcacaaaatggcccgaccatggtacgccagccagtgctgatagcttcatcaaatacatacgatatgctaggaaatcccacctgacagggccaatggtggttcactgctcagccgggatcgggcgcaccggggtgtttctgtgcgtcgacgtggtgttctgtgccattgtgaagaattgtagtgtgtcagtctag

SEQ ID NO: 50367 - DNA, 279 bp, Artificial Sequence
  Description of Artificial Sequence: Synthetic coding sequence
tgaggccccaactggcggggctgctggggctgcagcggcaccgtgggtgcggccccccaagctcaggtctttgagaacaaggttaactccgagaaagtcaagctgtccctcagaaatttccctcataacgactacgaagacgtgttcgaagagcctagtgagtctggttctgacccctctatgtggacagccagagggccatttggacgcgaccgctggagctctgaggatgaggaggccgctggcccttctcaggcgctcagtccactgctctcttag

SEQ ID NO: 50368 - DNA, 342 bp, Artificial Sequence
  Description of Artificial Sequence: Synthetic coding sequence
atgagcagcccccgggacttccgggccgagagcgtgaacgactacgagggaaacgactccgaagccgaagatctgaacttccgggaggcacttccgtccagcagccaggaaaataccccacgctctaaggtctttgagaataaagtgaactctgagaaggtcaaactgtcgttgcgtaacttccctcacaacgactacgaagatgtgttcgaggaaccttcagaatccgggtcagacccctcaatgtggaccgctaggggtccctttggcagagatcgctggtcgagcgaagacgaagaggctgcgggaccaagtcaggccctgagtccactcctgtcttag

SEQ ID NO: 50369 - DNA, 924 bp, Artificial Sequence
  Description of Artificial Sequence: Synthetic coding sequence
atggagaaccaggtgctgaccccccacgtgtactgggcccagcggcatcgtgaactgtacttgagggttgagttgtccgatgtccagaatcccgctatctctataactgagaatgtcctgcacttcaaggcccagggccatggggccaaaggagacaacgtttatgagtttcatctcgaattcctcgacctggttaagccggaggaagaggagcgactgaataagttgagactcgagagtgaaggatcccctgagaccttgaccaacctgcgaaaaggctacctatttatgtacaatctggtacagtttttgggctttagctggatttttgtcaatcttactgtcagattttgcatactgggtaaagaaagcttttacgacactttccacaccgtggccgacatgatgtacttttgccaaatgttggccgtcgtcgagactatcaacgcggccatcggagtcaccactagtcctgttcttcctagtctgatccagttactgggacggaactttatcctgttcatcatctttggtaccatggaggagatgcagaacaaagccgtcgtcttcttcgtattctacctatggtcggcaattgaaatctttcggtacagtttttacatgcttacatgtatagatatggattggaaggtactgacctggctgcgctatacactctggatacctctctatccccttggttgtctggcagaggccgtgagcgtgatccagtccatccctatcttcaacgagaccggccggtttagctttacattgccttaccccgttaagattaaagttagatttagcttcttcctccaaatctacttgatcatgatcttcctcggcctgtacattaattttcgccacctctacaagcagcgacgccgcagatacgggcagaaaaaaaagaagatccactag

SEQ ID NO: 50370 - DNA, 1932 bp, Artificial Sequence
  Description of Artificial Sequence: Synthetic coding sequence
atgcggaccctgcggcggctgaagttcatgagcagccccagcctgtccgatctcggcaagcgggaacccgctgctgcagctgatgagcggggaacccagcagcgaagggcctgtgccaacgctacctggaactctatccataacggcgtaatcgccgtgttccagagaaaaggacttccggaccaggagctgtttagcctcaacgaaggggtgaggcagttgctgaaaacggagcttgggtcattctttaccgagtacctgcagaatcagctgctgaccaaaggcatggtgatactgcgagataaaatccgtttctacgagggtcagaagctccttgacagcctcgccgaaacctgggacttctttttctcagacgtcctgccaatgctgcaggcgatattctatccagtgcaaggcaaagaaccctctgtccggcagctggccttgttacatttccgcaacgcaataacactaagtgtgaaactcgaagatgcgctggcccgggcccatgctcgcgtgcctcctgcgatagtgcaaatgctcctggtgctgcaaggcgtgcacgaaagcaggggtgtgacggaggattacctcagacttgaaaccctggtccaaaaagtcgttagcccttacctcggcacctatgggctgcatagcagcgagggaccttttacacactcctgtatcctggagctgcagagagataaagcggctgccgctgccgtcctgggggctgtgcggaaacgtccatccgtcgtgcctatggccggacaagatccagcccttagtactagtcacccattttacgacgtcgcaaggcacgggattctgcaggtggcaggagatgaccgcttcggtaggcgggttgtcaccttttcatgttgccggatgcctccgtcccatgagctcgaccatcagagactcctggagtataagaagaacctgaaggctttgtacgtcgtgcaccccaccagttttatcaaagtattatggaacatattaaagccattgattagtcataaattcggaaaaaaggttatctacttcaattacctcagtgagctccacgagcatcttaaatatgatcagctggtcataccccccgaagtcctacgctatgacgagaagctgcagtccctgcatgaaggacggacaccaccacccactaagacccccccaccccggccccctctgcccacccaacagttcggggttagtctgcaatatctgaaggataagaaccagggggaactcatccctccagtgcttcgcttcacagtgacctacctgagagagaagggattacgcacggagggcctctttagaaggtctgcgagcgtgcaaaccgttagagagattcaacgactgtacaaccaggggaagcccgtcaattttgatgactatggggatattcatattcccgccgtgattctgaagacatttttgcgcgagctccctcagccactgctaacgtttcaagcttatgaacagatcctagggataacctgtgtggagtcctcactccgggtgaccggttgtcggcagattttaaggtctttaccagagcacaactacgtcgtcctgagatatcttatgggattcctgcacgccgtatccagggagtctatctttaacaagatgaacagctctaacctcgcgtgcgttttcggcctgaatcttatctggccatctcagggcgttagttctctgagtgcgctagtgcctttgaatatgttcacagaactcctaattgagtattatgagaaaatcttcagtactccggaagctcccggtgaacacggtttggccccgtgggagcaaggttctcgcgccgcccctttgcaggaggccgtcccacggacgcaagcgacagggcttacgaaaccaacactgcccccttctccgttgatggcggccaggagacgactctag

SEQ ID NO: 50371 - DNA, 1695 bp, Artificial Sequence
  Description of Artificial Sequence: Synthetic coding sequence
atgcggaccctgcggcggctgaagttcatgagcagccccagcctgagtgatctggggaagagagaacccgccgctgctgctgatgagcgtggcacccagcagaggagagcttgtgcaaatgcaacgtggaactcaatccacaacggagtgatcgccgtatttcagaggaagggattgccggatcaggaattatttagtctcaacgagggcgtcagacagctcttaaagacagagctgggcagcttctttacagaatacctgcagaatcagctgctcaccaaaggaatggtcatactgagggacaaaatcagattttacgaggagttgcagcgcgataaggcggccgcagccgcagtattaggcgcagtccgcaagagaccgtcagtggtgccaatggcaggtcaagatcctgccttgtctacatcacaccccttctacgatgtggcccgccatggaattctgcaggtggctggagatgatcgcttcggcagacgagtcgtaaccttcagctgctgccgcatgccccccagccatgaactcgatcaccagcgtctgctcgaatacctaaaatatactctggatcagtacgtggagaatgattacaccatcgtttacttccactatgggttgaatagtcggaataagcctagcctgggctggctacagagtgcttacaaggaatttgaccggaagtataagaagaatctcaaggctctgtatgtagtgcacccaacatcgtttataaaggtgctgtggaacatcctgaaaccacttatctcacacaaattcggcaaaaaggttatctacttcaattacctgagcgagctacacgagcatctcaaatacgatcaactggtgatccccccagaagtcctgaggtatgatgaaaaattacagtcccttcacgagggccgcacccccccaccaaccaaaactccccctccacgtccaccattgccgacgcagcagttcggcgtgtcactgcaatacctgaaggataaaaatcagggtgagctgatcccgccagtattgagatttaccgttacatatttgcgcgaaaagggcctccgcaccgaggggctgtttagacggtctgcctctgtgcagacggtaagggagatacagcgcctctacaatcagggaaagccagtcaatttcgacgattacggagacatccacatccccgctgtgatactaaagacattcctgagggaactgccccagccactactcacatttcaggcctacgagcagattcttggcatcacttgcgtcgaaagttccctgcgagtgacaggctgcaggcagatattaagatcacttcctgagcacaactacgttgtcttaagatatctcatgggttttcttcacgcggtcagcagagagagcatcttcaataaaatgaactcctctaacttggcctgtgtcttcgggctgaacctgatctggccatctcagggagtttccagcttgtccgctctggtgccgctgaatatgttcaccgagttacttattgagtattacgaaaagatctttagcaccccggaggcgcccggggagcatgggctggccccttgggagcagggatcacgcgctgcccccctgcaggaggcagtcccgagaactcaggcaacaggtctgaccaaaccaactctcccaccgtcccctctcatggctgctcggcgaagattgtag

SEQ ID NO: 50372 - DNA, 1515 bp, Artificial Sequence
  Description of Artificial Sequence: Synthetic coding sequence
tgactgggcagcttcttcaccgagtacctgcagaaccagctgctgacaaaaggcatggtgatcttacgggataagatcaggttctatgaagagcttcagagagataaggccgctgcggccgccgtattgggcgccgtgcgcaagcggccgagtgtcgtgccaatggctgggcaggaccccgcactgtctacatcacatcctttttatgatgtggcccgccatgggatcctccaggtggctggtgacgatcgtttcggccggcgtgtcgtgaccttctcatgctgtcggatgcctccaagtcacgagctcgatcaccagcgtcttctcgaatatctcaaatatactctggaccagtacgtggaaaatgattataccattgtgtatttccattacggtctcaactcaagaaacaagcctagcctgggctggcttcagagcgcttacaaagagtttgatcgtaagtataaaaagaacctgaaggctctgtatgtggtccaccctacctcattcatcaaagtcctgtggaatattctcaagcctctcatcagccataagtttggaaagaaagtgatttacttcaattacctctctgagctgcatgaacacctgaagtatgaccaactggtgattccacctgaggtattacgttacgacgagaaactgcagtcactgcacgagggacgaaccccccctccaacaaagaccccccctcccagaccccctctgccgacacagcagttcggcgttagcctgcagtacctcaaagataagaatcaaggcgaattgatcccccctgtcctgaggtttacagtgacctatctccgcgagaaaggactgcgaaccgaaggcctgtttagaagatctgcttctgtccaaaccgtgcgcgaaatccagcggctgtataaccagggcaaaccggtgaatttcgacgactacggggacattcatattccagctgtgatcttaaagacctttttgagggagctcccccagccactgttaacattccaggcctacgaacagatcctcgggatcacttcattgcccctcgctccactagagttatcaagagagccccacgctcttccaggagtggagagttctcttcgggtgaccggctgtcggcagattcttaggagcctcccagagcacaactacgtggtgttgaggtatctcatgggtttcctgcacgctgtctctcgagagtccatctttaataagatgaactcctccaacctggcctgtgtgttcgggctgaacctcatttggccttcccagggagttagtagtctgtcggcccttgttccactgaatatgttcaccgagttgctcattgaatattatgaaaagatattctcaacacctgaagctccaggcgagcatggtctggctccttgggagcaaggctcccgcgcggcccccttgcaggaggccgtcccacggacccaggctaccggcctgactaagcccaccctaccacccagccctcttatggccgcccggagaaggctgtag

SEQ ID NO: 50373 - DNA, 1590 bp, Artificial Sequence
  Description of Artificial Sequence: Synthetic coding sequence
atgttccccctgaccgaggagaacaagcacgtggcccagctgctgcttaacaccggcacatgtccaagatgcattttcaggttctgtggcgtcgattttcacgccccttataagctaccttataaggaattgttgaatgaactccagaagttcctggagaccgaaaaagacgaactcatcctcgaagtgatgaatccaccacctaagaagatcaggctacaagagctggaggattcaattgataacttgtctcaaaacggggaaggtaggatatccgtctcccatgtgggtagcaccgcctccaaaaacagcaacttaaacgtgtgcaatgtctgtctcggcatcctccaggaattttgcgagaaggattttataaaaaaagtgtgtcagaaagtggaggccagcgggtttgagttcaccagcttggtgttttcagtctcctttcccccccaactctcagttagggaacacgctgcatggctcctcgtgaagcaagaaatgggaaagcagagtctgagcctcggtcgcgatgatattgttcaactgaaggaggcctataaatggataacacatccgctgttttcagaagagttaggagtgccgattgacggaaaatccctattcgaggtctcggtagtcttcgcccacccagagaccgtcgaagattgtcacttcctcgccgcgatttgtcctgattgtttcaaacctgcaaaaaataagcaatcagtgtttacccgcatggcagtgatgaaagcactcaataaaattaaagaagaggattttctgaaacagttcccctgccctcctaactccccaaaggccgtctgtgctgtacttgaaatagaatgtgctcatggtgcagtgttcgtcgccggtaggtacaacaagtatagccggaatctcccacagaccccgtggattatcgacggcgagcgtaaactggaatctagcgtagaggaactaataagtgaccatttgttagcggtttttaaagcggagtcctttaatttttccagttcaggacgagaagatgtagatgtgcggacgctcgggaatggaaggccctttgctattgaattggttaatcctcatagggtacacttcacttcccaggagatcaaggaactacagcagaagatcaataatagtagcaacaagatccaggttcgcgacttgcagctggtgacacgggaggcgatagggcacatgaaggaaggagaagaagagaaaacaaagacatattctgcactcatctggacaaataaagctatccagaaaaaagatatcgaattcctgaacgatatcaaggatctaaagattgaccagaagacccccctgagagttctgcatcgtcgacctctggccgtgcgtgcccgtgtgatccactttatggagacccaatatgtggacgagcaccatttccggctgcatttgaaaactcaagctggcacctatattaaggaatttgtgcatggagattttggccggacaaaacccaatatagggagcttaatgaacgtcacggcagatatccttgaactcgacgttgaaagcgtggatgtggactggccaccagcccttgacgattag

SEQ ID NO: 50374 - DNA, 1590 bp, Artificial Sequence
  Description of Artificial Sequence: Synthetic coding sequence
atgttccccctgaccgaggagaacaagcacgtggcccagctgctgttgaatacaggcacgtgtcctcgatgcatttttagattctgcggggtggatttccatgcaccctacaaattgccatacaaggagctcttgaacgagctgcagaaatttctggagacggagaaggacgagctgatcctcgaagttatgaacccacccccaaaaaaaattcgtctgcaggagttggaggactccatagataacctttctcagaacggcgaggggagaatttctgtgtcccacgttgggtccacagcatccaaaaactccaatctaaacgtctgcaatgtgtgcctgggtatcttacaggagttttgcgagaaggactttattaaaaaggtgtgccagaaggtggaggcaagtggttttgagttcactagtttagtattcagcgtgtcatttcctccacagttgtcagtgcgggagcatgctgcatggctccttgtgaaacaggaaatgggcaagcagtctttgagtctcggacgagatgacattgtacagctaaaggaggcctataagtggatcacacaccctttattttctgaggagctgggagtgcctattgatggcaaaagtctgtttgaagtaagcgtggtgtttgcccatcctgaaacagtggaggattgtcatttcctggcggctatttgtcccgattgcttcaaaccagccaaaaataaacagtccgtgttcacacgcatggccgtgatgaaggctcttaacaaaattaaggaagaggactttctgaagcaattcccttgccccccaaattccccaaaggccgtctgtgctgtcctcgagattgagtgtgcccatggggcggtgtttgtcgcaggacgctataacaaatactctcggaatctgcctcagacaccctggatcatcgacggagaaagaaagcttgaatctagcgtagaggagctgattagtgaccaccttttagcagttttcaaggctgaaagcttcaacttctcatcttccggcagggaggatgtcgacgtgagaacgctgggaaacgggcggcctttcgcaattgagctggtcaatcctcaccgggtccatttcacaagccaggaaattaaggagctccagcagaagatcaacaacagctccaataagatacaggtgagagatctgcagctggtgaccagggaggccattgggcatatgaaggagggcgaggaggaaaagacaaagacttactccgcgctgatctggacaaataaagccatccagaagaaagatattgagttcttaaatgacattaaagatctgaagatagatcagaaaacccctttgagggtgctgcaccgaagaccactcgcagtgagggctagggtgattcacttcatggaaacgcagtacgtggatgagcaccacttcagactccacctcaagactcaggctggaacctacataaaggagtttgtacatggcgattttgggcggaccaaaccaaatattggttccttgatgaatgtgacggctgatattctcgagctggatgtggagagcgtggatgtggattggccacccgccttggacgattag

SEQ ID NO: 50375 - DNA, 363 bp, Artificial Sequence
  Description of Artificial Sequence: Synthetic coding sequence
atgttccccctgaccgaggagaacaagcacgtggcccagctgctgctgaacacagggacatgtcccagatgtatattccgtttctgtggggtcgacttccacgccccttacaaattgccttataaagagctccttaacgagctccaaaagttcctggaaacagaaaaagacgaactcattcttgaagtcatgaatcctcctcccaaaaagataagactgcaggagctggaagattctattgataacttaagccagaacggagagggccgcatctcagtctcacacgtgggatcgacagcctcgaagaactctaatctgaacgtttgcaacgtgtgcttgggcattttacaagaattttgctag

SEQ ID NO: 50376 - DNA, 1986 bp, Artificial Sequence
  Description of Artificial Sequence: Synthetic coding sequence
atggagatgaccgagatgaccggcgtgagcctgaagcggggcgcccttgtggtcgaggataacgactctggggtaccagtggaggagaccaaaaaacagaaactctctgaatgcagcctgacaaagggacaagatggcctgcaaaacgactttctgtctatttcggaggacgtccctagaccccctgacactgtgtccaccggtaagggtggaaaaaattccgaagcacagttagaagatgaagaggaagaagaggaagatggattgtctgaggagtgcgaagaagaagaaagcgagtccttcgctgacatgatgaagcatggcctgaccgaggcagacgtgggcatcacgaagttcgtgtcgtcacatcagggattcagtgggattcttaaagaacggtacagcgatttcgtggtgcatgagatcggcaaggacggccggattagccacctaaatgacctgagtatccccgtggatgaagaggaccccagtgaggatatatttaccgtcctgaccgccgaggaaaagcagaggttggaggaattacagctgttcaagaacaaggaaacctccgtggcgatagaagtgatcgaggatactaaggaaaaacgaactatcatccaccaggcgataaagagcctgttccctggattagagaccaaaactgaggaccgggaaggcaagaagtacattgtggcatatcacgcggcagggaagaaggccttggctaacccgaggaagcattcatggcccaagtcacgcgggagttactgtcacttcgtgctgtacaaggagaataaagacaccatggacgccatcaatgtcctgtctaagtaccttcgagttaagcctaacatcttctcctatatgggaacgaaggacaagagggcgatcaccgtccaggagattgcagtgctgaaaatcaccgcacagcgcctcgcacacttaaacaagtgtcttatgaactttaagctgggaaactttagttatcagaaaaatccactcaaactcggagagctgcagggcaatcatttcacggtcgtgctgcgaaatatcaccggcacggatgatcaggtacagcaggccatgaatagccttaaagagatcggatttatcaactactatgggatgcagcggttcggtacaaccgctgtgcctacatatcaggtaggacgcgccattctgcagaatagctggaccgaagtcatggatcttattctgaagccccggtccggagccgagaaaggatatcttgttaaatgccgggaggagtgggccaagaccaaggacccaacagccgcattgcgaaagctgcctgtgaagcgctgcgtcgaaggtcagttgcttagggggctctccaaatacgggatgaagaacatcgtgtcggcgtttgggatcatccccaggaacaacaggcttatgtatatccacagttaccagtcttacgtgtggaacaatatggtcagcaagaggattgaagactatggtctgaaacctgttcccggggaccttgtgctgaaaggagccaccgcaacctacatagaggaagacgatgtcaacaattactccattcacgacgtggtcatgccactgccggggtttgacgttatataccctaagcacaagatccaagaagcctatcgggaaatgctgactgcagataacctggatatcgacaatatgcgacataaaattagggactacagcctctccggcgcatatcgaaaaatcatcattcgtccccagaatgtctcctgggaagtggtggcttacgatgatcctaaaattcctcttttcaataccgatgtagacaatcttgagggcaagacccctccagtctttgcctccgaagggaaatatagagcgctcaagatggatttctccctcccgccatccacctacgcaaccatggcgatccgggaagttttgaagatggacacttctatcaaaaatcagacccagctgaatacaacttggctccgctag

SEQ ID NO: 50377 - DNA, 1986 bp, Artificial Sequence
  Description of Artificial Sequence: Synthetic coding sequence
atggagatgaccgagatgaccggcgtgagcctgaagcggggcgcccttgtggtggaggataacgattccggcgtgcccgtggaggaaacaaaaaagcagaagctctctgagtgtagcttaacaaaggggcaggatgggctccagaacgattttctgtcaatcagtgaggacgtacctagaccccctgatacagtcagcacggggaaagggggaaaaaactcagaggcacagctcgaagacgaagaagaggaggaagaagatggcctcagcgaggaatgtgaagaggaagagtctgaaagtttcgctgatatgatgaaacatggtctcacagaagcagacgtgggcattacaaaatttgtcagcagccaccagggttttagcggcatcctgaaggagcgctatagcgattttgttgtgcacgagatagggaaggacggcaggatatcccacctgaatgatttgtccattccggtggatgaagaggatccatccgaggacatcttcacagtgctaacagccgaagaaaagcagcggttggaagagcttcagctgttcaaaaataaagagaccagtgtggccattgaggtaatagaagacactaaagaaaaacgcacgatcatccaccaggccatcaaatccttgttccctgggctggagacaaagactgaggaccgtgaaggaaagaagtacattgttgcataccatgctgccggcaagaaggccctggccaatccacggaagcactcctggccaaagtcccgcggctcctattgccacttcgttctatataaggaaaataaagacactatggacgccatcaacgtgctgtcaaagtacttgcgggttaaacccaatattttcagctacatgggcacgaaggacaagagggccatcacagtgcaagaaatagccgtcttaaagatcacagctcagcgtctggcccatctgaataagtgtcttatgaacttcaagctgggcaacttttcgtaccagaagaacccgctgaagcttggtgaactacagggcaatcacttcacagtggtgcttcgaaatattaccggcactgatgaccaggtacagcaggccatgaactcattgaaggaaatcgggtttataaactactacggaatgcagcgctttggtacaactgccgtccctacctatcaggtgggcagagccattctacagaatagttggacagaagtgatggaccttatcctgaaacctaggagcggcgctgagaagggttatttggtaaagtgccgcgaggaatgggcaaagaccaaagatccaaccgctgcactgcgaaaattgcccgtgaagaggtgcgtcgaggggcagctactccggggcttgagtaagtatggcatgaagaatatcgttagcgcgtttggaatcataccaagaaataacagactgatgtacattcattcctaccaaagctacgtgtggaataatatggttagtaagcgaatcgaagactacggcctcaaacccgtaccaggcgaccttgtgctgaagggtgctaccgcgacctacatagaggaagatgatgtgaataattatagcattcatgatgttgtaatgcccctgccaggatttgatgtcatctatccaaaacataaaatacaggaggcgtatcgggaaatgctcactgcagataacctggatatcgataacatgcggcacaagatccgggactactctcttagcggtgcctataggaagatcatcatccggccccagaatgtcagttgggaagtggtggcgtacgacgatcccaaaattcccctgtttaacaccgatgttgacaacttggaaggcaagacgcccccagtctttgcttcggaaggcaagtaccgagcactgaagatggatttcagcctaccacctagtacctacgccaccatggccattcgagaagtcctgaaaatggacacttccatcaagaaccagactcagttaaatacaacttggctgagatag

SEQ ID NO: 50378 - DNA, 1986 bp, Artificial Sequence
  Description of Artificial Sequence: Synthetic coding sequence
atggagatgaccgagatgaccggcgtgagcctgaagcggggcgccctggttgtagaagacaacgattctggggtgcccgtagaggaaactaagaagcagaaactctctgaatgctccttgactaagggccaggacggactgcagaatgactttctgtccatcagcgaggatgttccccgacccccagatactgtcagtacaggaaagggggggaagaatagcgaggcccagctagaagacgaagaggaagaggaggaggatgggctgtctgaagagtgcgaagaggaggagtcagagagtttcgcagatatgatgaaacatggccttacagaggcagacgttgggattaccaagttcgtgtcatctcaccaaggtttttcagggattctcaaagaacgctatagcgactttgtggtccacgagatcggaaaagacggccgcatctctcatctgaatgacctctccatacccgtggatgaggaagacccaagcgaagacatttttaccgtgctgactgcagaggagaaacagcgacttgaggaactgcagctgtttaaaaataaggagacctcagttgctattgaagtgattgaggatacaaaggaaaaaaggaccattatccaccaggctattaaaagcctgttccctggattggagacaaaaacagaggacagggagggaaagaagtatatcgtcgcgtaccatgccgctggaaagaaagccctcgcaaaccccagaaaacactcttggccaaaaagtcggggctcttattgccactttgtcctgtataaggagaataaagatactatggacgccattaacgtgctgagtaagtacctgagggtgaaaccgaacattttctcttacatgggtacaaaggacaaacgcgccattaccgtgcaagagatcgccgtgctaaaaataacagctcaacggctagcgcatttgaataagtgtcttatgaattttaaacttggaaacttctcttatcagaagaacccactgaaacttggcgaactgcaaggcaatcatttcaccgttgtcctgcggaatattacaggcaccgatgaccaagtacagcaagcgatgaattctctgaaggagatcgggtttatcaattattacggcatgcagcgctttggcacaaccgcagtacctacctatcaggtaggacgtgccatccttcagaacagctggactgaggtaatggatctgatccttaaacccagatctggcgctgagaagggctacctggtaaaatgtagagaagagtgggcaaaaaccaaggatcccactgctgccctgcgaaaactcccagtgaaaaggtgcgtggagggacagctgctgagaggactttccaagtacggtatgaagaatattgtgtccgcttttggtattatccctagaaataacagactcatgtacatacactcctatcaatcttacgtgtggaacaacatggtgtctaaacggatcgaagattatggcctcaaacccgtacccggagatctagtcctgaagggcgcgaccgccacctatatcgaagaggatgacgtaaataattatagcattcacgatgttgtgatgcccctccccggcttcgacgtgatttatcccaagcacaagatccaggaggcctaccgcgaaatgctgacagccgacaacttggacatagacaacatgagacacaagatcagggattacagtctgagtggagcttacagaaagatcattatccgccctcagaacgttagctgggaggttgtggcctacgacgatcctaaaatcccacttttcaacaccgatgttgacaatcttgagggtaagacacctccagtttttgccagcgaaggcaagtatagagccctgaagatggatttcagcttgcccccctccacttatgctactatggccattcgggaggttctcaaaatggacacttcgatcaagaaccagacacagctcaataccacatggctgaggtag

SEQ ID NO: 50379 - DNA, 2106 bp, Artificial Sequence
  Description of Artificial Sequence: Synthetic coding sequence
atggaggaggacaccgactaccggatccggttcagcagcctgtgcttcttcaacgaccacgttgggtttcatgggaccattaaaagctctccctcagactttattgtcattgaaatcgatgagcagggacagctcgtcaacaagactattgacgagcctatctttaaaattagcgagattcagctggagcctaacaactttccaaagaagccaaagctcgatcttcagaatctttctctagaggacggacggaaccaagaagtgcacacccttattaaatatactgatggggatcaaaatcaccagagcggatctgagaaggaggacaccatcgttgacgggaccagcaaatgcgaggaaaaggccgatgtgttaagtagcttcttggatgaaaagactcacgaacttctaaacaattttgcatgtgatgtgcgtgagaaatggctgtccaaaacggagttgatcggactgcccccggagttcagtattggtcgtatcctagataagaatcagagagcctcactgcacagcgcaatccggcagaagtttcccttcttggttaccgtgggtaagaattctgaaatagtagtgaagccaaatttagaatataaggaactgtgtcatttggtgtcagaggaagaagccttcgattttttcaagtatctcgacgcaaaaaaggagaacagcaagttcacgttcaagccagacacaaacaaagaccacagaaaagccgtgcatcactttgtgaacaagaaatttggcaatctggtggaaacaaagtcattctccaagatgaactgtagtgcaggcaatccgaatgtagtggtcacagtcagattcagggagaaagcacataaaaggggcaagcggcccctctccgagtgtcaggaggggaaagtaatctacacagctttcaccttaaggaaagaaaatttagagatgtttgaggcgatcggatttcttgcgataaaactgggcgtaattccaagcgacttttcatacgcaggcctaaaggataagaaggctatcacatatcaagctatggtggtacgaaaggtgacccccgagagactgaaaaatattgagaaggagatcgaaaaaaagaggatgaacgtgtttaatattcgcagcgtcgatgactcactgcggctgggccagcttaaaggaaaccatttcgacattgtgatacgcaacctaaaaaaacagatcaacgattcagcaaatctacgcgagaggattatggaggcgatagagaatgtgaagaagaagggctttgtcaattactacggaccccaaaggttcgggaaagggcgaaaagtgcatacagaccagatcgggctggcactgttgaaaaacgagatgatgaaagccatcaagctgttccttacaccggaggatctcgacgaccccgtcaatcgggccaagaaatatttcctgcaaacagaagacgccaaagggacactatccctgatgccggagtttaaggtaagggagcgagctttactggaggcactgcaccgcttcggcatgaccgaggagggatgcattcaggcctggttctctttaccccatagcatgcggattttttacgtgcacgcttatacttccaagatatggaatgaagcagtttcctatcggcttgaaacatacggcgcacgagtagttcaaggagaccttgtgtgcctcgatgaggacattgatgacgaaaactttccaaacagcaagatacaccttgtgacggaggaggaggggtccgcgaatatgtatgccatccaccaagtcgtcctgcccgtgctgggctacaacatccagtatcccaagaacaaggttggacaatggtaccatgatattttgagtcgcgatggactgcagacatgtcgctttaaagtccccactctgaagttgaatatccccggttgttaccggcagatcctcaagcatccatgtaacctgtcctaccagcttatggaagaccatgatattgacgtgaagaccaaagggtcccacattgacgagactgccctttcactcctcataagttttgatctggatgcctcctgctacgccactgtgtgcctgaaggagataatgaagcacgacgtctag

SEQ ID NO: 50380 - DNA, 2106 bp, Artificial Sequence
  Description of Artificial Sequence: Synthetic coding sequence
atggaggaggacaccgactaccggatccggttcagcagcctgtgctttttcaatgaccatgttggttttcatgggactattaagagcagcccctcagattttatcgtaattgaaatcgacgagcaaggccagctggtgaacaaaactatcgacgaaccaatttttaagatttcagaaatccagttggagcctaataatttccccaagaagcccaagctcgatctccaaaacctgtccctggaagatggccgcaaccaggaggttcacaccctgataaagtacacggacggggatcagaatcatcagtctggaagcgagaaggaggatacgattgtcgatggcaccagtaagtgtgaggaaaaggctgacgttctatcatccttcctggacgaaaagacgcacgaactcctcaacaattttgcctgcgacgtccgtgagaagtggttgtccaaaaccgagctgattgggttaccccctgagttcagcatcggccgaattctggacaagaatcagagagcttctcttcatagtgccatcagacaaaagtttccttttctcgttaccgtggggaagaacagtgaaattgtagtgaagcccaacttggagtataaagagctgtgccacttggtgagcgaagaggaggctttcgactttttcaagtaccttgacgctaaaaaagaaaattctaagttcacctttaagccagacacaaacaaggatcaccgcaaggcagtccatcatttcgtgaacaaaaaattcggcaatctggtggaaaccaagagtttttctaagatgaattgtagcgcaggcaatcccaacgtggtggttactgtgcgattccgagagaaagctcataagagaggaaagagacctctatctgagtgtcaggaagggaaggtcatctacaccgcattcaccctcaggaaagagaatcttgaaatgtttgaagccatagggttcctcgccattaagctgggggttatcccatcagactttagttacgccgggcttaaagacaagaaggccataacgtaccaagctatggtagtgcgaaaagtgacacctgagcgcctgaaaaacatcgagaaagagatagagaaaaagagaatgaatgtctttaatattcgttctgtagatgatagtcttagactgggacaactgaagggaaaccactttgacatcgtgattaggaatctcaaaaagcagatcaacgactcagcaaatctgcgtgaaaggatcatggaagccattgaaaatgtgaagaaaaaagggtttgtgaactactatggacctcaacggttcgggaaagggcggaaggtgcacaccgaccagattggcctggctctactgaagaatgagatgatgaaggctattaaactatttctcactcccgaggatttggatgacccagtgaaccgcgccaagaagtactttctacagacagaggacgccaaggggactctcagcctgatgccagaatttaaagtgcgcgagcgggctctactagaagctctgcatagatttggcatgaccgaagaaggatgcattcaagcctggttcagtctgccacattccatgcgcatcttctatgttcatgcttatacctctaaaatttggaacgaggcagtgagctacagacttgaaacctacggcgctcgcgtggtacagggggacctagtgtgtctggacgaggacattgacgacgagaacttccctaatagtaaaatccatctggttaccgaagaagaagggagcgcgaacatgtatgcaatacaccaggtggtgcttcccgtgctgggatacaacatccagtatcctaaaaataaagtgggccaatggtaccacgacattctctcacgggacggactacagacttgccgtttcaaagtccccactctaaaactgaacatacctggttgctacaggcagatccttaagcacccctgtaacctctcttatcagctcatggaagaccacgatattgatgtgaagaccaaagggagtcacattgacgagacagccctgagtctactcatttcctttgatctcgatgccagttgctacgccacagtttgcctgaaggagatcatgaagcatgacgtgtag

SEQ ID NO: 50381 - DNA, 381 bp, Artificial Sequence
  Description of Artificial Sequence: Synthetic coding sequence
atggaggaggacaccgactaccggatccggttcagcagcctgtgcttttttaacgaccacgtgggatttcacggtaccatcaaaagtagtccttcagatttcattgtcatcgagatagacgaacagggccaactagtgaataagacgattgatgaacccatcttcaagatatccgaaatccaacttgagcccaataactttcccaaaaaaccgaaactcgatctccagaatttatctctcgaggatggccgcaatcaggaggtacataccctcattaagtacaccgatggtgaccagaatcaccaatccggctcagaaaaagaggataccatcgttgatggaacctccaagtgcgaggaaaaggcagacgttctgtcctag

SEQ ID NO: 50382 - DNA, 2106 bp, Artificial Sequence
  Description of Artificial Sequence: Synthetic coding sequence
atggaggaggacaccgactaccggatccggttcagcagcctgtgcttcttcaatgaccacgtgggctttcatgggacaataaagtcctcgccctccgacttcatagtgatcgaaattgatgagcagggacaactagtgaacaagactattgacgagcctatttttaaaatctctgaaatccagctggagcccaacaatttccctaagaagcctaaactggacttacaaaacctgtcactggaggatggtcggaaccaggaggtccacactctgataaaatatacggatggcgaccagaatcaccaatccgggagcgagaaggaggacacgattgtagatggaactagtaaatgtgaggagaaagcagacgtcctgagctcttttttggacgaaaaaacccacgaacttcttaataatttcgcatgtgatgtccgagagaagtggctgtcaaaaactgagttgattggactgccgcccgagttctctattgggcgtatcctggacaaaaatcagagagcctccctgcactctgccatcaggcagaaatttccatttctggtgacggtggggaaaaattcggagatcgtggtgaaaccgaacctggaatacaaggaactgtgccacctcgtaagcgaagaggaggcttttgacttttttaagtacctagacgccaagaaggaaaactccaaattcactttcaaacccgacactaataaagatcatagaaaagccgtccatcattttgtaaacaaaaagtttggcaacctcgtcgagaccaagagtttttcaaagatgaattgctccgcaggcaatcctaacgtagtggttacagtgcggttcagagagaaggcccataaaagaggcaaacgcccactgtctgaatgtcaggaggggaaggtcatttatactgcctttactttgcggaaggagaatctagaaatgttcgaagctattgggttcttggctattaaactgggtgtgatccccagtgattttagttacgctggactcaaggacaagaaggcaattacttatcaggccatggtagtgaggaaagtcacacctgaaaggctcaagaatatcgagaaagagatcgagaagaaacggatgaatgtgttcaatatccgctccgtggacgattccctgaggctgggccaacttaagggaaaccacttcgatattgtcattagaaatcttaaaaaacagatcaatgacagcgccaatttacgggaaagaatcatggaggcaatcgagaatgtaaaaaaaaaaggctttgtcaattactacgggccacaaaggtttggtaaaggcagaaaagttcataccgaccagattgggctcgcactgttaaaaaatgaaatgatgaaagccatcaagttgttcctgaccccggaggacttggatgatcccgttaatcgggcaaagaagtatttcctacaaacagaagatgccaagggcacgctgtcactgatgccagagttcaaagtgagggaacgggccctgttagaagccttgcatcggttcggtatgaccgaggaggggtgtatccaggcttggtttagtctgccacactcaatgagaatcttctacgtacatgcctacacttcaaagatctggaatgaagctgtatcttatcggcttgagacatacggggcgcgcgttgtccagggggatctggtgtgtttggatgaagacatagacgatgagaacttccccaattccaagattcatctcgtgacggaagaggaaggctccgccaatatgtatgcgattcatcaggtcgtcctgcctgtgcttggttacaatatacaataccctaagaacaaggtaggtcaatggtatcacgacattctttccagagatggcctgcagacgtgcagattcaaggttcccactcttaaactgaacatcccaggatgttatcgccaaatcctgaaacacccatgtaacctgtcctatcagctgatggaagaccatgacatagacgtgaagactaagggatcacacatagacgagacggctttaagcctgctgataagcttcgacctagatgcttcatgctatgctacggtgtgcctgaaggagattatgaagcatgatgtttag

SEQ ID NO: 50383 - DNA, 1098 bp, Artificial Sequence
  Description of Artificial Sequence: Synthetic coding sequence
atggaggaggacaccgactaccggatccggttcagcagcctgtgctttttcaatgatcatgttggcttccacggaacaataaaaagctctcctagcgactttatcgtcatagagatcgacgaacaaggacaactcgtgaacaagacgattgatgagcctatattcaaaatttccgagatacagcttgagccaaataatttccccaagaaacctaaactggatttacagaacctcagtctggaagatggcagaaaccaagaggtacatacattgattaaatacactgacggggaccagaaccaccagtctggctcagagaaggaggacaccatcgtggatggtacctccaaatgtgaagagaaggccgacgtactttcaagcttcctcgacgagaaaacccatgaactgcttaacaactttgcctgcgacgtgcgagagaagtggctcagcaaaactgagctaattggcctgcctcccgagttcagtattgggaggattctggacaagaaccagcgtgcctccttgcacagcgctatacgacaaaagtttccctttctggtgaccgtcggtaagaattctgaaatagtagtgaagcctaatctggaatataaggagctctgtcacctggtgagtgaggaggaagcttttgatttctttaagtaccttgatgccaagaaggaaaacagcaagttcacctttaaaccggacactaacaaagatcacaggaaagcagtacaccactttgtcaataaaaagttcggcaacctggtcgaaaccaaatcgttcagtaagatgaactgttccgcgggtaacccaaacgtcgtagtaacagttcggttccgcgagaaagctcataaacggggcaaacgcccactgtcagaatgtcaggagggtaaagttatatacacagcctttacactgagaaaagagaatctggaaatgtttgaggctattggcttcttagcaattaaactgggtgtcatcccatctgacttttcatacgcaggtcttaaagataaaaaggccatcacttatcaagcaatggtcgtaaggaaggtgacacctgaaaggttgaagaatattgaaaaggagatttag

SEQ ID NO: 50384 - DNA, 912 bp, Artificial Sequence
  Description of Artificial Sequence: Synthetic coding sequence
atgagcagcgcccccgccagcggcagcgtgcgggcccggtacctggtttatttccagtacgtcggcactgacttcaacggcgtcgctgccgtccgtggtactcagcgggcggtgggcgttcagaattacctggaggaggccgctgagcggctgaactctgtcgaacctgtgaggttcactatcagttcacgtaccgatgctggagtacatgcactttcgaacgcggcacacctggacgttcagaggcgcagcggaagacccccgttcccccctgaggtgctggctgaggcacttaacacccatctgcgccaccctgcaatacgtgtcctgcgggctttccgtgttccaagcgattttcatgcccgtcacgcagcaacctccagaacctatttatacagattggcaaccgggtgccataggcgggatgagttacctgtgttcgaacgcaacctttgctggacccttcccgcagattgcctggacatggttgccatgcaggaggccgcccagcatttgctagggacacacgacttttcagccttccagtccgcgggctcccccgtgccgtcacctgtacgtactttaagacgcgtgtccgtgtcccctggacaggcctcaccccttgttaccccggaagagagccgaaaactcaggttttggaacctggaattcgagtcccagagttttctctaccgtcaggtgcgccggatgaccgcggttctggtggcagtgggtttgggcgcccttgctcctgcccaggttaagacgattctggagtctcaggatccactaggcaagcaccagactagagttgcccccgctcacgggttgtttctcaaatccgtgctctacggcaatctaggcgccgcctcttgtactctgcagggcccccagtttgggtcacacggatag

SEQ ID NO: 50385 - DNA, 216 bp, Artificial Sequence
  Description of Artificial Sequence: Synthetic coding sequence
atgggcgccaccggcctgggcttcctgctgagctggcggcaggacaaccttaacggcaccgattgccagggctgtaacatcctttactttagtgagacaaccggttccatgtgctccgaattgagcttaaacagaggcctagaagccaggcggaaaaaggatcttaaggactcatttctgtggcgcgatggtgtctcgccctgtctgccatgctag

SEQ ID NO: 50386 - DNA, 444 bp, Artificial Sequence
  Description of Artificial Sequence: Synthetic coding sequence
atgggcgccaccggcctgggcttcctgctgagctggcggcaggacaacctgaacgggaccgattgccaaggctgcaacatcctctactttagtgaaacaaccggctcaatgtgttcggaattgtctctcaatagaggcctggaggcccggagaaagaaggacctgaaggactccttcttgtggcgctacggcaaggtggggtgcatcagtctgcccttgcgggagatgaccgcatggatcaacccgccacagattagcgaaatctttcaaggttaccatcagagggtgcacggagccgatgcattgtctctccagactaatagcctgcgaagtaggctctcatcccaatgtttaggccagagcttcctgctgcgtactctggagaggggccgcgggtttagagcgctgggtgatatatgcggtcacgtccacgaggaggactag

SEQ ID NO: 50387 - DNA, 444 bp, Artificial Sequence
  Description of Artificial Sequence: Synthetic coding sequence
atgggcgccaccggcctgggcttcctgctgagctggcggcaggacaatttgaacgggacagattgtcaagggtgtaatatcctgtattttagtgaaaccaccgggagcatgtgtagcgagctaagcctgaaccgcggtctggaggccagaagaaaaaaagatctgaaagattcattcctgtggagatacggtaaggtcggttgcatatctttgccattgagggagatgaccgcttggattaacccccctcagatatctgaaatttttcaaggctatcaccagagggtgcacggggccgatgccctcagtttacagaccaattctctgagaagtagactgtcttctcagtgtctcgggcagtctttcctgctccgtaccttggaacggggaagaggatttcgcgccctgggtgatatctgtggccacgtgcatgaggaagactag

SEQ ID NO: 50388 - DNA, 216 bp, Artificial Sequence
  Description of Artificial Sequence: Synthetic coding sequence
atgggcgccaccggcctgggcttcctgctgagctggcggcaggacaatctgaatggcaccgattgccaaggttgcaacattctgtacttcagtgagacaaccggaagtatgtgcagtgagctgtctttgaatcggggattggaagcacgacgcaaaaaggacctgaaggattccttcctctggcgtgatggagtgtctccttgcctgccatgttag

SEQ ID NO: 50389 - DNA, 2202 bp, Artificial Sequence
  Description of Artificial Sequence: Synthetic coding sequence
atgggcaagctgatcacccggatgtggaagctgctgcggcggcggagtgcacctaaggagctgttgtccaggacgtctctggagacccagaagcttgatcttatgaccgaggtgtccgaactgaagctgaagctggttgggatggagaaagaacagagagagcaggaggagaagcagaggaaagcagaggaactcctgcaggagctgcggcaccttaaaataaaagttgaggagctggaaaacgagcggaaccagtacgaatggaaactcaaggcaacaaaagctgaagttgctcaacttcaagagcaggttgctctcaaagacgccgaaatcgagcgcctgcactctcaactttcaaggaccgccgccttgcattcggaatcccacactgagagggaccaggagatccagcggctgaaaatggggatggagacgttactgctggctaatgaagacaaggatcggagaattgaggaactgaccggtctgctgaaccagtaccgaaaggtcaaggagatcgtaatggtgacccagggcccctctgagcgtaccttgagcattaatgaggaggagcccgaagggggatttagcaagtggaacgccactaataaagatcccgaggaactgtttaagcaggagatgccccctcgatgtagctctcccactgtcgggccccccccactccctcagaagtctctcgaaacacgtgcgcaaaaaaagctctcttgcagcttggaggacttaagatcagagagtgtggataagtgtatggacggcaatcagcccttccctgttttggaaccgaaagatagtcccttcctggcagagcataagtatcccactctgccaggtaagctgtccggagctactcccaatggcgaggccgccaaatcgcctcccacaatctgccagcccgacgccactggaagctcattactgagactcagagacaccgagagtgggtgggatgacacagcagttgtcaacgatctgtcctcaacatcaagcggtactgagtctggcccccaatcacctctgacaccagatggtaagaggaatcctaaaggcattaagaagttctgggggaaaatacggcgcactcagagcggtaacttttatacagacaccctgggcatggcggagttccggcgaggcgggttgcgtgcaacagctgggcctcgcctgagcagaacacgtgatagtaaaggccagaagagcgatgccaacgctccctttgcacaatggagtaccgaaagagtgtgcgcttggctggaagatttcggcttggcccagtacgtgattttcgcgcgacagtgggtttccagcgggcatactttgctcacggctacaccgcaggatatggagaaagagctcggcattaaacaccccctgcataggaagaaattggtgctcgccgtgaaggctattaatacaaagcaagaggagaagtccgctctgctcgatcacatctgggtgacgcgctggcttgacgatatcgggctgccgcaatacaaggaccagttccacgaatctcgtgtggaccggaggatgctgcagtacctcacagtcaacgacctcctgttcttgaaagtgacatctcagctgcatcacctgtcaataaagtgcgcaatccacgtattgcatgtgaacaagttcaacccacactgcttgcaccgacgtccagccgacgaatctaacctcagtccctccgaagtggtacaatggtcaaatcaccgagtaatggaatggcttagaagcgttgatcttgccgagtatgccccaaatctgcgtggttccggcgtacatgggggattgattattctcgagccccggtttacaggcgatactctggccatgttgttgaacatccccccacaaaaaacgttgctgagaagacatttaacaactaagttcaatgctttgattggcccagaagccgaacaagaaaaaagggagaaaatggcctctcccgcctacacacctctcactaccactgccaaggtgcggccaaggaaactaggcttctcacatttcggcaacattcgcaagaaaaaatttgatgaatcaaccgattacatctgcccaatggagccgtcagacggggtttcagactcccaccgcgtgtattccggatacagaggattaagcccactggatgccccagaactcgatgggttggaccaggtgggtcaaatttcatag

SEQ ID NO: 50390 - DNA, 2157 bp, Artificial Sequence
  Description of Artificial Sequence: Synthetic coding sequence
atgctgcagcaggagctgctgagccggaccagcctggagacccagaagctggatcttatgaccgaagtctccgagcttaagttgaagctcgtgggaatggaaaaagaacaacgagaacaggaagagaaacaacgaaaggcagaagagctgctccaagagctgcggcatctgaagataaaagtcgaggaattagaaaatgaacggaatcagtacgagtggaaactcaaggctacaaaggctgaggtcgcccagttgcaagaacaagtcgctttaaaagatgcagagattgagcgcctgcactcgcaattgtccagaactgctgcccttcactccgagtctcacactgagcgggatcaagagatacagcgcctaaagatgggaatggagaccctgctgctggctaacgaagacaaggatcggcggatcgaggaacttacaggcctgttgaatcagtatagaaaagtcaaagaaatcgtgatggtcacccaaggacccagcgaaaggacactgtcaattaacgaggaggaacctgaggggggcttctctaaatggaacgctactaacaaagatccagaggagttattcaagcaggaaatgcctccaagatgctcctcccctaccgtcggccccccacctctgcctcaaaaatccctcgaaaccagagctcagaagaaactcagttgctccctggaggatctcagaagcgaatctgtggacaagtgcatggatgggaaccagccatttccagtgcttgaaccgaaggatagcccgtttctggccgaacataagtaccccacactgcccgggaagctctctggtgccacaccaaacggagaagctgccaagagcccacctaccatctgtcagcccgacgcgaccggaagttccttgcttcgtctcagggacaccgagtctgggtgggatgacacggccgtggtaaatgacctcagctcaaccagttccggtacagagagtggcccacagtcccccctgacaccagatggcaagcgcaaccccaagggtattaagaaattctggggcaagatacggagaacgcagagtggtaacttctatactgacaccctgggcatggctgaatttcgtaggggcggactccgggcaacggcaggccctagactttcccggactcgtgacagcaaggggcagaaaagtgacgcgaatgcgccatttgcacagtggtctaccgaaagggtctgcgcctggctggaggactttggcctggcccagtacgtcatttttgctaggcaatgggtttcatctgggcataccctgctcacagccacgcctcaggacatggaaaaggagttagggattaagcatccactacacaggaaaaagctcgtgcttgccgtgaaagcaatcaatactaagcaggaggaaaaatccgcactactggatcatatttgggtgacaaggtggctggatgatatcggtctccctcaatataaggatcagttccacgagtctagggtggatcgcagaatgctacagtacctcacagtgaatgacctattatttctgaaagtaacctcccaactccatcacctcagtattaagtgtgccattcacgtgctccacgtcaataaattcaacccacactgcttgcacagacgtcctgccgacgagtcgaacctgtccccctccgaggtagtgcaatggagcaatcatcgcgtgatggaatggctgaggtctgttgatctagcagagtatgcccctaatttacgaggttccggcgtccacggtgggctcatcatcctggagccccgatttaccggggacaccttggccatgttgcttaatatacccccacaaaaaacactgctgcgcagacacctgactactaagtttaatgcactgatcggtcctgaagcagaacaggagaagcgagagaagatggcatctccagcttatacacccctcaccacaaccgcaaaggtccgacctagaaagctaggcttcagccacttcggaaatatacggaaaaagaaatttgatgagagtacggactatatctgtcccatggagccgagcgacggtgtatcagatagccacagggtttacagcgggtatcgaggcttatcacccctcgatgctcctgagctggatggcctggatcaggttgggcagatttcctag

SEQ ID NO: 50391 - DNA, 2631 bp, Artificial Sequence
  Description of Artificial Sequence: Synthetic coding sequence
atggccagcgacgccagccacgccctggaggccgccctggagcagatggatgggatcattgctgggactaagactggtgccgacctttccgacggcacctgcgagcccggattggccagcccagcatcttatatgaatccattccccgtgctgcatcttatagaggacctccggctggccctcgagatgttggaacttcctcaggaacgggccgccctactgagccagattcctggccccaccgcggcttacattaaggaatggttcgaagagtctctgtcccaagtcaaccaccattccgctgcctctaatgagacctaccaggagcgattggctcgcctcgaaggcgacaaggaatcattgatcttgcaagtgtctgtgttgactgaccaagtagaagcgcaaggagagaagattcgggatctggaggtttgtctcgagggtcatcaggttaagctgaacgctgctgaagaaatgttgcagcaggaactcctgtcacggacatccctggaaacccagaagctagatctgatgacagaggtgtcggagctgaagttaaagcttgtaggcatggaaaaggaacagcgcgagcaagaagagaaacagcggaaggcggaagaactgttgcaggagttacgccatctaaaaattaaggtcgaagaactggagaatgagagaaaccaatatgagtggaagttgaaggcaaccaaggcagaagtggctcagcttcaggagcaggtagcgctaaaggatgcggaaattgagcggctccattcccagctctctcgcacagccgccttacacagtgagtcccacacagaacgagaccaggaaattcaacggctgaaaatgggcatggaaactctccttctggctaatgaggataaggatcggcgcatcgaggagctgacaggacttctcaaccagtaccggaaagtcaaggagatcgtcatggttactcaggggccctcagagcggaccctgtcgattaatgaggaggagccagagggaggattctcgaaatggaatgcaacaaacaaggatccggaggaattattcaaacaggagatgccccccagatgttcttcaccaaccgtcggcccgccacccttaccccagaagagtctcgagacaagggctcaaaagaagctctcttgctctctggaggacctcaggtccgaatctgtggacaagtgtatggacgggaatcaaccctttcctgtcttggagcctaaagactccccattcttggccgaacacaaatacccaacactgccaggcaagttgtctggtgccactccaaacggagaagcagcaaaaagtccgcctaccatctgtcaacctgatgccacaggcagttcgctgcttagactccgggacacagagagcggctgggacgacacagccgttgttaatgacctaagcagtacgtccagcggtactgagtctggaccccagtctccgctgacacctgatggaaaaaggaatccaaagggcatcaagaaattctggggcaagattagacgaactcaatcaggtaatttttacacagacacactcggcatggctgagtttcgtcggggtgggctgcgggccacggcaggcccaagactgtctcgcacgagagattcaaaggggcagaaatctgatgccaatgctccctttgctcaatggtcaacagagcgcgtgtgtgcatggcttgaggacttcggcctcgcccagtatgtgattttcgccagacagtgggtgtcttcagggcatactctcctcacagctacaccccaggatatggaaaaagaactcggaatcaagcatccactgcatagaaaaaagcttgtactcgctgtgaaggccataaacactaaacaggaggagaaatccgccctgctggaccacatctgggttacgagatggctcgatgacatagggcttccacagtataaagaccagtttcacgagtctcgtgtggaccggcggatgttgcagtatctgacagtcaacgatctgcttttcctgaaagtgaccagtcagctgcaccatttaagtattaagtgtgccatacatgttttacacgtgaacaaatttaatccccactgcctgcatcgcaggccggccgacgagtcaaatctgtcccccagtgaagtagtgcagtggtctaaccatcgggtgatggagtggctgaggtccgtagatttggctgagtacgctccaaacctgcgcggttctggtgtgcacggtgggctcatcatcttagaaccaagatttacgggggacaccctggcaatgttgcttaatattccgccacagaagactttactgaggcgtcacttaaccacgaagttcaacgctcttattggacccgaggcggagcaggaaaaaagagagaagatggccagtcctgcttacacaccactcacaacaactgctaaagtccgcccaaggaagttgggattcagtcactttggaaacatccgaaaaaagaagttcgatgagagtactgactacatctgcccaatggagccatccgacggggtgtcagattcgcacagggtatactccgggtacaggggtctttcccccctggatgcgcccgaactcgacgggctggatcaagtgggtcagatttcttag

SEQ ID NO: 50392 - DNA, 213 bp, Artificial Sequence
  Description of Artificial Sequence: Synthetic coding sequence
atggccagcgacgccagccacgccctggaggccgccctggagcagatggacggaatcatagccggcaccaagacaggtgctgatcttagtgatggcacctgcgaacccgggcttgccagtcccgcaagttacatgaatccctttcccgtgctacatctgatcgaagatctgaggctggcgttggagatgctggagctgccccaggagaggtag

SEQ ID NO: 50393 - DNA, 270 bp, Artificial Sequence
  Description of Artificial Sequence: Synthetic coding sequence
atggccagcgacgccagccacgccctggaggccgccctggagcagatggatggcataatcgccggcacaaaaacgggtgcagatctgagcgacggaacctgcgagcccgggctcgcatcccccgcttcatacatgaatccctttcctgtcctgcacctgatagaggacctgcgtttggcgctggagatgttggagctgccccaagagagagccgccttgctcagtcagatacctggcccaaccgcagcttacataaaggaatggttttag

SEQ ID NO: 50394 - DNA, 513 bp, Artificial Sequence
  Description of Artificial Sequence: Synthetic coding sequence
atggccagcgacgccagccacgccctggaggccgccctggagcagatggatggcatcattgccgggacaaagaccggcgcagatctgtctgacggtacctgtgaaccaggcctggccagcccagctagttatatgaatcctttcccagtcctgcacctaatagaagatttgagattagccctggagatgttggagctcccacaagaacgtgcagccctgctgagtcagatcccagggccgaccgcagcctacatcaaggagtggttcgaagaaagtctgtcccaggtgaatcatcactccgcggcctccaatgaaacatatcaggagcggctcgctcgccttgaaggcgataaggagtcattgatcctccaggtttccgtccttacagatcaggtggaggcacaaggagaaaaaatcagggaccttgaagtctgtttggaagggcaccaggtgaaattgaacgccgcagaagagatgctgcaacaggaactgctgagcaggacttcattgtag

SEQ ID NO: 50395 - DNA, 270 bp, Artificial Sequence
  Description of Artificial Sequence: Synthetic coding sequence
atggccagcgacgccagccacgccctggaggccgccctggagcagatggacggaatcatcgctggcactaagacaggcgccgatctctctgacggtacctgcgaacctggcctggcttctcctgctagttacatgaacccgttccccgtgttacacctcattgaagatttgcggttggcgcttgagatgctcgaattaccccaagagagggcagcacttttgagtcagatcccaggtcctaccgctgcttatataaaagagtggttctag

SEQ ID NO: 50396 - DNA, 654 bp, Artificial Sequence
  Description of Artificial Sequence: Synthetic coding sequence
atgctgcagtacctgaccgtgaacgacctgctgttcctgaaggtgaccagccaattacaccaccttagcatcaagtgcgcaatccacgtgttacacgtgaataagttcaatccacactgtctccaccggcggcccgccgacgagagcaacttgtctccttcagaggtagtacagtggagtaatcatcgcgtgatggaatggctgcgatctgttgatctggcagagtacgctccgaacctgcgtgggagtggtgtccatggaggccttattatcctggaaccccgcttcacgggagatacgctcgcaatgctgctgaatataccccctcagaaaacacttctgcgacggcatctgacgacgaagttcaacgctctgataggtcccgaggctgagcaggaaaaacgggaaaagatggccagtcccgcctacacccctctgactaccaccgccaaggtaaggccccgtaagctcggcttcagtcattttggaaacataagaaaaaagaagtttgacgaatcgacagactatatctgtcctatggagcctagcgacggcgtgtcggattctcacagagtgtatagcggttatagaggactgtctccactggatgctccagagctcgatggattggaccaagtcgggcaaatttcttag

SEQ ID NO: 50397 - DNA, 1203 bp, Artificial Sequence
  Description of Artificial Sequence: Synthetic coding sequence
atgctgcagcaggagctgctgagccggaccagcctggagacccagaagctggatctcatgacagaggtatcagaactgaagctgaaattggtgggtatggagaaagagcaaagggaacaagaggagaagcagcggaaagccgaggagctgctgcaagagctccgccacctgaaaataaaggtggaggaactcgagaacgagcgcaaccagtatgagtggaaattaaaagctacaaaggccgaagtggcccaactccaggaacaagtagcactgaaagacgctgaaatcgaacgattgcactctcagctttccagaacagcagcactgcactctgagagtcatactgaaagggatcaggaaatccagaggctgaaaatgggaatggagacactcttacttgccaatgaagataaagacagacggatcgaagagctgacaggcttgctgaatcagtataggaaagttaaagagatcgtcatggtgacgcagggaccatcagaacgtacgctgagcatcaacgaggaggaacccgagggaggtttctcgaaatggaatgctactaataaagatcctgaagaactgtttaaacaggagatgccacctagatgctcgtcccctaccgttgggcctccccctttgcctcagaagagcctggaaacccgggcgcagaagaaacttagctgctccctagaggatcttcggagtgaaagcgtcgacaagtgtatggacggaaatcaacctttccctgtgttggagcctaaagactcaccgttcctagccgagcacaagtacccaaccctgccgggcaaactgagcggggctacgcccaatggggaagctgccaaatcaccccccacaatttgccagccagacgccacgggaagctccctcctgcgcctgcgagacactgaaagcggatgggatgacaccgcagtcgtgaatgaccttagcagtacttcaagcgggaccgaatctggcccccagagccccctgactcctgacgggaaaaggaacccaaaaggcattaaaaagttttgggggaaaattcggaggacccagtctggaaacttctacacagatacgctggggatggccgaattcaggagaggaggactaagggccacagcggggccccgcctgtctcgcacccgcgatagcaaaggacaggggctgcagtggctgccaggacctcagccgccttag

SEQ ID NO: 50398 - DNA, 2277 bp, Artificial Sequence
  Description of Artificial Sequence: Synthetic coding sequence
atggacggcgacatcgacgtgtacaagcacttcagctggctgaagcggagtcaggtcaatcaccatagtgctgccagcaatgaaacctatcaagagaggttagccagactggaaggagataaggaaagtcttatccttcaagtatcggtgctgaccgatcaggtggaagcgcagggtgagaagatcagagacctggaagtctgtctggaaggacatcaagtcaagttgaacgcagcagaagaaatgctgcagcaggagctattgagccgtacttcccttgagacacagaaactggatctgatgacagaggtctctgagctaaaattgaagttagtgggtatggagaaagagcagagggaacaggaagagaagcaaagaaaggccgaggagcttctacaggaattgcgacacctgaagattaaagtggaagagttggaaaacgagcgaaaccagtacgagtggaaacttaaagctaccaaggcagaggtggcacagttgcaggagcaggtggcactcaaagatgccgaaatcgaacggttacattcacagctgtctcgtacggcagcattgcacagcgaaagccacaccgaaagggaccaagagattcaaaggctgaagatgggcatggagactcttctgctcgctaacgaggataaagacaggcgcattgaggaactcactggtctgttaaatcagtaccgaaaagtcaaggagatcgtaatggtgactcaaggacccagcgagaggaccctgagcatcaatgaggaagagcccgagggggggttcagtaaatggaatgcaaccaataaagatcccgaggaactgtttaagcaggagatgcccccaagatgctcgtctcccaccgtggggccccccccgctgccccagaaaagtttggagacccgcgcgcaaaaaaagctcagttgctctctggaggatttacgttctgaaagcgtagataaatgcatggacggtaatcagccatttcccgtgctggagcccaaagactctccatttttggccgagcacaagtaccccacgttgcccgggaaactcagcggagccacaccgaatggcgaagccgccaagagcccccccacgatctgccagccggatgctaccgggagctcattacttcgcctccgggacacagaaagcggttgggatgatacggcagtggttaacgatctaagctcaacgagcagtggaactgaatccgggccccagtcccctcttacgcccgatggaaagaggaatcccaaggggattaagaagttctggggcaagataaggaggacgcagagtggcaatttttacacggataccctggggatggctgagttcagaaggggaggactgcgggccaccgctggccccagactgagcaggacaagagatagcaaaggccaaaagtctgatgcaaacgccccatttgctcagtggtccactgaacgagtctgcgcatggctggaggacttcggcctagcccaatatgtgatttttgctagacaatgggtctcatctggccatacactcctgaccgcgaccccccaggacatggaaaaagagctggggatcaagcaccccttgcatcgtaaaaagttagtcctcgctgtgaaggcaattaatactaaacaagaagagaagtcagcgcttttggatcatatttgggtgactcgctggctcgatgacatagggctgcctcaatataaagaccagttccatgagtccagagtcgatcggagaatgttacagtacctgacagttaacgatctgctatttttgaaggtaaccagccaattgcaccatctgagtatcaagtgcgccattcacgtgctgcacgttaacaagttcaacccccattgtctgcatagacggcccgccgacgagtctaatctgtcccccagtgaggtggtgcagtggtctaaccacagggtgatggaatggcttaggtctgtcgacttagccgagtacgcgcccaatctgaggggttcaggcgtgcatggcggtctcatcatcctagagccaaggtttactggggatacactggctatgctcctgaacatcccgccccagaaaacgctactgcggagacatcttacaacgaaattcaacgctctaatcggtcccgaggctgagcaggagaaacgcgaaaagatggccagtcccgcctatacgccgctgactacacgctgggatcgtctggcagatgccctggttacttgtcctctatgtactctgcgggctcatagcaacacggtgtgtgtcaccatttag

SEQ ID NO: 50399 - DNA, 411 bp, Artificial Sequence
  Description of Artificial Sequence: Synthetic coding sequence
atgatggaccaggaggagaagaccgaggagggcagcggcccctgcgccgaggcagggagcccagatcaggagggcttcttcaatctgctttcccacgtgcagggagaccgaatggagggacagaggtgctctctgcaggcaggtcctggtcagacgactaaaagtcaatcggatcccaccccagaaatggattctttgatggacatgctggcctcgacccagggcagacgaatggacgaccagcgggtcactgtgtctagcttgcccggctttcagccggtcgggagtaaagatggcgcccagaaacgcgccggcacactgtcaccccaaccattattaaccccccaggaccctaccgccctgggatttagacgcaacagctccccccaacctcccacacaggccccctag

SEQ ID NO: 50400 - DNA, 207 bp, Artificial Sequence
  Description of Artificial Sequence: Synthetic coding sequence
atgagcgagctgaacaccaagaccagccccgccaccaaccaggccgcaggccaggaggagaagggcaaggcgggtaacgtgaaaaaagcggaagaagaggaagaaatcgatattgacttgaccgccccagaaactgaaaaagccgctctggcaattcaggggaagtttagacgattccagaagcgaaagaaagaccccagcagttag

SEQ ID NO: 50401 - DNA, 1437 bp, Artificial Sequence
  Description of Artificial Sequence: Synthetic coding sequence
atgtggctggccgccgccgcccccagcctggcccggcggctgctgtttctgggaccccctccaccaccattgttgctgctggtttttagtcggtccagccgcagacggctgcactccttaggcctggccgccatgccagagaaacggccgttcgagcggctgcccgcagacgtctcacctatcaattgttctctctgcctaaaaccagatctcctggactttacgtttgaggggaaattggaggctgcagctcaggtccggcaagctacaaatcaaattgtcatgaattgcgcggatattgacattattaccgcctcctacgctccagaaggcgacgaagagatccacgccaccggtttcaactaccagaatgaagatgagaaggttaccctctctttcccgtcaacgctgcagaccggcaccgggacactgaaaattgactttgttggggaactgaacgataaaatgaaagggttttaccggtccaagtatactaccccttcaggtgaggtccggtacgcagcagtcactcagtttgaggccacggatgcccgccgtgcattcccctgttgggatgaacccgctattaaagccacgttcgatatcagtcttgtcgtgcctaaggatcgcgtggcactgagcaatatgaacgtgatcgaccggaaaccttatcccgatgacgagaaccttgtggaagtcaagttcgcaaggacacccgtgacctccacatacctagtggcattcgtggtcggtgaatatgactttgtggagactcgatcaaaggatggggtgtgcgtctgcgtttacacccccgtaggcaaggctgaacagggaaagttcgccatcgaggtggccgcaaaaacattacccttttataaggactattttaacgtgccctatcccctgccgaaaatcgatttaatcgccatcgccgacttcgccgctggagccatggagaattgggatctagtgacatatagggagaccgcactgctgattgatcctaagaactcctgctcttcttctagacaatgggtggccctcgttgtcggccacgagctagcccatcagtggttcggaaacctcgtaaccatggaatggtggacgcatctctggttaaatgaggggttcgcctcttggatcgagtacctgtgcgtggaccattgctttcccgagtatgatatttggacccagttcgttagcgcagactatactagggcgcaggagctcgacgctctggataatagtcatcccatcgaggttagcgtgggccacccctccgaggtggatgagatcttcgatgccataagttacagtaaaggcgccagcgtgatcagaatgctccatgattacatcggggataaggactttaagaaaggcatgaatatgtatttgaccaagttccaacagaagaatgcggccgccggtaacctttag

SEQ ID NO: 50402 - DNA, 975 bp, Artificial Sequence
  Description of Artificial Sequence: Synthetic coding sequence
atgaagggcttctaccggagcaagtacaccacccccagcggcgaggtacgctatgcagctgtgacccagttcgaagctaccgatgcgcgccgtgcttttccatgttgggacgaacctgccatcaaggccacttttgatatttctctggtagtacctaaggatagagtggcactctctaatatgaatgtgattgaccgcaaaccatacccagatgacgagaacctcgtcgaggtcaagtttgcaagaactcccgttacgtccacatacttagttgccttcgtcgtgggcgagtacgactttgtggagaccagatcaaaggacggcgtgtgtgtatgtgtatatacaccagtcggtaaagccgagcaaggaaagtttgctatcgaggtcgcagccaaaaccctgcccttctataaagattactttaacgtaccataccctctgcccaagatagacctcatagcaatcgccgatttcgctgcaggagcgatggaaaactgggacctcgtgacgtacagagaaaccgcattactgatcgaccctaaaaactcctgttcctcttccaggcagtgggtggcccttgtggtgggccacgagctcgcacatcagtggtttgggaatctggtaacaatggaatggtggacacacctgtggctgaacgaggggtttgcctcctggatcgagtatctctgtgttgaccattgctttcctgagtacgatatctggacccagttcgtatctgcagactataccagagcgcaagaactggatgccctggacaacagtcaccccatcgaagtctctgtgggtcaccccagcgaggtggatgagattttcgatgcgattagttactctaagggagcttcggttattaggatgctgcatgactatataggcgacaaggacttcaagaaggggatgaatatgtatttgactaaatttcagcagaaaaatgctgcagcagggtggacctggtag

SEQ ID NO: 50403 - DNA, 729 bp, Artificial Sequence
  Description of Artificial Sequence: Synthetic coding sequence
ctggtgaagaccgccaagctgggcaccagctggaactacctgttcgacttccaccctcatcgcgtcttagtggtgggggctttcgcgaacttttgtaccgagcctactgggtgtagctgcctgttccctaagctccccccccatttactcatgctcccctgctggttccatcttctgtttttccaggactacatcatgtctggagccagcgccctccctcctggactggtgagtttcgtgaaggccccactgccccagtggtggccaggagggtgtccgggagtgggaggtcctttacaagcattggaagccaaacctgggcagttgagtctgccaataagaaatcaaaagaggctggtgaaatccgcgcttgagctcggggagaacgagctattccagcagttcccgaaccctcaatctagttgggttcagaggactcaggaggccttacgccctctactatctgtcgccctgcaactttttctgggtagaagaggcctacccctacccttccgtgccccaatccgcacagtggttggctccgcgattccagtgcagcagagcccaccccctagcccagcccaggtggataccctccaggcccggtacgtcggacggctgacccaactctttgaagagcaccaagctcgatacggtgttccggcagacaggcatcttgtgctgaccgaggcaaggcccaccgcctggccaagactgtctgcgggctag

SEQ ID NO: 50404 - DNA, 1419 bp, Artificial Sequence
  Description of Artificial Sequence: Synthetic coding sequence
atggccggcggcgaggccggcgtgaccctgggccagccccacctgtcaaggcaggatctgactaccttggacgtcaccaaactgacccccctgtcccacgaagtgatttcccggcaagccacaatcaatatcgggacgattggccatgtggctcacggcaagtccacagtcgtgaaagccatctctggtgttcacacagtccggttcaaaaacgagctcgagcgcaatatcaccatcaagctgggatatgcaaatgcaaagatttaccagctggatgacccaagttgccccaggccagagtgctaccggtcttgtggaagcagtatgcccgacgagttccctaccgatattcctggtactaagggaaacttcagacttgtgaggcacgtaagcttcgtcgactgtcccggccacgatatcctaatggccaccatgttgaacggggccgcggtcatggacgccgccctactgcttatcgccggaaatgaatcttgtccccaaccacagacctccgaacacctggccgccatcgaaattatgaagttgaaacatattctgattctgcagaacaaaatagacttagtgaaagagcgccaggcgaaggaacaatatgaacaaattctggccttcgtgcagggcacagtcgcagaaggagcaccaatcatcccaatatcagcccagctgaagtataatatcgaagtggtttgcgaatacatcgtgaagaaaattccagtgcctcctagagactttacttccgaacctcgactcatagtgattcggagtttcgatgtcaacaagcccggttgcgaagtggacgatctgaagggaggagtcgctggcggtagcatactcaagggagttctgaaagtggggcaggaaactgaggtcagaccaggaatcgtctccaaagattcagaaggcaaacttatgtgcaagtccatttttagcaaaattgtcagtttattcgccgaacacaatgacctccagtacgctgctccaggcgggctaatcggagtaggcacgaaaattgacccaacattatgccgggcggatcgcatggtcggacagattctgggagcagtgggcgcattacctgagatcttcactgaattagagatatcctactttctcttgcgaagactgttgggggtcaggaccgaaggggataagaaagctgccaaggtgcaaaagttaagcaagaacgaagtgctgatggtgaacattggctcgctgtctacaggaggcagggtgtccgctgttaaagctgacttgggcaagatcgtgctcacaaacccagtatgtacagaagttggggaaaaaattgccctgagtcgccgcgtggaaaagcactggcgccttatcggctggggacagattcgcaggggagtgacaataaaacccacagtggatgacgactag

SEQ ID NO: 50405 - DNA, 543 bp, Artificial Sequence
  Description of Artificial Sequence: Synthetic coding sequence
atggaggaggccggcctgtgcggcctgcgggagaaggccgacatgctttgtaactcagaatctcatgatatcctgcaacatcaggatagtaactgcagtgccacttctaacaaacatctgttagaagacgaggaaggacgggattttatcaccaagaacaggtcctgggtctcccccgttcattgcacgcaagagtctcgaagagagctgccagagcaagaggtggcacccccttcgggacagcaggcactgcagcagcaagagcaacgcaaatcactgagaaagaggtccttcattatagacgcatctcccaagcattttcgccttcagcgaagatcatggcaactgtccgtcagaaacatgctgattctggagattcatctattttaccgacgtgtttgcttcgagctttatgatttgaagcagaacagcttcttcggagattacgggaacatcctaaatcgagagactttgttggattttgttaagcagatcatggaaaaaattcagaattttctgaagaatcatgggaagttcttgtag

SEQ ID NO: 50406 - DNA, 396 bp, Artificial Sequence
  Description of Artificial Sequence: Synthetic coding sequence
atggaggaggccggcctgtgcggcctgcgggagaaggccgacatgctttgtaactccgagtctcacgatatcctccagcatcaagactccaattgttccgccacctccaataagcacctcctcgaagatgaggaaggcagagattttattacgaagaacaggagctgggtgtcccccgtgcattgtacccaggagtctagaagagaactgcctgagcaggaggtggcaccaccttcgggccagcaggccctccagtgcaacaggaataaagagaaagtgctcggaaaggaggtcctgcttcttatgcaggccttaaatactctgtctaccccagaggagaagttggcggccctgtgcaaaaagtatgccgatctgggcaacagtccccttttgtag

SEQ ID NO: 50407 - DNA, 423 bp, Artificial Sequence
  Description of Artificial Sequence: Synthetic coding sequence
atggaggaggccggcctgtgcggcctgcgggagaaggccgacatgttgtgcaattccgaatcacacgacattctgcaacaccaggacagtaactgctccgccacaagtaacaagcacctgcttgaggacgaggagggacgggacttcatcaccaaaaacagatcgtgggtctcacctgtccattgtacccaggagtctcggagggaactgcctgagcaggaggtggcacccccaagcggtcagcaggctcttcagtgtaatcggaataaagaaaaggtgttgggaaacaatctctgttccgtggtcggttgttgtcacatcctggtgttcctcttttacattttttgcagcatgagtgattacgaactgggcctttttggaggcaagtgctgtctcgtaaacctttttcttcacctcgtttag

SEQ ID NO: 50408 - DNA, 513 bp, Artificial Sequence
  Description of Artificial Sequence: Synthetic coding sequence
tgaaccagctggcggcggggcgaggtgaccccccggcggggcagcggagggggcgccaagacaatcggcgcgaagcagggaaggacgcaactctcaagcgggtttgtcaacagtaccatggaggaagcgggcctgtgtggacttcgcgagaaagcggatatgctatgtaattcggagagtcatgacatcctgcagcaccaggactccaactgctccgcgacttccaacaagcatctcctcgaggacgaggaaggccgggacttcattacaaagaatagaagttgggttagtcccgttcattgcacacaggaatcccgacgggagctgcccgaacaggaggtcgcacctccctcaggccagcaagcgctccaatgcaatagaaacaaagagaaagtgctgggaaaggaagttcttctgctgatgcaggcgcttaacacgctcagcacaccagaggagaaactggcggctctctgcaagaagtacgcagacctcggaaactcacccctcttgtag

SEQ ID NO: 50409 - DNA, 396 bp, Artificial Sequence
  Description of Artificial Sequence: Synthetic coding sequence
atggaggaggccggcctgtgcggcctgcgggagaaggccgacatgctgtgtaactctgagtcacacgatatcctgcaacatcaggacagcaattgcagcgctacttcgaacaagcatttactggaagacgaggaggggcgggatttcattactaaaaacagatcgtgggtctcaccagtgcattgtactcaggagagtagacgcgaacttccagaacaagaggttgctcctccaagtggacaacaggctctgcagtgtaatcggaacaaggaaaaagtacttgaaaggcagggattgagtctatccccgaggttggagcgcggcggtaccttcatggggcacggctctctgaaattgcccgaactagtcatcttatcgctacagacgctggaatag

SEQ ID NO: 50410 - DNA, 546 bp, Artificial Sequence
  Description of Artificial Sequence: Synthetic coding sequence
atgaagcaggaggaggcccagctgaaggagcagctgttcctgtacatggacaagttcgaagaatttcagacaacaatggccaaaacaaatgagctgttcacagcgtttaaacaagagactgagaaactgactaagaaaatcaaaaagctggagaaggaaatggtgatctggtatactaagtgggaaaataacaacactaccttgttgcagatggcggaggagaaaaccatacgcgataaaaattacaaagtgtttcagattaagcttgaacgtctcgagaaattgtataaagctctacagatcgagcgcaacgagttgtcggagaagcttggcatcctgaagggtcaggtgagcgtaaaagtggctgacgtcgatctggctgttcctgtaactcattcatgcgcagatttagatagttccaacatgcttaatacgagttctaagagggctcccggagtgcaccttgaagctgatccaaagggtatgaacgaggtgaagtgttacagtaaggccctctctaccggtagtccacttgggattgattag

SEQ ID NO: 50411 - DNA, 546 bp, Artificial Sequence
  Description of Artificial Sequence: Synthetic coding sequence
atgaagcaggaggaggcccagctgaaggagcagctgttcctgtacatggataaatttgaagaatttcaaactactatggccaagaccaatgaactgttcaccgcttttaaacaggaaaccgagaaattaacgaagaagattaaaaagctggagaaggaaatggtcatttggtacaccaagtgggagaataacaacaccacactgctccaaatggcagaggagaaaacaatccgggataaaaattataaggtatttcagattaaactagagagactggaaaagctgtataaagcactgcaaatcgagcgcaatgaactgtcagagaagttgggcattctgaagggacaggtttctgtgaaggtcgcggacgtggacttggctgtcccggttacacatagctgtgcggaccttgacagctcgaacatgctgaacacaagcagcaaaagagcccccggtgtgcatctggaagctgaccctaaaggaatgaatgaagtcaagtgttattcaaaagctttgagcacagggagccctctgggtatagattag

SEQ ID NO: 50412 - DNA, 792 bp, Artificial Sequence
  Description of Artificial Sequence: Synthetic coding sequence
atggaccgggccaagcagcagcaggccctgctgctgctgcccgtgtgcttagcactgacattctcactcacagctgttgtgagtagccactggtgtgagggcactagaagggtcgtgaagcccctttgtcaggaccaacccggaggccagcactgtatacatttcaaacgcgataactccagtaatggccgcatggataacaactcacaggctgtactgtatatttgggagctgggcgacgacaaatttatccaaaggggtttccacgtggggctctggcagagctgcgaggagtctctgaatggtgaagatgagaaatgcaggtctttcaggtcggtagtgcccgccgaggagcagggggtcctttggctgtccatcggtggcgaggtgttggacatcgtactgatcttgaccagcgcgattctactcggctcacgcgtgtcctgcaggtccccaggattccattggcttcgggtcgacgctctggtggccatcttcatggttctagccggactgttgggtatggttgcacatatgatgtatacgaccatctttcagataaccgtgaatctagggccagaggactggaagcctcaaacttgggactacggctggtcttactgcttggcttggggaagtttcgccctatgtctggctgtatctgtatcggcgatgagcagattcactgccgcaaggcttgagtttaccgagaaacagcaggcccagaacggcagcagacattcgcagcactctttcctcgagccagaagccagtgaatccatttggaaatag

SEQ ID NO: 50413 - DNA, 888 bp, Artificial Sequence
  Description of Artificial Sequence: Synthetic coding sequence
atggccgaggagacccagcacaacaagctggccgccgccaagaagaagctgaaggagtactggcagaagaaccgcccaagggttcctgcaggcgtaaacagaaataggaagacaaatgggtcaattcctgagaccgcgacgtccggaggttgccagccccccggtgactctgcaaccggattccacagagaagggccaacttcctctgcgaccctaaaagaccttgagagcccctgtcaagaacgagccgttgttctcgatagcacatccgtgaaaatctctcggctcaagaacaccattaagtccttgatctgcacccttaagaaggagaaacagcaggatatgagaagagtagaggaactggagcgaagcctctcaaagctcaaaaaccagatggccgagcccttgccgcctgaaccccctgccgtgccgtccgaggtggagctgcagcacctgcgaaaggaactcgagcgcgtggccggcgaactgcagtcacaggtgaagaacaatcaacacatcagtctactgaaccgccgacaggaggagcgaattagagaacaggaagagcggctccgaaaacaggaggaaagactacaagagcagcatgagaagcttagacagctggctaagccacaaagtgtgttcgaggaactgaataatgagaacaagagtaccctgcagctggagcagcaggtcaaagagctgcaggaaaagctgggcgaggtcaaggagacagagacatcaaccccctcaaagaagggatgggaggcaggatcgagccttttaggtggcgaggtgccgggacaaaggcagttgcctgcgtgggggctggtcacaactgcccctcgccgggcagtattaagactttttcttgcttcctgtttatag

SEQ ID NO: 50414 - DNA, 888 bp, Artificial Sequence
  Description of Artificial Sequence: Synthetic coding sequence
atggccgaggagacccagcacaacaagctggccgccgccaagaagaagctgaaggaatactggcaaaagaacagaccgcgggttcccgcaggtgtaaaccgaaaccggaagaccaatggatcaataccagaaacggctacttctggaggatgccagcccccaggagactccgccactggctttcatagagagggcccaaccagctctgctactctgaaagatttagagagcccctgtcaagagcgcgccgtggttctggattcgacctcagtcaaaatatcgcggctgaagaacactattaaaagtttgatttgcaccctgaagaaggagaaacagcaggacatgaggcgcgtcgaggaactagagcgctcgctcagcaaattgaagaaccagatggcggaaccactccctcctgagccacccgccgtacccagcgaggttgaactgcaacaccttcggaaggagttagagagggtggccggcgaactgcaatctcaggtgaagaataatcaacacataagcctgctcaaccgtcgccaagaggagcgcatccgggaacaagaagaacgtttgcgaaagcaagaggagcgtttgcaagaacagcacgagaagctcaggcaactggctaaaccccagagcgtgtttgaagaactgaataacgagaataaatccacgttgcaattggagcaacaagtgaaggaactgcaagagaagctcggcgaggtgaaggagacagaaacatccacaccctcaaagaaggggtgggaggcagggagtagtcttctcggtggcgaagtgcccggacagcgccaactgcctgcatggggactggttaccaccgcacctaggcgggccgttctccgcttgttcttggcatcctgcctgtag

SEQ ID NO: 50415 - DNA, 720 bp, Artificial Sequence
  Description of Artificial Sequence: Synthetic coding sequence
agcgccaccggcttccaccgggagggccccaccagcagcgccaccttaaaggacctcgaaagcccatgccaagagagagccgtggtgctagattccacctccgtgaaaatcagtcggctgaagaacaccatcaagagtttgatctgcactctgaaaaaggaaaaacagcaggatatgaggagggtcgaggaattggagaggagcctgagcaagctgaagaatcagatggccgaaccattaccccctgagccgcccgctgtgccatccgaggttgagttgcaacacttgcgcaaggagttagagagagtcgccggagagctgcaatctcaggtaaagaataatcaacacataagccttcttaataggcgccaggaggaacggattcgagaacaggaggaacgcttgcggaaacaggaagaacgtctccaggagcagcatgagaagctgaggcagctggccaaacctcagagcgtgttcgaagagctgaacaatgaaaataagtcaactctccagctcgaacagcaggtgaaagaactgcaggagaagcttggcgaagtgaaagagacagagacatctacaccttccaagaaaggctgggaagcaggttcgagcctgctggggggggaggttccaggccagaggcagttacccgcatggggtctggttactaccgcccctcgccgagctgttctgaggctattcttggcaagttgtctgtag

SEQ ID NO: 50416 - DNA, 1899 bp, Artificial Sequence
  Description of Artificial Sequence: Synthetic coding sequence
atggccgaggagacccagcacaacaagctggccgccgccaagaagaagttgaaggaatattggcagaagaatcgccctagggttccagcaggagtcaataggaatagaaaaacaaacggtagtatacctgagaccgctacctctggggggtgccagcctccgggcgacagtgctacaggcttccacagggaggggcctacctcttcagcaaccctcaaggatttggagtcaccctgtcaggagcgggcagtggtgctggattctacaagcgtaaagatctctcgtctcaaaaataccatcaaaagccttaaacagcaaaagaagcaggtcgagcaccagctggaggaagagaaaaaggcgaacaacgagagacagaaggcagaacgggaacttgaggtgcagatccagacacttataattcagaaggaggaactcaatacagatctgtatcacatggaacggtccctgagatactttgaagaagagtctaaggacctggctgtccggctccaacacagtctccagtgtaaaggggagttggaaagcgctttgtctgccgtcatagccaccgaaaagaaaaaggcgaatcagctttcgagctgcagtaaagcccacactgagtgggaactagaacagagtctgcaggatcaagctctgctgaaagcccaactgacgcagctgaaagagtcttttcagcaactccagctggaaagggatgagtgcgcggaacatattgaaggagaacgcgctcgatggcaccagcggatgagtaaaatgagccaggagatctgcacccttaaaaaggagaaacagcaagatatgcgtagggtggaggaactggagcgatccctgtccaagcttaaaaatcagatggccgagcctctgccacctgaacctcccgccgtgccctccgaggttgagctccagcacctccgtaaagagctcgagcgcgtggccggggagttgcaatcacaagtgaagaacaatcagcatatttcactgctgaatagaaggcaggaggaacgcatacgagagcaggaagaacgactgcggaagcaggaggagaggcttcaggagcagcacgagaaattgagacagttggccaaaccacaaagtgtcttcgaggagctcaataacgagaataagtctaccctgcagctcgaacagcaggtcaaagagcttcaggaaaagctgggagaagaacatctggaggctgcgtctcaacagaatcagcagctgacagctcagctgagtctcatggccctgcccggtgagggccatgggggcgaacatctggattctgagggagaagaggctcctcagcccatgccgagtgtgccagaggaccttgagagcagggaggccatgagctcctttatggatcacctcaaggaaaaagccgaccttagtgaattggtcaagaagcaggagttgcgctttattcagtactggcaagagcgctgtcaccaaaaaatccatcatttgctgtcagaaccaggggggagagcaaaggatgctgcgcttgggggcggtcaccatcaggctggagcacagggcggagatgaaggcgaggctgctggggcagccgcagatgggattgcggcctattccaactacaataatggccaccgaaagtttcttgctgccgcgcacaacagtgcggacgagcccgggccgggagcacctgctccccaagagttaggagcagcagataaacacggcgatttgagggaggtgaccctgacgagcagcgctcaaggagaggcccgtgaagatcctcttctggataaacctacagcacaaccaattgtccaggatcaccaagagcatccaggtctaggatcaaattgctgcgtgcctttgttttgttgggcctggctgcctcgcaggaggaggtag

SEQ ID NO: 50417 - DNA, 1899 bp, Artificial Sequence
  Description of Artificial Sequence: Synthetic coding sequence
atggccgaggagacccagcacaacaagctggccgccgccaagaagaagttgaaggagtattggcagaagaatcgtcctcgtgtccccgccggtgtgaataggaaccgcaagaccaacggatccattcctgagactgcgacaagtggcggttgccagcctcctggtgacagtgcaactggatttcatcgcgagggccccactagctcagctacactgaaggacctcgaaagcccatgtcaagagagagccgtagtgctggacagcacaagcgttaagatcagtcgcctgaagaacacaatcaagagcctcaagcagcaaaaaaagcaagtggagcaccagttggaagaagaaaagaaagcgaacaatgaacggcagaaggcggaacgcgaacttgaggtgcagatccaaacactaatcatccaaaaggaggaacttaatacagacctgtatcatatggagcggtcgctgcgctacttcgaggaggaatcaaaagatttggccgttcggctgcagcactcactccagtgcaagggagaactggaatccgccctcagcgccgtgatcgctaccgaaaaaaaaaaggctaatcagctatctagctgttctaaagcccacacggaatgggagttagagcagagcttgcaggaccaggccctgctgaaagctcagctcacccagctgaaggagagctttcagcaactgcagctggagcgagacgaatgtgcagagcacattgagggggagagagccaggtggcatcaacggatgtcaaaaatgtctcaagagatctgtacccttaagaaggagaagcagcaggacatgagacgcgtggaagagctggaacggagcctgtctaagctcaagaaccaaatggctgagcctctcccaccagagccccccgcagtaccctcagaggttgaactccagcatctccggaaggaactcgaacgggttgctggcgagctgcagtcccaggtgaaaaacaatcaacacatttccctcttgaataggcggcaggaggagcgaattcgagagcaggaggaaaggttgcggaaacaggaagagagattgcaggaacagcacgagaagctgagacagttggctaagccacaatcagtgttcgaggagcttaacaacgagaacaagtcgacattgcaattggagcaacaagtgaaggagctgcaggagaaactcggggaggagcatttggaggctgcgtctcagcagaaccaacagctgactgcgcagttaagcctgatggcccttcccggagaggggcacggcggggagcacctggacagcgagggggaagaggcacctcggccgatgccctccgtcccggaggatcccgaatcccgcgaggcaatgagttcattcatggaccacctaaaggagaaagctgatctgtcagaactggttaagaagcaggagcttcgatttattcagtattggcaggaacgttgccatcagaagatccaccatctgctgtctgagccggggggcagggctaaggacgctgctctggggggcggacaccaccaagctggggctcaaggtggagatgaaggtgaagcggccggagctgcagccgacgggatagctgcctatagtaattacaacaacgggcacaggaagttcctcgcggcagcacacaactccgcagacgaaccgggccctggcgcccctgcaccacaggaattgggcgctgcagacaaacacggtgatttgagagaagtaactctgacaagttcagcccagggagaagcccgggaggacccactcctggacaagcccaccgctcagcccatcgttcaggatcatcaggaacatcctggactggggtccaattgttgcgtgcccctgttctgttgggcctggctccctcggaggcggcgttag

SEQ ID NO: 50418 - DNA, 690 bp, Artificial Sequence
  Description of Artificial Sequence: Synthetic coding sequence
atggacatgggcaccagcgccctgagcaagaagccctggtggaccctccctcagaattttcatgccccgatggtcttccacatggaagaggatcaggaggagctgattttcggccacggtgatacataccttcggtgtatcgaggtgcactctcacaccctgatccaactggagagctggtttactgccacaggccagacccgcgttacggtggttggccctcaccgagcacggcagtggctccttcacatgttctgctgtgtcggtagtcaagactcctaccatcatgctagaggtggctccactgcctggccttgggagcgtgtgctctcggcccgttcgcgagggggtccctgtccaaaaaccttcatcctccagtggtgctccacctggaagcgcacacggcgtagcagtagctccgacctgatgacacgtacgttcgctgccctctcttgtactgccacgccgctgttctcttggtgctttaccgctaccgggcaaacaagagttacagtggtgggccctcccatggcgaaacagtggctgctgctgatgttccactgcgtcggcagccaagatagcaaatgccatgcacgcgggctgaagatgctcgagagagtacgttcccagcctctgaccaacgatgacctcgtaaccagtgttagcttgccaccatatacaggcgattag

SEQ ID NO: 50419 - DNA, 492 bp, Artificial Sequence
  Description of Artificial Sequence: Synthetic coding sequence
atgagcagctgccccgtgcacgactgccccagctgggaccccgagaggctagaaccagtggagacaggctctcggggcgccctgcgactcagaggcggggcccccggatccgccgctgggtttagagcgtctatctgggggcccgccggctacccgtcccctgtagggcttgggcacccggcctctctgccaaggcccgcctattccccccgctgccccgagcctgatgctcgccatggatggggctccggtagcaacgccgggtaccggggccccgaccgggctggaaccccctgtcccgcccaggacagagaaggcagatcttcttcccctgtgcctcccccacggctgaaagccatgacatcgcaggcgcggaagcagaatggaggcgctctgatcgatacggtagactggactagagaggcccccgattccgacccagtgatgtcaatgcagaagactcaaaaaccgcagacgaccgtgggccagtag

SEQ ID NO: 50420 - DNA, 591 bp, Artificial Sequence
  Description of Artificial Sequence: Synthetic coding sequence
atggaccacgaggccgcccagctggagaagcagcacgtgcacaacgtatatgaaagtaccgctccctacttctctgatctacagtcaaaggcatggccgagagtccggcagtttttgcaggaacagaagccaggctcactcattgcagacatcggctgcgggacaggcaaatatttgaaggtgaatagccaggttcataccgttggctgcgactattgcggtcccctggtagaaatcgcaaggaatcgcgggtgcgaggccatgggacttgagcatccatggatatggtatccacgcgcctcctggaatcagccaccaaccgacatagagggccctcagtatttttaccccccatgtcacccaatcccagatctgcaaaaacaaacaataatttgtcacttcaaaggacccactctcaatgagcagcagaagagtagcccaacccaccaccgtcttcatgcatgctttcaacactgtagagaggaagagtcgcgaccctggctgatggctctgtcgagctgggatcaagtggcgatggaaggccacgtgagtgcgagtctcacaagctgtatcgtgagacttttgttgtag

SEQ ID NO: 50421 - DNA, 1365 bp, Artificial Sequence
  Description of Artificial Sequence: Synthetic coding sequence
atggaccacgaggccgcccagctggagaagcagcacgtgcacaacgtctacgagtctactgctccgtacttcagtgacctccagtccaaagcgtggccaagagtgcgtcaatttttacaggagcagaaacctggtagcctgatcgccgatattgggtgcggcacgggaaaataccttaaggttaacagccaggtacacactgttgggtgtgactattgcggaccactggtggagatcgccagaaaccgtgggtgcgaagcgatggtctgcgacaacctgaacttaccgtttcgcgatgaggggttcgacgctatcatctcgataggcgtcatccatcacttcagcacaaagcaaagacgcattcgagccattaaagagatggctcgggtcttggtacccgggggccagctcatgatttatgtctgggcaatggagcagaaaaataggcatttcgagaagcaagatgtcctagtaccttggaaccgcgcactgtgtagtcagctattttcggaaagcagccagagcggcaggaagcgccagtgcggctaccctgaaagaggccatccctaccaccccccatgtagcgagtgttcctgctcagtgtgtttcaaagaacagtgtgggagcaagagatctcatagcgttggctacgagcccgctatggccaggacttgttttgccaatattagcaaggagggcgaggaggaatatggtttttactcaacgctcggcaaatcctttagatcatggttttttagtcgatctctagacgaatccaccctgagaaagcagatcgagcgagttcgtcctctgaaaaatacagaggtgtgggcgtcatccactgtaactgtccagcccagtcggcattccagccttgacttcgatcatcaagaacccttttctacgaaaggccagtccctggacgaggaagttttcgtggaaagctcttcaggaaagcacctggagtggctgagggcaccagggacccttaagcacttaaacggtgatcatcagggtgagatgcgaaggaacggcggcgggaatttcctagactccacgaacaccggggtcaactgcgtagacgcaggtaatatcgaggacgataacccctctgccagcaagattctgcggagaataagtgccgtcgattctaccgatttcaacccagatgataccatgtctgtcgaggatcctcaaaccgacgtcctggatagcactgccttcatgcggtattaccacgtctttagggaaggggaactttgcagtttactgaaagagaatgtttccgaactcaggatcctgagctctggtaacgaccacggtaattggtgtattatcgccgaaaagaaacgcggatgtgactag

SEQ ID NO: 50422 - DNA, 1104 bp, Artificial Sequence
  Description of Artificial Sequence: Synthetic coding sequence
atggtgtgcgacaacctgaacctgcccttccgggacgagggcttcgacgccatcatctctataggtgtcatacaccacttctctaccaagcagaggcggatacgagccataaaagagatggccagggtcctggtgcctggcggtcagttgatgatctatgtgtgggccatggaacagaagaataggcactttgagaagcaggacgtgctcgtaccctggaatagagctctgtgttcacagctgttctccgaatctagccagagcggaagaaaacggcaatgcggctatccggagcggggtcatccctatcatccaccctgcagcgagtgcagttgttctgtctgctttaaagagcagtgcggctcaaaacgcagccacagcgttggatatgagcctgccatggcacggacttgcttcgcaaacatctccaaagaaggcgaggaagagtatgggttttattcgaccttgggcaagagctttaggagctggtttttctctcggtctctagatgaatccactttaagaaaacagatcgagagagtcaggccattgaagaacacagaagtgtgggcatcttccaccgtgaccgtccagcctagtaggcatagctctctcgatttcgaccatcaggagcctttcagcacgaaggggcagtccctggacgaggaggttttcgtcgagagcagctcggggaaacaccttgaatggcttcgggccccaggcacactgaaacacctgaatggcgaccaccagggggagatgagacgtaacgggggaggtaattttttggactcaacgaatactggcgtgaattgcgttgacgccggaaacatagaggacgacaaccccagcgcctctaaaatcctgcggcgcatttcggcagtcgatagcacggacttcaacccagacgacactatgagtgtcgaggaccctcagactgacgtgctcgatagtactgcctttatgcgctattatcacgtgtttagagagggtgagctgtgtagtctcctgaaggagaatgtctctgagttacggattctctctagcggcaacgatcacggaaactggtgcattatcgctgaaaagaaacgtggatgtgactag

SEQ ID NO: 50423 - DNA, 2547 bp, Artificial Sequence
  Description of Artificial Sequence: Synthetic coding sequence
atggtgaagctgagcatcgtgctgaccccccagttcctgagccacgaccagggccagctgaccaaggagcttcagcagcacgtcaagtcggtcacttgcccatgcgagtacctacggaaagtgataaacacactggcggatcatcatcaccggggcacagacttcggtgggtccccctggctgcatgtgatcatagcattccccacatcctacaaagttgtgatcactctgtggattgtttacctgtgggtcagtctgctcaaaacaatcttctggagtaggaacggccatgatggttccacagacgttcaacaaagagcctggcgatccaaccgacgcaggcaggaggggctgaggagcatttgcatgcacaccaagaagcgggtcagcagcttcaggggtaacaaaatcgtgttaaaggatgttattacacttaggcgacatgttgagaccaaggtaagggcaaagattcggaagcggaaggtgaccacaaaaatcaatcaccatgataaaatcaatggtaagcgtaagacagcaagaaaacagaagatgttccaacgggcccaggaacttcgtcggcgtgctgaagactatcataaatgtaaaattcctcctagcgcccggaaagctctttgtaactgggtaaggatggccgctgcagaacatagacactcctccggcttaccctactggccttacctcactgcagaaacacttaagaaccgaatgggccatcagcctccccccccaacccaacaacactccatcaccgacaacagtctgtcactgaagacccccccagagtgtttactgactcccctgccgccctctgccgacgataacctgaaaactccccccgaatgtgtgctcactccactgcctccgtcagccgacgataaccttaagaccccacctgagtgtctgctaacacccctaccgccatcagccttgccatcagctccccctagcgcggacgataaccttaaaactcgggctgagtgcctgctccatcccctgccgccatctgccgacgacaatctgaagaccccctctgagcgccagcttaccccccttcctccctctgcaccaccctcagccgacgataatataaagacacccgcatttcatccccaacgcatgatcatctcccggcaccttccgagcgtgagcagcctgccctttcaccctcagctgcaccctcagcaaatgataattagccgccatcttccaagtgtttgcgggggccgattccatcctcagagaatgattatctcgaggcaccttccatctgtgagtagccttccatttcacccccagctgcacccccaacaaatgatcatttctcgacacctcccctctgtgtgcggtggaaggtttcacccccaacgaatgattattagtcgacacctcccctctgtgtcatctcttccatttcacccacagctacatccgcagcaaatgatcataagccgtcacctgccctctgtatgcggaggcaggtttcatccccagaggatgatcatctcccggcatcttccctctgtctcaagcctgccttttcacccacaactgcatcctcagcagatgatcatatcaagacacctcccctccgtgtgcggcggccgtttccatcctcagcggatgatcattagcagacatcttcctagtgtgagctctctccctttccacccccaacttcatccccagcagatgattatctcaaggcacctcccctctgtgtgcggcggtagattccatccccaacgcatgatcatttctcgccatctgccgtccgtgagctccctgccatttcatacccaactgcacccccagcagatgattatcagtcggcacttgccatcggtctgtggagagagattaaggggcccactgcctccaagcgcggacgacaacctcaaaaccccaagtgaaaggcagttaacccccttgccgcccagcgcacctcccagtgcggatgacaacattaagacacccgctgaaaggctccgtggccctctgcccccttcagccgacgataacttgaagacaccttcagaaagacagcttactcccttacctcccagtgccccgcctagtgccgatgacaacatcaaaacgccagccgaacggcttcggggccccctgccacctagcgccgatgataacttaaaaacccctccattggccacccaggaggcagaagccgaaaagcccaggaagccaaagagacagcgggctgcggagatggaacccccccccgaacccaagagaagacgggtgggagacgttgagccctcacggaaaccaaaacggcgaagggctgcagacgtggagccaagcagccccgagccaaaaagacgcagagttggcgacgtagagccctccaggaagcctaagagacggcgtgctgctgacgttgaaccatcttctcccgaaccgaagcggaggagggtgggagacgtggaaccaagtagaaagcctaaacggaggcgggctgcagatgtggagccttctctgcccgagcccaagcgacgcagactgtcatag

SEQ ID NO: 50424 - DNA, 3417 bp, Artificial Sequence
  Description of Artificial Sequence: Synthetic coding sequence
atggtgaagctgagcatcgtgctgaccccccagttcctgagccacgaccaaggccaactgaccaaggagttgcaacagcacgttaaaagcgtcacatgtccatgcgagtatctgagaaaggtgatcaatacactggccgaccatcatcaccgcggaacagacttcggcggatcaccatggctccacgtgattatcgcgtttccaacgagttataaggtcgtgattacactgtggatcgtctatctgtgggtatccttgctgaaaactatattctggagcaggaatgggcatgatggcagcacggatgtgcaacaacgggcatggaggtcaaatcgaaggcgccaagaggggctccggagtatctgtatgcacacaaagaaaagagtatcatccttccgaggcaacaagattgtgctcaaagacgtgattacactccgccgccacgtcgagactaaggtgcgggctaagattcgaaaacggaaggtgaccacaaagatcaatcatcacgataagatcaacgggaaaagaaagaccgcccgaaagcaaaagatgttccagagagcccaagagcttcggcgccgagccgaggattatcataaatgtaaaattccccccagcgctagaaaggcactgtgtaattgggtgcggatggccgctgcggaacaccgccactccagcggacttccatactggccctacctgaccgcggagactctgaaaaaccgcatgggccaccagccccctcctcctacccagcaacactctatcaccgacaattccctgtctctgaaaactcctcctgagtgtttgctaacccccctgcctcctagcgcggacgacaacttgaagacccccccggagtgtgtgctcaccccgctgccaccatctgcggatgacaacctgaaaactcctcctgaatgtgttttgacaccccttccgccctctgccgacgataacctaaagactcctcctgaatgcctgctgaccccgctcccaccaagcgctgatgataagttaaaaactcctccggagtgcctgctaacccccctgcctcctagcgccctgccttccgccccaccatcagctgatgataacctcaaaaccagagctgagtgcctgctccatcccctccccccttctgcagacgataatctgaagactccgtccgagcggcagctcacacctcttcccccatcagctccaccatccgccgacgacaatatcaagacccccgccgaacggctgagaggcccattgccccctagtgccgacgataacctgaaaaccccgagcgagaggcagttaacaccccttccacccagcgctcctcccagcgcagacgacaacataaaaacacccgcagagaggctgcgcggtccccttccgccatcagcagacgataacctgaagacaccgagtgaacggcaacttacacctctgcccccctcagctccgccttctgccgatgataatattaaaactcccgctgaacgactgcgcgggccccttcccccctcagctgatgacaatctgaaaactccgtctgagcgtcagctgaccccgctgccccctagcgcacctccatctgcagacgataacattaaaacacccgccgagagattgcgcgggccccttcccccctctgccgatgataacctgaagactccgagcgaacgccaactgacgcctctcccaccgagtgcacctccttcggccgatgacaacattaagacccctgccgagcgcctgcgtggacctctgcctcccagtgccgatgacaacctaaaaactccaagcgagagacagctgacccctttgcccccgtctgcccccccatctgccgatgacaacatcaagacgccggcattccacccacaacgcatgatcatcagccgacacctacctagtgtgtcctcgctgccattccatccccaactgcacccacagcagatgattatatcacgttatctgctttcagtgtgcggatttcgctttcatcatcaacccatgattattagccggcatctgccctctgtctcctctttgcctttccacccccaattgcacccacaacagatgatcatttcacggcacctcccttctgtttgcggaggcaggttccatccccagcggatgattatctctcggcacctccctagtgtctcctcgttgccctttcaccctcagttacacccccaacagatgatcatctcccgacacctgccgagtgtgtgcgggggccgatttcatcctcaaaggatgattattagtcgccacctgccatccgtttctagcttacctttccatccacagctgcatcctcagcagatgattatttcccgccatctcccgtctgtgtgtggcggaaggttccaccctcagagaatgatcatatctcgtcacctccctagtgtgagttctctcccctttcacccccaacttcacccccaacagatgataatttctcgtcacctgcccagtgtatgcggcgggagattccatccccagagaatgataatcagtcgtcacctgcctagtgtgagttccctgcctttccacccccagctccacccgcaacagatgattatatcaaggcatttaccgtcagtgtgcggggagaggctgcgcggccccctgcccccttccgcagacgataatctgaaaaccccttctgagcgacagttgactcccttgccacccagcgcaccacccagtgccgatgacaatataaaaacccccgctgagcgcctgaggggacctttaccaccttccgccgacgacaatttaaaaaccccaagcgagcgacaactgacccccttgccaccatcagcacctccctctgcagacgacaatattaagactcctgctgagaggctgcggggtcccttaccaccatcggctgatgacaacctgaagaccccctcggagcgccagctaacccctctcccaccttcggcccccccatcggcggacgataacataaaaactccagcagagcggttgagagggccccttcccccctctgcagatgacaatttaaaaactcctcctcttgctacacaagaagctgaagccgaaaagccccgcaagcccaagcgacaaagagcggccgaaatggagccaccccccgagcccaagcgccgtagagttggcgatgttgagccatctagaaaacccaagcgcaggcgcgctgctgatgtcgagcctagtagtccagagcccaagcgccgccgggtcggtgacgttgagccctctcgcaagcctaagcgacgcagggcagctgatgttgagccctcttctcctgagcctaagaggcgtagggtgggagatgtggaacccagcaggaagccaaaacggcgaagggctgccgatgtcgagccatcgctcccagagcctaaaagaaggcgcctgagctag

SEQ ID NO: 50425 - DNA, 2979 bp, Artificial Sequence
  Description of Artificial Sequence: Synthetic coding sequence
atgttccagcgggcccaggagctgcggcggcgggccgaggactaccacaagtgtaaaattcctccctccgcgaggaaggctctgtgtaactgggtgcgaatggctgcagctgagcatcggcacagcagcggtcttccctattggccctacctcaccgctgaaacactgaaaaacaggatgggccaccagccccccccaccgacccagcaacattccataaccgacaattccctgtcactgaagacccccccagagtgtctattgaccccattgcccccaagcgctgatgataatctgaaaacgcctcctgaatgtgtgctaactcctttgccgccgagcgctgacgataatctaaaaacccctccagaatgcgttcttacacctttacccccctccgccgatgataatctaaaaaccccaccagagtgtctgttgacacctcttcctccctctgccgatgataaacttaagaccccaccagagtgcctcctgacccctctgcccccttccgccttaccttctgcaccaccctctgccgacgataacttgaaaacgagagccgaatgcctactgcacccactacccccatcagcggatgacaatttgaaaacaccctctgagagacaactcacccctctgccacctagcgctccgcccagcgccgacgacaacatcaaaacgcctgcagaaagactgagaggaccacttcctccctctgcagatgacaatcttaagacgccaagcgagcgtcagttgacacctcttcctccttccgcacctccgtctgcagatgataatatcaagactcctgcagaaagactcaggggtcccctcccgccctctgccgacgacaacttaaagactccctccgagagacagctcacgcccctgcccccttccgcacctcctagtgctgacgataatatcaaaacaccagccgagcgtctccgcggcccgctgcccccttccgccgacgacaacctcaagaccccatccgaaaggcaactcaccccccttccaccctcagctcccccatccgcagatgacaatatcaagacacctgcagagcgattacggggccccctgccgccatcggctgacgacaatctgaaaaccccgtcagagagacagcttacacctcttcccccatcagctccaccttccgccgatgataacattaagactcccgctgagaggcttagaggcccactcccaccatcagcagatgacaaccttaagaccccctcagaaagacagctgacaccccttcccccttccgccccgccttccgctgacgacaacatcaagatcccagccgagagattgcgcatcccattaccgccaagcgccgacgacaaccttaagacccctagcgaaagacaactaacaccactgcctcccagtgccccaccctcagcagatgacaacataaaaaccccggcattccatccacagaggatgattattagccgacaccttccatccgtgtcatcgctgccttttcacccacagttgcaccctcagcagatgattatctctcgtcacctcccttctgtgtgcggaggccgtttccacccacagcggatgattatatcacgccacttaccaagcgtcagctcacttccgttccatcctcaactgcatcctcagcagatgattataagccgtcaccttccttcagtgtgcgggggtcggtttcacccccagaggatgattatatcaaggcatttgccctccgtgagttccttgccttttcatactcagctgcatcctcagcagatgataatttctcgccacctaccttcggtgtgcggcggtaggttccaccctcagcgaatgatcattagccgacacctgccatccgtctcatctctgccatttcaccctcagcttcaccctcagcaaatgatcatcagccgacatctgcccagtgtgtgcggaggacgttttcaccctcagcgaatgataatatcacgtcacttaccttcagtatcgtcactcccttttcacccacagcttcacccccagcaaatgatcatcagcagacatttgcccagtgtgtgcggacccctccccccgtctgctgacgacaatctgaaaaccccatcagagaggcagttgactccactgccaccctcagccccaccaagtgccgatgataatatcaaaactcccgcagagaggctgagaggccccctgcctccctctgccgacgataacctgaaaaccccttcggagcggcagctgactccactgcctccctccgcaccaccgtccgccgacgataacattaaaacacctgcagaaaggctccggggtcccttgccgcccagcgccgatgacaacctcaagacccccagcgagcggcagctaacccccctccctccctccgcaccccccagtgccgacgacaacataaaaaccccagctgagaggctgcggggtcctctccccccaagcgcggatgataatttaaaaaccccctctgaacggcaactgacccctctccctccctctgcacctccgtctgcagatgacaatatcaaaactcccgccgaacggcttcgtggcccactgcccccttccgctgacgataaccttaagaccccgcccctagccactcaggaggccgaggccgagaagcccaggaaaccaaagcgacagcgcgcagcggaaatggaacccccgccagagcccaaacgccgacgagtgggggacgtggagccctccaggaagcctaagagacgcagagcggcagatgtggagcctagctcaccagagcccaagaggcggcgggtgggagatgttgaacctagcaggaaacctaagcggcgccgcgccgcggatgtcgaaccctcatcacctgaacctaagcgccgtcgggtgggtgatgtcgagccctcccgcaagcctaagcgccgaagagctgctgacgtggagccgtcgctccctgaaccgaaacgccggaggttgagctag

SEQ ID NO: 50426 - DNA, 1263 bp, Artificial Sequence
  Description of Artificial Sequence: Synthetic coding sequence
atggccgccgccgagcaccggcacagcagcggcctgccctactggccatacctgacagctgagactctgaagaataggatgggccatcagccaccccctcccacacagcagcactcaataactgacaattccttgtctctgaaaacgcctcctgagtgccttcttactcccctccctccttccgccgacgataaccttaagaccccacctgaatgcgtcttgaccccgctcccaccctcagctgatgacaacctgaaaacacctccagagtgtgtgctgaccccgctgcccccatcagccgacgacaatctcaagacacctccggaatgtctgttaacacctctgccaccctctgctgacgataagctaaaaaccccgccagaatgcttactgactcccttgccgccaagtgccttgcctagcgcgccaccatccgcagacgacaatttgaaaacacgcgcagagtgtctcttacatccgctccctccatctgccgatgataacctcaagacaccatctgagcgccagctaacacccctgcctcccagtgccccaccttctgccgatgacaatatcaaaacaccggcagaacggctgcgcggccctctccccccctccgctgatgacaatctaaagaccccgtccgaacggcagctcacgccgcttccccccagtgcgccgccgtctgcagacgataatataaaaacacccgcagagagactacgaggacctctgcctccatcagctgacgataacctaaagactcctagtgagcgccagctgacacccctgcccccttcggccccaccctcggccgacgacaatatcaagacgccggctgagagactgcgtggccccctccccccgagcgccgacgataatctgaagacacccccacttgccactcaggaagccgaggcagagaaacccaggaaacccaagaggcaacgagcggcggagatggaaccgcccccagaacccaaaagacggcgagtgggcgatgtcgaaccatcccggaaacccaaacgcagaagagcggcagacgtggaaccgtccagccctgaacctaaaagacgccgcgtaggagacgtggaacctagccggaagcccaagagaagaagggccgccgacgttgaaccttccagtcctgaacctaaaagacgcagggtgggagatgtagaacctagtcgcaagcctaagagaagaagagcagcagacgtggagccctctttgcctgagcccaaacgccggcggctcagctag

SEQ ID NO: 50427 - DNA, 1986 bp, Artificial Sequence
  Description of Artificial Sequence: Synthetic coding sequence
atgttccagcgggcccaggagctgcggcggcgggccgaggactaccacaaatgcaaaattccaccatcggcacgaaaagccctgtgcaattgggtacgcatggctgctgccgagcaccgccactccagtggtcttccctactggccctaccttacagcggagaccttgaagaaccgcatgggccaccagccccctccacccactcaacagcactccatcacagacaattccctgtcactgaaaacacctcccgaatgtgtgcttacaccgttgccgccttcagctgacgacaatctcaaaacgccccccgagtgcgttctgacccccctgccgccgtctgccgacgataacctgaagacaccacccgagtgcctgctgactccactacctccaagtgcggacgacaacctcaagacccctcctgaatgcctcctgaccccactgcctccctccgcagatgacaacttaaagactccaccagagtgcctgctcactccgttgccaccctccgcacctccaagcgctcccccctcagctgacgataacctgaaaacccgagctgagtgcctgctgcatcctctgcctccctcagccgacgacaatctcaagaccccgtctgaaaggcagctcacacccctgcccccatctgcccctccttctgccgatgacaatattaaaacgccagcctttcatccccagaggatgattatctcccgacaccttccctctgtctctagcctgcctttccacccccagttgcactcacaacaaatgatcatctctcggtatctgcttagtgtgtgcgggtttcggttccaccatcagcctatgattatttctcgacacctaccctctgtgagtagtctccccttccaccctcagttgcacccccagcagatgatcatctccagacatctgcctagcgtgtgcggcgggaggtttcaccctcagaggatgataatcagccggcatcttccctctgtatcttcactacctttccacccacaactgcaccctcagcagatgatcatatcacgacacctgccctccgtgtgcggaggcagattccacccgcaaagaatgattattagccgccacctcccttcggtttccagcctgcccttccatccacaactgcatcctcagcagatgattatttctaggcaccttccatccgtgtgcggagggaggttccacccccaaaggatgataatctctaggcacctgccctccgttagttccttacccttccaccctcagttgcaccctcagcaaatgatcatttcgcggcacctacctagtgtgtgcggtgggaggtttcatccgcaacgcatgatcatctccaggcatctgccctccgtgagcagtctgccattccatccccaacttcacccgcagcaaatgattattagccgacatttgcctagcgtgtgtggtgaacgtctccggggccccctcccacctagcgcagatgataacctgaaaactccctccgaacgccagctgacgcccctgcccccctccgcccctccttcggcagatgacaatatcaagacccctgctgagaggctgcggggaccgctgccaccatcagccgacgataatctgaagaccccgccacttgccacacaggaagctgaggcagaaaagccgcgtaagccaaagagacaacgggcagccgagatggaacccccccccgagccaaaaagacgccgagtgggcgacgtcgaaccttctcggaagcctaagcgcagaagagcagcagacgtcgaaccatccagccccaaaccaaagcgcaggcgcgtgggggacgtagagccatctcgcaagcctaagcgcagaagggctgcagatgtggagccatctagtccagagccaaaacgccgacgcgtcggcgacgttgaaccctcaagaaaacccaaaagaagacgagctgccgacgtcgaaccctcgtcgccagagcctaaacgcaggcggttatcctag

SEQ ID NO: 50428 - DNA, 1263 bp, Artificial Sequence
  Description of Artificial Sequence: Synthetic coding sequence
atggccgccgccgagcaccggcacagcagcggcctgccctactggccatacttaaccgccgagacacttaagaacagaatgggccaccagcctccacccccaactcagcagcatagcatcacagataattctctgagcctcaaaacacctcccgaatgcgtcttaacccccttgccaccctctgccgacgataaccttaagaccccacccgagtgcgtgcttacgcccctgccaccctccgccgacgacaatttgaaaaccccccctgaatgtctattaactcctttaccaccatccgcagacgataatctgaagacacctccagaatgcctccttacccctttgccaccctccgccgatgacaacctgaaaacgccacctgaatgcttactgaccccccttcctcctagtgctccgccaagtgccccaccatcagccgatgataacctgaagacaagagccgagtgtttgctacatcccttacccccttctgctgatgacaatctcaagactccctctgaacgccaattgactccgttgccacctagcgctccgccatcagctgacgacaacatcaaaactcccgccgagcgtctgagagggccgctgcctcccagcgctgatgacaatctcaaaactcccagcgagcggcagttaacccccctccctcctagcgctcccccatctgcagacgacaatataaagacgccagccgaacgactaagggggccactgcctccatcagcggatgataacctcaagacccctagtgaaagacagttgacacctctgccaccctccgccccaccatcagccgatgataacattaaaacacccgccgagaggctgagaggaccgcttcctccttccgcggacgataacctgaaaaccccaccactggcgacccaagaggccgaggccgaaaagcctagaaaaccaaagcgacagcgcgcggctgagatggagcccccacccgagcctaagcgcagacgcgtaggggatgtagagccttctaggaagcctaagagacgccgcgcagccgacgtggagccctcctcccctaaaccgaaaaggcggcgcgttggcgatgtggagccctccaggaaaccaaaaaggaggagagcggctgatgttgaacccagcagccccgagcctaagagacggagggtgggcgatgtggaaccaagtagaaagccaaaacggaggagggctgccgatgtggaacctagctcacctgagcccaagaggaggcgccttagttag

SEQ ID NO: 50429 - DNA, 2505 bp, Artificial Sequence
  Description of Artificial Sequence: Synthetic coding sequence
atgaaggtgatcgtgatccaccggaagatgttccagcgggcccaggaactgagacggagggcagaagattatcataaatgtaaaatcccccctagtgcacgtaaagcgctgtgtaattgggtccgcatggctgctgccgagcacagacattctagcggacttccctattggccctatctgactgcggagaccttgaagaatcggatggggcatcagcccccgccgcctactcagcagcattcaatcaccgataatagcctcagcttgaaaacaccacccgaatgtgtgctgacccccttacccccctccgctgatgacaatctgaagactccccccgaatgcgtgttgacccccttaccaccatccgctgacgacaacctgaagactccgcctgagtgtcttctgactcccctgcctccttctgcggatgacaatttaaaaacacccccagagtgtctgctcacgccgcttcccccgagcgcagacgacaatctgaagactccacccgagtgcttgctcaccccgcttcccccatctgcaccaccttcagctccgccctctgctgatgacaatctgaaaacacgagctgaatgcctgctacacccgttaccgccctccgccgacgacaatctgaaaactccctctgagagacaactgactccactccccccaagcgcgccacccagcgctgacgacaacattaaaactcctgcggagaggctgcgtggcccattgcctccatcggccgatgataaccttaaaaccccgagcgaacggcaactgacacctcttcctccatcagcacctccctcggccgacgataatatcaaaactccagccgaacgcctgcgaggcccactgcctccgtctgctgatgacaatttgaagacaccttccgagcgccagctcacgccgctacctcccagcgcacccccgtccgctgatgataatattaagacgcccgctgagcgcctccgaggccctttgcctccttcagcagatgataatctcaagacccccagtgaaagacagctcacgccactgcccccctccgccgacgataacatcaagactcccgcattccacccccaacgtatgatcatctctcgacacctgccaagtgtttccagtttaccttttcaccctcagctccacagtcagcagatgataatcagccgttacctgctatccgtatgtggctttcgctttcaccaccagcctatgattatctctcgccatctgccttcggtcagctctctgccgttccatccccagctccacccacagcagatgatcatttcccgccacctcccatccgtgtgtggcgggcgttttcatccccagcgcatgatcatctcaagacatttgccgagtgtttcctcactgccattccatccacaattacatccccagcagatgattatatctagacatctccctagcgtgtgcggtggaaggtttcacccacagcggatgatcataagcaggcatctgccctctgtgtcatccctgccttttcaccctcagttgcatcctcaacagatgatcatctcaagacatctgccatccgtatgtggcgggcggtttcatccgcagcgtatgattatttcacggcacctcccctcagtttcctcgttgcccttccatccacagctccacccacagcaaatgattatatcgcgacacctcccttccgtctgtggtgagcgactgcgaggtcctttgcctccttctgctgatgacaacttgaaaacacccagtgagagacagctgactcccttaccacctagcgctccaccaagtgcagacgataacatcaagaccccagccgaaaggctgcgaggtccactgccaccttcggctgatgataacctgaagactccatctgaacgacagctgactccactgccgccgtcagccccgccaagcgccgatgataacattaaaacccccgccgaaagactcagaggtccattgcctccaagtgccgacgataatttaaagaccccaagtgagagacagctaacccctctgccaccgtctgctcccccgtcagccgacgataacattaagacccctgcagagcgcctcaggggcccgctgccaccctccgctgatgataaccttaaaacccctcctctcgcgacccaggaagccgaggccgagaagcccaggaagcccaaaaggcaaagagctgctgagatggagccccctcccgaacctaagaggagaagggtcggcgacgttgagccctcgagaaagcccaagcggcgccgggcagcagacgttgaacctagctcacccaagcccaagcgcagaagggtgggtgatgtagaaccttcacgaaagcctaaaagaaggcgcgctgccgacgtggaaccttcctcgccagaaccaaaaagaagacgcgtcggagacgtcgaaccatctaggaaacccaaacgacgtagggctgcagatgtggagcccagctcccctgagccgaaacgaagacgcctctcatag

SEQ ID NO: 50430 - DNA, 591 bp, Artificial Sequence
  Description of Artificial Sequence: Synthetic coding sequence
atgatccggtgcggcctggcctgcgagcggtgccggtggatcctgaccctgctcctgctgtctgctatcgcatttgacattatcgcacttgccgggagggggtggctccaatcttctgatcgcgtccagaccagctctctatggtggagatgtttcctgccccagggtcgtcgtcggaggcagcgggtcctgcgtgggcgcttgccccagccgcatggtgtgcgggtcggaagctcttccgcagctatgctcttctggggggtgtcaatcctggtgatatgttttatcctgtcttttttcgtcttgtgcgtgcctcagatcctggtgtttctcagagtaatcggtggactactggccctggccgccgtattccagataatcagcttggtaatatatccggtaaagtatacgcagcctagcacgtttatgccttcccccgctgtgaccagcatctataactgggcatgtggctttggctgggctgccatgattattctgataggatgtgccttcttctgctgttgcttaccaagttgcgaggacgacctactgggtaacaccaagcctcgctatttctataccagtgcctag

SEQ ID NO: 50431 - DNA, 1389 bp, Artificial Sequence
  Description of Artificial Sequence: Synthetic coding sequence
atggacagcctgtggggccccggcgccggcagccaccccttcggcgttcacaatacccgcctttctccggacctatgcccaggaaagatcgtgctgcgagctttgaaagagtccggcgccggaatgcctgagcaggataaggatccccgggtgcaggagaaccctggagaccagcgcagagtacccgaagttaccggcgacgctccttccgcttttagacccttaagggacaaccgtgggctgagcccttttgtgcctggcccaggaccccttcagacggacctgcatgcccagagaagcgagattaggtacaatcagacgagccagacctcctggactagctcatgtaccaaccggaatgccatcagcagttcctattctagcacagggggcctacccggcttgaagagacgcagaggcccggcctcttcccattgccagctgactctttcaagctctaaaacagtgagtgaggatcgacctcaagccgttagcagtggccacacacaatgcgaaaaggccgcagatatcgcgcccgggcagaccctggccctgcggaatgattcttctaccagcgaagcctcacgaccttctacccacaagttccctcttctgccaaggagacgcggagaacctctcatgttgcctcccccacttgagctggggtatagagtgacagtcgaggatttagatcgggagaaggaggccgcgtttcagcgcataaactctgctcttcaggtggaggacaaagccatcagtgattgtaggccgtccagaccttcacataccctgtcatctctggcaacaggcacttctgggctgccagcaatatcaaaagctccttccatggacgtgcagcaggaaacccacaaatctcaggactgcctgggactactcgcaccactcgccagcgcggcaggagtcccatcaactgcacctatgtcaggcaaaaagcataagcctccaggccccctcttcagctcctccgaccctctgcccgcaacctcctctcactctcaggactccgctcaggtcaccagcctgatacctgctccttttccagccgctagtatggatgtgggcatgcgaagaactcgttgcggcacgagtgctcccgctgcagcagcagccgcccctcctccctccacactgaacccaacactgggcagcctgctggagtggatggaggctctgcatatctccggcccccagccccaactgcaacaggtcccgaggggccagaatcaacgcagccagacatcaaggactagttcatgtcctaaacgcaatgcaatcagtagtccctataggtcaaccggcggcttacctgaaagaaagaggcgaagagggcctgcttcttcccattgtcagctgaacctcagctcctag

SEQ ID NO: 50432 - DNA, 381 bp, Artificial Sequence
  Description of Artificial Sequence: Synthetic coding sequence
atgggccggatcttccagctgctgcgggaccggcggatcagcagccgtggtcctggcctccatactccgaaggcagagccgcgcaggaggaaaggcctaacaaccggactcatgacacaggcagaacggcaaaaacaggcgcatcaaagacaagcagccatgagagaaactgcactgtggtgtactgggcatattcgcccacgtacacatacacataccgggacccacacccagaccgaccgcgagcgggagcggaatacccagcggctccgcgatagggaacgcagagagaacgggcgacacacacacatccacacacagacccatacgcaatctttgattgccaaagcccttaaggacacccacccggggaacccctag

SEQ ID NO: 50433 - DNA, 1395 bp, Artificial Sequence
  Description of Artificial Sequence: Synthetic coding sequence
atgatggcctgccgggaccccaagcccggcgccaagcggctggtgagggcgcaaaccttacagaaacagcgccgcgctcccgtgggacctagggcgccccctccagacgaggaggatccacgcttgaaatgtaagaattgcggcgccttcggacacatggcgcgctccacacggtgcccaatgaaatgttggaaagccgccctcgtgccaccgactttggggaaaaaggaaggtaaggagaacctcaagccttggaagccgcaggttgaggcaaaccctggtccgttaaataaggataaaggggaaaaggaggagcggcctcgccagcaggacccccagaggaaagcacttttgcacatcttttccggaaagcctcccgaaaaacccctacctaatagaaaggggagcaccgaatctagtgtatacctccgcgtggcctctgggcctatgcccgttcacaccacttcaaaaaggccaagggtcgaccccgtcctcgcagaccggagcgccacagagatgtccgatcgcgggtcagccctggcttccttaagcccccttcggaaagcctctctcagtagcagcagcagcttaggacctaaggagagacaaacaggagcggctgcggatatccctcagccggcagtacgacatcaggggcccgaacccctccttgtggtcaaaccaactcatagttctcctgaggggggatgtagagaggtccctcaggctgcaagcaaaacccacggccttctacaggcaatatcacctcaagcacaggataagcgccctgcagttacctctcagccatgtccccctgcagcaacccatagcctggggctagggtctaacttgtcgttcggacctggtgcgaaaagaccagcacaggcgccgattcaagcatgcctgaattttcctaagaaaccgaggctggggcctttccaaattcctgagagcgccattcaggggggggagctaggggctccagagtatcttcaaccaccccctgctaccaccgagctgggcccaagtacatcaccacaaatgggtaggagaacaccggcacaagtttcctctgtggacagacagcccccccactctcgaccatgtctgccaactgcgcaagcttgtaccatgtcccaccaccctgcaacaagtcatgacggtgcccagcccctacgggtgctgtttagacgcctagagaatggcaggtggagctcttccctactggccgctcccagcttccattcccccgagaaacccggtgcattcctggcacagtcgccacatgtgtccgaaaagagcgaggtccccagagtgagggttccacccaatgttctctacgaagatttgcaagtgagcagctcctccgaggattccgactcagacctggaatag

SEQ ID NO: 50434 - DNA, 1383 bp, Artificial Sequence
  Description of Artificial Sequence: Synthetic coding sequence
cagatggcccggcacagcgtgcaccaccaggcccagcggccccccagagcaaagaacccacaggagcagcagcgccgccccatgggccagaccacactgcctgctgagcaagaagaatcacgggtcaaatgtaaaaattgcggcgccttcgggcactccgctcgttctaaaacttgtcctatcaagcgctggtccggggccctgccacttcaggcactgggaagccacaaagagaaggaaaacctgaaacccgccaaggcccaactgcctttcacaacccccgggccattcaccactaatgaccgcgaaaaggaaaggtcaccatcaccccagcaacagcagtccgaagccccaacacagacattcccacggaccccacaggagaagatgcaagaggcgtggaaggaacccgctgaggactgcctttttctgcgacaccctacaatgcctctgcccgtacatacaacaaaaaagagaagcgtgctggggcctgtttcaacgggaccccctccagtaaacaagccagaaatgcggcttttgtgcccttcagggcataacgatagccctcagctttccacctgcggcccaacaaagggccatggccgggacgttacagccagtttacttcccgtgctgaaatcatcacaccagactcccacgctgtccgcacgcctgccagctaaccgcccggatatgagcagccacggcgcgttgcagcctgcaatgcaggcgctcgctctgggacccggactcaagtcacaggccgagattaagcaccccgatgccgatgcgaaaccaaggccccagcaggtaaggaagcagtgcggccaggactcgagaacccaggccccagacaaagaacctgctccagtgcccactcagacatttcagaacccagccaaaaaggcgagattcagttctttccaaactcctgcacttagaacccagctccccgacgtcggagctgtgcagacactccaaccccctcgtacagccaccggcctcggctccaaagaggccccaaaggcaaccgcagaaaccgcagccaccaagactgccacattgcagcctcgggtgaacctgcagccagccccaagtagtcctttcttgggcccagcccagggatgccctgttctccaacctggcccacccatccacgtccccgggcgcccaggatctgttacttttatgcgaggagataagggccagaagagtccacgattccgtatgcctccaaccagccgcccaccggagaatagtgcatccgcccaatcacccagattcagtaggcagccggaggggcaggggcctcaggtgtcaacaagcgttctttacgaggacctcctggtaactagcagtagcgaagattctgacagcgactag

SEQ ID NO: 50435 - DNA, 894 bp, Artificial Sequence
  Description of Artificial Sequence: Synthetic coding sequence
ttcgtgctgggcgccgtgagccccgccgtggtggtgctgtacaccatggtgctgcaggaaaatggatatggagtcgaggaagacattccaacacttttaatggctgcgtcatctatggatgacctgcttgccataacaggttttaacacatgcctgtcaatagtcttctactcaggtggtatgatcaataatgcaatagcatcactccgtaatgtctgcatcagtctccttgccgggatcgtgctggggttcttcgtaagatactttccgtccgaggatcaaaagaagatcactctgaagcggggcttcctggtgctgattacattcgtatccgcagtgctgggatcacagcccatagggctgcacggtagtggggggctatgtacattggtgctgcacttcattgagtggactaaatggtcacaagagaagatgaaggtccagaagataattaccaacgtgtgggacatttttcagcctttgctattcgggctcgtcggagccgaggtgtccgtttctctactggaatcaaatattgttggaatctctgtgtcaacgctgtcactggccttatgtgtgcgtatcctgaatatatacctcctgatgtgcttcgccggtttctcctttaaggaaaaaatattcatcgctctggcttggatgccaaaagcaaccgtccaagcagtgcttggaccactcgctctggagacggcaagagtgtccaccccccacctggagacctacgccaaggatgtcatgacggtggcattccttgccatcatgattacggccccgaatggtgccctgctgatgggaatactgggcccaaagatgttgaccaggcattatgatcccagcaagattaaactgcagctaagtacacttgagcatcattag

SEQ ID NO: 50436 - DNA, 2325 bp, Artificial Sequence
  Description of Artificial Sequence: Synthetic coding sequence
atggagcccgagcgggagggcaccgagcggcacccccggaaggtgcgggaatcgaggcaggctccaaacaaactggtgggcgctgccgaggccatgaaggccgggtgggacctcgaagagagccagcctgaggcaaagaaggctagactctctacaatcctgttcaccgataactgcgaggtcactcacgaccagctgtgtgaactgctcaagtatgcagttctaggcaaaagcaatgttcctaagcctagctggtgtcagcttttccaccaaaaccacctgaataatgtcgtcgtcttcgtcctgcagggcatgtctcagttacatttctatcggttttaccttgagtttggttgtctcagaaaagcgtttagacataaattccggcttccccctccgtcctcggattttctggccgacgttgtgggcctgcaaacagagcaacgcgcgggtgacttgcccaagacaatggaaggacctttgccatctaatgctaaggccgctattaacctacaggacgatccaatcatccagaagtacgggtcaaagaaagtgggcctcactcggtgcctgctgaccaaagaggagatgcgtacgtttcatttccccctgcaaggctttcccgattgcgaaaattttctcctgactaagtgtaacggctccatagcggataactcccctctctttgggctcgactgcgagatgtgcctgacatcaaaaggccgcgaacttactagaatttccctggttgctgaaggcgggtgctgcgtcatggatgagttggttaagcctgaaaacaagattctggactacctgacgtctttctccggcattacaaagaagatcctaaaccctgtcactacaaagttgaaggacgttcagcgacagctgaaggccttgttgcctcccgacgctgtgctcgttggacacagtcttgatcttgacttgagggcgctcaaaatgattcacccatatgtcatcgacacctctctgctatatgttcgcgagcagggccggcgtttcaaactgaagtttcttgcaaaggtgatcctcggaaaggatatccagtgtccggaccgactcgggcatgacgccaccgaagacgccaggacaatactcgaactggctcggtattttctgaagcatggccccaagaaaattgccgagctcaaccttgaggccctcgcgaatcaccaagagattcaagctgccggccaggagcccaagaatactgccgaggtactgcagcatcccaatacgagcgtgctggagtgcttggattccgtgggacaaaaactgcttttcctgacaagggagacagacgccggagagttacctagcagcagaaactgccaaaccatcaaatgtctgtccaataaggaggttttggaacaggcccgcgtggagataccacttttccccttcagcattgtgcagttttccttcaaagcatttagccccgtgttgaccgaggagatgaacaaacgtatgcgaatcaagtggactgagatctctaccgtttacgcaggcccattcagtaaaaattgcaacctgagagctcttaagcggctgtttaagtctttcggacccgttcagtcaatgacttttgtcttagaaacccgccagccacacctctgcatccagtatgaagtgctcgaggcagcacagctggccattgaatctttagatggcatactggtcgacggtatttgtatcaaagtgcagaggcccgtgactgaactcacacttgattgcgataccttggtaaatgagcttgagggggacagcgaaaatcaggggtcgatctacctgtctggggtatcagaaacattcaaggagcagctgcttcaagagccacgactatttctgggcctagaggccgtgatcttgcccaaagatctgaagagcggcaaacaaaaaaaatactgctttctgaagtttaagtcattcgggagcgcccagcaggctctaaacattctcaccggaaaggactggaagctgaagggacggcacgcactcactccccgccacctgcatgcatggttgcgcgggctcccgccagagagcaccaggctccctggcctacgtgtagttcctcccccatttgaacaggaggccctgcagaccttgaaactagaccacccaaaaatagctgcttggcgctggagcagaaaaatcggcaaattgtataacagtctgtgccccggaaccctgtgtttaatcttgctgcctggaaccaagagtacccacggctcattatctgggctaggactcatgggaatcaaagaagaggaggagtcagcaggcccaggtctctgttcctag

SEQ ID NO: 50437 - DNA, 2232 bp, Artificial Sequence
  Description of Artificial Sequence: Synthetic coding sequence
atggagcccgagcgggagggcaccgagcggcacccccggaaggtgagagagagtcggcaggccccgaataaacttgtgggagccgccgaagccatgaaagccggttgggacttagaggaaagccagcctgaggctaaaaaagctcgactgagtaccatcctgttcacagataactgcgaagttacccatgaccaactctgcgagttacttaagtacgcagttctgggcaaaagtaatgttcctaaacctagctggtgtcagttgttccatcaaaaccacctcaataacgttgtggtctttgttctgcagggaatgtcccagctccatttttaccgattttatctggaatttgggtgcctacgaaaggcctttaggcataaattccggctgccacctcccagcagcgattttttggccgacgtggtagggctgcaaacagagcagcgggctggcgacttgccaaaaaccatggaaggccccctcccttcaaacgcaaaagccgccatcaacctccaggacgaccccattatccagaagtacggttctaagaaggtgggtctgaccagatgcctcctgacaaaggaggaaatgcggacctttcattttcctctccaggggttcccagattgcgaaaacttcctgctcaccaagtgcaatgggtctattgccgacaattctcctctattcggacttgactgcgagatgtgtctgacatcgaaggggcgcgagctcacaagaatttccctggtggcggagggggggtgctgcgttatggacgagctggtgaaacctgagaacaaaattctcgactaccttactagtttttccggcatcaccaagaaaattctgaacccggtgactaccaagctgaaggatgtgcagcgtcaattaaaggccctgctgccgccagacgccgtactggtgggccactctttggacctagacttacgggcccttaagatgatccacccctacgtgatagatactagccttctatacgtcagggagcaaggcaggcggtttaagctaaagtttctggccaaagtgatcctgggaaaggacatacaatgtcctgatcggctgggccatgacgcaactgaggacgcgcgaaccatcctagagctggcccgatatttcctgaagcatggcccaaagaagattgcagaactgaatctcgaggcacttgcaaaccatcaggaaatccaggcagcaggacaggaaccaaaaaataccgccgaagttttacagcaccctaatactagcgtgttagagtgcctcgattccgttgggcagaagctgctctttctgacccgcgagactgacgccggtgagttacctagtagtaggaattgtcagaccattaaatgtttgagcaacaaagaggtcttagaacaggctcgggtagagatcccgctctttccattcagcatagtacagtttagctttaaagctttctctcccgtgctgacagaagagatgaacaagcgaatgcggatcaaatggacagaaattagcacggtgtatgctggtccgttttctaagaattgtaatttgcgggccctgaagcggctgtttaaaagtttcggcccggtccagagcatgacatttgtgttagaaacacgccaggtgcaacgacccgtgacagaacttacactggattgtgatactctggtgaacgagctcgaaggagactctgagaaccagggttccatttacctgtctggtgtaagcgagacttttaaagaacaactgcttcaggagcctaggttgttcttgggcctggaggccgtgatcctccctaaggacttaaaatctgggaagcagaaaaaatactgcttcttaaaattcaagtcctttggttctgcccagcaagctctcaatattctaacaggaaaagactggaagttgaaaggaaggcacgctttgacccctaggcatctgcatgcctggctccgcggccttccgccggagtccacacgcctgcctggactgcgcgttgtacctcccccctttgaacaggaggccctgcaaacgctgaaactggaccatcccaagatcgccgcctggcgttggtctcggaaaatcggaaaactatataactctttgtgtcctggcacactgtgtttgatcctgctgcctggaacaaagtcgactcacggctctctcagtgggctcgggttaatggggattaaagaagaggaggagtctgccggccccgggctgtgctcatag

SEQ ID NO: 50438 - DNA, 2082 bp, Artificial Sequence
  Description of Artificial Sequence: Synthetic coding sequence
agcctgccccagagcgaggcccagggccaggccgtggacctgcggacacctgtctcctgccttcgggggcggctacctcccggccataccgaggcgaggctggttggtggagagcacccttgcgctggccgtctggaagtgacctggggaactgtttgtgacgcagctcttgatctggccacagcccatgttgtgtgtagggagctgcaatgtggagccgtggtctctactcccgaaggagcccgtttcggacgcgggtctgggcctgtttggaccgaagccttccgctgtgctggcaatgagagtctactgtttcattgcccccgcggtaggggctcccagtgtggacatggacatgatgccgggttgcgctgctccgaatttcgtatggtcaacggtagctcctcttgtgagggccgtgtggagtttcaagtccaagggagttgggcacctttgtgcgccacccattgggacattgccgatgccacagtattgtgtcaccaactcaactgcgggaacgcagtggctgcccctgggggcgggcattttggtgacggcgatgcggccatctggcccgacgccttccactgcgaaggcactgaaagttacttgtggaactgcccggtgtccactctcggtgcccctgcctgtgcaccaggcaacacagccagtgcagtgtgcagcggccttgcccatgcattgagacttcgagaaggccagtcgaggtgcgatgggcgcgtcgaggtaagcctggacggcgtctggggacgagtcttggatgatgcctgggacctccgcggcgctggggtggtatgtagacaactgggttgtaggggggcccaacaggcgtacgatgcgcccgcaccctcacggggctccgttcaagtggcattgagtcgagtcagatgcctgggtaccgagactaggctgacgcagtgtaacgtgtcagcaaccttgcaagaacctgcgggcacctctagagatgctggcgtcgtgtgttctggtgaggtgggcaccgccagccctatggcccgtcgccacgggatccctggcgccttgacacttagcttacatcgggaaccccagggcgcggcaggccgcggagccggcgccctgcacggcggggcttggggaaccgtctgcgatgacgcctgggatctcagggacgcacacgtcgtatgtaggcagctcggatgtggaagagcactaagccctggggggagaacattacgcagtcgcggacgggcccacctggctggtagagcgggccttcccggtccccgagtttgtgctgttgcagtgcccgtgggggggcttggagccgccaggctcgaggcacaggggggcagacggagactattgctgagagttggcgggtccgaagccgcaagatgggacctgctgctttgttgggtggcaggcagggtactgcagtgggatttaggacgtcatgtgcagcaatgtcccgagggtcccctattggtacatcacttacaagcggctggtgtttggggggttgggttagctggcgagcaagccctgcctctctgtggacaccgggaccgcctggggggtcagcaccgagtgccacaggcagcccagctgcactccgtggccatgccctttccacctatggctcctgcactcctgcggccttcccgggctggcctggattacctgtgtagaatcgtgaggggccaagcgactggatgttggggagccccgcagctcttgttgttggcgagactgccgcgtggaggacgcacagcgagagccagggggcggggccctctcctgagggctcggggcgcgctcgctcgcggactgctcggtcacagggtgagacgatggctgggtcccgggggccggggtggccgcgtgcctccggcagggctttggtctggtagacgacgcccaggcgggaggcgcctctggccttggctcagggctcgggtggccggaagagggggggtccctggtcagcggggagtccctgtgggcctgccacgttcaggcggcgatgctgagacagcccgtacacggcgaactcgtgcgtgtgcagccggcaaaacgaattcatag

SEQ ID NO: 50439 - DNA, 1359 bp, Artificial Sequence
  Description of Artificial Sequence: Synthetic coding sequence
atgaacagcggcatcctgcaggtgttccagcgggagctgatctgcccaatttgtatgaattactttatcgatcctgttacgatagattgtggccacagtttctgtaggccttgcttctaccttaactggaaagattcaccttttttggtgcagtgctccgagtgtacaaagtctacagggcagattaacttgaaaactaatatacactttaaaaaaatggccagtctggccagaaaggtgagcttgtggctgttccttagttcagaggaacaaatgtgcggtactcaccgggagactaaaaaaatgttttgcgaggtcgatcgaagcctattgtgtctactgtgcagtagtagtcaggagcaccgtgatcatcgacattgccccattgagtccgctgcagaggaacaccaggagaaacttcttcaaaaaatgcagtcactttgggaaaaggcctgtgagaatcatcgaaacctgaatgtcgaaactactcgcacaaggtgctggaaagactatgtgaatttacgcctggaagcaatccgcgcggagtaccagaagatgcctgctttccatcacgaggaggagaaacacaatctggagatgctgaagaaaaaagggaaggatatttttcaccgcctgcacttgtcaaaggccaagatggcccatcgccgagaaattcttagagggatgtatgaggaattaaacgagatgtgtcacaaaccagacgtggaactgttgcaggctttcggtgatattctccaccgctccgaaagtgtcctgctgcacatgccccaacccctgaaccctgagctttctgccggccccattacgggactcagagatcggctgaaccagtttcgggtacatattactctccatcacgaggaagccaattctgacattttcttgtgcgagatcctgaggagcatgtgtataggctgtgatcaccaagatgtcccatactttacagccacgccccggtcgtttctggcctggggagctcagacttttaccagtggcaagtactactgggaggtgcacgttggggattcctggaattgggccttcggagtctgcaacatgtattggaaagagaagaatcaaaacgagaaaattgacggcgaggatggattgtttctgctcgggtgcgtgaaaaacgacatccagcggtcacttttcaccacctcccccttgctgttacagtatatccctaggcctactagtcgtgttggcttatttttggattgcgaagcaaagactgtcagctttgtagatgtcaaccagtctagcctcatttacaccatacctaactgctccttttctcctccgctccggcctatcttctgctgtatccatttttag

SEQ ID NO: 50440 - DNA, 339 bp, Artificial Sequence
  Description of Artificial Sequence: Synthetic coding sequence
caggtggcctacgtgcgggcccgggagctgcacaccctggaggtgaccggcctggaaaccgtggcacagtccaaggctcatgtagcttcattggagggactaatccctgaagataaggtcgtgctcctcgcgggcagccctctgcaaaacgaagccaccttggggcagtgtggtgtggaagcgcttactacgctggaggtcgtggggcgccgtctgggcggtaacaactgcttgtctttgcaagtgaatccagttcagccggcccgatacttgtggacaacccttcatagttctaagcagggagaacctaacagcagcgctaatcaccgctgtagttag

SEQ ID NO: 50441 - DNA, 1026 bp, Artificial Sequence
  Description of Artificial Sequence: Synthetic coding sequence
atgcggctgtgcctgatcccccggaacaccggcaccccccagcgggtcctgcgaccggtcgtgtggtcccccccatcacgcaaaaagcctgtcctctctccacacaatagcattatgttcggccacctgtctccagtgaggattccctgtttgcggggaaagtttaacttgcagctgccctccttggacgatcaggttatccctgcccgacttcccaaaactgaagtgtccgctgaagagcccaaggaggcaacagaagtgaaggatcaggtagagactcagggccaggaagacaataaacgcggaccctgttccaatggcgaggctgccagtaccagccgccctctcgaaacccaggggaacctaacgtcatcctggtataaccctcgacccttagaaggaaacgtacaccttaagtctctcactgagaagaatcagacggacaaggctcaagtgcatgcagtaagcttttattcaaaggggcacggggtggcatcttctcacagtcctgcgggaggtatcctcccatttgggaaaccggatccacttccaaccgtcctgcctgctcctgtccctggctgctctctgtggccagagaaggcagctctgaaggtcctgggagaggaccacctgccttcgtctccaggcctgctcatggtaggagaagatatgcaacctaaggatcctgctgcattaggatcgagtcggtcctcacctccaagagccgctggacacaggtcccacaagcggaagctgagcggccctccgcttcaattacagccaacaccgccccttcaattgcggtgtgatagggatgaaagaccgcccccagcaaagttgccatgtctcagcccagaagctctcttggtcgggcaggcatctcagagagagggcaggctgcagcatggaaacatgcgaaagaacatgcgcgttttgtcccgtatttccaagtttcgccgtttgcgccagctgctgaggagaagaaagaaaaccagacaaggcaggcgggggggttcatgtctgtag

SEQ ID NO: 50442 - DNA, 285 bp, Artificial Sequence
  Description of Artificial Sequence: Synthetic coding sequence
atgcggaagctgcggctgcgggccagcaaccccggccccagcggcgccccaggtactaggcagcatttcagtacgtccagaggcgggcatcactgtgctcgtcggtggcttaggcgcgtgaggaggagccgctcccagacaccttcataccaaaaccttgatcctaaccctccaatagtgcggtttcccctccctttagagcgaatatcagaagttccaaggcgagcctgtctgcacgggcgggacgcttcgtccgtgtggcctccccctgagcggtccgactag

SEQ ID NO: 50443 - DNA, 2268 bp, Artificial Sequence
  Description of Artificial Sequence: Synthetic coding sequence
atggccgccgtggccgccgaggccgccgccaccgccgccagccccggagaagggggagcgggggaggccgaacccgagatggaacccatcccaggctctgaggccggaaccgacccccttcctgtcactgccaccgaggcatccgtgccagacggcgaaacagatggtcagcagtccgccccacaggccgatgagccgcccctgccacccccccctcccccccccggggagctggccaggagccctgaagccgtgggccccgaactggaggcagaagaaaagctctccgtccgggttgcagaatcagctgccgccgctccacagggcggccccgaacttcccccaagcccggcttctcctcctgaacaacctccagccccggaagaacgcgaggagccgccgctgccacagcccgtggccccggctttggtacccccagcaggaggagatagcaccgtgagccagttgattcccggctcagaggtcagagtgacgctcgaccacattatagaagacgccctcgtggtgagttttcggttcggagagaagctcttcagcggcgtgctgatggacctgagcaaacggtttggcccacatggaattcctgtgaccgtgttccctaagcgtgaatacaaagacaaacctgaagccatgccactgcaatcgaacacttttcaggaagggacagaggtgaaatgcgaagccaacggagcagttccagatgatcccagtcccgtcccacacccagagctttcactggccgagtcgctctggacctccaagccgcctcctctattccacgaaggagcaccatatccgcctccactcttcataagggacacatacaaccagagtatcccgcagccacctccccgcaaaattaagcgtcctaaaagaaagatgtatcgcgaagaaccgacaagcatcatgaatgccatcaagctgagacccaggcaggtgctgtgtgacaagtgcaagaatagcgttgtggccgaaaaaaaagaaatacgcaaggggagcagcgcaacagatagtagtaagtatgaagataaaaagcgcaggaatgagtctgtcacaactgtgaataaaaaactgaagaccgatcataaggtagatggaaagaatcagaacgaatcgcagaaacgtaatgctgtagttaaagtgagtaatattgcccactcaagaggacgagtggtgaaggtgagcgcacaggcaaacaccagtaaagcccagttatccactaagaaggttctccagtccaagaatatggaccacgccaaagcccgagaggtgctgaagatcgctaaagaaaaggcccagaagaaacaaaacgagactagcacaagtaagaatgcgcactcaaaggtgcacttcacaaggcgttatcagaacccatccagcgggtctttgcccccccgcgtccgtctcaagccacagagatatcggaacgaagaaaatgattcatctctgaagacaggcctggagaagatgcggtccggaaaaatggcccctaagccacagagcaggtgcacttctactcgttccgccggagaggctcctagcgagaaccagagtccatctaagggcccagaagaggctagtagtgaggtccaagatactaatgaggtccacgtgccgggggaccaggatgaacctcagaccctgggcaagaaaggttctaagaacaatattagcgtgtacatgactctgaaccagaaaaaatccgacagttcctctgcatctgtgtgcagcattgattcaactgacgacctcaaaagcagcaactcagaatgctcttctagcgagtctttcgatttccctcctggtagcatgcatgcacccagcacaagctccaccagctcttcctccaaagaggaaaaaaagctaagcaacagtcttaaaatgaaagtgtttagcaaaaacgtgagcaagtgtgtaacacccgacggccgcacaatctgtgtaggcgacatcgtctgggctaaaatctacggctttccatggtggccagctcgtatcctaacaataactgtgagtcggaaggacaacggtttgctggttcgacaggaggcgcggatcagttggtttggcagcccaactacgtcgttcttagccttgtcacaactctcgccttttctggagaacttccagtcaagattcaacaaaaaacgaaagggactttaccggaaagcaattacagaagcagctaaggcagctaagcaactcactcccgaggtacgtgcactactcacccagtttgagacatag

SEQ ID NO: 50444 - DNA, 1683 bp, Artificial Sequence
  Description of Artificial Sequence: Synthetic coding sequence
atggccgccgtggccgccgaggccgccgccaccgccgccagccccggcgagggcggagctggtgaagccgagcccgagatggaaccaatcccaggtagcgaggctggtaccgatccactccctgtgacagccaccgaggcgagcgttccggatggagagaccgacggacagcagtcagctcctcaagccgacgaacctccactgccacctcccccccctccgccaggtgaactggcaagatctccagaggccgtgggtccagagctcgaagctgaagagaagctgagtgtccgggtggccgagtccgctgccgccgccccccaaggtgggcctgaactccctccctctccagcttcacctcctgagcagcctccagcacccgaagagcgggaggaaccccctctgccacagcccgtggcccccgccctcgtgccccccgctggcggcgactcaacagtctctcagctcattccaggatctgaagtccgcgtgactttggaccacatcatagaggatgccctagttgtgagcttccgctttggggagaagttgttttcaggagttctcatggatctgtccaagcgctttggcccgcacggcattccagtcactgtgtttcccaagcgtgagtacaaggataagcctgaggccatgcctctgcagagcaatacatttcaggagggaaccgaagtgaaatgtgaagctaacggagcagttccggacgatccctctccagtccctcaccctgagctctctctagcggaatccctgtggacctctaaaccaccaccactatttcacgagggcgccccttacccccccccactgtttattcgagatacatacaatcagagtatcccacagccgcctccccgcaagatcaagaggcccaaacgcaagatgtatagagaagagcccacgagcatcatgaatgctatcaaactgagacctaggcaagtgttgtgcgataaatgcaagaacagcgttgtggctgaaaaaaaagagattcgtaaaggctcttctgcaaccgatagttctaagtatgaagataagaagaggagaaacgagagtgtcacaacagtcaacaagaaactcaagacggaccacaaggtggacggcaaaaaccagaatgaatcccagaagaggaatgctgtcgtgaaagtttctaatatcgcccatagccggggacgagtggttaaggtttccgcacaggctaacacctcaaaggcccagctgtcgactaagaaagtgcttcagtcaaaaaatatggatcacgccaaggcccgagaggtgctcaagatcgcaaaagaaaaagcacagaaaaaacagaacgaaaccagcacctccaagaacgcacactccaaagttcatttcaccagacgctaccaaaatccatcctccgggtccctgcctccaagagttagactaaagccccagcgttatcggaacgaggagaacgactcttccttgaaaacaggcttggagaagatgcgctccggaaaaatggctccaaaaccacagagcagatgtacgagcacgcggtcagccgggctgaacaaatggcaacttctccatcaaactgtaacttcccctgccgccccgctccaatgtcttaccgatcactgtggtttccggcttggcgcattaaaactgactgtgaaacgggcagcccagcgacactag

SEQ ID NO: 50445 - DNA, 1563 bp, Artificial Sequence
  Description of Artificial Sequence: Synthetic coding sequence
atggccgccgtggccgccgaggccgccgccaccgccgccagccccggagaggggggagccggcgaagccgagccggaaatggagccaataccgggtagcgaagcggggactgaccccctgccagtgactgccaccgaggcttcagtcccagatggggagactgacggtcagcagtccgcaccccaggctgacgagcctcctctccctcctcctcccccccctccaggagagttagcccggtcgccggaagccgttggtccagaactcgaggccgaggagaaattgagcgtgcgcgtggccgaaagtgccgccgctgccccacagggagggccggaacttcctcctagccctgcatcccctcctgagcaaccgcccgcacctgaggagagggaagaaccaccactgccacaacccgtggctcccgcgttagttcctcctgccggcggggacagcaccgtgtcgcaattgattcccggatcagaagtgcgggtaacgcttgatcatattatcgaagacgcactggtcgtcagttttaggttcggagagaagttgttctctggagtgttgatggatttgtcaaagaggttcggaccccacggcattccggtgaccgttttccctaagcgagaatacaaggacaaaccagaggccatgccactgcaatcgaacaccttccaggaaggaactgaggtgaagtgcgaggccaacggcgcagtgccagacgaccccagtcccgttccccaccctgagctgtctctggccgaaagtttatggacctctaagcccccccctctgtttcatgagggcgccccctaccccccccctctgtttataagagacacttataatcaaagcatccctcagcctccaccccggaaaattaaacgtcctaagagaaaaatgtatcgagaagagcccacctccattatgaatgcaataaagctcaggcccagacaggtactttgtgacaagtgcaaaaactcagtcgtagctgagaagaaagagattaggaaagggagcagtgcgactgactcatccaagtacgaggacaaaaaacgacggaacgagagtgtgacaaccgtgaacaagaagttaaaaacagatcataaggttgacggcaaaaatcaaaacgagtcccagaagcgaaacgcagtggtcaaagtttccaacattgcccattcacgcggaagggtcgtcaaggtcagtgcccaggccaatacaagtaaggctcaactgtcaaccaaaaaggttctccaatcaaaaaatatggatcatgccaaggcacgcgaggtgcttaagatcgcaaaagagaaagcccagaaaaaacagaatgagacctccacatcaaaaaatgcccattctaaggttcacttcactaggagatatcagaacccatcatcagggagcctgccaccacgtgttagattaaaaccccagaggtacagaaacgaagaaaacgattcctctctgaaaaccggcttggaaaagatgcggagtgggaaaatggctcctaaaccccagagcaggtgcacttccacccgttcggcagcccagcgacactag

SEQ ID NO: 50446 - DNA, 1773 bp, Artificial Sequence
  Description of Artificial Sequence: Synthetic coding sequence
atggagccccgggccggctgccggctgcccgtgcgggtggagcaggttgtgaatggggcgctcgtcgtgaccgttagctgtggtgaacggtcattcgcagggattttgctggactgcaccaaaaagagcggactctttggccttcccccactggctcccttgccacaagtcgacgagtcccccgtaaacgactcacatgggagagctcccgaggaaggcgacgcagaagtgatgcagcttggcagttccagccccccgcctgcccggggtgtgcagccccctgagaccacccggcccgagcctcctccccccctggtccctccactcccggcagggtctctgcccccataccccccctacttcgagggggctcctttcccccatcccttatggctgagagatacctacaagttatgggtgccacagcctccccctcgtaccatcaaacgtactcgacgccggctgtctcggaatagagacccggggcggctgattctttccaccatccgtttacgaccccgacaggtgttgtgtgagaagtgcaaaagcacactttccccgccagaggccagtcctgggccacccgctgcaccccgggctaggcggcgtctgggctctgggccggatagagaactgcggaagccagaagagcccgagaacggcgaacctacagcagccgcgacagcgcgcagaagcaaaagggagagaagagaagaagaccgtgcccctgcagaacaggtgccgcggtcccccgtaatcaaaataagttatagcacccctcagggaaaaggagaagtggtgaaaataccctcccgggtccatgggtctctcgagcctttccgtccgcagcaggctcctcaggacgacggctcccaggaccccgaggtgttggatagggaaagccgggacagaccctcctgtgcaccaagtgcatccattcccaagttaaagctgacccgaccagtcccagctggcgccgacctgccaccacctaagatccgtcttaagccccacagactgggagactctgagcacgaacctgtttatcgcgccgagctggttggggaactaaacgggtacctgcgggacagctctcctgccccctgcgcagacgggccagccggtgggctggctgacctgagcagcggctcttctggggaagacgatgatttcaagtcctgcccacaagggccccaaggacgggagggactcgccttcttggtttcctgtcccgagggtcgcgccgactgtgcctctgagtctgcttgcagcagcgactctctggatgaagcaagatcaagtgggtcggagggtacacccgccgacaccggcgatttgtcccctgggcatggcgctagcgcccccagcgtgagtagggaagcccggcagacggtgcctcccctcacagttagactccacacccagtcagttagcgagtgcatcaccgaggacggccgaaccgtggcggtcggggacatcgtgtggggaaaaattcacggtttcccctggtggccggctcgcgtcctagatatctcattggggcaaaaggaggacggtgaaccatcatggagggaggcaaaggtctcttggttcgggtcgccaacaactagcttcctgagtatttcaaagctgagtccattttccgagttttttaaactgcgctttaaccggaagaagaaggggatgtataggaaggccattaccgaggcagctaatgctgcgcgacacgtggccccggaaatccgggagctcctaactcagttcgagacttag

SEQ ID NO: 50447 - DNA, 1500 bp, Artificial Sequence
  Description of Artificial Sequence: Synthetic coding sequence
atggagccccgggccggctgccggctgcccgtgcgggtggagcaggtggtgaacggcgccctagtggtgaccgtcagttgcggggagcgctcctttgcagggatattgttggattgcaccaaaaaatctggcttgtttgggttaccaccactggctccactgccacaggtcgacgaatcccccgttaacgattcacatggacgcgcgcctgaagagggcgacgcagaagtgatgcaactgggaagctcttctccaccaccggccagaggcgttcagccgcctgagactacaagacctgagcccccaccccctctcgtcccccctctgccagccggttctctgcccccctatcctccgtactttgaaggcgcaccattcccccatccattatggttaagagatacttacaaactgtgggtcccacagcccccaccccgcacgatcaaaagaactaggagacgactgagtaggaaccgagacccagggagactgattctctcaaccattcggctgcgccctaggcaggtcttgtgtgagaagtgcaaatcaactcttagtcctcctgaggcaagtcccggaccacccgccgctcccagagcccgccggcgcctgggaagcggcccagaccgcgagctgaggaagccagaggagcccgagaacggcgaaccaaccgcagcggccacagctaggaggtctaaaagagagcggcgggaggaggaccgcgcccccgccgaacaggtgccacgatccccagtaataaaaattagttactcaacccctcagggtaagggcgaggtggtgaaaatccccagtagggtccacggcagcctggagcctttcaggccccagcaggcacctcaggacgatggaagtcaggacccagaagtgttagaccgcgagagccgggacaggccctcttgtgccccctccgcatctattcccaaattaaaattaactcgtcctgtgcccgctggagcagacctccctccaccaaaaatacgcctcaagcctcaccggctcggcgattccgagcatgaacctgtctaccgcgccgagttggtgggggagcttaacggatacctgcgggactcatccccggctccttgcgctgacggccctgcaggcggtctggctgatttgagttccgggtcaagcggggaggacgacgatttcaaaagttgtccgcagggtccacagggccgcgagggtctagccttccttgttagctgccccgagggcagagccgattgtgcctctgaaagcgcctgctctagtgattccctcgacgaagcacggtctagcggatctgagggtacaccagcggatacaggcgatctgagccccggacacggcgcctctgcgccatctgtgtcaagggaggcacgccagaccgttccacccctgacggtgagactgcatacacagtctgtctctgagtgcattactgaagatggtcgaacagttgccgtaggagacattgtttgggggcatcgtagatag

SEQ ID NO: 50448 - DNA, 540 bp, Artificial Sequence
  Description of Artificial Sequence: Synthetic coding sequence
tgacagagccggcggatcgagcccgtgatgggccggctgctgctgtgtgcttcacatggagaaatcgaaaagcacccatcactgcacgcctcctcgtacggcttggtggcaatcaaagaagctcacgacatcgagacccggctcaacgaggtagagaagctgctcaaaactataatttccatgccctgcaagtactcaagaagtgaagtcgtcctcacgttcttcgaacgcagcccccttgaccaggtacttaaaaatgataacgtgcacaaaattcaaccatcattccagtctccagtgaaaatttcagaaattatgcgttccaacggtttctgcttggccaatacagagaccattgtcatcgaccacagcataccaaacggcagggaccagcagctgggagtggatcctactgaacacctcttcgaaaatgggtcagagttcccgtcggagctcgaggacggcgacgaccccgcggcctatgtgaccaacctgagttactatcacctagtcccttttgagacagacatttgggattag

SEQ ID NO: 50449 - DNA, 696 bp, Artificial Sequence
  Description of Artificial Sequence: Synthetic coding sequence
atggccagcgccgtgttcgagggcaccagcctggtgaacatgttcgtacgggggtgttgggttaatggtatccggcgcctgattgtatctagaaggggggatgaagaggagtttttcgagatcaggacagagtggtctgaccggtctgtgctgtatctacatagaagcctggcggacctcgggcgcctctggcagaggttacgagacgccttccctgaagacaggagcgaacttgcacagggtcccctgaggcaaggccttgtcgctattaaggaagctcacgacattgagacgcggttgaatgaagtggaaaagctgctcaagacaattataagcatgccctgcaagtatagccggagtgaggtagtgttgacattctttgagcggagtcctttagatcaggtccttaaaaatgacaatgtgcataagatccagccaagcttccagtcccctgttaagatcagtgaaattatgcggagtaacgggttctgcctggcgaatactgaaacgattgtgatcgatcacagtattcctaacggtagggatcagcagttaggagtcgacccaacggaacacctgttcgaaaatggcagcgagttccccagcgaactggaagacggcgatgaccccgctgcttatgtgaccaacctaagttattatcacctggtcccttttgagactgacatatgggattag

SEQ ID NO: 50450 - DNA, 1503 bp, Artificial Sequence
  Description of Artificial Sequence: Synthetic coding sequence
atggaggccgcccggcccccccccaccgccggcaagttcgtggtggtaggcgggggcatcgcgggagtcacctgtgcagaacaactggcgacccacttcccttctgaggacatcctgctggtgaccgcctcgccagttatcaaagcagtgacaaacttcaagcagattagcaaaattctggaagaattcgacgttgaggagcagtcatccactatgctaggcaagcggttcccgaacatcaaagtcatcgagtccggcgtaaagcagctaaagagcgaagagcattgcatcgtgactgaagacggaaatcaacacgtttataagaaactatgtctgtgcgccggggcaaagccaaagttgatctgtgaggggaatccatacgtgctcggaattcgtgacaccgacagcgcacaggaatttcaaaaacagctgacgaaagccaagcgcattatgatcatcggtaacgggggaatcgccctggaactcgtttatgagatcgaggggtgtgaggtgatttgggccatcaaggataaggcaattgggaatactttctttgacgcaggggccgccgagttcctgacttcaaaacttattgccgaaaagagtgaagctaagatcgcgcataagcggacacgttacactacggagggccgaaagaaggaggcgaggtcgaagagcaaggccgataacgtcggtagcgctttgggtccagattggcatgaagggctgaacctcaaaggtacgaaagaattctcacataagattcatctggagacaatgtgcgaggtaaaaaaaatatacctgcaagacgagttcaggatcttaaaaaagaaaagtttcactttccctcgcgatcataagtctgttacagccgatacggaaatgtggcccgtctatgtcgaacttactaatgagaagatctacggctgcgacttcatcgtcagtgccacaggagtgacccctaatgttgagccattcctacacggtaattctttcgatctcggagaggacggtggtctgaaggtggatgaccatatgcacacctcattgccggacatctacgctgctggagacatttgtacaactagctggcagctgagccccgtgtggcaacagatgcggctttggactcaggcccgacagatgggatggtacgcagctaagtgcatggctgccgcctcctccggcgattccattgatatggacttctcttttgaacttttcgcacacgtcactaagttttttaactacaaagtggtgctcttggggaaatataatgcccaaggactcgggtccgaccacgaattaatgctgaggtgtactaaaggcagggagtatattaaagttgtgatgcagaatggtcggatgatgggcgctgtcctgattggcgagaccgatctagaagagactttcgagaaccttattcttaaccagatgaatctgtcttcttacggcgaggatctccttgacccaaatatcgatattgaggattattttgattag

SEQ ID NO: 50451 - DNA, 420 bp, Artificial Sequence
  Description of Artificial Sequence: Synthetic coding sequence
atggaggccgcccggcccccccccaccgccggcaagttcgtggtggtgggaggcggtatagccggcgtcacttgcgccgaacagttagctactcactttccatctgaggacatcctgttagtaacagccagtccagtaattaaagccgtcacaaatttcaaacagattagcaagatcctcgaggaattcgatgtggaggaacaaagctctaccatgttggggaaacgctttccgaatataaaggtaatcgagagtggtgttaagcagttaaagtcagaagagcattgtattgtgaccgaagatggaaatcaacacgtgtataagaagctatgcctctgtgccggcgcaaagcctaagctcatctgtgagggaaacccttacgttttaggcatcagggatacagactctgcgcaggtctag

SEQ ID NO: 50452 - DNA, 1746 bp, Artificial Sequence
  Description of Artificial Sequence: Synthetic coding sequence
atggccgccagcggccggggcctgtgcaaggccgtggccgccagccccttccctgcgtggagacgggataatacagaggccagaggggggctgaagcccgaatatgacgcggttgttatcggtgctggccacaacgggctcgtggcagccgcttacctgcagcgtctgggcgttaatactgcggtgttcgagcgcaggcacgttatcggcggggccgcagtaacggaagaaatcattccggggtttaaattttctagagcttcttatcttttgtcattgttacgccctcagatttacaccgacctagaacttaaaaagcacgggttgaggctacacctgaggaacccgtatagctttaccccaatgctcgaagagggcgccggaagcaaggtacctagatgcctcctcttgggcacagatatggccgaaaatcagaagcagattgcccagttctcacaaaaagatgcccaggtgtttcctaaatatgaagaattcatgcaccgtttggcacttgccatcgaccccctgctggatgctgctcctgtagatatggctgcatttcaacatggatctctattgcagaggatgcggagtctttcaaccctcaagccccttctgaaagctggacgaatactgggcgctcagctgccgaggtactacgaagtcttaaccgcaccaatcaccaaggtgctggaccagtggtttgagtctgagccacttaaggccacactggctaccgatgccgttattggcgccatgacatcgccgcataccccgggttccggctatgttctgctgcaccacgttatgggagggctggagggcatgcaaggcgcttggggctacgtacagggcggaatgggagctctgagcgacgctattgcatcaagtgctacaacccacggcgcgagcattttcaccgagaaaactgtagcgaaggttcaggttaatagtgaaggatgcgttcaaggagtggtgttggaagatggcaccgaagtgcggtctaagatggtgctaagcaatacttctccacaaattactttcttgaagcttactccgcaggagtggttgccggaagaattcctcgagcggatttctcagctggatacgcggtcccccgtgactaaaatcaatgtggctgtggataggctgccttctttcttggcagcaccgaacgccccacggggacagccgttgcctcaccaccagtgctcgatccatctcaactgcgaggatacattattgcttcatcaggcctttgaagacgccatggatggactccctagtcaccgccccgtgattgagctatgtatacccagctcgcttgatccaacgctcgcccccccagggtgtcatgtcgttagtctgtttactcagtacatgccctacactctggccggcggcaaggcatgggacgaacaggagcgagacgcttacgcagaccgggtgtttgactgcattgaggtgtatgcccctggatttaaggattccgttgtcggtagggatatactgacccccccagatttagagcggatcttcggtctacctggcggcaatatcttccattgtgctatgtccttagatcaactctactttgcacggccggtccccctgcactcaggatataggtgccctttgcagggcctgtacctgtgcggcagtggcgcccatccaggcgggggcgtgatgggagccgcaggcagaaacgctgctcacgtagcctttagggatcttaagtccatgtag

SEQ ID NO: 50453 - DNA, 591 bp, Artificial Sequence
  Description of Artificial Sequence: Synthetic coding sequence
atgaagccccggaccctggtggagctgagcaagctgggcctgggcaacgaaaccgtggtgcagcttcgcaccctagagttaccagtggactaccgggaagccaaacggcgcgttacgggaatttgggaagaccaccaaccccagttggtggttcacgtgggtatggataccgcagcgaaagctatcatattagagcagtcaggtaaaaaccaaggataccgagacgccgacataagaagcttttggcctgaaggcggagtgtgcttgccaggcagtcccgatgtgctggagtccggagtctgtatgaaagccgtctgtaaacgggtggccgttgagggcgtggacgttatcttctcaagggacgctggaaggtacgtgtgtgactacacctattatttatcgctccaccacggtaaaggctgtgctgcccttattcacgttccaccactgagcaggggcctccctgcaagtttactcgggagagcacttagggtcattattcaagaaatgctcgaagaggtcggcaaaccaaagcacagagcccaattcgaggagaacagcacaatggtcctgccggcaaaggggaattag

SEQ ID NO: 50454 - DNA, 429 bp, Artificial Sequence
  Description of Artificial Sequence: Synthetic coding sequence
atggacaccgccgccaaggccatcatcctggagcagagcggcaagaatcaagggtacagagatgccgacatccgcagcttttggccagaaggcggagtctgtctccctggcagccccgatgtacttgaaagtggggtctgtatgaaggctgtgtgcaaaagagtggctgtggaaggcgtcgatgtgatattcagccgcgatgccggaagatatgtgtgcgactatacttattatttgagtctgcaccatggtaagggctgtgccgcccttattcatgtcccacccctatcaagggggctgccagcatcattgctgggacgggctctccgggttattatccaggaaatgcttgaagaggtcggaaagcccaagcacagagcccaatttgaagagaattcaaccatggtgctccccgccaaggggaactag

SEQ ID NO: 50455 - DNA, 429 bp, Artificial Sequence
  Description of Artificial Sequence: Synthetic coding sequence
atggacaccgccgccaaggccatcatcctggagcagagcggcaagaaccaggggtacagagatgccgacatccgctcattttggcccgaagggggagtttgtctccccggatcacccgatgtgttggaaagcggagtgtgcatgaaagccgtgtgcaaaagggtcgcagtggaaggcgtcgatgtcatcttttctcgggacgcaggccgctacgtgtgtgattatacatattacctgagccttcatcacggtaaggggtgcgctgcactaatccatgtgccccctctgagcagaggtcttccagcctccctccttggtcgagcattacgggtcatcattcaggaaatgctggaagaggtggggaagcccaagcatagagcccagttcgaggaaaatagcaccatggtcctccccgctaagggtaattag

SEQ ID NO: 50456 - DNA, 8397 bp, Artificial Sequence
  Description of Artificial Sequence: Synthetic coding sequence
atgaccagcatccacttcgtggtgcaccccctgcccggcaccgaggatcagctgaatgaccggctccgggaggtgtccgaaaagttgaataagtacaaccttaacagtcaccccccgctgaatgtcctggagcaagccacaatcaaacagtgtgtcgtgggaccaaatcacgccgctttcctactcgaagacggacgtgtttgtagaattgggtttagcgtccagcccgacagactggagctgggcaagccagataacaatgacggaagtaagcttaactctaattccggcgccgggagaacatcgagaccgggtcgaacaagcgactctccctggttcctgtccgggtctgaaacgcttgggcgcctcgctggaaataccctgggctcacgttggtcctctggggttggcgggagcggagggggaagttctggaagatcttctgcaggtgcccgggattccaggaggcagacacgcgtgattagaaccggacgggatcggggctcaggccttctaggatcccagcctcagccggtaatccccgcttccgtgatccctgaggagctgatctctcaagcccaggtggttcttcagggcaagagtagatccgtcattatccgtgaactacagcgcacaaatctggacgtcaatttggctgtcaataacctgctgtctagagacgacgaagacggcgatgacggggacgataccgcgtctgaaagctatctccctggcgaagatctgatgtccctgctggacgccgatatccatagcgcccacccaagtgtgataatagacgcagatgccatgttctcagaggacatatcttactttggatatccctcctttcggcgaagcagcctgagccgactgggctcttcaagggtgctgctgctgcctttggagcgcgattcagagctgcttcgagagcgcgaatctgtcctgcggctgcgggagaggaggtggctcgacggggcaagttttgataacgagcggggtagcacatccaaggaaggggagcccaatctagataagaaaaacacacccgtgcagagcccagtctctttgggagaggacctgcagtggtggcctgacaaagatggtacaaagttcatctgcattggggccctgtactctgagctacttgcagtcagctcaaagggcgaactctaccaatggaagtggagtgaaagcgagccttaccgaaatgcacagaacccaagcctgcatcaccccagagccacttttcttggactgaccaatgaaaaaatcgtcttgttatccgccaactcaattcgcgccacggtcgcgacagaaaataacaaagtggcaacttgggtggacgaaaccctcagctctgtcgctagcaaacttgagcacacagctcaaacatactcagagctacaaggcgagaggatcgtgtcccttcactgttgtgcgttgtacacatgtgcgcaattagagaacagcctctactggtggggtgtggtgcctttcagccagcggaagaaaatgctcgagaaggcacgcgcaaaaaacaaaaagcccaagagctcagcaggcatcagttctatgcctaatattacggtggggacacaggtgtgtttacgaaataatccattgtatcatgccggcgctgtggcgttcagcatttctgccggaatacctaaggtcggagtgctcatggagtccgtgtggaatatgaacgattcttgccgctttcagctgaggagccccgagtcccttaaaaacatggagaaagcttctaagaccactgaagcgaagcccgaatccaagcaggagccggtgaagacggagatggggccacctccttcacccgcgtctacgtgttccgacgcctctagcattgcatccagcgcctcaatgccgtataaacggcgcaggtcgaccccagcgcccaaagaggaggagaaagtcaacgaggaacagtggtcgttacgcgaggttgtgttcgtcgaagatgtgaagaacgtaccagtaggtaaggtgcttaaggtcgatggagcgtacgttgctgtcaaattccccggaactagttctaatacaaattgccagaacagttcagggcctgatgctgatccttccagtctgctccaggattgcaggctattgaggatcgatgaattacaggtggtgaaaactggaggcacacctaaggtgcctgactgtttccagagaacaccaaagaagctctgcatcccggaaaagaccgaaatcctggccgtaaacgtcgacagcaaaggcgtccacgccgtgctcaagaccggaaactgggtacgctattgcattttcgacttggccaccgggaaggccgaacaggaaaataactttccgacctctagcatcgcgttccttggacagaacgaacgcaacgttgctatcttcaccgctgggcaagaaagccctatcatcctgagggatggaaatggcacgatctatcctatggcgaaggattgcatgggtggtattcgggaccctgactggctcgacctccctcctatcagctcgctcggtatgggtgtccacagcctgatcaacttgcccgccaactccacaattaagaaaaaagctgccgttattatcatggcagtagaaaaacagaccctcatgcagcatatactccgctgcgactacgaggcctgcaggcagtacctgatgaaccttgagcaagctgtagtgttggagcagaacctgcaaatgcttcagacctttattagccaccgttgcgacgggaacaggaatatcttgcacgcttgtgtgagtgtttgcttcccaacctccaacaaggagaccaaagaggaagaagaggctgagcgtagcgagcgcaacacattcgcggaaaggttgtctgccgtggaggccatcgctaacgccataagtgtggtgtccagcaacggaccagggaacagagctggatccagcagcagcagatctttacggttgagagaaatgatgagacgtagtctgcgggccgcaggcctgggacgacatgaggctggtgcttctagcagtgatcaccaggaccccgtgagcccccctatcgcccccccttcctgggtcccagatcctcccgccatggatccagatggggacatagatttcatcctcgccccagccgtggggagtctcaccacagccgctaccggaaccgggcagggtcctagtacatccactattcctggcccatcaacagaaccgtcagttgtcgaatcgaaagaccgaaaagccaacgctcacttcatcctgaagttgctctgtgattcagtcgttctccagccgtatctccgtgagcttctgagtgccaaggatgctagaggtatgacgcccttcatgtcagctgtgtcggggcgagcttacccggccgccataaccattctggaaacagcccaaaaaatcgccaaggccgagatcagcagcagtgaaaaagaggaggacgtattcatgggaatggtatgcccatcagggaccaaccccgacgactcccctctgtatgtgttgtgttgtaatgacacatgtagcttcacttggacaggagccgaacacatcaaccaggacatcttcgagtgcaggacttgcggcttgctcgagtcgctatgttgctgtaccgaatgtgcccgcgtgtgtcacaagggacacgactgcaagctgaagcggaccagcccaaccgcctactgtgactgttgggaaaaatgcaagtgtaaaacgctgattgcagggcagaagtcagctcgactcgatctcctctatcgcctgctaaccgctaccaacctggttaccctacccaattcacgaggagagcacctcctcttgtttctggttcagacggtggcacggcagactgtggagcattgccagtacaggccgccacgtatacgtgaggatagaaaccgcaagacagcctccccagaggattctgatatgcccgaccatgacctcgagcctcctagatttgcccagctggcgctcgagagagtgttgcaagattggaatgccctcaagtctatgatcatgtttggctcacaagagaacaaagatccactcagcgccagctcaagaattggccacttactccctgaggaacaggtctatttaaaccagcagagcggtaccattagactggattgcttcacacactgtctaatcgttaagtgtaccgccgacattctgctactggatacactgctcgggaccctggttaaggagctgcagaacaagtacactccagggcgacgcgaggaagctatcgccgttaccatgcggtttttaagatcagtggctcgcgtattcgtgatcctctccgtggagatggcctcaagtaaaaagaaaaataattttatacctcagccaattggcaaatgtaagcgcgtattccaggccctgctgccgtacgcagtcgaggaactgtgcaatgttgctgagtctctgatcgtccccgtgagaatgggaatcgcacggccaactgccccttttacgctggcttctacctccatcgacgcaatgcaaggatctgaagagttgtttagtgttgaacccttgccccccagaccatcatccgaccagtcctcaagttctagtcagtcacaatctagctacataatccgcaatcctcaacagaggagaatatcccaatctcagcccgtgcgaggaagagatgaagagcaggacgatatagttagcgcagacgtcgaggaagttgaagtggtggagggagtggccggggaggaagaccatcatgatgaacaggaggagcacggagaggagaacgccgaagcagagggacagcatgacgagcatgatgaagatgggagtgacatggaacttgatttactggctgccgctgaaactgaaagtgactccgaaagcaatcatagcaatcaggataacgcctctggcaggcgctctgtggtgaccgctgccacagcaggttccgaagcaggtgcgtcctcagtgcccgccttctttagtgaggacgactctcagagcaacgatagcagcgattccgactcttcctcctcccagtctgacgatattgagcaagagaccttcatgttggacgagcccctggaacgcacaacaaactcttctcacgcaaacggtgcagctcaggcacctagatccatgcagtgggccgtccgcaatacccaacaccaacgagcggcctctaccgcgccgtcatcaactagtacacccgcagcttccagcgccggcttgatttatattgatccttcgaaccttcgccggtcgggtacaatatccacgtccgcagctgcggcggcagcagcactggaggctagcaacgcaagttcctacttgacatctgcatcctcccttgcccgtgcgtacagtattgtgatcagacagatctctgacctgatgggcttaatcccaaaatacaatcatctggtttacagtcagatcccagctgccgttaagctgacctatcaagatgccgtaaacctgcagaactatgtggaggaaaaactgatccccacttggaattggatggtttccatcatggacagtaccgaagcacagctccgttacggcagcgccctcgcctcagctggagatcctggtcaccccaaccaccctttacacgcgagccagaactcagcgcggcgtgagaggatgaccgccagggaagaggcgtctctacgcacgctggagggacgcagaagggccacactactttccgcccgacagggcatgatgtctgcccggggagactttttgaattatgctctctcattgatgagaagtcataatgatgaacactccgatgtgctgcctgtacttgatgtctgttctttgaagcatgtcgcttatgtgttccaggcattgatctattggatcaaagcaatgaaccagcagacaactctggataccccgcagctcgagcgaaaacgaacgcgtgaactgttagaattaggcattgacaacgaagattctgagcatgagaacgacgacgatacaaatcagtcagctactctcaacgacaaagacgatgactcccttcctgccgagacggggcagaaccaccccttctttaggcggagtgattcgatgacctttctcggatgcattcctcctaatccttttgaggttcccctcgccgaggccattccactggccgatcagcctcacctgctgcaacccaatgctagaaaagaagacttgttcgggcgcccttcccagggattgtactcatcctctgccagtagcggcaagtgcttaatggaggtgacagtggatcgaaattgcttagaagtcctccctacaaaaatgagctacgctgcaaacctcaagaacgtgatgaacatgcaaaaccgacaaaaaaaggaaggggaggagcagcccgttctcccagaggagaccgagtccagtaagccaggcccctctgctcatgatctggcagctcaactgaagtcttcgctgctggccgagatcggcctgactgaatccgagggaccaccactcactagtttccgcccccagtgctcctttatgggcatggtgatcagccatgacatgctgctgggtaggtggcgtttaagtttagaactctttggacgtgttttcatggaagacgtgggggccgaacctggctctattttaactgagcttggcggcttcgaggtcaaggagtcaaaatttagaagggagatggaaaaactgagaaaccagcaatctcgagacctcagtctggaagtcgaccgcgacagggatctcctcatccagcagactatgcgacagctcaacaaccacttcgggcggcgctgtgctacaactcccatggcagtccacagagtcaaggttacattcaaagatgagcccggtgagggaagtggggtggcaagaagtttttatacagcgatcgcccaggccttccttagtaacgagaagctgcccaacctcgaatgcatccagaatgccaataaaggcacacataccagcctaatgcaacggctcagaaaccgtggcgagcgcgatagagagagagaaagagagcgcgagatgcggcggagctccggcttacgggcaggctctaggcgagacagagatagggacttccgacgtcagttgagtatagacaccagaccctttaggccagcttctgagggtaatcccagcgacgatccggaacctctgcccgctcatcgtcaggctctgggggagcgactgtatccccgtgtgcaagcaatgcaacccgctttcgcatccaagatcacaggtatgctgctggagctctcacccgctcaattattgctgctccttgccagtgaagacagcttgcgggcccgcgttgacgaggcaatggaactgattattgctcatggacgtgagaatggcgctgatagcattctggatctcggtctggtggatagcagcgagaaagtgcaggagaatcgaaagcggcatgggtcctcccgctctgtggtggacatggacctcgacgacacagacgacggggacgataatgcccccctgttctaccagccaggtaaaagaggtttctacactcctagacccggcaaaaataccgaggcaaggctcaactgttttcgtaatattgggaggattctgggcctttgcctcctgcagaatgagctgtgtcccatcactcttaataggcatgtgatcaaggtacttttgggacgtaaggtgaattggcacgatttcgccttctttgacccagtgatgtacgaaagtttgcgccagctcatactggcaagccaaagtagcgatgctgacgcagtgttttctgccatggacttggccttcgccatagatctgtgcaaagaagaggggggtggacaagtagaactaatcccaaatggagtgaatattcctgttactccacagaatgtctatgaatacgtgagaaagtacgccgaacacaggatgttggtggtagcagaacagcccctccacgctatgcgaaagggcttgctcgatgtcttacccaaaaactcattggaagacctgactgcggaggactttcgtcttctcgtgaatgggtgtggtgaagtgaacgtgcagatgctgatcagttttacttcttttaatgacgaatctggagagaatgccgaaaaactattgcaattcaagcgttggttctggtcaatcgtggagaagatgtccatgacagagagacaggatttagtgtatttttggacgtcttctcccagcctgcctgccagcgaggaggggtttcaaccaatgccctccattactattagacccccagacgaccagcacctgcctactgcaaatacctgtatctctcggctgtatgttcctttatatagctccaagcagatcctgaagcaaaaacttctgctggcaataaagaccaagaatttcggctttgtttag

SEQ ID NO: 50457 - DNA, 414 bp, Artificial Sequence
  Description of Artificial Sequence: Synthetic coding sequence
atggcccggggccggcacgtgggcagcagcgagaccaagctgctgcagcatctgctggaggcttgcggcaggtgtgaggaggtgcccgaggcctacgtggacatccacaccggattaagcggatctggagtggccttcgtgtgcgcattcagcgaggctctggcagagggcgcagtcaagatgggcatgccgtcttcactggctcatcgaatcgcggcgcagacgctgctgggaacagctaaaatgctgttgcacgagggccaacaccccgcgcagctacgctctgatgtgtgcactcctggggggactacaatctatggcttgcacgcgcttgagcagggagggctgcgcgctgccaccatgtcggccgttgaagcagctacctgtagagccaaggagctgagtcggaagtag

SEQ ID NO: 50458 - DNA, 762 bp, Artificial Sequence
  Description of Artificial Sequence: Synthetic coding sequence
atgacccagggcaccgaggacctgaagggccccggccagcggtgcgaaaacgagcccctgctggaccctgttggtcccgagccgttaggcccggagagtcagtctgggaaaggagacatggttgagatggctaccaggttcggcagtacacttcaactggacctggagaaaggcaaagaaagtctgctggagaaacgcttggtggcggaggaagaagaggatgaggaagaagtggaagaagatggtcccagctcatgttcggaggacgactattccgagctgctgcaagagattactgataacttgacaaagaaagaaatccagattgagaagatccacctcgacacttcatccttcgttgaagaactgccgggagaaaaggatctagcccatgttgtagagatttatgattttgagcctgccctgaagaccgaagatcttctggccactttctctgagttccaagaaaaaggattccgcattcagtgggttgatgacacccatgcccttggcatttttccttgtctggcaagtgcggccgaggccctgactagggagtttagtgtgcttaagatacgtccactaacacaggggacgaaacagagcaaactcaaagctctccagagaccgaaactgctcaggctggtcaaggagcggccccaaacaaacgccacagtggctagaagacttgtggcacgcgctttggggctccagcataaaaagaaagaaagaccagctgtccgcggtcccctgcccccatag

SEQ ID NO: 50459 - DNA, 1443 bp, Artificial Sequence
  Description of Artificial Sequence: Synthetic coding sequence
atgaacatgaaggccagccgggtgaccctgggcgaggccggcgcccgggcccggtggcctcttggaactccaagggccgctgcaacaaggcgggaggcagcagcgcttccacctgtgacactggcactgctttgtttggacggtgttttcttgtcctccgctgagaatgattttgttcatcgcatacaggaagaactggacaggttcttgctccagaagcagctgtccaaggtgctcttgttcccaccgttgtcttcccgcctgcgctaccttattcaccgaactgccgagaacttcgatttactctcctcattcagcgtgggcgagggatggaaacgcaggactgtaatctgtcaccaggacatacgagtgccctcaagcgatggactgtcaggcccatgcagagccccagcttcctgtccatctcggtaccacggcccacgacctatttccaatcagggagccgctgctgtgcctcggggcgctagagcaggcaggtggtatcgggggcgtaaacccgaccaacccctttatgttccccgggtgttgcgtaggcaggaagaatgggggctgacctcgacctccgtacttaagagagaagcccctgctggccgggaccctgaggaacccggtgacgtgggagctggcgatcccaacagcgatcaaggtttacctgtcctgatgacacagggcactgaggatttaaaaggaccaggacagcgatgcgagaacgagccactgctggatccagtgggcccagagcccctaggaccagaatcccagtccggaaaaggtgatatggtggaaatggccacacgtttcggatccacacttcagctggaccttgagaagggtaaagagagccttctagaaaaacgcctcgtggccgaagaagaagaggatgaggaagaggtggaggaagatgggccttcttcttgctcagaggatgactactctgaactgctgcaagaaattacagataatttaaccaagaaggagattcagattgaaaagatccacctggacacttcaagttttgtggaggaactgcctggagaaaaagatctcgcccatgttgtcgaaatttatgactttgaacccgcgctcaagaccgaggaccttctcgctacattttccgagttccaggaaaagggttttcgtatacagtgggtcgatgacacacacgccctcggcattttcccatgcctggcttcagctgcggaagcgctcacacgagagttttctgtcctgaaaatccggcctctgacgcagggaaccaagcagagcaaactcaaagccctgcaacggcccaaactcctgcgactcgtgaaagagaggccgcagactaacgcgacggtcgcaaggagactggtggcacgcgctctcggtctgcagcacaaaaaaaaggaaagacccgcagttagaggcccgttacctccatag

SEQ ID NO: 50460 - DNA, 762 bp, Artificial Sequence
  Description of Artificial Sequence: Synthetic coding sequence
atgacccagggcaccgaggacctgaagggccccggccagcggtgcgagaacgagccgctcctcgatccagtcggtcccgagcccctgggacctgaaagtcagtccgggaagggagacatggttgaaatggccacccggttcggaagtacattgcaactggatttggagaaaggtaaagagtcactactcgagaagagacttgtcgctgaagaggaagaggacgaggaagaggtggaggaggatggcccatctagttgttccgaagatgattactcagagcttctgcaggagattacggataatctgactaaaaaagaaattcaaattgagaagatccacctggacaccagcagctttgtcgaggagctccccggcgaaaaggacctggcacatgtcgttgaaatatatgacttcgagcccgcgctgaaaaccgaggacctgctcgctacattctccgagtttcaggaaaaaggctttagaatacaatgggttgacgatactcacgcactcggcatatttccttgcctcgcatccgcggctgaggcattaacgagagaattctcagtcctgaagatcagacctctgacgcagggcaccaagcagtcaaaactgaaggccctgcagcgccccaagctcctaagactagtaaaagagaggcctcagacaaatgcgacagtagccaggcgcctcgtggctagggccctgggcctgcagcataagaagaaagagaggcccgccgtccgcgggcccctgcccccctag

SEQ ID NO: 50461 - DNA, 111 bp, Artificial Sequence
  Description of Artificial Sequence: Synthetic coding sequence
atgacccagggcaccgaggacctgaagggccccggccagcggtgcgagaatgaacccctactggatccagtgggcccggaaccgttggggcccgaatcacagagcggatag

SEQ ID NO: 50462 - DNA, 402 bp, Artificial Sequence
  Description of Artificial Sequence: Synthetic coding sequence
atgacccagggcaccgaggacctgaagggccccggccagcggtgcgaaaacgagcctctgctcgatcctgttggccccgaaccacttgggcctgaatcccagtctgggaaaggagacatggtggagatggcaacaaggttcgggagtaccctgcaacttgacctagagaaaggaaaagagtctctgttggagaagcggctggtggccgaggaagaagaagacgaagaggaggtcgaagaggatggaccatcttcctgctctgaagacgactattctgagttgctccaagagatcaccgataacctgacaaagaaggaaatccagatcgagaagattcacctagacacatcctcctttgtcgaagaattacctggggaaaaggaccttgctcatgtcgtgtag

SEQ ID NO: 50463 - DNA, 291 bp, Artificial Sequence
  Description of Artificial Sequence: Synthetic coding sequence
atgacccagggcaccgaggacctgaagggccccggccagcggtgcgagaatgaacccctgctagatcccgttggacccgaaccactaggccctgaatctcagtcaggaaaaggcgacatggtcgagatggccacgcgctttggctcaaccttgcaattagacctcgaaaaaggaaaagaaagtttgctcgaaaagcggctggtcgcagaagaggaggaggacgaagaggaagtggaggaagacggcccaagtagttgctctgaggatgattattccgaactgctgcagtag

SEQ ID NO: 50464 - DNA, 3300 bp, Artificial Sequence
  Description of Artificial Sequence: Synthetic coding sequence
atgcggatgagcgacaccgtgaccgtgaaggacgagaccgccaccatgaaggatctggaggctgaggtaaaggacaccactcgcgttgagaacctgataaagagtgagaactacgggaagatccttgttgaaaagaatgaacattgtattgaaaacaacatcgaccttcagcggcctctgcagtcctttggccagactggaaagaggtcaaagtcatcctcaaaactgaagcttgtgcgatccttggctgtttgtgaggagtcccctccccctcctgcccctgagatctctcaggaaaatcaggagaagatacagattcagttgactcagagcttcgagaaagaggaaaagccttcaaaggacgaggcagagaaggagaaggcctccgataaactgcccaggaagatgctatcacgggattcttcacaggaatacacggactccacaggaatagacctgcacgaattcctggtgaacacgctaaagaataatccccgggaccgaatgatgctgctcaagctcgagcaggagatcctggattttattggtaataacgaatctccacggaagaagttccctcccatgacaagctaccataggatgctgctccacagagtggccgcttatttcggcttggatcacaatgtggatcaatctggaaaaagcgttatcgtgaataaaacaagcaacacacgaatccctgaccaaaagttcaatgaacatattaaagatgacaagggggaagatttccaaaagcgctatatacttaagcgcgataactctagcttcgacaaagatgataatcagatgcggatccgcctgaaggacgaccgacgaagcaaaagtatagaagagagggaggaagagtaccagagggcccgcgaccggatcttcagtcaggactctctttgttcccaggagaattatatcatcgacaagcgcctgcaagatgaagatgcctcaagtacccagcagagacgacagatcttccgagtcaataaagacgcgtcggggaggtcaaccaattctcatcagtcaagtaccgaaaatgagctcaaatattccgaacccaggccctggtcttcaacggacagcgactcatctttgagaaatttgaagccggccgtgacaaaggcctctagcttttcggggatctcagtgttaacaaggggggactcctcggggtccagtaagagcatcggccgcctttcgaagacagggtcagaatctagtggatctgttggcagctctacgggtagcctgtcccacattcagcagccccttccaggaacagcactgagccagagctcccatggtgctccagtcgtttacccaacagtgtctacacatagctccttgtcgttcgacgggggactgaatggacaggtggcttcgccctcaacttcattcttcctcctgcccctggaagcagccgggattccaccaggaagtattcttataaatccgcaaaccgggcagccctttatcaatcccgatggaagtcctgtggtttacaatccgcctatgacccagcagccagtgcggtcacaggtgcccgggccaccacaacctccacttccagcaccgcctcagcagcccgcggccaaccatattttctcgcaagataatctgggttcccagttcagtcacatgtccctggccaggcagccgtctgccgatggaagcgatcctcatgccgcaatgtttcaatcaacggttgtacttcaatcgccgcagcagagcggctacatcatgactgcagctccccctcctcacccccctccacctccacccccacctcctcctccccctcccctcccacccggccagcccgttccgaccgctggctaccctgcgagcggccacccggtttctcagccagtcctccagcaacaagggtacatccagcaaccttcgcctcagatgccagcgtgctattgtgccccagggcactatcactcatctcagcctcagtataggcctgtccctagtgtgcactacaattcacaccttaaccagcccttgccccagccagcccagcagaccggatatcaggtcatacccaaccagcagcagaattatcagggcatcgttggggtccagcagccacagtcacaaagccttgtgtccgggcagcccaactccataggtaaccaaattcagggagtggttataccctatacttccgttcccacctatcaggtgtcccttccacaagggagtcagggcatcccccatcagacgtaccagcaacccgtgatgtttcccaatcagagtaatcagggaagcatgcccacaacggggatgccggtttattactccgtcatccctcccggccaacagaacaacctatcttcaagcgtgggatacctccagcatcccggtagcgaacaggtgcaatttccaaggacaaccagcccctgctccagccaacaactgcaaggccatcagtgtaccgctggaccaccacctccccctggtggcggaatggttatgatgcagctgagtgttccgaacaatccacaatcctgtgctcattcacctccacaatggaaacaaaataagtactactgcgatcaccagaggggccagaaatgtgtcgaattctctagtgtggataatattgtccagcacagcccacaactcagtagccccattatttctcccgcccagtctccagctcctgctcagctgtccactctgaaaaccgtgcggcccagcggcccaccgctgagcatcatgcctcagttttcccggcctttcgtaccaggtcagggtgattcccgctacccccttctgggccagccactgcagtacaacccacccgccgttctacatggccacatcccaaaccaacagggccagcctgggagcagacatgggaatcgcgggcgccgccaagccaagaaggctgccagtacagacctcggagccggagagacagtcgtagggaaggtgctggagatcacggagctgccagacgggatcacacggatggaggctgagaaactgttcggtgagctgtttaaaataggagccaaaatccgttggctaagagacccacaatcccagcctcggcggcaccccctctgctgcgggtctggcgataatactgcgaaccccgagcgaagcaagccaagcgacctggcatccacatataccgttctagccacatttccaagtatttctgcagcacagaatgccctgaagaaacagataaattcagtcaataaattcaaattacggacctccaagaaacattatgatttccacatcctcgagcgtgcatcctcccagtag

SEQ ID NO: 50465 - DNA, 2913 bp, Artificial Sequence
  Description of Artificial Sequence: Synthetic coding sequence
atgcggatgagcgacaccgtgaccgtgaaggacgagaccgccaccatgaaagaccttgaagccgaggtgaaagacacgacacgggtggagaaccttatcaagagtgaaaactacggaaagattctggtggagaagaacgaacattgcattgaaaataacattgacctgcaagagaaaatccagatccagctgacccagagcttcgagaaagaagagaaaccctcaaaagatgaagccgaaaaggaaaaggcttccgacaagcttccgaggaagatgctcagccgcgatagcagccaggaatatacggatagcacagggattgaccttcacgagtttctggtgaatacactgaaaaacaacccaagggatcgcatgatgttattaaaactggagcaggagattctggatttcatcgggaacaatgaatccccccggaaaaaatttcccccgatgacgtcctaccacaggatgttgctccatagggtggcagcatactttgggctcgaccataacgtagaccagagcgggaagtccgttattgtgaataagactagcaacactagaattccggaccagaaattcaacgaacatattaaagacgacaaaggtgaggactttcagaagcgctacatcttgaagcgggataattcatcatttgacaaagatgacaaccagatgaggatcaggctaaaggatgatcggcgctcgaagagtatcgaggaacgggaggaagaataccagagggctcgcgataggatctttagccaggactccctctgtagccaggaaaactacataattgacaagcgcttacaggacgaggacgcaagctcaacacagcagcgtcgccagatatttcgggtgaataaggatgcgagcggccggtctaccaactcccaccagagctcgacggagaatgaactgaaatacagcgaacctaggccttggagctcaactgacagcgattccagtcttcgaaacctcaaacccgcagtgactaaagccagttctttttctggtatttcagtcctgacgcgtggagattctagtggatcctcgaagagtatcggccgcttgagcaaaaccgggcagccctttattaacccagatggcagtcctgtggtgtacaatccccccatgacccagcagccagtgaggtcgcaggtgcccggtcccccacaacctcctctccccgcaccaccccagcagcccgcggcgaaccatatattctcacaggataatctgggaagccagttctctcacatgtcgttggcgcgccaaccatccgcagatggaagtgatcctcatgccgctatgtttcaatcaaccgttgtgctacagagtcctcagcagtccggatatattatgaccgccgccccacctccacacccccctcctccccctccacccccccctccgcctcccccactgccccctgggcagcccgtcccaaccgccgggtatccagcgtcgggccatccagtatctcagccagtcttacagcagcaagggtatatccagcagcctagcccccaaatgccggcttgttattgcgcaccaggccattaccactcttcgcaaccacaataccgtcccgttcctagcgtccattacaatagccatctaaatcagcccctgcctcagcctgcacagcagaccggatatcaggtcattcctaatcagcagcaaaactaccagggaatcgtcggagtgcagcagccacagtcccaatcattggtcagcggtcagccaaactccatcggaaaccagatccagggggtcgtgatcccttatacttcagtcccgacttatcaggtttctcttccccagggaagtcagggaattccccaccagacataccaacagcctgttatgttccccaatcagagcaaccagggtagtatgcccactactggaatgcctgtgtattatagtgtgatccctcccggccagcagaataatctgagtagtagcgttggatatcttcagcacccggggtccgaacaggttcagtttccacgtacgacctctccatgctcctcacagcagctgcagggccaccagtgcactgccggccctccgccgccacctggcggcggcatggttatgatgcagctttctgtccccaacaaccctcaatcttgcgctcacagcccaccacaatggaaacagaacaaatattattgcgatcaccaacggggacagaagtgcgtggagtttagctcagttgataacatagtacagcattcgcctcagctttctagtccaatcatcagtcctgcccagagcccggcccctgctcagctatcaacactgaagaccgtgagacctagtggtcctcccttgagtatcatgcctcagtttagccgacccttcgtgcctgggcagggagattctcgatacccgttgctgggccagccccttcaatacaacccacccgcggtgctccacggacatatacccaaccaacagggacagccaggctcacggcatggcaacagaggccgtagacaggcgaagaaggcagcatcaaccgacctcggcgccggcgaaaccgtggtcggaaaggtcttggaaatcaccgagcttccagacgggataaccaggatggaagccgaaaaactgttcggggagctctttaagatcggggctaaaattaggtggctcagggatccacagagccagcctcgacggcacccattatgctgtggcagcggggacaacaccgcgaatcctgagcggtccaaaccatcagacctggccagtacgtacacggtgttggcaactttcccctccatttccgctgctcagaatgccctcaagaaacagattaactccgtcaacaagttcaagctacggacatcaaagaaacattacgactttcatatcctggagcgggcatcaagccagtag

SEQ ID NO: 50466 - DNA, 807 bp, Artificial Sequence
  Description of Artificial Sequence: Synthetic coding sequence
atggtggccctggagaaccccgagtgcggccccgaggccgccgaggggacacccggtgggcgcaggttgctgcctttaccttcttgtctgccagccctcgcctcaagccaggttaagcggctcagtgcaagtcgacgcaagcagcatttcattaaccaggcagtgaggaattctgaccttgttcctaaggctaaagggcgtaagagcttacagcgactggaaaacactcagtacttgctgacgctgctcgaaactgacggcggtctccctggactcgaggatggcgatctggctcctccggcatctcctggcatctttgctgaggcctgcaacaacgccacctatgtggaagtgtggaatgactttatgaacaggtctggggaggaacaggaacgagttctccgctatctggaggacgagggaaggtccaaagcacgacgtagagggccaggccgtggcgaggatcgccgcagagaggacccagcctacactccacgggagtgcttccagcgcatctcccgaagattacgtgctgtcctcaagaggtccagaatccctatggaaaccttagagacctgggaggagcgtctgctgaggttcttctcggtgtccccacaggccgtctataccgctatgctggataatagttttgagcgattgctcctccatgcggtgtgtcagtatatggatttaatcagtgccagcgcggatctagaagggaagagacaaatgaaagtgtctaatcgacacctggatttcctcccccccggcctactgctcagcgcgtatctagagcagcactcttag

SEQ ID NO: 50467 - DNA, 690 bp, Artificial Sequence
  Description of Artificial Sequence: Synthetic coding sequence
atggccgaggacaagaccaagcccagcgagctggaccagggcaagtacgacgccgacgataacgttaaaattatctgcctgggggactcggccgttggtaagtcaaagcttatggagcgcttccttatggatgggttccaacctcagcagctttccacatacgcgctgacactttacaaacatacggccacagtagacggacgaacgattttggtcgatttttgggacactgccgggcaggagcggtttcagtccatgcacgcctcctattaccacaaagctcacgcatgtatcatggtttttgacgtccagaggaaggttacctatcggaacctatctacctggtacactgagctgagggagttccgacccgagatcccttgtatcgtcgtcgcaaataaaatagatgcggatataaacgtgacacaaaagagcttcaatttcgcaaaaaaattttccctccctctgtatttcgtatccgccgcagatggcacaaatgtggtgaagctcttcaacgacgcgattcgcctggcggtctcttataagcagaactcgcaagacttcatggacgagatctttcaggagttggagaacttctctctcgagcaggaggaggaagatgtccctgatcaggaacagtcgtcctccattgagaccccaagtgaagaagcagcctccccccattcttag

SEQ ID NO: 50468 - DNA, 687 bp, Artificial Sequence
  Description of Artificial Sequence: Synthetic coding sequence
atggccgaggacaagaccaagcccagcgagctggaccagggcaagtacgacgctgatgataacgtcaagatcatttgcctcggagattccgcagtgggcaaaagcaaacttatggaaaggttcctgatggacggctttcagccccagcagctgtctacttatgctctgactttgtataagcatactgccaccgtagacggacgaaccattctagtggatttttgggacactgccggccaagagcggtttcagagtatgcacgcctcctactatcacaaagctcatgcatgtatcatggtcttcgacgtgcagcggaaagttacctatcggaacctgtctacttggtatacagagctccgcgaatttagacccgagatcccctgtattgtggtggctaataagatcgatgacatcaatgtgacacagaagtcattcaattttgcaaaaaagttctctctacccttatacttcgtgtctgccgccgacggcacaaacgtggtgaaactctttaatgacgctatccgccttgctgtctcctacaagcagaacagccaggactttatggacgagatattccaggagctggagaacttctctcttgagcaggaggaggaggacgtcccagatcaggaacagtcttcttcaatcgagaccccctccgaggaagccgcttctcctcatagttag

SEQ ID NO: 50469 - DNA, 690 bp, Artificial Sequence
  Description of Artificial Sequence: Synthetic coding sequence
atggccgaggacaagaccaagcccagcgagctggaccagggcaagtacgacgctgatgataacgtgaagatcatatgtttgggagactctgcagtcggcaaaagtaagttgatggaaaggttcctgatggatggctttcagccgcagcagttatccacatacgctctgactctctacaaacataccgcgaccgtcgatggccgaaccatcctagtggacttctgggacaccgccggccaggagaggttccagagtatgcatgcctcgtattaccacaaagctcacgcttgcattatggtgttcgatgtacagaggaaggtaacatatcggaacctttccacctggtatacagagcttagagagttccgacccgaaatcccctgtattgtcgtggcgaataagattgatgccgacatcaatgtcactcagaagagttttaacttcgcaaaaaagttttctctacctctgtattttgtctcggcagctgatggaacaaatgttgttaagcttttcaacgacgctattaggctggcagtctcttacaagcagaacagccaggactttatggatgagatttttcaggagctagagaatttcagcctggagcaagaggaggaggacgtacctgaccaggaacagagcagctccattgaaaccccaagtgaggaagctgctagtccacattcctag

SEQ ID NO: 50470 - DNA, 558 bp, Artificial Sequence
  Description of Artificial Sequence: Synthetic coding sequence
atgctgaaggccaagatcctgttcgtgggcccctgcgagagcggcaaaaccgttctcgcgaacttcctaactgagagcagtgacataactgagtactctcctacacagggcgtccgaatccttgagtttgaaaaccctcatgtgacaagcaataataaggggacgggctgtgagttcgaactctgggattgtgggggtgatgccaagtttgaatcctgctggcctgccttaatgaaggatgcccacggtgtcgtgatcgttttcaatgccgatattccaagtcacaggaaagagatggagatgtggtattcttgttttgttcagcagccctccctccaagatactcaatgtatgctcatcgcccaccacaagccaggatctggagacgataaagggagcctgtcactctcgcctccactgaacaaactgaagttggtgcattctaaccttgaagatgatcccgaagagatacgaatggaatttattaaatatctgaagagtattatcaactccatgtccgaatcacgggaccgcgaggaaatgtcaattatgacctag

SEQ ID NO: 50471 - DNA, 558 bp, Artificial Sequence
  Description of Artificial Sequence: Synthetic coding sequence
atgctgaaggccaagatcctgttcgtgggcccctgcgagagcggcaaaaccgtgttggcgaattttctgactgaatcaagtgacattaccgagtactctcctacccaaggtgttcgcatcctggagttcgagaacccacacgtcacctctaacaataaaggcacgggatgtgagtttgaactttgggattgcggcggcgacgcaaagtttgaaagttgttggcctgcactgatgaaggacgcccacggcgtagtcattgtctttaacgccgacatccccagccacagaaaagagatggaaatgtggtactcatgttttgttcagcaaccttctctgcaggacacccagtgcatgctcatcgctcatcacaagccaggaagcggcgatgacaaaggcagcttatccctgtctccgcctctgaacaaactgaagttagttcattcaaatctcgaagacgatcccgaagagatccgcatggaattcatcaaatatttaaagtcaataattaacagcatgtcagagagcagggaccgggaagaaatgtcaatcatgacatag

SEQ ID NO: 50472 - DNA, 468 bp, Artificial Sequence
  Description of Artificial Sequence: Synthetic coding sequence
atgctgaaggccaagatcctgttcgtgggcccctgcgagagcggcaaaactgtgctggctaactttctaacagagtcctccgacattaccgaatacagccctactcagggtgtgaggttcgagtcttgttggcctgcactcatgaaggacgcccatggcgtcgtgatcgtgttcaatgccgatattccctcccacaggaaggaaatggaaatgtggtacagctgctttgtccagcagccctcgctgcaggacacgcagtgtatgctcatcgcccatcacaagcccgggtccggcgacgataagggaagcttgtcgctgagtccacctcttaacaagcttaagctcgttcattcaaacctggaggatgaccccgaggaaataagaatggaattcatcaagtatttaaagtctatcatcaattccatgagcgaaagcagagacagggaagagatgtctataatgacttag

SEQ ID NO: 50473 - DNA, 327 bp, Artificial Sequence
  Description of Artificial Sequence: Synthetic coding sequence
atgaaggacgcccacggcgtggtgatcgtgttcaacgccgacatcccttcacacagaaaagaaatggaaatgtggtactcctgcttcgtacagcagccgtcactccaggacacgcaatgtatgctgatcgcccatcacaaacccgggtccggggatgataagggttccctctccctctctccccccctgaacaagctgaagctggtacactcaaatctggaagatgaccccgaggaaatcagaatggagttcataaagtacctgaagtctatcattaattcaatgtctgagtcccgcgaccgagaggagatgtctatcatgacttag

SEQ ID NO: 50474 - DNA, 327 bp, Artificial Sequence
  Description of Artificial Sequence: Synthetic coding sequence
atgaaggacgcccacggcgtggtgatcgtgttcaacgccgacatcccctcacatagaaaagagatggaaatgtggtacagttgttttgtgcagcagcccagtttgcaggacacccagtgtatgctgatcgcccatcacaaaccaggaagtggcgacgacaagggatcactcagcctgagtccacccctaaacaaactgaagctggtgcacagtaatctggaagatgatcctgaggagatcaggatggagtttattaagtacttaaagagtatcatcaacagcatgagtgagtctagggaccgcgaggagatgagcatcatgacttag

SEQ ID NO: 50475 - DNA, 1071 bp, Artificial Sequence
  Description of Artificial Sequence: Synthetic coding sequence
atggacagcagcgaggagcacgccggctgccccgcccggggcacctgtcccgtcttcctggcaatgtctgcgggcacagtcaggtacgcccccagtggcctgtgccccgtgctggaaggtaatttacgcgaggagccctgggggaccgactcccctccgcagcccgaccaggggctaccccccccccttgcagcggttcccgtaccatggaaatctacagatccatgccaggggcatcgtgagtcacctggcgccctagtcgagaccagtgctggagaagaggcccaaggtcaagaaggtcctgcggctgcacagctcgacgtgctgcggcttagaagctcgtccatggaaattcgggagaagggatcagagtttttaaaagaagagctacaccgagcacaaaaagaactgaagctgaaggacgaagaatgtgagagattatccaaggtgagagaacagttagaacaggagctggaggagttgacagctagtctatttgaagaagcccacaagatggtacgagaagctaatatgaagcaggctgccagtgaaaagcagctcaaggaggctcggggaaaagtcgacacaattctctttgctgagttccaggcgtggagggaatcaccgacattagataaaacctgtccctttctcgagagagtttaccgggaggatgtcggcccatgcctcgatttcacaatgcaggagctgtcggtgctggtacgagctgccgtcgaggataacacattgactatcgagccggtggctagccaaacactgccaaccgttaaggtcgctgaggtggattgctcaagtactaacacatgcgctctcagtggtctaacaaggacctgtaggcatagaatcagactgggggactcaaaaagccactattatatctcgccatcatctagggcacgcattactgcggtttgtaatttcttcacatacatacgctacattcagcaggggctcgtcagacaggacgccgaaccaatgttttgggaaataatgcggctgagaaaagaaatgtcactggcaaagctggggttcttccctcaggaagcctag

SEQ ID NO: 50476 - DNA, 1149 bp, Artificial Sequence
  Description of Artificial Sequence: Synthetic coding sequence
atgtggagcggccccccccagcccgaccagggcctgcccccccccctagctgcggtgcccgtcccatggaaaagtactgacccatgccaaggccatagggagtctcctggtgccctggtggagactagcgccggagaagaagcacaagggcaggaggggcctgccgccgcccaactggatgtcttacgactgcggagctcatctatggagattcgagagaaaggttctgagttccttaaggaagaactacacagagcgcagaaggagcttaagctgaaggatgaggaatgtgaacgcttgagtaaagtgcgcgagcagctagagcaagagctcgaggagttgaccgcatccctgttcgaggaagcccacaaaatggtcagagaagctaacatgaaacaggccgcatctgagaaacagctgaaagaggctcgggggaagatagatatgttacaggctgaagttaccgccttgaagactttggttataacatccacacctgctagtcccaaccgggagttgcaccctcagcttctatcacctacaaaggccggaccaaggaagggtcatagccggcacaaaagcactagcagcacattatgtccggccgtctgtccagcagctggacacacgctgacccccgaccgggaagggaaggaggtggatactatcctctttgctgagttccaggcttggcgggaatcgcctactctggataaaacctgcccattcctcgaacgggtctacagagaggacgtgggtccttgtctggactttaccatgcaggaactcagtgtgcttgtgcgcgctgcagtcgaggataacactctcacaatagagccagtggcttctcagaccctccccacggttaaggtggcagaagtagattgcagctcaaccaatacttgcgctttgtcgggcctgacccgcacatgtcggcaccgaatccgcctgggagatagtaagtcccattactacatcagcccttcctctcgggcacgaattactgccgtgtgtaacttcttcacctatatccgttacatccaacagggactggttcgacaggatgcagagccaatgttttgggagatcatgcgcttgaggaaagagatgtccctggccaaattgggatttttccctcaggaggcctag

SEQ ID NO: 50477 - DNA, 318 bp, Artificial Sequence
  Description of Artificial Sequence: Synthetic coding sequence
atggccacccagggccccgacaaggtgatcttcctgctggtgggccacaaatctgatctacagagtacacggtgcgtatctgcccaagaggcagaggaattggctgccagcctagggatggccttcgtggagacctcagtcaaaaacaattgtaatgttgacctggcctttgacactcttgcggacgcgattcaacaggccttgcagcagggagacattaaactagaagaggggtgggggggcgtaaggctaatacataagacccagatacccagaagtccctcaagaaaacagcactctggtccgtgtcagtgctag

SEQ ID NO: 50478 - DNA, 1398 bp, Artificial Sequence
  Description of Artificial Sequence: Synthetic coding sequence
atggccatgaccggcagcaccccctgcagcagcatgagcaaccacacgaaggagagggtcacgatgacaaaagttaccctggagaacttctacagtaatctcattgcccagcatgaggagagggaaatgcgtcagaagaagctcgagaaagttatggaagaggagggcttaaaagatgaggagaagcggttaaggcgatctgcacatgctaggaaggagaccgagttcctacgtctaaagaggactcgactgggactggaggacttcgagtctctcaaagtcattggccgcggggcattcggcgaggttagattggtgcaaaagaaggatactggacatgtgtacgcaatgaagattcttcgcaaagctgacatgctggaaaaggaacaggttggccacataagggcagagagggatattctcgtagaggcagatagcttatgggttgttaaaatgttctatagctttcaggataagctgaacttgtatctgatcatggagtttctgcctggtggcgatatgatgactttgctgatgaagaaggataccctgaccgaggaggagactcaattttacatagccgagacagttttggccattgattctatccatcagcttgggtttatccacagagacatcaagccagataatctgctgttagacagtaaaggccatgttaagctgtccgactttgggctctgtaccggacttaagaaagcacatcggaccgagttttataggaatttaaatcactccttgccttcagactttactttccaaaacatgaactcaaagagaaaagccgagacgtggaaaaggaatagacggcaactcgcgttttccaccgttggcacccccgactacatcgcccccgaggtatttatgcagactggctataataagctctgtgactggtggtcactgggggtgattatgtatgaaatgcttataggctatccgcccttttgttccgaaacacctcaggaaacttacaagaaagttatgaactggaaggagacactgaccttcccccccgaggtgcctattagtgagaaagctaaagacctcatccttagattctgctgtgagtgggaacacagaataggtgcaccaggagtggaggaaataaaaagcaacagctttttcgagggtgtcgactgggagcatatcagggaacgacctgctgcaatatccatcgaaatcaagagcatcgatgatacttctaacttcgacgaatttccggaatccgacatcctcaagcccacagtcgccacatctaatcaccccgagacagattacaagaataaagattgggtgttcataaattacacttataaaaggttcgaggggctgactgctaggggggccatcccctcttatatgaaggctgctaaatag

SEQ ID NO: 50479 - DNA, 651 bp, Artificial Sequence
  Description of Artificial Sequence: Synthetic coding sequence
atggccggccggggcggcgccgcccggcccaacggccccgccgccggcaataaaatttgtcagttcaaactggtgctgttgggcgagtctgctgtcggcaagagctctttggtcttgaggtttgtgaagggtcagtttcacgagtaccaggaatccacgattggagcagccttcctcacccagaccgtatgtctcgacgacacaactgtgaaattcgaaatctgggacacagccggccaggagcgataccattcgctggcccccatgtattatagaggggctcaggccgccattgtggtttacgatatcactaacactgacaccttcgcacgagcgaagaattgggtgaaagagctgcagaggcaggcatcaccaaatatcgtgatcgcacttgcaggaaataaagcagatctagcttccaaaagggcagttgagttccaagaagctcaggcttacgcagacgataacagcttgctatttatggaaaccagtgctaaaaccgctatgaacgttaatgagatcttcatggcaatcgctaaaaagttaccaaagaacgagccacagaatgccacaggagctcccgggagaaacaggggtgtggacctgcaagaaaataatcctgcttctaggtcacagtgctgtagcaactag

SEQ ID NO: 50480 - DNA, 861 bp, Artificial Sequence
  Description of Artificial Sequence: Synthetic coding sequence
atggccgacaccatcttcggcagcggcaacgaccagtgggtgtgccccaatgacagacagctcgccttgcgtgccaaactgcaaacgggctggagtgtgcatacctatcagacagaaaaacaacggcggaagcagcatctttcacctgccgaagttgaggccattctccaggtcatacaacgcgccgagcggctggatgttctcgaacagcaacggataggtcggctcgtggaaaggcttgagacaatgcgacgaaatgtgatgggcaacggtctttcccaatgcctgttgtgcggtgaggtcttgggttttctggggagctcatccgttttctgcaaagattgtcgcaaggtgtggaagcgttcaggagcttggttctacaaggggctgccaaaatacatcctgcccttgaagacaccagggagagccgacgacccacatttccgtccccttccaacagaacctgcggaaagggagccccggtcttcagagacgtcccggatttacacctgggccaggggcagggtggtttccagcgactcggacagcgactctgatctcagcagctcgtccctggaagacagactcccgtctactggggtgcgcgatagaaaaggcgacaaaccctggaaagaaagcggaggttcagtcgaggcaccgagaatgggcttcactcatccccctggccatctttccggatgtcagagctccctggcatcaggtgagacggggactggcagcgctgaccctccaggcggtcccagacctggccttaccagacgggctcctgtcaaggacactccagggcgggcccccgcagcagatgccgctcccgcaggtcctagctcatgtttagggtag

SEQ ID NO: 50481 - DNA, 2013 bp, Artificial Sequence
  Description of Artificial Sequence: Synthetic coding sequence
atgaaccaggtgaccgactgggtggaccccagcttcgacgacttcctggagtgttccggtgtgagcaccatcactgccacctccttaggtgtgaacaattcgtctcaccggcgtaagaacggcccttccacactggagagtagccgatttccagcccggaaaagaggcaatctaagttcgttggagcagatatatgggctggaaaacagcaaggaatatctgagcgagaatgaaccatgggtggataagtataagcccgagacccagcacgagctcgccgtgcacaagaagaagatcgaagaagtggagacttggctgaaggcccaggtgctggagagacaaccaaagcaaggagggtccattcttctcataaccggtccccccgggtgtggcaagaccacgacccttaaaatcttatccaaagagcacggtatccaagtgcaggaatggatcaaccccgtgctgcctgacttccagaaggacgatttcaagggaatgtttaataccgaaagtagtttccatatgtttccttatcaatcccagatcgccgtgtttaaggagtttctcctgcgggctaccaagtacaataaactacaaatgctgggagacgacctacgaacggataagaaaattatcctggttgaggatcttcctaaccagttctaccgggatagtcatacccttcacgaggtgcttagaaagtacgtgaggatcggtagatgccccctgatcttcatcatttcggactccctgtcaggtgacaacaatcagaggctgctgttcccgaaggagattcaagaagagtgtagtatttcaaacatctccttcaaccccgtagctccgacaattatgatgaagttcctcaaccgcatagtcaccatcgaggcgaacaagaatggcggcaaaatcaccgtgccagacaaaacttccctggaactgctctgccagggctgttccggggatattcggagcgcaatcaatagcttacagtttagcagttccaagggggaaaataaccttcgcccacgaaagaagggtatgtcacttaagtccgacgctgtgctgagcaagtccaaaagacgcaagaagcctgatcgcgtgtttgagaatcaggaggtacaagctatcggcggaaaagatgtgtcgctatttctgtttagggcgttgggcaaaattctgtattgcaagagggcctccctcactgaactggattctcctaggttgcctagtcacctgagtgagtacgaacgcgatacacttctggtggagccggaagaagtggtggaaatgtcgcatatgcctggagacttatttaacctatacctccaccagaactacattgatttctttatggaaattgacgatatcgttcgcgcctctgagtttctgagcttcgcagacatcctctcgggtgactggaacactcgcagtttgttgagagagtactcgaccagtattgccacgcggggggttatgcactcaaacaaggcacgtggttatgcccactgtcagggaggaggctccagcttccgtccccttcacaaaccccaatggttccttataaataagaaatatagagagaactgtctagcggcgaaggccttgttcccagacttctgtcttccagccctctgtagacaaacccaactgttgccttatctggccctgctgacaatcccaatgaggaaccaagcacagatttcatttatccaagacatagggagactgcctctgaagagacattttggcagactgaagatggaggccttgacagatcgggaacacggtatgatcgaccctgattcaggggacgaagctcagctgaacggtggccacagtgccgaggagtccttgggcgaacccacacaagcgactgttccagagacatggagtcttcccctgtcacaaaactccgcaagtgaattacccgccagccagccacagcccttctccgcccagggggacatggaagagaacatcatcattgaggattacgagagcgatggcacttag

SEQ ID NO: 50482 - DNA, 2013 bp, Artificial Sequence
  Description of Artificial Sequence: Synthetic coding sequence
atgaaccaggtgaccgactgggtggaccccagcttcgacgacttccttgagtgttctggtgttagtaccatcaccgccacatccctcggtgtcaacaacagcagccacaggaggaagaacgggccaagtacactggagtccagtcggtttcctgcccggaaacgaggaaacctgagctcgctcgagcagatctatgggctcgaaaatagtaaagagtacctgagtgagaacgagccttgggtggacaagtacaagcctgagacacagcacgagctagctgtgcacaagaaaaagattgaggaggtagagacctggctgaaggcccaagtgctagagcgccagcctaaacagggcggttctattctacttattacaggtcccccaggatgtggtaagacgaccaccctgaaaatcttaagcaaagaacatggcatccaagtccaggaatggatcaatccagtgctccctgattttcagaaagacgacttcaaaggcatgtttaatacagagtcctcattccacatgtttccctaccagagccagatcgcagtgtttaaagagtttctactgcgggccacgaaatataacaaactgcagatgctcggggacgaccttcgaacagacaagaagattatcttagttgaagatctgccaaatcagttctacagggatagtcacactcttcatgaggtgctccggaaatacgtccggatcggcagatgtcccctgatctttattatatctgatagtctctccggggataataaccagcggctcctgtttccaaaagagatacaggaggagtgtagcattagcaatattagcttcaatcctgtggctccaaccataatgatgaagttcctcaatcgaatagtaacaattgaggccaataaaaacggaggcaagataacagtaccagacaagacaagcctggaactgctctgccaggggtgctcaggcgacatcaggtccgcgattaattcgctccagttttcttctagcaaaggtgagaataacctgcgccctagaaaaaagggcatgtctttgaaatcggatgccgtgctgtccaagtctaagagacggaaaaaaccagatagggtttttgaaaaccaggaggtacaagccattgggggcaaggatgtcagccttttcctgtttcgtgccctgggcaaaatattgtactgtaaacgagcctctctgacagaactagacagccccagactcccgagccatctctccgagtacgagagggatacactgctggttgaacctgaagaagttgttgaaatgtcccatatgcccggtgacttgttcaatttgtacttacaccagaattacatagatttctttatggaaattgacgatattgtacgggcatcagaatttctgtcctttgccgatattttaagcggggactggaataccagatccctgctgagggaatactctacatctattgcgactcgtggtgtcatgcactccaataaagcccgaggctatgcccactgccagggaggaggatccagcttccgacctctgcataagcctcagtggttcctgattaataaaaagtaccgcgagaactgcttggccgcaaaggccttgtttccagatttctgcctgcctgctctctgcagacagactcaactgttgccttacctggcactactaacgatccccatgcggaatcaggcccaaattagttttattcaggacattgggaggcttcccctgaagcgccattttgggcgcttgaaaatggaagcacttacagatcgggaacacggaatgatcgacccagactcgggcgacgaggcacagcttaatggaggtcactctgctgaggaaagcctgggtgagccaacccaggcaaccgtccctgaaacatggtcactgcccttgtctcagaattccgcgtccgaactccccgcatctcagccccagccattctccgcacagggagatatggaagagaacatcattattgaagactatgaatctgacggtacctag

SEQ ID NO: 50483 - DNA, 2013 bp, Artificial Sequence
  Description of Artificial Sequence: Synthetic coding sequence
atgaaccaggtgaccgactgggtggaccccagcttcgacgacttcctagagtgtagcggggtatcaaccattaccgctacatccttgggggtcaacaattcttcccacagacggaaaaacgggccctccacattagagagttctcggtttccagccagaaagagagggaatttgtcaagcctggagcagatctacggtctagaaaactctaaggaatacctttccgaaaatgagccctgggttgacaagtataaacccgagacccaacacgaacttgcagttcacaaaaaaaagatcgaggaagtcgagacatggctgaaggcacaggtgctggaaaggcaaccgaaacagggtgggtccatactgctaattacaggcccacccggctgcggtaagacaaccaccttgaaaatattgtctaaggagcacggtatccaggtccaagaatggatcaatcccgtgttgcccgattttcaaaaagatgactttaaaggcatgttcaataccgagagttcattccatatgtttccttatcaatcccagatcgccgtgtttaaagagtttctcctccgcgcgaccaagtacaataaattacagatgcttggagacgacctgagaaccgataaaaaaataattctggttgaagatctgccgaatcaattttacagagattctcacacactccatgaggtgcttagaaaatatgttcgaataggtcggtgtcccttaattttcattattagtgattcccttagtggcgataataatcagcggctgctttttccaaaagagatacaagaggagtgctctatttccaacatttcttttaaccccgttgcccccactatcatgatgaaatttctgaatcggatagttactatagaggcgaataaaaatggcggtaaaatcactgttcccgacaaaacatcactcgagctgctgtgccagggctgctctggggatatccgctccgcgattaactcccttcagtttagctcatccaaaggggagaacaatctgcgaccgaggaaaaagggcatgtcattgaagtcggacgctgtgctgtctaaaagcaagcgtcgtaagaagcccgacagggtttttgagaaccaggaagtgcaggcaattggaggtaaggatgtaagcttattcctgtttagggcgttaggaaagattctgtattgcaagagggccagcctgacagagctcgacagcccccgccttccttctcatctgtcagagtatgagcgagacaccctcctcgtcgagcccgaggaggtcgttgagatgagccacatgccgggggatctgttcaacctgtacctccaccagaattatatagacttcttcatggaaatagacgatattgtaagagcttctgagtttctgtcttttgccgatatattgagtggtgactggaatactcgctccctgctgagagaatactctacttctatcgcaacccgcggtgtgatgcatagtaacaaggcgcgcggctacgcccattgccaggggggcggaagctcattccggccactgcataagccccaatggttccttatcaataagaagtacagggagaattgccttgctgccaaagctcttttccccgacttttgtctgccagcgctgtgtcgccaaacccaactccttccctacctagcgctcttaactatccccatgcgcaatcaggcgcaaatcagcttcattcaggacatcggccgcctgcccctgaaacgccacttcggtcgcctcaagatggaggccttaacagaccgcgaacatggcatgattgacccagacagcggtgatgaggcacagctgaatggtggccactctgccgaggaatccctcggcgagcccacgcaagctacagtgcctgagacatggtcattacccctctcacagaattcggcatccgagttgccggcgtctcagccgcaaccttttagcgcccagggggatatggaagagaacattataatcgaggattacgagtcggacggcacatag

SEQ ID NO: 50484 - DNA, 3480 bp, Artificial Sequence
  Description of Artificial Sequence: Synthetic coding sequence
atgagcctgccccagcccaccccccggatggccgagctgcggaagccgacgtctagtctgacgccccccgaggaccctgactcccagcctccaagctcaaagagactctgtcttgaggagcctggaggggtctttaaagccgggtggcgcctgccccttgtccctcggctttctgaggcagagaaggtctgggagctttctccacggcctttcaaaggcctcctggtcagcactaacgcgatttttgataacagcaccgattcctgcgtagaaaagtcggtgtcagggaagcaaatctgcaacctcaagtgctcgaatctgaagtttcagatgtccagctgccttcaaagccctccttcgcagagcccagattccgacctgcgggccagcggaagaagtgaggccggactgcacgaccgtgaggcctttagcgtgcacaggtccaactccagcaaggccggtgtgtcgcagttactgccttctacctccattcacgacattcacggtatccggaatgagaacaggaaacagcagttcgtgcaaggcagggataatgtgcataaggaaaacccctttcttgatgtgacattctataaagagacaaagtctcccttccacgaaataaagaataggtgtaaggccaacagcgttgtgccctcaaataaaagggaaaacaacatcagcagctccgttctgaaaatctctaaatcccagaaccagccaagcttggagattgcaaaaccttcatatttccgggacagcgggacaatctctgtgccccagttccccatggatcttaatagcaagatgagtagtgtgtacttgaaggaaatcgccaaaaaaaagaacgataagaaagaggcctacgtgcgcgatttcacgaatatctattggagtcaaaacaggcccgacgtcaagaagcaaaagctacagaatgataagaagacagtggaggcagaaaatatttttagcaagtgttatgagaatgattacccatcactttcctcccagaacacttgtaagaggaaggatctgatcagcagcaattactgcaactgcagctccattcagtgcaatgtgcgcgactccaggaagaattttgctatcctggagaatgccaattgggaagaggccgaatgcctggactcttatgtgttgactagactggagaaaagtcagaactgggactgtaatgtccgtcacatcctgagaagaaaccgtggcaactgttggatcatcaacaactgcaagacaaagtgcgaaaatatgaaaaagaccgaggagaaatggaattggctgctgcttctcgaaatcgaccttctttctaaggaggactatcactgtgccaaagtgataaacgcgtatgaggagcagtctaaacttcttgtgagagaaatcttgggatcccagactgcgttgattaccaccgtgtggctgaacggaaaaggcgaaaacgataacactttgcagttaaggtataacacgacccaaaaagtgttccacgtcaacaatccatttgagagtttcattatcgagatcttttactttcataagtctattagcggaaacaaaaaggacaattcaatactcacgtgctgtaacattctgaagtgtaagaaacagatcggcatcattgggattcagaatttgattacaagaaacatgaacaccaacatcaagaacggtattctgtctatctacttgcaagacagcgtgtccgaaccactggatattctgcttaaaacaaacatagcattccttctaaataacttcgactctctgacaaggatcgaaaatgattttgaattggaggaagaatgcatctttaagtgtatgctctacttgaagtaccccaaaaatatcgtggaaaatcacactgcctacctggtgaaaattttaaccagctccaggttattggaggacaacatgaaaccaatgctgaagaagcggaagctcttcagaaccgagcaagtgttcgagaaatccaagaaaaaactgattaatagtttttccatgacaacacagaacacagggttcccaatattcgaaacttatgagaagatccccctcttaatggacttcgacgatatggacgaaatctctctgatcagggagattacttgccagaacatgagttgcccccagcaggtggtcaacgtggagaattgggctcattacaactcctcaaccgtgaaggcgcacgggaatagttgtcctcaatttattcagaacaaccgcggctatattaatgagaacttctacgaggtgaacatgcattcccaagatctcaacatggagcgaaaacaggggcacaacaaaattagcaactttgactgcgagcatatttttgaggacttatgtaacgttcggcagcaggctatacccgcttctcataatataattcacaacgaagagacccatactacatctatcacccaggtccttaacttctggaacctgttatccgagatcgaagaaaaaaaatacgatctgatcctcaaggaggaggtgaaggtgacggccgagagcctcaccaattcctgtcaagtgcacaaagacacaaaaatcgagaaggaggagaaggacagcttttttcccatggacgacatgttttcagtgcagtcagtttctctgatcagcaaggaggttaacgtggaagagaataagtacgtgaaccagaactacgtgaccaacaccaatgaatatgaaagtatcctccctgaaagggagatcgctaattctaaagattttcatcgcaagaacgactccgccctatacataaatcaccagtttgagactggcctttcggaagggaacgacgagtgttttcaggacctggctgctaaatatctgtccacagaggcactcaccatcgtaaaggacttcgagatgaaaagaaagtttgacctcgtcctggaggagttgagaatgtttcacgaaatttccagagaaaatgaactcctctcaaccgttgagaccaataacggtcaggagaattactttggagaaaatgatgccgagaaggtgaaaatggagatcgagaaagatctaaaaatggtggtggtcaacaaaatacgggcaagcagcagtttccacgacactatcgccggccccaacatgggaaaaagccaccagagccttttcaaatggaaaacagttcctaataacggcgaacaggaagtgccaaatgagagttgctacccatccaggagcgaagaggaattactctacagcacaagtgagaaggactgcgagacaccactaccaaaacgtcctgcgtttctaccggacgaatgcaaggaggagttcaattacctgctccgtggaggaagccatttcccgcatggtatttctagagtacggccgcttaagacctgctcacggcctataagaattggcctctcaaggaaggcgagaatcaagcagctgcatccctatcttaaacaaatgtgttacgggaatctgaaagagaatttttag

SEQ ID NO: 50485 - DNA, 1683 bp, Artificial Sequence
  Description of Artificial Sequence: Synthetic coding sequence
atgaccgtgaagcccgccaaggccgccagcctggcccggaacctggctaagagaaggcgcacctacctggggggagccgcaggccgctctcaggaaccagaggtgccctgcgccgcggtcctcccagggaagccaggggaccgtaattgcccagagtttcccccgcccgataggacactgggctgctgggctactgacgccgcccccgctgctggactgtgcggggcgggctccgaaccttccatcgcccccaccagttgtgccggtaacctccccagtagacccccacccctgctgtctccacttctggcttctcggaacccttgtccctggcactacttgcatttaagcggaagtcataatacgcttgctcccacatgcttcaaggcaaagctacatcgcaagagagggtcacagcctcccgacatggcgtcagcgctgacagacaggacaagccgggcaccatccacatatacttataccagccggccaagagctttgccttgccagaggtcacgataccgggacagcctgacccagcctgatgaagagcccatgcactatggtaatatcatgtatgaccgtcgggtgattcgcgggaacacgtatgccttacaaactggacctctcctgggccggcccgattccctggaacttcagcgtcagagggaggcgaggaagagggcactagcccgtaaacaagctcaggagcagcttcggccccagactcctgaacccgtagagggaaggaagcacgtggatgtgcagactgaactctacctcgaggagattgctgatcgcatcatagaagtggacatggagtgccaaacggatgcctttttagacaggccaccaacacccctttttatccctgccaagaccggcaaagacgttgccactcaaatcctggaaggagaactttttgattttgatttagaggtcaaacctgtcctggaggtgctggtaggaaagaccatcgagcagtcattgctggaagtgatggaagaggaggagttggccaacctcagagcttcccaaagggagtacgaggagctgcgtaatagcgaaagggctgaagttcagaggctggaggaacaggaacgccgacatagggaagagaaggaaaggcggaagaaacagcagtgggagattatgcacaaacacaacgagaccagccaaaagatcgctgccagagctttcgcccaaagatacctggcggacctgctgccatccgtcttcgggtcgctgcgggattccggatacttctacgacccaatagagagagacatcgaaatcggcttcttaccttggctgatgaacgaggttgaaaagactatggaatactccatggtaggccgaactgtgctggatatgttaatccgggaagtggtcgagaagagattatgtatgtacgagcatggcgaggatacccatcaaagccctgagcctgaagatgaacccggcggaccaggggctatgaccgagtctctcgaggccagtgagttcctggagcagtctatgagccagacaagagaattacttcttgatggcggatatttgcagaggacaacctacgacaggcggtcctcacaggagcgaaagtttatggaggagagggaacttcttgggcaggatgaggaaacggctatgagaaagagtctcggcgaggaggagctcagctag

SEQ ID NO: 50486 - DNA, 1395 bp, Artificial Sequence
  Description of Artificial Sequence: Synthetic coding sequence
atgaccgtgaagcccgccaaggccgccagcctggcccggaacctggccaaaagacgcaggacctacctaggtggggccgccggcaggagccaagagccggaggtcccatgtgccgccgtgctgcctggaaaacctggcgaccgcaattgcccggagttccctccccctgaccggacactcggatgctgggccacagatgccgcgccagccgcagggctgtgcggagccggatctgagccctcgatcgcccccacaagctgtgccggcaatctcccatcccgcccacctcccctccttagccctctccttgcatctagaaatccttgcccctggcactacttgcacctgtccggttctcacaatacgctggctcctacctgcttcaaagcgaaattgcaccgcaagagaggcagtcaacctccagacatggcctcagccctgactgaccgcactagcagggcaccctccacctacacatacaccagccgcccacgagcccttccatgccagaggtcccgatatcgagattctctgacacagcccgacgaggaacccatgcattacggcaatatcatgtacgaccgaagagtgatccgggggaacacgtatgcactgcaaaccggtccactcttgttcgattttgaccttgaagtaaaaccagtgctcgaggttctcgtcggaaagaccatcgagcagtcccttctggaagtgatggaagaagaggagctggcgaacctgcgagcctcgcagcgcgagtatgaagaactgaggaacagcgagagagcagaagtccagagacttgaagagcaggagcgaaggcacagagaggaaaaggagcgccgtaaaaaacagcagtgggagataatgcataagcacaatgagacaagccaaaaaattgccgccagagcatttgcgcagcggtacctggccgacctcttaccgagtgtctttggaagcctccgcgactctggctatttctacgatcccatcgagcgtgatattgagattggctttctgccctggctcatgaacgaagtggaaaagaccatggagtactcaatggtggggaggaccgtgttggacatgttaatccgcgaggtagttgagaagcgcttgtgcatgtatgagcatggtgaagatacacaccagtctcctgagccagaggacgaacctggtggccccggcgctatgaccgaatccctcgaagcctcagaatttctggaacagtccatgtcgcaaactagggagctactgttggacggcgggtacctgcaacgcaccacatatgataggcggagcagtcaggaacggaagtttatggaggaacgagaactgttggggcaggatgaggaaactgccatgaggaaatctctgggcgaggaggagttgtcctag

SEQ ID NO: 50487 - DNA, 1257 bp, Artificial Sequence
  Description of Artificial Sequence: Synthetic coding sequence
atggccagcgccctgaccgaccggaccagccgggcccccagcacctatacttacacaagccgacctagggcgctgccttgtcagagaagccggtacagggacagcctcacacaaccggatgaggaacctatgcattatggcaatattatgtatgaccgccgggtcatccgagggaacacttacgcgctacaaaccgggcccctcttgggcaggccggactcactcgagctgcagcgccaaagggaagcacggaaaagagcgttagcccgcaagcaggcccaggagcagttgaggcctcaaacgcccgagccagtggagggtaggaaacacgtggatgtgcagaccgaattatatctggaggaaatcgctgatagaattattgaggtggacatggaatgccaaaccgacgccttcctcgatcgtcccccaacccctctattcattcctgccaagaccggcaaggatgtcgctacacagatcctggagggcgagcttttcgattttgacttggaggtcaagcccgttctggaagtcctggtgggcaaaacaatcgagcaatccctcctggaggtcatggaagaagaagaattagctaacttacgcgcttcccagagggaatatgaagaattgaggaacagcgaacgtgccgaggtccagcgcttggaggaacaggaacggcgccaccgggaggaaaaagagagacggaagaagcaacagtgggaaataatgcataaacacaacgaaacctctcaaaagatcgcagcaagggcctttgcgcagcgatacctagccgatcttttgcctagcgtgtttggctcgctgagagactccggatacttctacgaccccatagaacgtgatatcgaaatcgggtttttgccgtggctgatgaatgaggtggagaaaactatggagtattccatggtgggcaggacagtgttggacatgctgattagggaggtggttgagaaacgcctctgtatgtatgagcacggggaggacacgcaccagtctccagagcccgaagatgagcctggaggccctggggccatgaccgaaagcctggaggcatctgagttcctggagcagagcatgtctcagacaagagagctgctcctggacgggggctacctccagcgtacaacttacgaccggcgctctagtcaggaacgcaaatttatggaagagcgagagctgctcggccaggacgaagaaaccgcgatgagaaaaagcctgggagaagaggaactgtcatag

SEQ ID NO: 50488 - DNA, 969 bp, Artificial Sequence
  Description of Artificial Sequence: Synthetic coding sequence
atggccagcgccctgaccgaccggaccagccgggcccccagcacctacacgtacactagcagaccacgggcgctcccctgccaacgcagccgttaccgcgactcactgacccaaccagatgaggaacctatgcactacggcaacataatgtacgataggagggtgatccggggcaacacgtacgccctgcagaccggcccgctcctcttcgatttcgaccttgaagttaagccagttctcgaggtgctggttgggaagactatagagcaaagcctgctcgaagtgatggaggaagaagagctggcaaatttgcgcgcaagccaaagagaatatgaggaactgagaaactctgaaagagccgaagtgcagaggttagaagaacaggaaagacggcaccgcgaagaaaaggagcggaggaagaagcagcagtgggaaattatgcacaagcataacgaaactagtcaaaaaatcgccgccagagccttcgcccaaaggtacttagccgacttgctgcctagtgtctttggctctttgagggactcagggtatttctatgatccaatcgagagggacatagaaattggctttctgccatggttgatgaatgaagtggaaaaaacaatggagtattccatggtcggtcgcacagtgctggatatgctcattcgcgaggtggtcgagaaaagactgtgcatgtacgagcacggggaagatacacatcagtctcctgaacccgaggacgagcccggcggacccggagctatgacagagagtttagaagcttccgaattccttgagcaatctatgagccagaccagagagctgttgctggatgggggctacctgcagagaacaacttatgatcgtcgatcctcacaggagcggaaatttatggaagagcgggaactgctgggacaggatgaagagacagctatgcgcaaaagcctaggagaagaggagctgagttag

SEQ ID NO: 50489 - DNA, 2613 bp, Artificial Sequence
  Description of Artificial Sequence: Synthetic coding sequence
atggtgaaggagaagaagaaggccgacaagaagggcgagaagagcgcgcggtctcctagctccctgtccgataatctggatttctcgaaacaggacggaaacacgaccaggcaggaaatgtccccagcgggggtgccccttttgggcatgcaactcaatgaggtcaagccaaagaaagatcggcagaacgttcagcagaatgaagacgccactcagtatgaggaatccatcttgacgaagctgattgttgaaagttacgaaggtgaaaaggtaagagggttatacgagggagaggggtttgccgccttccaaggagggtgtacttacagagggatgttctcagaggggctgatgcacggtcagggaacctacatctgggcggatgggctgaagtacgaaggggacttcgtgaagaatgtaccgatgaatcacggcgtttacacctggcctgatgggtcaatgtatgaaggcgaagtggtcaacggaatgcggaacggatttggcatgtttaagtgctccacgcagcctgtgtcttatattgggcactggtgtaacggaaaacgccacgggaaaggctcaatctactacaatcaagaaggtacatgttggtatgagggagattgggtgcaaaacattaaaaagggctggggtataagatgttataagagtggcaatatttatgaggggcagtgggaggataatatgcgccatggggaggggagaatgcgttggctaaccacaaatgaggagtacaccggccgatgggaacgcggcatccagaacgggttcggcacccacacttggtttcttaagagaatacggtccagtcagtacccgctacgcaacgagtacatcggtgagttcgtgaacgggtatcggcacggacggggcaagttctactacgccagtggcgcgatgtacgatggtgaatgggtgagcaataagaaacatggaatgggccgactaacctttaagaacgggcgcgtgtacgaaggcgcttttagcaacgatcatattgccggctttcctgatcttgaggtcgagtttattagttgcctagatctcagctcaggagtggctccgagactgtcacgcagcgctgagctgattagaaaattagacggcagcgagtctcattcggtgctggggagctccatagaactggacctgaacttactgctggacatgtaccccgaaaccgttcaaccagaggaaaaaaagcaggttgagtatgcagtcctgaggaacattacggaactgcggcggatctactctttttatagcagcctgggttgcgggcacagtctcgacaacacatttctcatgacaaaacttcacttctggcggttcctgaaggactgcaaatttcaccaccataagctgacactagcagatatggacagaatcctttcggctaacaacgacattccggtcgaagagatccatagtcccttcaccacgatcctgctccgtacattcctgaactacctcctgcatttggcttatcacatataccacgaagaattccagaagcggtcaccctcattgttcctctgttttaccaaactgatgacagagaacattagaccaaatgcgttccagattaagggcaacctgttcagggagcagcagcgcaccttgtactctatgtcgtacatgaacaagtgctgggaaatctacctggcatactgccggcctagtgccgctccccctcacgagccaaccatgaaaatgcggcacttcctgtggatgctcaaagactttaagatgatcaacaaggaactgacagctgccacgttcatggaggtgattgccgaagacaatcggttcatttacgacgggatcgattctaattttgaaccagagctggtgtttttagagttttttgaagccctgctatctttcgcttttatatgcgtgacagatcagatgaccaaatcatatactaacgtgccagctgatgacgttagtggcaacaagcacgagaccatttataccatattgaatcaggatgcacagaacaagtcacctagcgccgtcatgtcacacgagtccgacgcagcgcattccgattctgccagatctagctctagtaaactggagcttagcccagatgtgaataaaatcagaaagagtgagccaaagattaaaaagtccgtgtcccatgagagagtttcaaagatgaactttaagttgacaggcaaaggcattacatttttctcttcggaatctaagaagtacgagagaccgaaggacgaccgcgaggaagaatttaacacgtgggtgaacaatatgtacgtgttttttgtgaataccctgttccatgcttacaaacgggaagaggctattaaggagaaaattagggctgacaggcttcggtctaccgctcaggcacaacagcgcaaaatggaggatgacgaactcgaggctcgcttaaacattttcatcctcagagaggaggaagccaaacggcatgactacgaggtggatattacggttctgaaggaacctgccgatgtgtcttcatctcacctaatcctcgaccccccaaaggaggatgtaacagtatcaccatcttctaagacgatcacaagcaagaagaaaaagaagtag

SEQ ID NO: 50490 - DNA, 1857 bp, Artificial Sequence
  Description of Artificial Sequence: Synthetic coding sequence
atgaaccacggcgtgtacacctggcccgacggcagcatgtacgagggcgaggtagtgaacggtatgcgcaatggctttggcatgtttaagtgttctacacagccagtgtcatatattggccattggtgtaatggtaagcggcacggaaagggctcaatttactataaccaggaagggacctgctggtatgaaggagattgggtgcagaatattaagaaaggttggggtattagatgctacaaatcgggtaacatctatgaaggccaatgggaggataatatgcgccacggggagggccggatgagatggctgactacgaacgaagaatacaccggtcggtgggagaggggcatccagaacggctttggcactcatacttggtttctcaagcgaattagatcttcccaatatccccttagaaatgaatatattggcgaatttgttaacggataccgccatggtcggggaaagttttactatgcgagcggcgccatgtatgacggagaatgggtcagcaacaagaaacatgggatggggaggctcactttcaaaaatggaagagtctacgaaggcgctttctccaatgatcacattgcgggatttccagatctggaggttgagtttatttcctgcctggatctaagttcaggagtggcacccaggctgtctaggagcgccgaactgattagaaagttagacggttcagagtcccactctgttttgggttcttcaatcgaactggacttgaacttattgctggatatgtatccagagactgtgcaacctgaggaaaagaagcaagtggaatacgccgttctcaggaatataactgagctgagacgaatttacagcttctattcatctctcggctgtggacactccctcgacaataccttcctgatgactaagctgcatttttggaggtttctgaaggattgcaagttccaccaccacaaactcaccctggccgacatggaccgcatcttgtcagccaacaatgatatcccagtggaggaaattcatagtcccttcactacaatcctgctgaggacctttcttaactacctgctgcacttggcgtaccacatttatcatgaggagttccaaaagcgatcaccaagtctctttctctgtttcacaaagctgatgaccgaaaatattcgtccaaatgctttccaaattaaaggaaatctgtttcgcgaacagcagcggactctgtactcaatgtcatacatgaacaaatgttgggagatctatctggcttattgtcgtccgtccgctgcacctccccatgagccgaccatgaaaatgaggcacttcctgtggatgctcaaagatttcaagatgattaacaaggaactgacagccgccaccttcatggaggtgattgcagaggataaccggttcatttatgatgggattgactccaacttcgagccagagttagtgttcctagaattctttgaagctctgttaagtttcgcttttatttgcgtcacggatcagatgactaaatcttatacgaatgttccagcagatgatgttagtggaaataagcacgagacaatttataccatccttaaccaagatgcacaaaacaaaagtccgagtgcggttatgtctcacgaatccgacgcggcccactcagactctgccaggtcttcatcttccaagctcgaactttcccccgacgtcaataaaattaggaagagcgaacctaagatcaaaaagagtgtttcacacgagcgagtctccaaaatgaacttcaagctgacgggaaagggcattactttttttagttccgagagcaagaaatacgagcgacccaaagacgaccgggaagaggacggacgctag

SEQ ID NO: 50491 - DNA, 2613 bp, Artificial Sequence
  Description of Artificial Sequence: Synthetic coding sequence
atggtgaaggagaagaagaaggccgacaagaagggcgagaagagcgccaggtcccctagctctctgtcagacaatctagacttctcaaagcaagatgggaacaccacgcgtcaagaaatgtcccccgctggcgtgcccctgcttgggatgcagttgaacgaagtcaagcccaaaaaagaccggcagaatgtgcagcaaaacgaggacgctacgcaatacgaggaatcaattctgacaaagttaattgtggagtcttacgagggcgagaaggtcaggggtttatatgagggcgaaggcttcgctgcatttcagggtgggtgcacttatcgtggtatgttcagcgaaggtcttatgcacggccaagggacgtacatctgggccgatgggttgaaatacgagggcgacttcgtgaagaacgttccaatgaatcatggcgtatatacctggcccgatgggagtatgtatgagggcgaggtggtgaacggcatgcgcaacggcttcggtatgtttaaatgtagtacgcagccagtgagttacatcggacattggtgtaacggaaagaggcacggaaaagggtcaatttattataaccaagagggaacatgctggtacgagggggactgggtgcagaatatcaaaaaaggctggggcatcagatgctacaaatctggaaatatatacgaaggtcagtgggaggacaatatgcggcacggcgagggacgcatgcgctggctgaccactaatgaagagtacacaggccgttgggagcgcggcatccagaatggtttcggcacacatacctggtttctcaagagaatacggagctcccagtaccccttgcgtaatgaatatatcggggaatttgtcaacgggtaccgacacggcagaggaaaattttattacgctagtggcgctatgtacgacggagagtgggtttctaacaagaagcatgggatggggcgccttacatttaagaacggccgggtatatgagggggcatttagcaatgatcacatcgctggattccccgatctggaggtggagttcatcagctgtctagatctctcaagtggtgttgctccccggctgtccagatctgccgaactcattaggaagcttgatggttccgaaagccactctgtgctgggatctagcatcgagctagatctgaatctgctgctggacatgtatcctgagaccgtccagcctgaggaaaagaaacaggttgaatatgccgtactccgcaacatcactgagttgcgccggatttactcattctactcctcgctaggctgcggccacagcctagacaacacattcctcatgactaagctgcacttctggaggttcctcaaggattgtaagttccaccaccacaaattgacgctggctgacatggatcgcatactgtcagcgaacaacgatatcccagtggaagagatccatagtcctttcactactatccttctgagaaccttcctcaactacctgctgcacttagcgtatcacatctatcacgaggagttccagaaaaggagcccttccttgttcctgtgttttacaaaactaatgacagaaaatatccggccgaatgcgtttcagattaaaggtaacctctttcgcgagcagcagagaacgctatatagcatgagctacatgaacaaatgctgggagatttatttagcctactgtagaccatctgccgcgccccctcacgaacccaccatgaaaatgagacatttcctctggatgttaaaggattttaagatgataaacaaggagctaaccgctgctactttcatggaagttattgctgaagacaataggtttatttacgacggaatagactccaactttgaaccagagttggtgttcctggaattctttgaggcactgttgtctttcgcctttatctgcgtgacggatcagatgaccaagagctataccaacgtgccagccgacgatgtgagcggaaacaagcacgagaccatctacaccattcttaatcaggacgctcagaacaaaagtccatctgccgtgatgagccacgagtccgatgcagcacatagtgactccgcccgaagttcatccagtaaactagaactatcacctgacgtgaataaaatcaggaaatctgagcctaagatcaagaaaagcgtgtcccacgaacgggtatccaagatgaattttaaattgactggcaaggggataacattcttcagctctgagagcaagaagtatgagaggcccaaagacgatagggaggaggagtttaatacttgggtgaacaacatgtacgtcttctttgttaacactctgttccacgcctacaagagagaggaggcgataaaggagaagatccgggccgatcgcctgcggtccacagctcaggctcagcagagaaagatggaagacgacgagttggaagcaaggttgaatattttcattctccgggaagaagaagccaaacgccatgattacgaggtggatattacagtcctgaaggaacccgcagatgtgtcatcctcccatctaattttggacccccccaaagaggacgtcactgtgtctccttcaagcaaaaccattacaagcaagaagaagaaaaagtag

SEQ ID NO: 50492 - DNA, 2613 bp, Artificial Sequence
  Description of Artificial Sequence: Synthetic coding sequence
atggtgaaggagaagaagaaggccgacaagaagggcgagaagagcgctcggtcaccgagctcactctctgacaatctggatttctcgaagcaggacggtaacaccacaaggcaggaaatgagccctgcaggagtcccgctcctgggaatgcagttaaatgaggttaaaccaaaaaaagaccgccagaatgtccagcagaacgaggacgccacccaatacgaggagtctattttgacaaagctcatcgttgaatcttacgaaggggagaaggttaggggattatacgagggagaaggatttgctgcattccagggaggctgtacttatagaggtatgttctccgaagggttgatgcacggacaaggtacttacatatgggcggacggactgaaatacgaaggggactttgtgaaaaatgtgcctatgaatcatggcgtctatacgtggcctgacggttcaatgtatgaaggggaggtagtgaacggcatgcggaacggattcggaatgttcaaatgcagcacacagcctgtgtcatacatcggccactggtgcaatggaaagagacatggaaaggggagcatatactacaatcaagagggcacctgttggtacgagggggattgggtgcagaatatcaagaagggctggggaattagatgctacaagtccggcaatatctacgaaggacagtgggaagataacatgcgacatggcgaagggaggatgcgatggctgacaactaacgaggagtatacgggaaggtgggaacggggcatacaaaacggtttcggtacgcacacatggttcctgaaacgtatacgaagctcacagtacccactaagaaacgagtatattggtgaattcgttaacggttacagacacggcagaggaaaattttattacgcaagcggtgccatgtacgacggcgaatgggtgtcgaacaagaagcatgggatgggccgcctgaccttcaagaacggcagggtctatgaaggggcttttagtaatgaccatatagctgggtttcccgacctggaagtcgaattcatcagctgcctggacctctcatcgggcgtcgcccctaggctgtccagatctgccgaattaatccgaaagttagatggctccgagtctcactctgtgttgggcagttccattgaattagatctcaatctactgctggatatgtacccggagaccgttcagcctgaggagaagaaacaggtggagtatgccgtgctgaggaacatcactgagctgaggagaatctactctttctactcttcactgggctgcggacactctctagacaatacttttcttatgaccaaactccatttctggaggtttctgaaagactgcaagttccatcatcataagttgaccctcgcagatatggacaggatactaagtgccaacaatgatatcccagtggaagagatccactcccccttcactactatcctgctccgcacatttctgaattaccttttgcacctcgcttatcatatctaccatgaagagtttcagaagcgctctccaagcctgttcttgtgcttcacgaagctgatgaccgagaatatacgccctaacgctttccagatcaaagggaacctatttagagaacagcaacggacgctttactctatgtcttatatgaacaaatgttgggaaatttacctcgcatattgcaggccctccgccgccccacctcatgaaccaactatgaagatgaggcactttctctggatgttgaaagactttaaaatgatcaataaagagttaactgcagcaacattcatggaggtcattgctgaagataatcgtttcatttacgatggtatagacagtaattttgagcctgagctggtatttcttgaatttttcgaagcgctactgtcatttgccttcatctgtgtgacggaccaaatgaccaaaagttatacaaatgttccagcggatgatgtgagtggtaacaagcacgagactatttacacaattttaaatcaggatgcacagaataagagcccttccgccgtgatgtctcatgagtccgacgcagctcatagcgactcagctaggtcatcaagctcaaagctggaactctcaccggacgtgaacaagatccgaaaatccgagcctaaaatcaagaaaagcgtgtcccacgagagagtatctaagatgaattttaaactgacggggaagggaatcacattcttcagtagcgagtccaaaaagtatgaaaggccgaaggacgatagagaggaagaatttaacacctgggtcaataatatgtatgtctttttcgtcaacaccctttttcatgcgtacaagagggaagaggcaataaaggaaaagatcagggcagaccgcctgcgttctactgcccaagcccaacagaggaaaatggaggatgatgagctggaggctcggctgaatatcttcattctgcgcgaggaggaagctaaaagacatgactatgaagttgatatcaccgtactgaaagagccagccgacgtgagttcctctcatctaattcttgatccacccaaggaagatgtaactgtctccccatccagtaaaaccatcacatccaaaaagaaaaagaaatag

SEQ ID NO: 50493 - DNA, 2613 bp, Artificial Sequence
  Description of Artificial Sequence: Synthetic coding sequence
atggtgaaggagaagaagaaggccgacaagaagggcgagaagagcgcccgtagccctagctcgctctccgataacctggacttctctaagcaggacgggaatacaaccaggcaggagatgtcacccgctggagtgcccctcctcggcatgcagctcaatgaggtgaaacctaagaaagataggcagaatgtccaacaaaacgaagacgccactcaatatgaagaatctatcctaacaaagctgattgtcgaatcctatgagggagagaaggtaagaggattgtacgaaggcgagggcttcgcagccttccaggggggttgcacataccgggggatgttcagtgagggcctcatgcatggtcagggaacgtatatctgggctgacggactaaaatacgaaggggacttcgtcaagaacgtgcccatgaaccatggggtttatacttggcccgatggatcaatgtacgagggggaggtggtcaatggaatgcgcaatgggttcgggatgttcaagtgctcaacccagcctgtgagttatatcgggcattggtgcaacggcaagcgacacgggaaggggtctatctattacaatcaggaaggcacttgttggtatgagggcgattgggtccagaatattaagaaaggatggggaattagatgctataagtcgggaaatatctacgagggtcagtgggaggacaacatgagacacggcgagggcaggatgaggtggctcaccactaatgaggagtacaccgggcgctgggaaagggggattcagaacggtttcggaacccacacatggttccttaaacgcatccggtcctctcagtacccacttcgtaacgagtacataggcgaatttgtcaacggttataggcatggtcggggaaaattctactatgcgtccggggcaatgtacgacggagagtgggtctctaacaagaagcatggaatgggtcgcctgacatttaagaatggcagggtgtacgaaggagctttttcaaacgatcatattgcagggttcccagacctggaggtggagtttatctcatgtctcgacctgagttctggagttgccccccggctatcaagatccgcagagcttatccgtaagctcgacgggtccgaatcgcactcagtgctggggtcctctattgaacttgatctcaatctgttgttagacatgtacccagagactgtacaacccgaggagaagaagcaggtggaatacgctgtgcttcggaatataacagagcttaggcgaatatactctttttacagtagtctaggctgtgggcatagtctggataacactttcctaatgaccaagctgcacttctggcgctttctcaaggactgtaagttccaccatcataagcttacactcgccgacatggaccggattctgagcgctaacaatgacatcccagtggaggaaattcattcccctttcaccactatcctgctgagaaccttcttaaattacttgttgcatctggcttatcatatttaccacgaagagttccagaagcggagcccctccctgttcctttgcttcactaaactcatgactgaaaatatacgcccaaatgcatttcagatcaagggcaatctgttcagggagcaacagagaaccctgtatagtatgtcctacatgaataagtgttgggagatctacctggcgtactgtaggccttccgccgcccctccccatgaacccaccatgaagatgcggcactttctgtggatgctaaaggacttcaagatgattaataaggagctgactgccgctacatttatggaggtgatagcagaagataataggttcatatacgacggcatcgattccaacttcgagccggagctggttttcctggagttcttcgaggcattgctgtcctttgccttcatttgtgtgacggaccagatgactaaatcttataccaacgtcccagccgatgacgtatccggtaacaaacatgagacaatctacacaattttgaaccaggatgcccagaacaaaagtcccagtgcggtgatgtcccacgaatcggacgccgcccactccgatagtgctaggtcttcttcttcaaagttggagctgtcgcccgacgtcaacaagatccgtaagtcagaacccaagattaagaaaagcgtgagtcacgagagggtgtccaagatgaatttcaaattgacagggaaagggatcacttttttctccagcgagtcaaagaagtacgaacggcctaaagacgaccgggaggaggagtttaacacctgggtgaacaacatgtacgttttttttgtaaacaccctctttcatgcctataagcgcgaagaggcaattaaagagaagatacgggcggatagactgcggtccacggcgcaggctcagcagcggaagatggaggacgacgagctcgaggccagacttaacatattcatcctgcgcgaggaggaggccaaacgacacgactacgaagtggatatcaccgttctaaaagagcctgccgacgtaagctcatctcatctgattctggaccctccgaaggaagacgtaaccgtgagtccttcgtctaagaccattaccagcaagaagaaaaaaaagtag

SEQ ID NO: 50494 - DNA, 15 bp, Artificial Sequence
  Description of Artificial Sequence: Synthetic coding sequence
atggtgaaggagtag

SEQ ID NO: 50495 - DNA, 843 bp, Artificial Sequence
  Description of Artificial Sequence: Synthetic coding sequence
atgcggcacggcgagggccggatgcggtggctgaccaccaacgaggagtacacggggcggtgggagcgcggaatacagaatgggttcggtactcacacctggttcttgaaacgcattcgctcatcccagtatccccttagaaatgaatacataggcgagttcgtgaatggctataggcatggtagaggtaaattctactacgctagcggcgcaatgtatgacggagagtgggtctccaacaagaaacatggcatgggcagactgacattcaagaatggcagggtctacgaaggggctttttctaacgaccatatcgccggctttcctgacctcgaggtggaattcatcagttgcctggacctgtcttctggcgtcgctccaaggctcagccgatctgccgagctaatccgaaagcttgacggctcagaaagccactccgtgctgggctcttctatcgaactggacttaaatctgctcctagatatgtatcctgaaacagttcagccggaagagaaaaaacaggtggaatatgctgtgcttcggaacatcaccgagttgagacggatctacagtttctattctagccttggctgtggacatagtctggataatacctttctgatgacaaaactgcatttttggcgcttcctcaaggactgtaaatttcaccaccataagctaactctggccgatatggacagaatcctgagcgcaaataacgatataccagtcgaagaaatccacagtccctttacaaccatcctgttacgcactttcttgaattacttgttgcacctggcttaccacatatatcacgaggaatttcagcagttcatcccatag

SEQ ID NO: 50496 - DNA, 42 bp, Artificial Sequence; identical to SEQ ID NO: 24198
  Description of Artificial Sequence: Synthetic coding sequence

SEQ ID NO: 50497 - DNA, 2613 bp, Artificial Sequence
  Description of Artificial Sequence: Synthetic coding sequence
atggtgaaggagaagaagaaggccgacaagaagggcgagaagagcgcaagaagcccttcaagcctgtcagacaacctggatttctccaagcaagacggaaataccactcggcaggagatgtcaccagcgggagttccactcctgggaatgcagcttaatgaggtaaaaccaaagaaagatcggcagaatgtccagcagaatgaagatgcaagtcaatatgaggagtcaattctcaccaaactcatcgtggagtcctacgaaggagaaaaagtgagaggcctctatgaaggtgaaggcttcgccgcctttcagggtggctgtacttaccgggggatgttctctgagggactgatgcacggccaaggaacttatatatgggccgatggactcaagtacgagggtgatttcgtcaagaacgtcccaatgaatcatggagtctacacgtggcccgatggaagcatgtacgaaggcgaggtggtaaacggcatgcgcaacggattcggaatgtttaagtgctcaacgcagccagtgagttacatcggccattggtgcaacgggaaacgacacggaaagggaagtatttactacaatcaggagggaacctgttggtacgagggagactgggtgcagaacatcaagaaagggtggggtatccgctgttataagtccggtaacatctatgaaggtcagtgggaagataacatgcgccacggagaggggaggatgcgctggttgacaacaaatgaggagtacactggccgttgggaaagaggaatccagaatgggttcgggactcacacatggttcttgaaaagaatccgctcgtcccaataccctctgcggaacgaatacatcggggagttcgtgaacggttatcgccatggacgaggcaagttttattatgccagcggtgctatgtatgacggggagtgggttagcaataagaagcacggcatggggcggctgaccttcaagaacggacgagtatacgaaggagctttttcgaatgatcacattgcagggtttccagatctggaggtggaattcattagctgtctggaccttagttctggcgtcgcacccagactgagccggtctgctgaactcattcgcaagctggatgggtcagagtcacactctgtgctgggatcatccattgaactggacctcaacctgctgctcgatatgtaccctgagacagttcaacctgaagagaaaaaacaggttgaatatgctgtgctgaggaacattactgaactcagacggatctattccttctactctagtctcgggtgtggacactctctggacaacactttcctcatgaccaagttacacttctggcgattcctcaaggactgcaaattccaccaccataagctcacactggctgacatggaccgaattctttctgctaataacgatattccagtggaagaaatccactctcctttcaccactatccttctccggacttttctgaactacctgttacacctggcttatcacatatatcacgaagaatttcagaaaaggagtcccagtttgtttttgtgtttcaccaagctaatgaccgagaacattagaccgaatgcctgccagattaaaggtaacctatttagagaacagcagaggacgctctattctatgagttacatgaacaagtgttgggaaatttatctcgcttactgtcgaccttcagccgcacccccccatgagcccactatgaagatgcgacacttcctttggatgttgaaagatttcaagatgattaataaggagctaaccgctgcaacctttatggaggtgattgccgaggacaacaggtttatctacgacggtatcgacagcaattttgagcctgagctcgtgttcttggaattttttgaggccctgctgtccttcgctttcatatgcgtgaccgaccagatgaccaagtcatataccaacgtgcctgcagacgatgtgagcggcaacaaacatgagactatttacacaatactcaatcaggacgcacagaacaaatcaccatctgctgtcatgtcacatgagtccgacgcagctcactctgattctgctcgtagctcttcttccaaattggagttgtctcccgacgttaacaaaatcagaaaaagcgaacctaagatcaaaaagtcagtaagccatgagcgagtgagcaaaatgaatttcaaactgactgggaagggaattacgtttttctctagcgaatctaaaaaatacgagcggcccaaggatgatagggaggaggagttcaatacgtgggttaataatacttacgtgttctttgtcaacactctgtttcacgcttacaaaagagaggaggctatcaaggaaaagatccgtgctgatcgccttcgcagtaccgcgcaggctcagcagcgaaaaatggaggacgatgaactggaagcgcgcctgaacattttcattctgagagaggaggaagccaaacggcacgactacgaggtggacatcacggttctaaaagagccagctgatgtgtcgtcctctcatctcattctggatcccccaaaagaggatgtgacagttagtcctagctcgaaaacaattacctcaaagaaaaagaaaaagtag

SEQ ID NO: 50498 - DNA, 843 bp, Artificial Sequence
  Description of Artificial Sequence: Synthetic coding sequence
atgcggcacggcgagggccggatgcggtggctgaccaccaacgaggaatacactggccgctgggaacgcggaattcagaatggcttcggaacccacacatggttcctgaagcgcataaggagctcgcagtatccactgaggaacgagtacattggtgagttcgtgaacggctatcgccatggccgaggtaagttctattatgccagcggagctatgtatgacggtgagtgggtgtcaaacaagaagcacggcatggggagattgacgttcaagaatggcagggtatacgaaggcgctttcagcaatgaccacattgccgggttccctgacctcgaagtcgagtttatttcttgcctggacctgtcctcaggagtggccccgcggctctccagatcggccgagcttatcagaaagctggacggcagcgagtcccactcggtcctcggcagttcaatagagttggatctgaatctccttctggatatgtaccctgagactgtacagccggaggaaaaaaaacaggtcgagtatgcggtgcttaggaacatcaccgagctccgcaggatatatagtttttatagttctctgggctgtggtcactcgctggacaatacttttcttatgacgaaactacacttctggaggttcttaaaagactgcaaatttcaccatcacaagttgacgctggcggacatggatagaatactgtcggctaataatgacatacccgtggaggagatacattcgcccttcactacaatattgctacgcacattcctgaattatttacttcatcttgcctaccacatatatcacgaggagttccaacagttcatcccttag

SEQ ID NO: 50499 - DNA, 2613 bp, Artificial Sequence
  Description of Artificial Sequence: Synthetic coding sequence
atggtgaaggagaagaagaaggccgacaagaagggcgagaagagcgctcgatcaccttcttccctgagcgataacctagacttctccaaacaggacggaaataccactagacaggagatgagtcctgctggcgtgccattactcgggatgcagcttaacgaggtcaagcccaaaaaagaccgtcagaacgttcagcagaatgaagacgcttctcagtatgaggagtccatattgacaaagttgatagtggagtcgtacgaaggcgagaaagtccgagggctctacgaaggcgaaggcttcgctgcgtttcaagggggatgtacgtacaggggaatgttctctgaaggtctgatgcacggtcaagggacatatatctgggccgatgggctgaagtacgaaggggatttcgtgaaaaacgtccctatgaatcatggggtgtatacctggccagacggatccatgtacgaaggagaagttgtcaatggcatgcgcaacggcttcggaatgtttaagtgtagtacccagcccgtgtcttacatcggacactggtgtaacggaaagcgtcatggcaagggtagtatctactacaatcaggaaggcacctgttggtatgagggtgactgggtacagaatatcaagaaaggctggggcattcgatgctacaagagtggaaatatctatgaaggccagtgggaagacaacatgcggcatggcgagggccggatgaggtggctaaccacgaacgaggaatatacaggccggtgggagaggggcatccagaatgggttcggaacacatacttggtttctgaagagaataagatcctcacagtatcccctacgcaatgaatacatcggggaattcgtgaatggatacagacacgggagaggaaaattttactatgccagcggggccatgtatgatggtgaatgggtgtccaataagaagcatggtatgggaaggctcacctttaagaatggccgcgtgtatgaaggggcatttagcaacgatcacatcgccggattccccgacctcgaagtggagtttatctcttgccttgacttgtcgagcggggtggcccctcgcctgtccagaagcgctgaactcattcgtaagctcgacggatctgagtcccactccgtattagggtcatctatcgaactggacctgaatttgctccttgatatgtatcccgaaaccgtccaacccgaggagaagaaacaagtcgagtacgccgtgttgagaaatatcacagagctcaggcgcatctatagtttttacagctcccttgggtgtggtcactccctagacaacaccttcctcatgacaaaacttcacttctggcggttccttaaggactgtaaatttcaccaccataagctgaccctggccgacatggatcgcatcttgagtgctaataacgacatccctgtggaggagatccactctccgtttacgaccatattgttacggacctttctcaactacctgctgcatcttgcctaccatatctaccatgaagagttccaaaaaagaagcccatctctcttcctgtgttttacaaaactgatgactgagaatatcagacccaatgcgtgccaaattaaagggaacttgttcagggagcagcagaggacactgtatagtatgtcttacatgaataaatgctgggagatttacctagcctactgccggccctccgccgccccccctcatgagccaaccatgaagatgcgacacttcctctggatgctgaaggactttaaaatgatcaacaaggaactgacggcagctactttcatggaggtcatagccgaggacaatcgttttatttatgacggtattgactcgaatttcgaacccgaactggtatttctggagttttttgaggctctgctgtccttcgcttttatctgcgtgactgatcagatgaccaagagctacaccaacgtgcccgctgacgacgtgagcggcaataagcacgaaactatatatacgattctgaaccaggacgcccagaacaagtctccttccgctgtcatgagccacgagtccgatgcggcccatagcgattccgccagaagcagtagcagtaagctcgagctgagtcctgatgtgaacaagatccggaaaagcgagcccaagatcaaaaagagcgttagtcacgaaagagtctcaaaaatgaattttaagctcaccggcaaagggatcaccttcttttcttctgaaagtaagaagtacgagcggccaaaagacgaccgcgaagaggagttcaacacctgggtcaacaacacttacgtgttcttcgtgaatacgctgttccacgcctataagagggaggaagccatcaaggagaaaattcgcgccgacagattgcggtccactgcccaggcacagcagcgtaagatggaagacgatgaattggaggctagacttaacattttcatcctgagggaagaagaggccaagaggcatgattatgaggtcgatataaccgtgctcaaagaacctgcagacgtgtcaagctcgcatctgatactggatccaccgaaggaggacgtcaccgtcagcccatcatccaagacaattacgtctaagaagaagaaaaaatag

SEQ ID NO: 50500 - DNA, 2613 bp, Artificial Sequence
  Description of Artificial Sequence: Synthetic coding sequence
atggtgaaggagaagaagaaggccgacaagaagggcgagaagagcgcccgctctcctagttctctgtcagataatttggacttcagtaaacaagatggtaacaccaccaggcaggagatgagtcctgcaggagttcccttgctcggaatgcagctcaacgaagtaaaacctaagaaggacagacagaacgtccaacagaatgaggatgcgagccaatatgaggagagtattctgacaaagctgatcgtggagtcatatgaaggcgaaaaggtgcggggtttatacgagggagagggattcgcagccttccagggcggatgcacataccgtgggatgtttagcgagggattaatgcatggccagggaacctatatttgggcagatggactcaaatatgagggggattttgtgaagaacgtgcccatgaaccacggcgtatacacatggcccgatggctctatgtacgagggggaggtcgtcaacggcatgcgaaatggatttggcatgtttaagtgctctacccaaccagtttcctacattggccactggtgtaatggcaagcggcacggaaaggggtctatatactataaccaagagggtacctgttggtacgagggggactgggtgcagaatattaagaaagggtggggtatccggtgctacaagagtggtaacatttacgaaggccagtgggaggataatatgcgccacggcgaagggcgcatgcggtggctgaccacgaacgaagaatacacggggcggtgggagcgggggatccagaacggtttcggcactcacacgtggttcctgaagcgtatcagatcatcccaatacccgctgaggaatgagtatatcggggaattcgttaatggctatcgccatggacggggcaagttttattacgcaagcggggccatgtacgatggggagtgggtgtccaataagaagcacggaatggggcggctgacctttaaaaacggccgggtgtacgagggcgccttctctaatgatcacattgccggtttccccgacctcgaagtggaattcatctcatgcctggacctatctagtggggtcgccccaaggctttcgagatcagccgaacttatcagaaaactggacggctctgagtctcattcagtcctaggaagctccatcgagctggatctgaatctactgctggacatgtatccagaaacagtacagcctgaagaaaagaagcaagtagaatacgcggttctgagaaatattacggaactgaggagaatctattctttctatagctccctgggatgcgggcactctttagataacacatttctcatgaccaagctacacttctggaggtttcttaaggactgcaagttccatcaccacaagctcaccctggcagatatggataggatcttgtctgccaacaacgatatccccgttgaagagattcacagtccattcacgacaatcctgctacggactttcttgaactatttactgcatcttgcatatcatatttatcatgaagagtttcaaaagaggagtcctagcctcttcttgtgctttaccaaattgatgactgagaacatccgacctaacgcatgtcagataaagggaaacctattcagagaacagcagagaacattatatagcatgtcttatatgaacaagtgttgggaaatctacctcgcctattgcaggccaagtgccgccccaccgcacgaaccaaccatgaaaatgcgacactttttatggatgcttaaagactttaagatgattaataaggagctaaccgctgcgactttcatggaggtaatagctgaagacaatcggtttatttatgacgggatcgactcaaactttgaacccgagctggtcttcttagagttctttgaagctctcctgtcattcgcttttatctgtgtgacggaccagatgactaaaagctacaccaatgttcccgctgacgatgtgtccggcaataaacatgaaacaatatacacaatcctgaaccaggatgcacagaataaatcgcccagcgctgtgatgtcccatgagtctgatgctgcgcattctgattctgccaggtcttcttcctctaaactcgaactttcgccagacgttaacaagattcgaaaatcagagccaaaaatcaagaagagtgtgagtcacgaacgtgttagcaaaatgaactttaaattgacgggaaaaggcatcacatttttttcgagtgaatccaaaaaatacgagcgcccaaaagacgacagagaggaagaattcaacacctgggttaataacacttacgtcttctttgtgaacacactgttccacgcctacaagcgtgaggaggctatcaaggaaaaaattcgggccgataggcttagatcaactgcccaagcacagcagcgaaaaatggaggatgatgaactggaggctagattgaatatctttatcctccgtgaagaggaagccaaacggcatgactacgaagtggacatcacagtcctgaaggagccagccgacgtatcatcatcgcatctaattttggatccgcctaaagaagatgtgactgttagcccttcatctaagactatcacctctaaaaagaagaaaaaatag

SEQ ID NO: 50501 - DNA, 180 bp, Artificial Sequence
  Description of Artificial Sequence: Synthetic coding sequence
atggtgaaggagaagaagaaggccgacaagaagggcgagaagagcgctcgctcaccatccagtctgtccgataatctcgacttttccaaacaggacggtaacacaacccgccaggaaatgtccccagccggagtgcccctgctgggcatgcagctgaatgaagtcaaacccaagaagtag

SEQ ID NO: 50502 - DNA, 2613 bp, Artificial Sequence
  Description of Artificial Sequence: Synthetic coding sequence
atggtgaaggagaagaagaaggccgacaagaagggcgagaagagcgctcgctctccatcatcgttatctgacaaccttgatttctcaaaacaggacgggaacacgaccaggcaggagatgtctccagctggagtcccgcttctggggatgcagcttaacgaggtgaaacctaaaaaagaccgtcagaatgtgcagcagaatgaggatgcttcacagtatgaagaatcgattttgacaaagctgatcgtggaaagctacgagggcgaaaaagttaggggcctgtatgagggggagggctttgccgcatttcagggagggtgcacctatagaggtatgttttccgagggcctgatgcacggacagggtacctacatttgggccgacgggctgaagtacgagggcgactttgtcaaaaacgttccaatgaaccacggagtgtatacatggccggacggctcaatgtacgagggggaggtggtcaatggaatgcgtaatggctttggcatgttcaagtgctctacccagcccgtgagttacataggacattggtgcaatgggaaaaggcacggaaagggttccatctattataatcaagagggaacttgctggtatgagggagactgggtgcagaatatcaagaaaggatggggtatccggtgttataagtccgggaatatatacgagggccagtgggaggataatatgaggcatggggaaggtcgcatgcgctggctcactactaatgaagagtacaccggccgttgggagagaggcatacagaacggttttggaacccacacatggtttctgaaacggatacgctcctcccagtatcccctccgaaacgagtacattggcgaattcgtgaacggatataggcatggcaggggcaagttctactatgcctctggggcgatgtacgacggagaatgggtcagtaataagaagcacggcatgggtcgactgaccttcaaaaatggtagggtctatgagggggccttctccaacgatcatattgcaggctttccggatctggaggttgagtttatttcttgtcttgacctgagcagtggggtggctccccggttatctcggtctgctgagttgatccgaaaactagatggaagcgagtcccacagcgtgttaggaagcagtatagagctggacctaaaccttttgctagacatgtaccccgaaactgttcagccagaagaaaagaaacaggtcgaatacgctgtgctgcgcaatattacagagctgcgccgtatctactctttctactcctccctaggctgtggtcactctctggacaacacctttttaatgaccaagttgcacttttggagattcctcaaagactgcaaatttcaccaccataaattgaccctagcagacatggaccggatcctgagtgccaataacgatatcccggtggaggaaatacatagtccttttacaactatattgcttaggacgtttctaaattatctgctccacttggcctaccatatctaccatgaagagttccagaaacgctctccatctttgttcctctgcttcaccaaactgatgacagaaaacataaggccgaacgcctgtcaaattaaaggtaatttgttccgagagcagcagcggactctctattctatgtcctacatgaataagtgctgggaaatctatttggcttattgcaggcccagtgctgctcctccacatgaaccaacaatgaaaatgagacattttctgtggatgctcaaagactttaagatgatcaacaaagagctgacggcggcgaccttcatggaggtgatagctgaggacaatagatttatttatgatgggatcgactctaactttgaacctgaattggtgttcctggaatttttcgaggcacttttatccttcgcattcatctgtgtgacggatcagatgactaaatcatataccaacgtgccagccgatgatgtcagcggcaataagcacgaaacaatctatactatcttgaaccaggatgcgcagaacaaaagccccagtgccgtgatgtcacacgagtccgacgctgcacactctgactccgctcggagcagtagttcaaagctggagctgtctccagacgtgaacaaaattcgaaagagcgaaccaaaaattaagaagagtgtgtctcacgaaagagtatccaagatgaactttaagctcacaggtaagggcatcacgtttttctcaagtgagagtaaaaagtatgagagaccgaaggatgatagagaagaggaattcaatacatgggtgaataatacatatgtcttcttcgtaaatacactgtttcatgcctacaaacgggaagaggcaatcaaagagaaaattcgggctgatagactacgctctacagctcaggcccagcagcgcaaaatggaggacgacgagctcgaggcccggctgaacatcttcatcctgcgcgaggaggaggctaaacgccatgactatgaggttgacattactgtcctcaaagagcctgcagatgtgtcctcatctcacctgatcctggacccgcctaaggaggatgtcaccgtgagccccagcagtaagactattacgtcaaagaaaaaaaaaaaatag

SEQ ID NO: 50503 - DNA, 30 bp, Artificial Sequence; identical to SEQ ID NO: 24205
  Description of Artificial Sequence: Synthetic coding sequence

SEQ ID NO: 50504 - DNA, 1857 bp, Artificial Sequence
  Description of Artificial Sequence: Synthetic coding sequence
atgaaccacggcgtgtacacctggcccgacggcagcatgtacgagggtgaggttgtaaatgggatgcgcaatggtttcggcatgttcaaatgcagcactcagcccgtttcatacattgggcactggtgtaacggaaagagacatggaaaggggtccatttactacaaccaagagggtacctgctggtacgagggcgactgggtgcagaacattaagaaaggatggggaatcaggtgttacaaatccggtaatatctacgaggggcaatgggaagataatatgcggcacggggagggtaggatgaggtggctcactactaatgaggaatatacgggaagatgggaaaggggaattcagaatggttttggcacgcacacatggtttctcaaacgtattaggagctcacaatacccactaagaaacgaatacataggagaattcgttaacgggtacagacacgggaggggcaagttttattatgcatcgggcgccatgtacgatggcgagtgggtgtcaaacaaaaagcacgggatgggcagattgacgtttaaaaacggccgggtctacgaaggcgcctttagtaatgatcatatcgccgggttccccgatctggaggtggagtttatttcttgtcttgacctgagctccggagtggccccccgtctctctcggtctgccgagctgatccgcaagctggacgggtcagaatcccacagcgtgctgggctcttctattgaactcgatctaaatctgctgctcgacatgtatccggaaacagtgcagccagaagagaaaaaacaagtcgagtacgcagtgctcaggaacattactgaactgcggcgcatctattccttttactctagcctcggctgtggtcactcccttgacaataccttcctcatgacgaaattgcacttctggagattcctaaaggattgcaagttccatcaccataaacttacgctcgcagatatggatagaatattaagtgcaaacaatgatatcccagttgaggagattcatagcccttttaccaccatcctgttaaggactttcctgaactatctcctgcatctagcctatcacatctaccacgaagagtttcagaaacgatcaccttccttgttcctctgtttcacaaaattgatgacggaaaatataagacccaatgcttgtcagatcaaagggaatctgttcagggagcaacagagaaccctatacagtatgagctatatgaacaaatgttgggagatttaccttgcttactgcaggccgtctgccgcaccgcctcacgagcctacgatgaaaatgcgccacttcctgtggatgctcaaagatttcaagatgataaataaggagctaactgccgcgaccttcatggaggtgatcgctgaggacaacaggtttatatatgacgggattgacagcaactttgaacccgagctagtcttccttgaatttttcgaagcgctactgtcttttgccttcatttgcgttacggaccagatgacaaaaagttacacgaacgtcccggccgacgatgtgagtgggaataaacacgagactatctacaccattctcaatcaggatgctcaaaacaagtccccctctgctgtgatgtcccatgaatctgatgcagcccattctgatagcgcacggagtagttcttccaaactcgagctgagccccgacgtgaataaaatcagaaagtccgagccaaaaataaagaagtctgtcagccacgaacgggtgtctaagatgaattttaaactgaccggtaaagggatcacctttttctcttccgagagcaagaagtacgagcgacccaaggacgaccgtgaggaagacggtcgctag

SEQ ID NO: 50505 - DNA, 327 bp, Artificial Sequence
  Description of Artificial Sequence: Synthetic coding sequence
atgaaggccctgtgcctgctgctgctgcccgtgctgggcctgctggtgagctccaaaaccctctgtagtatggaggaagctatcaatgagaggatccaggaggttgccggctcactgatcttccgcgcaatttcatcaattgggttggaatgccaatccgtgacaagccggggagacctcgcaacatgtccccggggttttgccgtgactggatgtacttgcggctccgcttgcggatcatgggatgtccgggcagaaactacctgtcactgccagtgtgctggcatggattggacgggagctcgatgctgtagagttcagccatag

SEQ ID NO: 50506 - DNA, 4485 bp, Artificial Sequence
  Description of Artificial Sequence: Synthetic coding sequence
atgtacagcgagtggcggagcctgcacctggtgatccagaacgaccagggtcatacttcagtgcttcactcgtaccctgaatcggtgggaagggaggtggctaacgccgtggtgcgaccattggggcaggttctaggaacaccctctgtagccggatccgaaaatctgctcaagacagacaaggaagtgaagtggaccatggaggtaatttgctacggcctgacattgcctctcgacggtgaaactgttaagtattgcgtagatgtgtacacagactggatcatggcccttgtattgcccaaggatagcattccgcttccagttatcaaggaacctaatcagtatgtgcagacgatcctgaagcacctgcaaaatctctttgtccctcgacaggaacaaggtagcagccagatccggctgtgtctccaggtattacgggctattcagaaacttgccagagagtcgagcctcatggcccgggagacatgggaggtgctcctgctctttctactacagatcaatgatatccttctcgcacccccaactgtgcagggcggaatcgccgagaatctcgccgagaagttgataggcgtgctgtttgaagtttggctgttggcgtgcactagatgtttcccaactcccccgtattggaagacggccaaggagatggtggccaactggcgccatcaccccgctgtggtcgagcagtggtcaaaagtcatttgcgcgctgacaagtcggctgctgcgctttacctacggtccgtcattccctgccttcaaagttcctgacgaagacgcttcactgattccccccgagatggacaacgagtgtgtggctcaaacttggtttcgctttctccatatgctttctaatcctgtggatctgtccaatccagccatcataagcagtactcctaaattccaagagcagttcctcaacgtgtccgggatgccccaggaactgaatcaatacccgtgtctcaagcatttaccccagatcttctttagagccatgaggggcatttcttgtctggtagacgcatttctggggatatccagacccagaagcgactccgccccacccacccccgtgaataggctttcaatgccccagagtgctgctgtgtctaccactccacctcataaccgtagacacagagcagtcaccgtcaacaaagcgaccatgaaaactagcacggtgagcacggcccacgccagcaaagtacaacatcaaacgagcagcacaagcccactaagttcaccgaaccagacatcttcggagcctcgtccacttcccgctcctaggcgtccgaaggtgaattccatcctcaacctgttcggcagttggcttttcgatgccgcattcgtgcattgcaaactgcacaatggtattaatagagactccagcatgacagccatcactacccaggcgtcgatggagtttcgcagaaaaggtagtcagatgagcaccgatacaatggtgagtaatcccatgttcgacgcgagtgaatttcctgacaactatgaggccgggcgggctgaagcttgtggtacactttgcagaatcttttgctctaagaagacaggggaagaaatcctgcccgcatatttgagccgtttttacatgctacttatccagggacttcagatcaatgactatgtgtgtcacccagttctggcctctgtgatccttaattccccaccgcttttttgctgcgacctaaaaggcattgacgtggtcgtcccttacttcattagcgcactcgagacaatactgccagaccgggagttaagtaagtttaaatcatacgttaaccccactgaactgcggaggtccagcatcaacattcttctaagcctgcttccactcccccaccattttggtactgtgaagtcagaggtggtccttgaagggaagttctcaaacgacgatagctcctcctatgacaaaccaatcacgtttctctctctcaaactcaggctggtgaatatactcataggagcccttcagacagagactgatccaaacaacactcagatgattctgggggcgatgctgaatattgttcaggattctgctttgctggaagctattgggtgtcagatggaaatggggggaggagaaaataacctcaaaagtcactctcgcaccaactcgggcatatcatccgcatcaggtgggtccacagaacctacgacacccgacagtgaaagacccgcccaggcccttctgagagattatgcacttaacacagactccgccgctgggctcctcatcaggtccatccacttggtgacccagaggctgaactctcaatggcgccaggacatgtccattagcctcgccgcactggagttattaagcggactggcaaaagtcaaggttatggtcgacagcggagacaggaaaagggcgatcagttccgtctgtacctatattgtctatcagtgttctaggccagcacccctgcattccagggatctgcactctatgatcgtagccgcttttcaatgtctgtgcgtgtggctgacagaacaccccgatatgcttgacgaaaaggattgtctcaaggaagtcctggaaattgtggagctcggcatcagtggatcaaaaagcaagaataacgagcaggaagtgaaatataagggagataaagaacctaacccagcatcaatgcgcgtcaaagacgccgcagaagctactctgacctgcatcatgcagttgctgggagcattcccctccccttccgggcccgctagtccttgctcccttgtcaacgaaactaccctgatcaagtattcaaggttacccaccatcaacaagcacagctttcgctacttcgtactagacaactcagtgatccttgccatgcttgaacagcctctgggcaacgagcagaacgatttcttccctagcgtgaccgtgttggtccgagggatgagcggacgtctagcctgggctcaacaactttgtttgttgccgagaggggccaaggctaatcaaaagctcttcgtgccagaaccgcgacctgtccccaaaaatgacgtgggtttcaagtactctgttaagcataggccgtttccagaggaagtggacaagatcccttttgtgaaggcagatctgtccattccggacctgcatgagattgtcaccgaggaactagaggagcgacacgagaaactgagaagcggtatggctcagcagatcgcctacgaaatccacctggaacagcaatccgaggaggagctgcaaaagcgttcctttcccgaccccgtgacagactgcaaaccccccccccccgctcaggaattccaaactgcccgtctctttctgtctcactttggctttctttccctggaagcgctgaaggaacccgccaactctaggttgcccccacatctgatagctctggactccactatcccagggttctttgatgatatcggataccttgacctgctcccatgtcgtccattcgacacggttttcatcttttatatgaagccaggtcaaaaaactaaccaggagatcctgaagaatgttgagtcgtcccgaactgtccagccacacttcctcgaatttctgctctcactgggttggagcgtggacgtaggccgacatcccggatggacagggcacgtgagtacttcttggtccatcaactgttgtgacgatggagaagggagtcagcaggaggtgatctcttctgaagacatcggagcgtctatttttaatggacagaagaaggtcctgtattacgccgacgcgctcaccgaaatcgcttttgttgtgccctcccccgtagagagtcttacggactcgctggaaagcaatatctcagaccaagactccgattccaacatggacttaatgccaggtattctgaagcagccaagtttaacactcgagctgttccctaatcacactgacaatttgaactcttcacagcggctctccccgtctagtaggatgagaaaactgccacaaggcaggcccgtgccgcctctggggccagagaccagggtgagcgtggtgtgggtggagcgatacgatgatatcgaaaattttcccctttcagagttgatgacagagatatcaacaggcgtagagaccactgccaatagctcaacatcccttcggtcaaccacacttgagaaggaggtccctgtcattttcattcatcccctgaacaccgggctgtttcgtataaaaattcagggcgctactggaaagttcaacatggtgattccactcgttgacggcatgattgtcagccgaagggccttgggctttctcgtgagacagacagttatcaacatttgtagacgcaagcgactggaatccgactcttattcaccaccgcatgtgaggagaaagcagaagatcaccgatatcgtcaacaaatatcggaacaagcagcttgagcctgagttttacaccagcctgtttcaggaggtgggattaaaaaattgcagttcatag

SEQ ID NO: 50507 - DNA, 2892 bp, Artificial Sequence
  Description of Artificial Sequence: Synthetic coding sequence
atgtacagcgagtggcggagcctgcacctggtgatccagaacgaccagggacatacatccgtcctgcatagttatcccgagagcgtcggaagggaagtggcaaacgccgtggttcgccctctcggccaggttctgggtacgccctcggtggcaggctccgagaatttgctgaaaactgataaagaggtgaaatggacgatggaagtgatatgctacggcttgaccctgccccttgatggagagacggtgaagtactgcgtggacgtgtatactgattggatcatggccctagtcctgccgaaggactccatccctctcccagtgatcaaggagcctaatcagtacgtgcagactattctgaagcatctgcagaacctgtttgttccccgccaggagcaaggctcttcacagatacgtctgtgcctgcaggtactgagagccatccagaaactggccagagaaagcagcctgatggcacgcgaaacttgggaagttctcttattgttcttgctccagattaatgacattttattagccccacctacagtacaaggtggaatcgctgagaatctcgccgaaaagctgatcggagttctgtttgaagtgtggctactggcctgtactcgatgtttccccactcccccatactggaagactgccaaggagatggtcgcgaactggcgccaccatcccgcggtggtggagcagtggtccaaggtgatttgcgccctgaccagtcgtctgctgcgtttcacatacggcccttccttccctgcctttaaagttcccgacgaggacgcttccctcatccctccagagatggacaacgaatgtgtagcccagacttggtttaggtttctccatatgctgtccaacccggttgatctgtctaaccccgccatcatctcctctactccaaaatttcaggaacagttccttaatgtatctgggatgccacaggagctgaaccagtacccgtgcttgaagcacctgccacagatcttttttcgcgccatgagaggcatctcctgcctcgttgatgccttcctcgggatctcacgcccgcgatccgactccgcacctcctacccccgtgaataggctttccatgcctcaaagcgcggcagttagcacaactccacctcacaacagacgccatcgtgcagtgactgtaaacaaggccactatgaaaacttcaaccgtatccactgctcacgcttctaaagttcagcatcagacttccagtacaagcccgttatcatcccccaaccagaccagcagtgagcctcggcccctccccgccccacgccgtccaaaagtgaattcaattctgaatctgttcgggtcatggctgttcgacgctgcctttgttcactgcaagctccacaatgggattaatagggatagcagcatgactgcgattacaacccaagcaagtatggaattcaggcggaagggatcacaaatgagtaccgataccatggtctctaatccgatgttcgacgctagtgagtttcccgacaactacgaggccggacgagcagaagcttgcgggaccctgtgtagaatcttttgttcgaaaaagacaggggaagagatactcccagcttacctatcccgcttctatatgctactcattcagggactccagattaacgattatgtgtgccacccggtactcgctagcgtgattctgaatagccctcctttgttctgttgcgacttaaaaggaatcgatgtggtggtgccttattttatttcagccctggaaaccatattacccgaccgcgaactgtctaagttcaagagttacgtaaatcctacggagctgaggcgttccagcatcaatatcctgctgagtcttttgccactccctcatcattttggcaccgtaaaatcagaagtggtgctagagggcaaatttagtaatgacgactcctcatcctacgacaagccgatcacattcctctcattaaaacttcgcttggtgaacatcctgattggggccctgcaaacagagaccgatcctaataacacgcagatgatcctcggggccatgctcaacatcgtacaggatagtgccctgctcgaggcaatcggctgccaaatggaaatgggcggtggcgaaaataacctcaagtcacattcccgaacaaacagcggcatctcatcagcctccggcggatccacagagccgaccacccctgattcggaacgccccgcccaggccctgctgcgcgattacgccttgaatactgactcagctgctggcctgcttataaggtctatacatctggttacacaacgtctaaactctcagtggaggcaggatatgagtatctctctcgcagcgctggagttgctctctggcctggccaaagtcaaagtaatggtggactccggcgacagaaaacgagctattagcagtgtttgtacatacattgtgtatcagtgttctagaccagctcctcttcacagccgcgatctgcattcaatgatcgtagctgcttttcagtgcctgtgcgtctggctgaccgaacatccagacatgctagacgaaaaagattgcctgaaagaagtgctggaaatagtcgaactcgggatttcagggagcaagtctaagaataacgagcaagaggtgaagtataagggggataaggaaccgaatccggccagcatgagagtgaaggacgccgctgaagctacgctgacatgtatcatgcagcttctgggggcattccctagtccctcaggtccagctagtccttgttcactggtaaacgagaccacgttgattaagtattctcgcctgccaactatcaacaagcagctggagccagagttctatacaagtctgttccaggaggttgggctgaagaattgcagcagctag

SEQ ID NO: 50508 - DNA, 3822 bp, Artificial Sequence
  Description of Artificial Sequence: Synthetic coding sequence
atggtggccaactggcggcaccaccccgccgtggtggagcagtggtccaaagtgatttgtgccctaacaagtcggcttctgcgcttcacctatggaccatcattcccagccttcaaggtgcccgacgaggatgcaagtttgattccaccggagatggataatgagtgtgtcgcccagacatggttcagattcttgcatatgctgtcaaacccagtcgatctctccaatccagccattatatcttccacccccaagttccaggagcagttcttgaacgtgtccggtatgccacaggagctgaaccaatacccttgcctgaaacatcttccacaaatctttttcagggcaatgaggggaattagctgcttggtcgatgccttcctgggcatttctcggcctagaagtgactctgccccacctactcccgtgaaccggctttccatgccccaatcggctgcagtttccaccacacctccccacaatcggcggcacagagcagtcaccgtcaacaaagccacaatgaagacgtccacggtctcaaccgcacacgctagtaaggtgcagcatcagacttcatccacatccccactgtcatcccctaaccaaacttcaagcgagcctcggccgctgcctgctccgcgacgacctaaagtgaattctatcctgaacctgtttgggagttggctctttgacgcggccttcgtgcactgcaaactgcacaacggtatcaatagggactcctctatgacagccatcacaactcaggcttccatggagttcagaagaaaagggtcacaaatgtccaccgatacaatggtgtccaaccctatgtttgacgcaagtgagttcccggacaattacgaagccgggcgagccgaagcctgcggaacgctatgtagaatcttttgctccaagaagaccggagaagaaatattgcctgcctacctcagtaggttttacatgctgctgattcaaggcctgcaaataaatgactatgtgtgtcatccagtgcttgcttcagttatcctgaatagtccaccactcttctgctgcgacttgaaggggatcgatgttgtagttccatatttcatttctgccttggagaccatcctaccagatcgagagctatctaagtttaagtcttacgtcaacccaacggaactgagaaggagcagcatcaatatcctgttgtcactattgcctcttcctcatcacttcgggacagttaagtccgaggtcgtgctagaggggaagttctccaatgatgacagctcttcctacgacaaacccataacattccttagcctcaagctcagactggtaaatatactcatcggcgccctgcaaactgagacggaccctaacaacacacagatgatactgggggcaatgctaaacatagtccaggacagtgcgctgttggaggccattgggtgtcagatggagatgggtggcggtgagaacaatttgaagtcccatagcaggaccaattcagggatctcctccgcaagcggaggatcaaccgagcctaccacccccgactcagagcgtcccgctcaagctttgctacgtgattacgccctgaacactgattccgccgccggcttgctaattcgctccatccacctggtcacacaaagactgaactcccagtggaggcaagatatgagtattagtctcgctgcgctcgagctgctctccggactggccaaggtgaaagtcatggtggattctggcgacagaaagcgggccatttcatccgtgtgtacctacatcgtgtaccagtgttcgcggcctgcccctttgcactcaagagatcttcacagcatgattgtggccgcattccagtgtttgtgcgtgtggcttactgagcatcctgacatgttggatgaaaaggactgtctgaaggaggtgctggaaatcgtggaacttggaatctccggcagtaagagtaaaaataacgaacaggaggttaaatataagggggataaggagccaaacccagcatccatgcgcgtgaaggacgctgcggaggcaactcttacatgcatcatgcagctgctgggagcctttccttcgccatctggccctgcttctccctgttcattggtgaacgagacgactctgatcaaatattctagattgccaacgatcaataaacattcctttagatatttcgttctggataacagcgtgattttagcaatgttggaacagcccttgggaaacgaacaaaatgatttcttcccaagcgtcacagttctagtgagaggaatgagcggcaggctggcttgggcccagcagctctgcctcctccctagaggcgctaaagccaaccagaagctctttgtgccggagcctcgccctgtgccaaaaaatgacgtgggcttcaaatacagcgtgaaacatagacccttcccagaagaggtggacaagatcccctttgtgaaggccgacctgtcaatacccgatttacatgagatcgtgacagaagagttagaggaaaggcatgagaagctgaggtccgggatggctcagcagattgcgtacgagatccacctggaacagcaatctgaagaagagcttcagaagaggagtttccccgatccggtgacggattgtaagcctcccccacccgcccaggagtttcagacagcccgactttttttgtcccatttcggatttttgagtttagaagctctgaaagagccggctaacagtaggctacccccacacctcattgcccttgacagtaccattcccgggttctttgatgacatcggctaccttgaccttctgccttgtaggccctttgatacagtttttattttctacatgaagcctgggcagaagacaaatcaggaaatcctcaaaaacgtagagtccagccgaacagtgcagccgcatttccttgagttcctgctctcactgggatggagcgtcgacgtgggaaggcatcctgggtggacgggacatgtgtcaacatcatggagcatcaattgttgcgacgacggcgagggctctcaacaagaagaggtcatcagtagcgaagatattggggcctcgattttcaacggacaaaagaaagttctgtattacgcggatgcactgacagagatagcttttgtcgtcccaagccctgtggagagtctgactgattcactggagtcgaacatcagcgatcaagattccgacagcaatatggatctgatgccggggattttgaagcagcccagcttgaccctcgaactgtttccaaatcatactgataatcttaacagcagccagcgtttgagtccctctagccgcatgagaaagcttccccagggacggcctgttccccctctagggcccgaaacaagggtctccgtcgtttgggtggaaaggtacgacgacattgaaaatttccccctctccgagttgatgaccgagatttctacaggtgttgaaacaacagctaatagttcaacatccctgcgaagtacgaccttggagaaggaagtcccagtcattttcatccaccccctcaacactggactgttccgcatcaaaatacagggagccacaggtaagttcaatatggtaatccctttggtcgacgggatgattgtctcgcggcgggccctgggattcctggtgagacagacagtaattaacatctgtcgaagaaagcgcttagagagtgactcttacagtcctcctcatgtgcggaggaagcagaagattacagacatcgtaaacaagtataggaataagcagctggagcctgagttctatacctcactgttccaggaggtcggcttgaagaactgtagctcctag

SEQ ID NO: 50509 - DNA, 4485 bp, Artificial Sequence
  Description of Artificial Sequence: Synthetic coding sequence
atgtacagcgagtggcggagcctgcacctggtgatccagaacgaccagggtcatacttccgtgctccacagctatcctgagagcgtgggacgggaggtggccaatgcagtcgttcgcccattgggacaggtgctcggtacgcccagtgtggccggttccgaaaacttgctgaaaaccgataaagaggtgaaatggacaatggaggtgatctgttacggacttactctgcctcttgacggcgagactgtgaagtattgtgtcgacgtttacacggactggatcatggcactggtattgcctaaggatagtatcccactccccgtgattaaggaacccaatcagtatgtgcagactatcttaaagcaccttcagaatctttttgtgcctagacaggagcagggctccagccagatacgcctgtgtctgcaagtattacgcgccattcagaaactggcgagagaatctagtctgatggcaagggaaacctgggaagttctgttgttgttcttgctccagattaacgacatcctcctcgctccaccgacggtgcagggaggcatagctgaaaatctggcagagaagctcataggcgttttattcgaagtctggttacttgcgtgtacgaggtgctttccgactccgccttattggaagacggctaaagaaatggttgctaattggcgccaccaccccgccgtagtcgaacagtggtctaaggttatttgtgccttaacaagccgcctgttgcggtttacatatggtcctagcttccccgcctttaaagttcctgacgaggacgcctcgctgatcccccctgagatggataacgagtgtgtcgcacaaacttggttcagattccttcatatgctgagtaatcccgtggacttgagcaatccagcaataatatcaagcactcctaagttccaagaacagtttctgaatgtgagcggcatgccccaggaacttaatcagtacccctgcctgaagcacctgccacaaatcttcttcagggccatgagggggatcagttgtttggtggacgcctttctgggcatatctaggccaaggtccgattcagctccaccaacacctgtcaaccggctttccatgcctcaatccgccgcagtcagcactacaccccctcataaccgtcgccatcgggccgtgacagtcaacaaggctactatgaaaaccagtacagtcagcacagctcacgcctcaaaggtgcaacatcagaccagtagtacgagccctctctctagcccgaaccagacaagcagtgagccccgccctctcccagcccctagacgcccaaaggttaatagcattctgaatctatttggctcctggctgttcgatgcagccttcgtgcattgcaaacttcacaatgggatcaatcgtgatagctcaatgaccgccatcactactcaagccagcatggaattccggaggaaaggaagccagatgtcaaccgatacaatggtaagcaatcccatgtttgatgcttccgagtttcccgataactacgaagccggccgagcggaggcttgcggaaccctttgccgtatcttctgctccaaaaaaacaggcgaggagattctcccagcctacctgagcaggttctacatgcttcttattcagggattacagatcaacgattatgtttgtcatccagtgctggcgtccgtcatcctgaacagcccaccactcttctgttgcgacctcaagggcattgacgtcgttgtcccatattttatctcagcacttgagacaatccttcctgatagggagctctccaagttcaagtcctacgtcaacccaactgagctgagaagaagcagtatcaacattctgctgagcttgttacccttgccgcatcatttcggaacagtgaagtcagaagtcgtcctggagggaaagttctcgaacgacgacagctcctcatacgataaacctatcacttttctgtcgctcaaactgagactggtgaacatcctaattggcgcgttgcagacggaaacagaccctaataacacccagatgatcctgggtgctatgctaaatattgtgcaggattcggcgctgcttgaagctatcggatgccagatggaaatgggcggcggcgagaataaccttaagagccacagccgcacgaattccggaatttcgtctgcttcaggcggctctaccgagcccaccaccccagatagcgaacgccctgctcaggcactgctgcgggattacgcccttaataccgatagtgcagcaggcttattgatccgtagtatccatctagtgactcaaaggctcaatagtcagtggaggcaggacatgagcattagcctggccgccttggaactgttaagtgggcttgctaaggtgaaggtcatggtggactctggggataggaaacgagctattagtagcgtgtgcacttatatcgtgtaccaatgttctagacccgcccctctgcatagtcgggatctgcactcgatgatcgtggcggcatttcaatgtctatgcgtctggctgacggaacaccccgatatgctggatgagaaggattgtctgaaagaagtccttgaaatcgtagagcttggcatcagtggatccaagtcgaaaaataatgaacaagaagtgaagtataagggggacaaggagcccaaccccgcaagtatgagggttaaagatgctgctgaggccactcttacatgtattatgcagctcttgggcgccttcccatcaccaagcggccccgcgtcaccttgctccctcgtgaacgagacaacgctgataaagtattcccggcttcctactattaacaaacatagctttcggtactttgtactggataatagtgtgatccttgctatgttagaacaacctttgggcaacgaacagaacgactttttcccttcagttaccgtgctcgtcaggggcatgagcggtagactcgcttgggcccaacagttgtgcttgttaccaagaggagccaaagccaatcaaaaactattcgtaccggagccccgacctgttcccaaaaacgatgtcgggttcaaatattcagttaagcaccgacctttccctgaggaagtggataaaataccgttcgtcaaggccgatctgagcatcccggacttacacgagattgtgaccgaagaactggaggaaagacatgagaagctgaggtccggaatggcccaacagatagcatacgagatccacctggaacagcaaagcgaggaagagctgcagaaacgttccttccctgacccggtgacagattgtaaacctcctccgcccgcccaggaattccagaccgccaggctgttcctgtctcattttggctttctgagtctggaggcactcaaggaacctgcaaactctcggcttcctccgcacctgatcgctctggactcaactataccgggcttctttgacgacatcgggtacttggatcttctgccttgccggccatttgacactgtcttcatcttctacatgaagccaggccaaaagactaaccaggaaattttgaaaaacgtggagtcttctagaaccgtccaaccgcacttcctggaattcctgctgagcctgggctggtcggtggacgtgggaaggcatcccgggtggacggggcatgtcagtacgagctggtccataaattgctgcgacgacggagaaggaagccaacaggaggtgattagttcagaagatattggcgcctccatttttaatgggcagaagaaggtgttatattatgcggacgcccttactgagatcgcattcgtggtgccatcccccgtggagtctctgactgattccctcgagagcaacatcagtgaccaggactctgactcgaacatggatctcatgccgggcatcctgaagcaaccctccctcactttggagctgttccccaaccacaccgacaacctgaattctagccagcggcttagtcccagtagccgaatgagaaagctgccccagggcagacccgtccccccccttggccctgaaacgagggtttctgtggtgtgggttgagcgatatgacgacatcgagaactttcctctgagcgagttaatgactgagatcagtaccggcgtggaaacaacagctaactccagcactagcctacggtctacaaccctggaaaaggaggtgcccgtcattttcatccacccactcaatacaggtttgttcagaataaagatccagggggctacgggtaaattcaacatggtgattcccctggtggatggtatgattgtgagccgccgcgctttgggctttctcgtccggcagacagtgatcaacatttgcaggcggaaacgccttgaatctgacagctattcgccccctcacgtgcggcgcaagcagaaaatcaccgacatcgttaacaaatatcgcaacaaacagctggagccagagttttacacctcgttgtttcaggaggtaggactaaagaattgtagcagttag

SEQ ID NO: 50510 - DNA, 4476 bp, Artificial Sequence
  Description of Artificial Sequence: Synthetic coding sequence
atgtacagcgagtggcggagcctgcacctggtgatccagaacgaccaggggcatacaagcgttctgcacagttatccagagtctgttggaagggaagtggcgaatgccgtggtgagacctctgggccaggtgttaggcaccccgtccgttgccggaagtgaaaatcttttaaagacggacaaagaggtgaaatggacaatggaggttatttgctatgggctaaccctaccactggacggagaaaccgtaaagtactgcgtcgacgtttacaccgattggattatggcccttgtgttgcctaaggactctattcccctacctgttattaaggaaccgaaccaatatgttcaaacaattctcaagcatctgcaaaatctgttcgttccaagacaggagcagggctcttcccagattaggttgtgtttgcaagtcttgcgcgcaattcagaagctcgctcgcgagtcatcgctgatggcccgcgaaacctgggaggtgctgctcctattcttgctgcagatcaacgatattctgttggcaccccccacggtgcaggggggtatcgctgagaaccttgctgaaaaactgatcggtgtgttgttcgaggtttggctactcgcctgcaccagatgtttccccacaccaccatattggaagactgctaaagagatggttgccaactggcgccaccatccagctgtggtcgagcagtggagtaaagtgatctgtgccctaacatcgcggctgctgcgttttacatacggccctagcttccctgccttcaaggtccctgacgaggacgcctctctgatccctcccgagatggacaatgagtgcgttgctcagacctggtttagatttctgcacatgctctctaacccagtggacttgtctaaccccgcaattatcagttcaacgcccaagtttcaggagcaatttctgaacgtgagcggtatgccgcaggagctgaatcagtacccttgtctgaaacacttaccacagattttttttcgcgcgatgagaggcatcagttgcctggtggacgcctttctggggatatctagaccccgatcggactcggctccacccaccccagtcaaccgcctcagtatgcctcaatcggccgcagtttcaacaaccccacctcacaataggagacatagggccgtgaccgttaataaggctaccatgaaaacgagtacagtttctacagcccatgctagtaaggtgcagcatcagacatcctcaacttcccctctgtcctcccccaaccagacttcttcagaaccaaggccgctgcccgcccctcgccggccaaaggtcaattcaatcctgaacctgttcggcagctggctctttgacgccgcctttgtccactgtaagcttcacaatgggattaacagagacagcagcatgacagctatcaccacacaggcaagcatggaatttagacgcaaggggagccaaatgtctactgatacgatggtgagtaatcccatgtttgatgcgagcgagtttcccgacaactatgaagccggtcgggcggaggcatgtgggaccctgtgcaggatcttctgctccaaaaaaaccggcgaggagatcctccccgcttacctttcgcggttctatatgttgctcatccagggactgcaaatcaacgactatgtgtgccatcctgttctggcatctgtcattctgaatagtccacctctgttctgttgcgacttgaaaggcattgatgtcgtggttccttactttataagcgccttggaaacaatcttaccggaccgtgagctgtctaagtttaagtcttatgtaaatccaacagagctccgccgaagctctatcaacattctgctttccctgctcccgctgccacatcattttggtacagtcaagtcggaagtcgtactggaggggaaattttcaaacgatgatagtagcagttacgacaaacccattactttcctgtcgctgaagctgagactcgtaaacatactgatcggtgcgctccagacggagaccgaccccaataacacacagatgatccttggagccatgctgaacattgtccaggacagcgctctcctggaggcaattggatgtcagatggagatgggggggggagaaaacaatctgaaatcgcatagccgcaccaacagcggaatcagttccgcctcgggcggtagtaccgagccaacgacacctgattctgaacgtcccgcacaggcactcctgcgggattatgatagcgcagctgggctcctcattagatccatccatctcgttactcagagactcaactcacagtggcggcaggatatgtcaatcagtctggccgcattggaattgctctcaggcctggcgaaagtcaaagtcatggttgacagcggagacagaaagagagccatctcctccgtctgtacatacatcgtgtaccagtgctcacggcctgccccccttcactcccgagacctgcattccatgatcgttgccgccttccagtgcctgtgcgtctggcttacagagcaccctgacatgctggacgaaaaagactgtttgaaggaagtcctcgagattgttgagctgggaatctcagggagcaagagtaaaaacaatgaacaggaagtgaagtacaagggcgataaggaaccaaatccagcttccatgcgggtgaaagacgcagctgaggccacccttacgtgtatcatgcagctgcttggcgcctttccttccccgtctggaccagcctccccatgcagtctggttaatgaaactaccctgattaagtattcaagactccccaccattaacaagcattccttcagatattttgtgctagataattctgtgattctggccatgttagagcaaccactgggaaatgaacagaatgatttctttccttctgtgaccgtgttggtgagaggaatgagtgggaggctggcgtgggcccaacagctgtgcctattacctcggggggcaaaggccaatcaaaaattatttgtgcctgaaccaagaccagtgcccaaaaacgatgtcggattcaaatattctgtgaagcacagaccctttccagaagaggtggataaaatccccttcgtaaaggcggacttatccattccagatctgcacgaaattgtgactgaagagttagaggaaagacacgagaagttaagaagtggaatggcccagcagattgcttatgagattcatctggaacagcagagtgaggaggaattgcaaaaacgaagttttcctgaccctgtgacggactgcaaaccacctcctcctgctcaggagtttcaaacagctcgactattcttgtcacattttggattcctgtctctggaggcattgaaggaacccgcaaatagccgactcccaccccatttgattgcccttgatagcaccatcccggggtttttcgacgacattggctacctcgatctcctgccctgccgccccttcgatacagtctttatattctacatgaaacccggccaaaagaccaaccaagagattctcaagaacgtggagtcttccaggacagtgcagccacactttctggaattcttgctctccttggggtggtctgtcgatgtgggcaggcatcccggttggaccgggcatgttagcacatcctggtctattaactgctgcgacgacggcgagggtagccaacaggaggaggtgattagttctgaggatatcggtgctagtatttttaacggtcagaaaaaggtcctgtattacgccgacgccttgacagagatcgccttcgtggttcctagccctgtcgagtcactgaccgactccttggagtctaacatatcagatcaagacagcgacagtaatatggacctgatgccaggcatcttaaaacagccaagccttacgctggagcttttccccaaccataccgataaccttaatagtagccagcggttgagcccaagctctaggatgagaaaactcccccaggggcgtccggtacctccactcggcccagagactcgagtctccgtggtgtgggtggagcgttacgacgacatcgagaatttcccactttcggaactgatgacggaaatttctacgggagtcgagacaacagccaactctagcaccagcttgcgcagcacaaccttggagaaggaagtccctgtcatattcattcatcccctgaacactggactgttccgtatcaaaatccagggggcaactggcaagttcaatatggttatcccgctcgtggacggcatgatcgtttcacgccgggctctaggctttttggttagacagacagtcattaatatttgtaggcgtaagcgcctagagagtgatagttattccccgccccatgtccgccgcaagcagaaaatcaccgacattgtcaacaaatacagaaataagcagctggagcccgaattctatacaagtctctttcaagaagtgggactgaaaaactgttcaagttag

SEQ ID NO: 50511 - DNA, 3972 bp, Artificial Sequence
  Description of Artificial Sequence: Synthetic coding sequence
atcaacgacatcctgctggccccccccaccgtgcagggcggcatcgccgaaaatctcgcagagaaactgatcggagtcctgtttgaggtgtggctgctggcctgtacgcgctgctttcctacacctccatattggaaaactgctaaggaaatggttgcaaactggagacaccaccctgcggtggtggagcagtggtcaaaggtcatttgtgccctgacctctcggctgctcaggttcacgtacgggccctccttcccagctttcaaagtgccagacgaggatgcaagcctcatcccacctgaaatggataatgagtgcgtggcccagacatggtttaggttcctccatatgctctctaacccagtcgacctcagtaaccccgctattatctcatcgacacccaagttccaagagcaatttcttaatgtgtcaggtatgccgcaagagctgaaccaatacccctgtctaaagcaccttccacagatcttctttcgagctatgagaggaatcagctgtctcgtggacgcgtttctgggtatctcaagaccacgcagtgattcagctccacctaccccagtgaacagactgtctatgcctcagagcgccgctgtatctactacgcctccacacaatcggcgacacagagcagtcactgtgaataaagcaaccatgaaaacttccactgtaagcacggcccacgccagcaaggtgcagcaccagaccagcagcacgtccccactgtccagcccgaaccagacctcctccgagccccgacccctacctgcaccacggagacctaaagtcaatagcatcctcaatctctttggcagctggttgtttgatgccgccttcgtccattgcaaactgcataacggtatcaacagagatagctccatgactgcaattacaacgcaggccagtatggagtttagaagaaagggatcacagatgtccactgacacaatggtttctaacccaatgttcgatgccagcgaattccccgacaactatgaggctggccgagccgaagcctgtggcacactgtgcaggatcttctgctcaaagaaaacaggtgaggaaatcctgccggcctacctcagccggttttacatgttgctaatccagggccttcagattaatgattatgtatgtcacccggtcctggcctccgtgattctgaattcaccgcccctgttctgctgcgatttgaagggcattgatgtggtcgtgccgtacttcattagcgccttggagactatcctgccggacagagagctgtctaagttcaagtcttacgtcaacccaactgaacttaggaggtcctcgatcaacatcttgctgagcctcctgcctctcccccaccacttcggaactgtgaagtccgaagtagtccttgaaggtaagttcagtaacgatgacagtagtagctacgacaagccaatcacctttctgtccctaaaacttaggcttgtgaacatcttgatcggcgctctccaaaccgaaactgacccaaacaatacccagatgatcctaggcgctatgttgaatatcgtccaagattccgcactgctggaggctatcgggtgtcagatggagatgggcggcggcgagaataacctgaagtctcacagccggactaatagcggaatctcatccgcttctgggggcagcaccgaaccgaccacgcctgattcagagagaccggctcaggctctcttacgagactacgcgctaaatacagactcagccgccggactgctgattaggtcgatccacctggtcacccagcgactcaatagccagtggcgacaggacatgtccatctctctggctgcactagagttgttatccggtttagctaaggttaaggtgatggtggattcaggagacaggaaacgagctataagttctgtctgcacatacatcgtgtaccagtgctcaagaccggcaccactgcactctcgcgatctccactcaatgatcgtcgcagcgttccaatgtttatgtgtgtggcttactgaacacccagacatgttagatgagaaagactgcctgaaagaagtattagagatcgttgagctgggcatttcggggtcgaagtccaaaaataacgaacaagaggtgaagtataaaggagataaggaacctaatcctgcttccatgcgtgtcaaagatgctgcagaagccacactaacttgtattatgcagttattaggagcgtttcccagtcctagcggccctgctagtccttgcagcctagttaacgaaaccaccttgattaaatactcgcgcttgccgacaatcaataagcactcgtttcgctattttgtcctggacaatagcgtcattttggccatgcttgaacaaccccttggcaatgagcagaatgatttcttccctagtgtgactgtactcgtgagaggaatgtccggtaggttagcctgggcacaacagctctgtctgctaccacgaggcgctaaggccaaccaaaaactcttcgtgcccgagccacgtccggtgcccaaaaacgatgtgggcttcaagtactctgtcaagcaccggccttttccggaagaggtggacaaaattccctttgtgaaggctgatttaagcatacccgacctgcacgagatcgtaaccgaagaactcgaggagaggcatgaaaagctcaggtctggtatggcacaacaaattgcctacgagatccacttggagcagcagtcagaggaagagctacagaaaaggtcattccctgatccagtgactgactgtaagcccccaccacccgcccaggagttccagactgcacggctgttcctcagtcattttgggtttttgtccctggaagctctgaaggaaccagctaactctcgcttaccaccccatttgatcgctttagatagcactatccccggatttttcgatgacattgggtacttggacctattgccatgccggccttttgatacagtcttcatcttttacatgaaaccaggacagaaaacaaatcaagagatcctcaaaaacgtagagtcgtcaagaaccgtgcagcctcattttctcgagttcctgctgagcttagggtggtccgttgacgtggggcggcatcctgggtggaccggacacgtgtctactagttggagcatcaattgttgtgacgacggagagggctcccagcaggaggaagtcatttcgtccgaggatatcggtgcaagcatcttcaatggtcagaaaaaggtgctgtactatgccgacgcactgactgagattgcgtttgtggtaccctctcctgtggagagccttactgatagcctcgaatcaaacatttcagaccaagactccgatagcaatatggaccttatgcctgggatcctgaaacagcctagtctaacactcgagctgttccccaatcatacagacaacctgaatagtagtcagcgcctctctccgagtagccgtatgagaaagcttcctcaaggcagaccagttcctcccctggggccagaaacgagggtgagcgttgtgtgggttgagcgctatgacgacattgaaaattttcccctgagcgagcttatgaccgaaatcagcaccggggtggagaccacagccaactcatcaactagccttcgcagtacaaccctggagaaggaagtgcccgtcattttcatccaccctctgaacaccggtctgttccgtattaagatccaaggtgctactggaaagtttaatatggtcatccctctcgtggatggaatgattgtgtcccgccgagcgctcggctttctcgtgcgacaaactgtgatcaatatttgcaggcgtaaacgtcttgaaagtgactcatactcaccaccccatgtgcggcgcaaacagaagattacagacatcgtgaataaatatcgcaacaaacaactggaacccgagttttatacctctctgttccaagaggtgggacttaaaaactgcagcagctag

SEQ ID NO: 50512 - DNA, 1434 bp, Artificial Sequence
  Description of Artificial Sequence: Synthetic coding sequence
atgtacagcgagtggcggagcctgcacctggtgatccagaacgaccaggggcacacctccgtcctacatagttatccggagagtgtaggtcgagaggttgccaacgctgttgttcgccccttgggccaggtgctggggacccctagtgtagccggctctgaaaatctgctgaagacggataaggaggtgaagtggaccatggaagtgatctgttacggccttacgcttccgctggatggcgagaccgtcaagtattgcgtggatgtgtataccgattggataatggctctggtcctgccgaaggattccatccccctccccgtcattaaggaaccaaaccagtacgtccagaccatactgaaacacctgcagaatttgttcgtcccacgtcaggagcaaggttcaagccaaattcgactctgtttacaggttctccgggcaatccagaaattagccagggaatccagccttatggcccgcgaaacctgggaagtgctcctgctgtttctcctacagataaatgacattctccttgcacctcctactgtgcaggggggcatcgccgagaacttggccgagaaactcattggtgtgttgttcgaggtctggctgctggcatgcacaagatgctttcctacccctccctattggaaaactgcgaaagaaatggtcgccaattggagacaccacccggctgtggtggaacaatggtcaaaagttatctgtgcacttacatctaggctcctgcggttcacgtacgggccaagcttcccagcctttaaggtccccgacgaggacgcctctctcatccctcctgagatggataatgaatgcgtggctcaaacttggtttaggttcctacatatgctcagtaaccctgttgacctgagtaaccccgccattatcagttctacgcctaagtttcaggagcagttcttgaatgtcagcgggatgccccaggagttaaaccaatacccgtgcttgaaacatctacctcagatattctttcgggccatgaggggtatttcttgcctcgtggatgccttcctgggcatctccagaccccgttctgactccgcccccccgacacccgtgaatcggcttagtatgcctcagtcggcagccgttagcacaacacccccccataatcgacgtcacagggctgttaccgtgaacaaagccacaatgaagacttccacagtctccaccgcacacgcttcaaaagttcagcatcagacatcctccaccagtccccttagcagtccaaaccaaacatctagcgaaccccgcccgctgccagcacctcgcaggccaaaagtgaactctattctgaacctgtttggatcctggctgttcgatgccgcgttcgtgcactgcaagctgcataacggaattaatagagacagttcgatgactgattttacatgcttctag

SEQ ID NO: 50513 - DNA, 2334 bp, Artificial Sequence
  Description of Artificial Sequence: Synthetic coding sequence
atgctgccccggcccctgcggctgctgctggacaccagcccccccgggggagtggtgctgagctctttcagatcccgggatccagaggagggtggcggccctggtggcctggttgtgggaggcggccaggaggaagaggaggaagaagaagaggaagcccccgtgtccgtctgggatgaggaggaagacggcgccgtgttcacggtgacatcaagacagtataggcccctggatccactggtgcccatgccacctccaaggagttcgagacggttgcgcgccggcacactggaagccctggtccgtcacctgctggacacaagaacctcgggtacggatgtgtcatttatgagtgcattcttagccacacacagggcctttacctccacccccgcactcttaggccttatggcggaccgcctggaggcactggaatctcacccaaccgatgaactcgagcggacgactgaggtggcaataagcgtcctaagcacatggctggcttctcacccagaggatttcggctcagaggccaagggacagctggacagactcgagagttttctgctgcaaaccggttacgcagccgggaaaggggtgggaggaggcagcgccgatctgatcaggaatctgcgcagccgcgtagaccctcaagcgccagaccttcccaagcctcttgccctgcccggcgaccctccggcggaccccaccgacgtgctggtgttcttggcagatcatctggctgagcaactgactctccttgatgcggagttgttcctcaatttgattccgagtcagtgtctgggtggcctgtgggggcatcgagaccgtccaggacatagccatctttgcccttcagtacgggcaactgtgacgcaattcaataaggttgctggcgctgtcgtgtcatctgtcctcggcgctaccagcacgggagaggggcctggtgaggtaacaatccggcctctgaggcccccccagagagctcggttgttagagaagtggataagggtggctgaggagtgtaggctgctgaggaatttttcctcggtttacgccgtggtgtctgcccttcagagctctccaattcatcgactcagagctgcatggggggaggcaacacgcgattccctccgcgtattctcttccctgtgccaaatcttcagcgaggaggacaattactcccagagccgagaactcttggtccaggaggtgaaactacaaagcccacttgaacctcactccaagaaagcgcccagatccggaagtagggggggaggagtggtgccctacctgggaacctttctgaaggatctggtgatgctggatgcggcctctaaggatgagctagaaaatgggtatatcaacttcgataagcgcagaaaggaattcgcagttctatctgagctgagacggttgcagaatgaatgccgcggttacaacctccagcccgaccacgatattcaacggtggctccaggggctccggccactcacagaggctcagagtcaccgagtgtcctgcgaagtggagcctcccggaagtagtgaccctccggcgcccagagtcctaagacctacgctggttattagccagtggactgaggtgctgggaagcgttggggtacccacaccactggtgagctgcgatagaccttcaaccggaggcgatgaggcacctacaaccccggcccctcttctcacgagactcgcccagcacatgaagtggccttcagtgtcctcactcgattctgcgctcgagagcagccctagtctgcattcccccgctgacccatcacacctgtccccccccgctagttccccacggccttcccgcgggcatagacgcagtgccagttgtggatcccccctctcaggcggtgccgaggaggcctctggtggtaccggttacggtggtgaaggatctggacccggcgcctcagactgccgtattattagggttcagatggagctcggagaggatggatcagtctataaatctatcctagtgaccagccaggataaggcaccatccgttatcagcagagtgcttaagaagaacaatcgcgattcggccgtcgccagcgagtacgaacttgtgcagctattgcccggggagagggagctgacgatccctgcgagtgcaaatgttttttatgctatggatggggccagtcacgactttttgctgagacagcggcggagatctagcaccgcaactcccggcgtgacatcaggaccttccgcctccggaactcctccctctgaagggggcggaggcagctttcccagaattaaagcaactggccggaaaatcgcacgagccttattctag

SEQ ID NO: 50514 - DNA, 441 bp, Artificial Sequence
  Description of Artificial Sequence: Synthetic coding sequence
atgctgccccggcccctgcggctgctgctggacaccagcccccccgggggcgttgtgttgtcgtccttcagatcccgagaccccgaggaaggaggagggcccggaggcctcgtggtggggggcggccaggaggaggaggaggaagaagaagaagaggccccagtgagtgtgtgggacgaagaggaagatggcgccgtcttcaccgttacctcaagacagtatagacccctggatccattggttcctatgccacccccacgttccagtcggcggctgcgcgcagggacacttgaagcactcgttaggcacctgctcgatactagaacaagcgggactgacgtcagcttcatgtcagccttcctggctactcaccgcgcttttaccagcacccccgccctgttgggacttatggctgaccggttggaagcattggagagctag

SEQ ID NO: 50515 - DNA, 2334 bp, Artificial Sequence
  Description of Artificial Sequence: Synthetic coding sequence
atgctgccccggcccctgcggctgctgctggacaccagcccccccggtggcgtggttttgagcagcttccgttcacgggaccctgaagaaggagggggccccgggggactggtggtcggcggtggacaagaggaagaagaggaagaggaagaagaagcacctgtgagtgtgtgggacgaggaagaagacggcgctgtgttcacagtcactagtcgccaatataggcccctggatcctcttgtgccaatgccaccccctagatcatccagacgcctgcgcgctggaacacttgaagctctggtgaggcacctgctggacacgcgcacttccggtacagatgtttcatttatgagcgcatttctggctacccaccgggcgttcacgtctacgccagcactgctcggcctcatggcagatcggctggaggcccttgagtctcatcccacagatgagctcgagcgaacaacagaagtcgccatcagcgtgctgagcacatggctggcttcccaccccgaggatttcggctccgaagccaaagggcagcttgatcggttggagagctttttgctgcagactggttatgcagcaggaaagggcgtggggggtggctccgcagatctgatcaggaacttgagatccagagtagatccacaggcgcccgatttacccaaacccctggccctccccggggatccccctgctgaccccactgacgtccttgtcttcctcgccgaccacctcgctgagcaacttacacttctcgatgcggagcttttcctgaatctcattccgtctcagtgcctgggtggcctgtgggggcaccgcgaccggccgggacactctcatctgtgccctagtgtcagggctacagttacccagttcaataaggtggccggagctgtggtgagctcagtgctgggcgcaacctccaccggggaagggccaggagaggttaccattaggcctctgcgcccaccacagagggcgcggctgctggagaaatggattcgcgtagcagaggagtgcaggctcctgcggaattttagttccgtgtatgctgtcgtttctgcactacaatcttccccaatccatcgtcttagagctgcatggggcgaggccaccagggactcattaagagtattctcctccctttgccagatcttcagcgaggaggacaactacagtcaatcccgagagctgctggtgcaagaagtgaagctccagtcgcctctggagccccactccaaaaaggcccctcggagtggatccaggggcggcggcgtggtcccatatctcggcacattcctcaaggacttagttatgctggacgccgcctcaaaggatgagttggaaaatggctatataaactttgacaagagacgaaaagagtttgccgtactgagcgagctgcggagactgcagaacgaatgtagaggatacaatttgcagcctgatcacgatatccagcggtggctgcagggcctccgcccactcaccgaggcccagagtcatagagtatcttgtgaggtcgaaccccccgggtcttccgacccgccagcccctagggtccttaggcctactctggttatctcacagtggacagaggttctggggagcgtcggcgtccctactcccctcgtgagctgcgataggccaagcacaggtggggatgaggcacctactactcccgcccctctattaactaggctggcgcagcacatgaaatggccttccgtttcttctttggactccgcattagaaagttcacccagccttcatagtcccgccgatcctagtcacctcagtccccctgcaagctctcctaggccctctagaggccacagaagaagcgcctcgtgcggctctccactgagcgggggcgcagaagaagcgtctggtggaacaggatatggaggggaaggttcagggccaggggccagcgactgtagaatcataagggtacagatggagctcggcgaggatggctccgtgtataaatccatcctggttacgagccaggacaaggcaccgtctgtaatcagccgggtcctgaagaagaataacagggattccgcagtggcctctgagtatgaactggtacagctgctccccggcgaacgggagttaacaatacccgccagtgccaatgttttctacgctatggacggcgccagccacgatttcttgttgaggcaacggcggcggagcagcaccgctacccctggcgtgacaagcgggccttcagccagcggaacccccccttcagaaggagggggcgggtcctttcctagaatcaaagcgaccggcaggaaaattgcccgggctctcttctag

SEQ ID NO: 50516 - DNA, 2334 bp, Artificial Sequence
  Description of Artificial Sequence: Synthetic coding sequence
atgctgccccggcccctgcggctgctgctggacaccagcccccccgggggcgtggtactctctagtttccggagcagggacccggaagagggtgggggccctggtggactggtcgttggagggggccaagaagaggaagaggaggaagaagaggaggcgcctgtttccgtttgggatgaggaggaagatggcgcggtttttactgttacgagcagacaatacaggcccctggatccattagttcctatgcctccacctaggagcagtcgacggctccgtgcaggtacattggaggctctggtcagacacctgcttgacactaggactagcggcacagacgtctcattcatgtcagcctttctggctacacacagagcttttaccagcaccccagcgctgcttggactgatggcggataggctggaggccctggaatcccaccccacagatgagttggagcgcacaaccgaggtagccatttccgtgctgtctacttggctagcttcgcacccagaggattttggcagcgaggcaaagggccagctcgaccgattagagtccttcctgctgcagaccgggtacgcggccggaaagggcgtgggggggggatctgcagaccttataagaaacctgcgctccagggtggatcctcaggcacctgatctccccaagcctctggccctgccaggggatccaccagccgatcccactgacgtcctggtatttcttgccgaccacctggccgaacaacttactctactcgatgccgagcttttcctgaacttaatcccgagtcaatgcctcggggggttgtggggacaccgcgaccggcctgggcattcacacctttgcccatccgtccgagcgacagtgacccaattcaacaaagtcgccggagcagttgttagctccgtgctgggggctacgagtacgggcgagggccccggagaagtcacaataagacctctccggccaccgcaacgcgctcggctgttagagaagtggataagggtggccgaagagtgccggcttctgcgtaatttctccagcgtgtacgccgtggtgtccgctctacagagttctcctattcatcggctgagagccgcctggggggaagcaaccagagacagcttacgcgtattttcttccctttgccagattttctctgaggaggacaactactcacagagtagggaacttctcgtacaggaagttaagctacagtcccccctggaaccccactctaagaaagctccacgttccggatctagaggggggggtgtcgtcccttatctggggaccttcttgaaggatcttgttatgctggatgcggctagtaaggacgagctggagaacggttatataaacttcgacaagcggcggaaagagtttgctgtattatctgagcttcgaagactgcagaacgagtgcagaggttataaccttcagcccgaccacgatattcaaagatggttgcagggacttcgccccttgactgaggctcagtcccacagggttagctgcgaagtagagccccccggttcgagtgatcctccagcccctagggtgctaaggcctaccctcgtgataagccagtggacagaagtcctcgggagtgtcggggtgccgacccccctcgtgagctgcgacagacccagcaccggcggggacgaggcaccgaccactcctgctccacttctgacacgcttagcgcagcatatgaagtggccctccgtgtcttctctggattccgccttagagagttccccttcactccatagcccggctgatccttctcacctcagtccacccgccagcagtcctcgtccctcccgtggtcataggcggagcgccagctgtgggtcccccttaagcgggggcgcagaagaggcctcaggtggcaccgggtacggcggggaaggctcgggaccgggagcaagcgattgccggattattcgagtgcagatggaattaggggaggatggttccgtatacaaatccatccttgtgacctcccaggataaggccccttcggtaatatcccgcgttcttaagaagaataaccgagattccgccgtggctagtgagtacgagctggtccagctgcttcccggcgaaagagagcttacaatacctgcgtcagccaacgtgttttacgcaatggatggagcctcacacgatttcctgcttcggcagaggcgaaggtcttctacagccacccccggagtgacatcaggtccgtccgcttccggaaccccgccgtcagagggagggggcgggagctttcctcgcatcaaggccaccgggcgcaaaattgcgcgggccctgttctag

SEQ ID NO: 50517 - DNA, 1977 bp, Artificial Sequence
  Description of Artificial Sequence: Synthetic coding sequence
atggccgaccggctggaggccctggagagccaccccaccgacgagctggagagaaccactgaggttgccattagcgtgctttccacttggctagcgtctcaccccgaagactttggatcagaagccaagggccagctggacaggttggaatcctttctgctgcagactggatatgcagccggtaaaggagtagggggaggatccgccgatctgatcagaaacctaaggagtcgggtcgatccccaggcgcctgatttgccgaaaccactcgcattgccaggagatcccccagcggacccaactgacgttctggtctttttggccgatcacctcgctgaacaactgacgctgttggacgccgagctgttccttaatctgatcccttcccagtgcctcggtggactgtggggacacagagatcggccaggacattcccatttatgcccgtccgtcagagcgacagtcacccagttcaataaggttgccggggctgtggtgtcttcggtcctcggtgccacgtctacaggtgagggccctggtgaagtcacaatacggcccctgcgacctccgcagagggcaaggttactagagaaatggatccgggtggcagaagagtgtaggctgctgaggaatttctcctcagtgtacgccgttgtgagcgcactgcagagtagcccaatccatcggcttcgggccgcttggggtgaggctaccagggattctctccgggtgttctctagcttatgtcagatcttttccgaggaggataactattcccaatccagggagcttctggtgcaggaggttaagctacagtcccccctcgagccacactcaaagaaagccccccgctctggctctaggggcggtggagtcgttccctacttaggcacattcctgaaagacctggtgatgctcgacgcagcctcaaaggatgaacttgaaaatgggtacattaacttcgataagagacgcaaggaatttgcagtcttatccgagctccgtaggttgcagaacgagtgccgcgggtataatctgcagcctgaccatgatattcaaagatggctccagggccttaggccattaacagaagcgcagagtcaccgtgttagctgtgaggtggagcctcccggatctagcgatcctcccgctcccagagtccttcgcccgaccctggtgatttctcagtggacagaagtgctaggatcagttggcgtgccgacaccgctggtctcctgtgacagaccttccactgggggcgacgaggccccgaccactcccgctccactcctcacacggctggcgcagcacatgaaatggcccagcgtgagtagcctcgacagtgccctggagtcctccccctccctgcactcacccgccgatccaagtcacctgtcacctccagccagtagccctagacctagtcgcggacacaggcgatctgctagttgtggtagtccattatctggcggtgcggaagaggcgagcgggggaaccgggtatggcggcgagggcagcgggccgggcgccagtgactgccgcattatcagggtgcagatggaactaggggaggacggaagcgtgtataagagtatcttggtgacatcacaggataaagctccatcagtcatatcacgcgttctaaaaaagaacaaccgggatagcgcggtggctagcgaatatgagctcgtgcagcttctgcccggtgaacgcgaactgacgattcctgcatcagcaaacgtgttctacgccatggacggagcctctcacgactttttactgcgcggagaggggcctctgctgttgcacctggccagtcccgtcgctagacttccccaggagttgttaagagttcgcgaagagggagcccccttccccggatctcgacctcagggcggacggctccacggccactgctcggaggaggaggctcccctagcttataggtcccacggagtgcacaccagatgcggctag

SEQ ID NO: 50518 - DNA, 441 bp, Artificial Sequence
  Description of Artificial Sequence: Synthetic coding sequence
atgctgccccggcccctgcggctgctgctggacaccagcccccccggcggagtcgtcctgtcctctttcagatcgagggaccctgaagagggtggcggtccagggggtctggtggtcggcggcggtcaggaggaggaggaagaagaggaagaagaggcccccgtgagtgtctgggatgaagaggaagacggagcagtgttcacagttacgagccgccagtacagaccactggaccccctggtcccgatgcccccccctcgatccagtagaagactgcgggccggaactttggaggccctagtcaggcatctcctcgacactcgtacatctgggacagatgtttcttttatgagcgcatttctggcaacgcacagggccttcacctccacacctgcactactaggtctgatggctgaccgcctggaagccctcgagagttag

SEQ ID NO: 50519 - DNA, 441 bp, Artificial Sequence
  Description of Artificial Sequence: Synthetic coding sequence
atgctgccccggcccctgcggctgctgctggacaccagcccccccggcggagtcgtcctgagttcttttagaagtcgggaccccgaggaaggcggcggcccagggggcctagtggtcggagggggacaggaagaggaggaggaggaggaggaggaggctcccgtgagcgtgtgggacgaggaggaagatggtgcggtttttacagtgactagtagacagtatcgaccgttagacccactggtccccatgcctcccccacgcagtagccggcgccttcgcgccgggacactggaagcactggtcagacacctgcttgacacacggacctctgggaccgatgtttcctttatgtccgcttttctggccacccatcgagcttttacaagcactcccgctctgttaggattaatggccgaccgtctggaggcgctggaaagttag

SEQ ID NO: 50520 - DNA, 1383 bp, Artificial Sequence
  Description of Artificial Sequence: Synthetic coding sequence
atgccccccccccggagcagccggcggctgcgggccggcaccctggaagcactcgttcgtcatctcttggacacgcgcacaagtggcaccgacgtcagtttcatgtccgccttcttggctacccaccgggccttcaccagcaccccagcgctgctgggcctcatggcagatagactggaagcccttgaatcccacccaaccgacgagttagagagaaccactgaggtcgcaattagcgtgttaagtacttggcttgctagccatccagaggattttggatccgaggccaaggggcagctggacagactagaatcgtttcttcttcagactggatacgctgctggcaagggtgttggcggaggatcagcagatcttatcaggaacctgcggagtcgggttgacccgcaggcacctgacctgcccaaacccttagctcttcctggcgacccaccagctgaccctactgacgttctagttttcttggccgatcatctggccgaacagcttactctgctcgacgccgagctttttctcaacctcattccctcacaatgcctcggggggctctgggggcaccgggaccgtccagggcacagtcatctgtgcccatccgtgcgggcaacggtgacgcaattcaacaaagtcgcgggcgcagtggttagctcagtattaggagccacttctacgggcgagggtcccggggaggtgaccatccgtccactgagacccccccaacgggcccgcttactggaaaaatggatcagagtggctgaagaatgtagacttctgcgcaacttttcttcagtgtacgccgtagtgtccgccctccaatcttctccaatccacagactgcgagcagcatggggcgaagcgactcgcgattctttgcgagtgttcagcagtttgtgtcagatcttctccgaagaggataactactctcagagtagagaacttttagtacaggaggtgaaactgcagtccccccttgagccacattctaaaaaagctccaaggagtggctctagaggcggcggagttgtaccttatctgggcacattcttgaaagacttagtgatgctagatgccgccagcaaagatgagctcgagaatggttacatcaactttgataagcgtcgaaaggtcagtggggtgtccggactggatgccggcctgccgtacccatgcagccgtaagggaaggggcaaatctcagggaagcctcagtttcgggagctgttcgctgcgggcccccagccaggaattcgctgtgctctccgaactcagacgactccaaaatgagtgtcgaggctataacttgcagccagatcacgacatacagcgatggctgcaggggttgcgacctctcactgaggcgcagcgttag

SEQ ID NO: 50521 - DNA, 441 bp, Artificial Sequence
  Description of Artificial Sequence: Synthetic coding sequence
atgctgccccggcccctgcggctgctgctggacaccagcccccccggcggggtagtcttgtcctcttttaggagccgggatccagaggagggcggaggaccaggaggcctcgtggttggagggggacaagaggaggaggaggaggaagaagaagaagcccctgtgagtgtgtgggacgaagaggaggatggcgccgttttcactgtgacatcacgtcagtacaggcccctagaccctctggtgcctatgccaccaccacggtccagtaggaggttaagggccggaacccttgaggcactggtgaggcacttgttggacactaggacaagcgggacggacgtgagcttcatgtccgccttcctcgccacacaccgggccttcactagcacccctgctctcctggggttgatggccgataggctggaagcactggaaagttag

SEQ ID NO: 50522 - DNA, 2334 bp, Artificial Sequence
  Description of Artificial Sequence: Synthetic coding sequence
atgctgccccggcccctgcggctgctgctggacaccagcccccccggcggggtcgtcctctccagttttcggtccagagaccctgaggaaggaggaggtccggggggtctcgtcgtgggcggggggcaagaagaggaggaagaggaagaggaagaagctccagttagtgtctgggatgaggaagaagatggagcagtgttcacagtgacttcacgccagtaccgccccctagatcctctggtaccaatgcctcccccccggagttcacgcagactgagagcgggtactctggaagctctggttaggcacctgctggatacccggacatctggaaccgacgtgtcatttatgtccgcttttcttgccacacaccgggctttcacttccacacccgcgctgttaggcctgatggcagaccgtctagaggctttggagagtcaccccacagacgaactggagagaacgactgaggtggccatcagcgtcctgtcaacgtggctggcctctcaccccgaagatttcggctccgaagccaagggccagctcgaccgactggagtctttcctgctgcagaccggatacgccgccggcaagggcgtgggcggaggctctgcggatcttataagaaatctcagatctcgtgtagatccacaggcacccgacttaccaaaacctttggctttgcctggcgacccaccagctgatcctacagacgtgttggtattcctcgcagatcacttggctgagcagttaactctcttggatgctgaattgtttttaaacctaatcccaagtcagtgtctaggcggcctgtggggccaccgcgacaggccaggtcactcccatctttgcccttctgtgagggccacagtgacacagtttaacaaggtagcaggagctgtcgtgagtagtgtcctaggggccacctcgacaggggagggtccaggggaggtcacaatcagaccgctccggcctccacagcgggcacgcctcctggagaagtggatccgagttgccgaagaatgccgcctgctgcgcaatttcagctcagtgtacgcagtggtcagcgcactacagtcatctccgattcaccgcttgagagcggcctggggggaagccacccgcgactccctgagagtattcagctccttgtgccagattttctctgaggaggataattattctcaatccagagaacttttagtacaagaggtcaaactgcaatctccacttgagccccactccaagaaagctcccaggtccgggagtaggggaggaggagtcgttccatacctcggcacattcctgaaggacctggtgatgctggacgccgcctccaaggacgaactcgagaacggatacattaattttgataaaaggcggaaagaatttgccgtcctgagcgaactcagaaggctgcagaacgagtgccgaggctataatctgcagcccgatcatgacattcaaaggtggctgcagggtctccgcccactgactgaggcccagtctcacagagtgtcctgcgaggttgagcctcctggcagcagtgatccacccgctcctcgggtccttagacccactctggttatttctcagtggacggaggttttgggaagtgtgggagtgccaaccccgttggtcagctgcgataggccttccacaggaggagacgaggctcccaccacccctgcccccctgctgactcgcctggcacagcacatgaagtggccaagcgtgagtagtctggattccgccttggagtcgtctcccagccttcacagccccgccgacccatcccaccttagccctcccgcatccagtcccagaccatcccgtggacaccgaaggagcgctagttgcgggagccctctgtctggcggtgctgaggaagcctcaggtggaacgggctatggcggtgaggggtccggtcctggggccagcgactgcagaattattcgggttcagatggaacttggagaagacggaagcgtgtacaagtctatccttgtgacttcacaagacaaggctccatccgtaatttcccgggttctcaaaaaaaacaacagggactcggctgtggccagtgaatacgagctggtccaacttctgccaggcgagcgagagctaacaattcctgcctcagccaatgtgttttatgctatggacggagcgtctcacgattttctgctgcggcagcggagaagatcatctaccgccaccccaggcgtgacttctggccctagtgcatccggtacacccccctcagagggcgggggtggatcatttccgcgcattaaggcaaccgggcgcaaaatcgccagggctctgttctag

SEQ ID NO: 50523 - DNA, 441 bp, Artificial Sequence
  Description of Artificial Sequence: Synthetic coding sequence
atgctgccccggcccctgcggctgctgctggacaccagcccccccgggggcgtggtcctctcgtcgttccgatcaagagaccccgaggagggcggaggacccgggggattagtcgttggaggcgggcaagaagaagaagaggaggaggaagaggaagcccctgtgagtgtgtgggacgaggaggaggatggggctgtcttcaccgtcacatcccggcagtaccggcccttagacccattggtccccatgccacccccccggagcagtaggcggctgcgcgcaggaactctggaggctctggtaaggcacctcctcgacacgaggacttccggaactgatgtgtccttcatgtctgcatttctcgccactcatagggcattcacaagtaccccagccctccttggactcatggctgataggctggaagcattagaaagctag

SEQ ID NO: 50524 - DNA, 2334 bp, Artificial Sequence
  Description of Artificial Sequence: Synthetic coding sequence
atgctgccccggcccctgcggctgctgctggacaccagcccccccggcggcgtcgtcctgtcttcgttccgatcgcgagatcctgaggagggaggcgggccgggaggtctcgtggttggagggggacaggaagaggaggaagaggaggaggaggaggctcccgtgtcagtgtgggacgaggaagaagatggcgccgtctttacggttacttcccggcagtataggcctctggaccctctggtccccatgcccccccccaggtccagtaggaggctgcgagctggaacacttgaggctctggtgcgtcacctgctggacactcgcacttctggcacagacgtcagctttatgtccgcttttctggcgacccatagggcatttacgagtacacctgcgctgttgggtttgatggccgacagactggaagccctggagagtcacccgaccgacgaacttgaacggacaactgaagtggctattagtgtgttgtcgacatggctggcctctcatcccgaggattttgggtcagaggctaaaggtcaattggataggctggagagcttcctactgcaaactggctacgctgccggcaaaggagtcggtggaggatcagcagacttgatcagaaacctcaggtcaagggtggatccacaggctcccgacctaccaaaacccctggcattgcctggggacccacctgccgaccccacggacgttctagtcttccttgccgaccacctggcagagcagctgacactgctcgatgcagagttattcctgaacctaattccttctcagtgcctaggcggactgtggggacaccgcgataggccagggcactcccatttgtgtccaagtgtgagagccacagtaacccagttcaacaaggtggctggcgctgtggtttcctccgttctcggagccacctctacaggcgagggacctggagaagtgaccatccgtcctctgaggcccccacaacgagcgagactgctggagaaatggatacgcgtcgcggaggagtgccggctcctcagaaatttcagctccgtgtatgccgtagtgagtgcacttcagtccagccctattcatagactccgggccgcctggggtgaggcgactcgggactcgttaagagtgttttctagtctgtgtcagatattcagcgaagaggataactattctcagtccagagaactgctcgtgcaggaggtcaagttacagtcaccgctggaaccacactctaagaaggccccacgttctggaagcaggggagggggcgtcgtaccataccttggaacatttctgaaagacctggtgatgttggatgccgcatcgaaagatgagctggagaacggatacattaacttcgacaagcgtagaaaagaattcgcagtattaagtgagctcaggcggctacagaatgagtgccgcggatataacctgcagccagaccatgacattcagcgctggttgcagggactgagaccactcacggaagcacagtctcatagggtcagctgtgaggtggagcctcccggcagcagcgatccccccgcaccacgggtgctaagacccactcttgtgatttcccaatggacagaggtcttgggctctgtgggtgttcccacaccgttggtgtcgtgcgacaggccttccactgggggagatgaagcgcccaccacaccagccccactgctgacccgcctggcacagcatatgaaatggccgtccgtgagttctctggactcggccttagagtcatcaccaagcctgcatagtccagctgacccatcacacttgagtccgccagcatcttcaccaaggccttctcgtggtcaccggcgaagcgcttcctgcggatcacccctttcagggggcgctgaggaggcttctggaggaaccgggtatggcggggaaggttctggacctggagcctccgactgtagaataatacgcgttcagatggagcttggcgaggatggttcagtgtacaaaagcatactcgtgacgtcccaggacaaagcaccaagtgtgatctccagggtacttaaaaaaaataatcgtgacagtgccgtcgcgagcgaatacgagctcgttcaactcctgcccggggagcgggaattgactattccggccagcgcaaatgttttctacgccatggatggggcctcccacgacttccttctgcggcagcggcgacggtctagcacggccacgccaggggtaacctccggtccctcagcctcaggcacaccgccctcagagggtggtggcggctcatttcctagaatcaaagccacgggccggaagattgccagggctctcttttag

SEQ ID NO: 50525 - DNA, 1383 bp, Artificial Sequence
  Description of Artificial Sequence: Synthetic coding sequence
atgccccccccccggagcagccggcggctgcgggccggcaccctggaggcgcttgtacggcacctgctggatactagaacctctggcacagatgtgagtttcatgtcagcgtttctcgcaactcaccgcgccttcacatctacccctgcccttctgggcctgatggccgaccgcctggaggccttagagagtcatcccacagatgagctggagcgcacaaccgaagtcgctataagcgtgctttccacgtggcttgcaagccacccagaggatttcggttctgaggccaaaggacagctggataggctcgaatcctttctactccaaaccggttatgcagccggcaagggggttgggggaggatccgcagaccttattagaaatctgcggtcaagggtggatccacaggcaccagatctcccaaagccactggccctgccaggagatccccccgctgatccaactgacgtcctagttttcctagccgatcatctggcagaacagctgaccctgttggatgccgagttgtttttaaacctcatcccgtcacagtgtctcggaggtctctggggacatagggatcgtcccggccatagtcacctctgcccttcagtgcgagcgacagtcacacaattcaacaaagttgctggcgccgtggtctcaagcgtactcggagccactagcactggagagggaccgggggaagtgaccattcggcctctacggccgccgcaaagggcgcgacttttggagaagtggatccgagtggccgaagaatgtaggctcctccgcaatttctcaagtgtgtatgccgtagtaagcgccctccagtcttcaccgatccaccgacttagagctgcgtggggagaggcgacacgcgactccctgcgcgtgttttcatccctgtgtcagatcttttctgaagaggataactattcacaatctcgagagctgttggttcaagaggttaagctgcagagcccattagagccccacagcaaaaaagccccaaggtcaggatcacggggggggggggttgtgccttacctcggcacttttttaaaagacctggtgatgctcgacgcagccagtaaagatgagctggagaacggatacatcaatttcgataagcggcgaaaggtttccggcgtgagcggcctggatgctggacttccatatccttgttcacgaaagggcagaggcaagagccagggctcactttcattcggctcctgtagcctccgggcccccagccaggaattcgccgtgctgagcgaactccgacggctgcagaacgaatgtcgagggtacaacctgcagcctgaccacgacattcaaaggtggttacagggactgaggcctctgactgaagcgcaacggtag

SEQ ID NO: 50526 - DNA, 1977 bp, Artificial Sequence
  Description of Artificial Sequence: Synthetic coding sequence
atggccgaccggctggaggccctggagagccaccccaccgacgagctggaacgcaccactgaggttgcaatctccgtgctgtcaacatggctggcaagccatcccgaagacttcggttctgaagcgaaggggcaactggaccgtttggaatcctttttgctgcagacgggttacgcagccggcaagggcgtaggaggaggtagcgccgacctgatcaggaacttgagaagtcgcgttgacccacaggctccagatctgcccaaaccattagctctgccgggcgatccaccagccgatcccactgatgtgctagtgttcttagctgatcacctcgctgaacagctgacactccttgatgctgaattgtttctgaatctgatcccaagccagtgtctgggtggtctgtggggacatcgggatagacctggccacagtcatttatgcccatccgtacgagccactgttacacaattcaataaagtagccggcgcagtggtatcaagtgtcctgggtgctacctcaacaggagaaggccccggcgaggtcaccatccgacctctacggcctcctcaaagagccagactgctggagaaatggattagggtggcagaggaatgtagactactgcggaacttcagttccgtctacgccgtggtctctgccctccaaagcagcccaatccataggttgagagcagcttggggggaggcaaccagagactcactaagggtgttcagttctctctgtcaaattttttccgaggaggataactactcccaatcaagagaactgcttgtgcaagaggtgaaattacagtctccactggagccacattcaaaaaaggcccctcggtcggggtcacgggggggcggagtagtaccctacctcggaacttttctcaaagatttggtcatgctggacgccgcatctaaggatgagttagagaatggatacattaacttcgacaagcgtaggaaggaatttgcagtcctgtccgagctgcgtcggctgcagaatgaatgtcgggggtataatctccagccagaccacgatattcaaagatggctgcaaggactgaggccactgaccgaggcccagtcccatcgggttagctgcgaggtcgagccccctggttcaagtgatcctccagccccacgagtgctgcgccctacgctcgtaatatcccagtggactgaagtactgggatccgtcggggtccctactccattggtatcatgcgaccgccctagcaccggaggggatgaggctcctactactcctgccccactcctgactcgcctggctcagcacatgaagtggccatctgtgagctcactggactccgcacttgaatcatccccctcactgcacagtcctgctgatccttcacaccttagcccaccggcatcaagccccagaccatcccgggggcacagacgctccgcaagctgcggctcacctctgtcgggcggagctgaggaggcctcaggtgggactggctatggcggggaaggttctggtcccggcgcctcagactgccgtatcatccgagttcaaatggaactgggagaggatggatccgtctataagtccatcctggtgacctcccaggacaaagcaccctctgtgatatcacgtgtgcttaagaaaaacaatcgcgatagtgccgtagcttccgagtatgagctcgtccagctgttacctggagaacgtgagctgactatcccggccagtgcaaacgtgttctatgcgatggatggagctagccatgattttttgcttcgaggtgagggccccctgttgcttcatctggcaagtcccgtcgccagactgccacaggagcttctgcgggtgcgtgaagagggagctcctttccctggatcacgacctcaaggcgggcgcctgcacgggcactgttctgaggaggaggccccattagcttaccggagtcatggagtgcataccaggtgcggatag

SEQ ID NO: 50527 - DNA, 1977 bp, Artificial Sequence
  Description of Artificial Sequence: Synthetic coding sequence
atggccgaccggctggaggccctggagagccaccccaccgacgagctggagagaactactgaggtggccatcagtgtgctgagcacctggctagccagccacccagaggattttggatcagaggctaagggacagctcgatcgcctggaaagttttcttctgcagaccggttacgccgcaggaaagggagttggcggcggctctgccgacctgattcggaatcttaggtcccgggtcgacccccaggctcccgatcttccgaaacccctcgccctccccggcgaccctccggccgatcccacggacgtgctggtcttcctggccgaccacctggccgagcagctgacactactggacgctgagttgttcctaaatctcatcccatctcaatgcctaggtggcctgtgggggcatagggataggcccggccacagtcatctgtgcccaagcgttagagcaactgtgacccagttcaataaggtcgctggcgcggttgtatcctccgtgctcggcgctacctccaccggtgagggtcctggagaggttactatccgccccctgcgtcccccgcagagggctcgcttgctggagaagtggatcagagtggccgaggaatgccgactgttgaggaatttcagcagcgtctatgcggtcgtgagtgcccttcagagctcaccaattcaccggctacgagcagcatggggcgaagctacacgcgacagtctacgcgtgttcagctctctctgccagatattcagcgaggaggataattattcccaaagtcgtgagctgctggtccaagaagtgaagctacaatccccactcgagccacatagcaagaaagcccctcgttcgggttctcgagggggcggcgtagtgccctacctcggcacctttttgaaggatctggttatgcttgatgcggcctcgaaggatgaactcgagaatggctacattaattttgataaaaggcggaaggagtttgctgtgctctcagagcttcgtcgccttcagaacgagtgtcgtggctacaacttacagcccgaccatgacatccaaagatggttacaaggacttaggccactcacagaagcccaatcccacagagtttcttgcgaggttgaaccgcccgggagctcagaccctccagcccccagagtgctgcgccccactctcgtgatttctcagtggacggaagtgttggggtccgtgggggtaccaacaccattagtcagctgcgaccgaccaagcaccggcggcgatgaagctcccaccaccccagccccactcttaactcgccttgcccagcacatgaaatggccaagtgtttcctctttggacagcgccctggagtcaagtccaagcctccactctccggccgacccttcccacctctccccacccgctagttcccctcgtccaagccggggccacagacgtagcgcgtcctgtggatcccctctgtcggggggggccgaagaagcctccggcgggacagggtacgggggcgaaggatctgggcctggggcgagcgactgtcggataatccgcgttcagatggaacttggtgaggacgggagcgtgtataagtcaatactggtgacaagtcaagacaaggccccatccgtcataagccgggtcctgaaaaaaaataaccgggattccgcagttgcaagtgaatacgaactggtgcagctgctccctggagagcgcgagctgactattcctgcgtccgctaatgtgttctacgcaatggacggagcttctcatgactttctcctgcgcggagaaggacctctcctactccaccttgccagccccgtggctagactgccacaggaattactccgcgtcagagaggaaggggcccccttccccgggtccagaccacaaggaggcaggctgcacgggcactgttccgaagaggaggctccgttagcctaccggtcacatggagtacacacaagatgtgggtag

SEQ ID NO: 50528 - DNA, 1977 bp, Artificial Sequence
  Description of Artificial Sequence: Synthetic coding sequence
atggccgaccggctggaggccctggagagccaccccaccgacgagctcgagaggactaccgaggtggctatcagcgttttaagcacctggcttgctagccatcccgaggatttcggctccgaagccaagggtcagctggatcgcctcgagagcttcttgctccagacagggtacgccgctggtaagggggtcgggggcggatcggcagacttaatacgaaatctcaggagcagggtcgaccctcaggcgccagacctgcctaaaccactggctctcccaggcgatccaccggcagatcccaccgacgtgctggtgttcttggcagaccaccttgcagaacaactgaccttgctggacgccgagctgtttctgaatctcatcccttctcagtgtctaggtggcctatggggacaccgcgaccgacctggtcactctcacctgtgtccgtctgtgcgagcaactgttacgcagtttaataaagtcgctggggctgtggtgtcatccgtgctgggcgccacttccactggcgagggccccggcgaagtaactatacgcccactgaggcctccccaaagggccagactgcttgaaaagtggatcagagtagctgaagaatgccggttgttgcgcaattttagctccgtttacgctgtcgtatcagcactacagtcctccccgattcatcgtctgcgcgcagcgtggggcgaagctacaagagacagtctccgtgtctttagcagcctgtgccagatcttctctgaagaggacaactacagccagagtcgtgagctgctggtgcaggaggtgaaattacagagcccgctggagccccactctaaaaaagccccacgttccggaagtcgcggaggtggagtcgtaccttatttgggaacctttcttaaagatctggtaatgctcgacgctgcaagcaaggacgagctcgaaaatggatacatcaattttgacaaacggaggaaagaatttgctgtgttatcggagctccggcgtctgcaaaatgagtgtagaggttacaatctgcagcctgaccatgatatccagaggtggttgcaagggttgaggcctcttaccgaggcacagtcccaccgggtcagctgtgaagtggaaccgccaggttccagcgacccccccgcacccagggtcctgaggcctacccttgtgatttcacagtggaccgaagttctggggagcgtgggggtgcctacccccctcgtgtcgtgcgatcggcccagcaccggcggcgatgaagccccaaccacacctgccccactgttaactaggctggcgcaacatatgaaatggcccagcgtatccagtctggatagcgctttggagtcctcccctagcctgcacagccccgctgatcctagccatctgagcccacctgcctccagccctcgaccttcccgcgggcaccgtagaagcgcaagctgtggatctccactgtccggaggcgccgaagaagccagcggcggaactgggtacgggggagagggctctggccctggcgcctctgactgccgcattattcgcgtccagatggaacttggcgaggacggaagcgtgtacaaatccatcttggtcactagccaagataaggcaccatcagtgatttcccgcgtgctaaaaaagaataatagggatagcgccgtggcgtctgagtatgaactggtgcagctcctgcctggcgagagggagctgacaatccccgctagcgccaacgtgttttacgctatggatggggccagccatgacttcttattgcgcggcgagggtcctctgctattacatctcgcctcccctgttgcacggctaccacaggagcttctgcgcgtgcgggaagaaggggctcctttccctggcagtagaccccagggcggccgcctccatggacactgtagcgaggaagaggcaccactggcttatcggagccacggagtccataccagatgcggatag

SEQ ID NO: 50529 - DNA, 1977 bp, Artificial Sequence
  Description of Artificial Sequence: Synthetic coding sequence
atggccgaccggctggaggccctggagagccaccccaccgacgagttggagaggaccaccgaggtcgccatctcagttctcagtacttggcttgcatcccaccctgaagactttgggagcgaggccaaaggtcagctcgacaggttagagtcttttctgttgcaaactgggtatgccgccggaaaaggtgttggtgggggctctgccgaccttattaggaacctgcgaagcagagttgatccacaggctcccgatctgccaaaacctctggcgttaccaggagatccacccgctgaccccacagatgttctagtgttcctggcggaccatctcgcagagcaactcaccctgttagacgctgagctgtttctaaacttaattccatctcagtgtctcggcggcttatgggggcaccgggatcgacctggtcactcccacctctgtccctccgtgcgcgctaccgtgacacagttcaacaaagtcgcaggagctgtcgttagttcagtactgggcgcgaccagtaccggagaaggcccaggagaggtaacaataagacctctgagacccccacagagggctaggctgctggagaagtggatcagagttgccgaggaatgtaggttgctcaggaacttctcatctgtttatgccgtggtatctgccctccagagcagtcctatccataggctgcgcgcagcttggggggaggctacccgcgattcactccgggtgttttcctccctgtgccagatcttttctgaagaggataactactcccagagccgggaactgttggtccaagaagtaaaattacagagtcccctggagccacattccaagaaagcacccagatccggctctcgggggggcggggtcgttccttaccttgggaccttcctcaaggatctagtcatgctggacgccgcaagcaaggacgagctcgaaaatgggtacatcaacttcgataagcgtcgcaaagaattcgccgtgctctccgagctgagacgcctacagaatgaatgtagagggtataaccttcagcccgaccatgatatccaaaggtggctgcagggactgcggccccttactgaagcccagtcacatagagtgagttgtgaagtggagccacctggttcttcagacccgcctgcaccccgtgtcctgaggcccaccctcgtgatatcacagtggacagaagtgctcggcagcgtcggagtgcccaccccattagtctcatgcgaccgaccctcgacaggcggagacgaggcaccgactacaccagcacccctgctgacgcgcctcgcccaacatatgaagtggccttccgtcagctccctcgattctgcgctagaaagttccccatcccttcactccccggccgacccgtcccacctttcaccccccgcttcctcccccaggccctcccgaggtcaccggcgctccgcctcctgcgggtcgccacttagcgggggtgccgaggaagcctcgggaggcaccggatacggcggcgaaggctctggtccaggagccagcgattgccgtatcattcgcgtccagatggagctgggagaagatggatccgtctataaatctattttagtgaccagtcaggacaaggccccaagtgtgatttctcgcgtgctaaaaaaaaacaatcgcgacagcgcggttgcttccgagtacgagcttgtccagctcctgcctggagagcgggaattgacgatacccgcttctgctaacgtcttctacgctatggacggtgcctcacatgatttcctgctgcgaggagagggacctctgttgttgcacttggcctccccggtggctcgacttccacaagagttactccgagtgagggaggagggggcacctttcccaggcagtagaccacagggcgggcggctccatggtcactgttcagaagaggaggccccattggcttatcgatcacatggcgtacatacccggtgcggatag

SEQ ID NO: 50530 - DNA, 1383 bp, Artificial Sequence
  Description of Artificial Sequence: Synthetic coding sequence
atgccccccccccggagcagccggcggctgcgggccggcaccctggaggccctggtgcgacaccttctggatacacggacctcaggtaccgacgtttcctttatgtcagcttttctggctacccaccgggcctttacgtccacccccgcactactagggctgatggccgaccgattggaggccctggagtcacaccccacagacgagcttgagagaacaactgaagtagcaattagtgttttaagcacgtggctcgcctcacacccagaagattttgggtcggaagctaagggacagctggatagactggagtccttcctgcttcagacgggttacgccgctgggaagggagtgggcggggggtcagcggaccttattaggaacctccgatccagggttgacccccaggccccagaccttcccaaacccctggctctcccgggagacccacccgctgatccaacggatgtcctggtattcctggcagatcatcttgccgaacagctgacgctactcgacgctgagttgtttctgaacttgatcccctcccagtgtctgggaggactctgggggcaccgggataggccggggcatagtcacttgtgccctagcgtgagggctacagttacacagtttaataaagtcgctggggctgtcgttagctccgtgctgggggcaacatccacaggggagggaccgggagaagttacaatacgtcccttgcgtcccccccagagggctcggctgctggaaaagtggatcagggtggcagaggaatgtagactcctccgtaatttttcgagtgtgtacgcggtggttagtgctttgcagtctagtccaattcatagattaagagcggcctggggtgaggctactagggattcactgcgggtatttagctctctctgtcaaatcttctcagaagaggacaattatagtcagtctcgggagctcctggtccaggaggtgaagcttcaatctcccctcgagccccacagtaagaaagcccccagaagcggatcccgaggcggcggcgtcgttccatacttaggcacattccttaaggatctggtgatgttggatgccgctagcaaggacgagcttgagaatggttatattaattttgataagcgacggaaggtatccggggtgagtgggcttgacgccgggcttccttacccctgttcccggaagggtcgcgggaaatcccaggggtcgcttagctttgggagttgttcactgcgcgcaccttctcaggaattcgctgtgctatcagaactgaggagactgcagaatgagtgtcgtgggtacaatcttcaacccgaccacgatatacagagatggcttcagggattgcgccctttgaccgaagctcagcgctag

SEQ ID NO: 50531 - DNA, 1383 bp, Artificial Sequence
  Description of Artificial Sequence: Synthetic coding sequence
atgccccccccccggagcagccggcggctgcgggccggcaccctggaagcattggtgcgacacctgctggatactcgaacctcaggcactgatgtgtcatttatgtccgcctttcttgcaacccatcgtgcattcacaagcactcctgccttgcttggactcatggctgacaggctcgaggcgttggagtcacaccccacggatgaactcgagagaactaccgaggtggcaatttccgtgctgtctacatggttggcctctcaccccgaggattttgggagtgaggccaagggtcaactggatagactggaatccttcctactgcaaaccggatacgccgccggtaaaggcgtgggtggaggatccgccgatctgatccgcaacttgagaagccgggtggaccctcaggcacccgatcttcctaaacctctcgcgctcccaggagacccaccagccgaccccacagatgttctcgttttcctcgctgaccacctagccgaacagttaacactgctggacgctgaactgtttctgaatctgatcccgtctcaatgcctaggaggattgtggggtcaccgcgatcggccgggacactctcatctctgccctagcgttcgcgccaccgtgacacagtttaacaaggtggctggcgcagtggtgtcctcggtactgggggccacctccactggtgagggcccaggggaagtgacgatacgcccccttaggcccccgcagcgcgccagactcctcgaaaagtggatcagggtcgccgaagagtgtaggctcctgcgtaatttctcttctgtatatgctgtggtgtctgcgttacagtctagtcccatccacaggctgagagccgcatggggggaagcaacaagagacagcctcagagtgttttcatccttgtgccagattttcagcgaggaagacaactacagtcagagcagggagctattggtgcaggaagttaagctgcagagcccactcgagccacactcaaagaaggctcccagaagcggatctcggggtgggggagtcgtcccctacctgggaactttcctcaaggacctggtaatgctggacgcagcatcaaaagatgagctcgaaaatgggtatattaatttcgacaagcgaaggaaggtgtccggcgtctcaggcttggatgccggattaccctatccttgttctagaaaggggcggggcaaatcccagggcagcctgtccttcgggtcatgctccctgagagccccctcacaagaatttgccgtgctcagcgaattaagaagattacaaaatgagtgccgtggatataacctgcagccagatcacgacatccagaggtggttacaaggtctgagaccactgacggaggctcagcgctag

SEQ ID NO: 50532 - DNA, 1383 bp, Artificial Sequence
  Description of Artificial Sequence: Synthetic coding sequence
atgccccccccccggagcagccggcggctgcgggccggcaccctggaagcgttggtccggcatctattggatacaaggacatcgggcacagatgtgtcttttatgtctgccttcctggctacccatcgggcattcacttccacacctgccctcctgggattgatggccgaccggctagaggcgctcgagagtcatccgacggacgagctggagaggacaactgaggtcgcgatctctgtgttaagcacctggctggctagtcatccggaggactttgggtctgaggcgaaaggtcagctcgacaggttggagtcctttttgttacagaccggatatgccgcgggcaaaggagtcggcggcggatccgcagatctaattaggaacttgcggagtagagtagacccccaagcccccgacctgccaaagcccctcgcattaccaggggatcccccggcagatccaactgatgtgctggtatttctcgcagaccatctcgccgagcagctcaccctgctggacgctgagctgttcttgaatttgattccatcgcaatgtctcggcggactgtggggtcacagggatagacctggacactcacacttgtgcccatccgtgagggctaccgtcactcaattcaataaagtagcgggcgccgttgtgtctagcgtgttgggggcaaccagcaccggagagggccctggggaggtgacaattcggcctctcagaccaccccaaagagcccgcctcctagagaaatggattagggtagcagaggaatgcaggctgctcaggaacttttccagcgtatatgccgtggtgagcgccctgcaatcatcccccatccatagacttcgcgccgcgtggggagaggctactcgagacagcctccgcgtgttcagttcgctgtgtcaaatttttagtgaagaggacaattactcacagagccgagagctgctggtacaggaggtcaagctccaaagcccattagaacctcactcaaaaaaagctcccaggtctgggagtagaggtggcggagttgttccttatctgggcactttcctcaaggatcttgtcatgctagacgccgctagcaaggatgagttggaaaatggatacatcaactttgacaagagaaggaaggtttcaggagtgtccggactggacgccgggctgccgtatccgtgtagcaggaagggtcgcggcaagtcccaggggtctctgagttttgggtcttgcagtttgcgggctccttcgcaggagtttgcagtgctcagcgagttgcgccgtcttcaaaatgagtgtagaggatacaatctccagcctgaccacgacatccagagatggttacaaggactacgtccgctgaccgaagcccagcggtag

SEQ ID NO: 50533 - DNA, 1494 bp, Artificial Sequence
  Description of Artificial Sequence: Synthetic coding sequence
gcccgggccggccggggcgccgccagcggccccccccgggtggcccagaccagtgaccctgacagtagtgaggcctgcgctgaagaggaggaagggctcatgccccaagggccacaactcttggacttttctgttgatgaggtggcagagcagttgaccctcattgatctcgaattgttctccaaggtgcgcctctacgagtgcttgggcagtgtgtggtcccaacgtgaccgacccggcgcagctggcgccagccccacggtcagagcaactgtggcacagttcaatacagttaccggctgtgtcttaggaagcgttctgggggctcctgggttggccgcaccccagagagctcagaggttggagaagtggatccggattgcccagcgctgcagggagctgagaaatttttctagccttcgcgctatactcagcgccctccagtcgaacccgatctatcggctcaaacgcagctggggagccgttagccgcgagcctctcagtacattccgcaagctgtcccagattttttctgatgagaataaccacctctcatccagggagatcctgtttcaggaggaggcgacggaaggttctcaggaagaggataatacacctggatcactgccctctaaacccccccccggtccggtgccatacctaggaaccttcctgactgatcttgtaatgcttgacaccgcgctccctgatatgctggaaggcgacctgatcaactttgaaaagcggaggaaagaatgggaaattctggctaggatccagcagctgcagaggaggtgccagtcttatacattatcccctcatcctcccattctggcagctctgcatgcccagaatcagctgaccgaggagcagagctaccgcttgtcccgcgtgatagaaccacccgcagcaagctgcccctcctccccgcggatccgaagacgtatctccctcactaaacgcctgtccgctaagcttgctcgagagaagtcgagttcacccagcggcagcccaggggacccctcgtctcctaccagcagtgtgagtccaggatcgccaccatctagccccaggtctagggatgcacccgccggctctccccctgctagtccgggtcctcagggacccagtacaaagttaccactctcactggatctaccgagtccccggcccttcgcgttgcctctgggctcccctagaatacctctgcctgcccagcagtctagtgaggctcgcgttatccgcgtgtcaatcgacaatgatcatggcaatctgtaccgcagcatcctgctgactagtcaggataaggcgccttccgtggtcagacgggccctccaaaagcacaatgtccctcagccatgggcgtgtgactaccagctgttccaggtcttgcccggagatcggggttgggaggaaatgctgattagcgctattaagtcggttggaactttctttggcatgtttgctatgtgccaagcgcgtttctaccggtag

SEQ ID NO: 50534 - DNA, 2133 bp, Artificial Sequence
  Description of Artificial Sequence: Synthetic coding sequence
atggagcggaccgccggcaaggagctggccctggcccccctgcaggattggggagaggagacagaagatggcgcggtatattctgtgtcgttgaggcggcagcggtcgcagcgaagatcccctgcggaaggccccggcggctctcaagcaccctcaccaatcgcgaatacctttctgcactaccgcacatccaaagtgcgggttctccgcgcagcgcggttggagcggctagtcggtgagctggtgttcggcgatcgagagcaagacccatcatttatgcccgcttttctggcgacttatcgaacgttcgtgccaactgcctgcctgctgggatttcttctcccccccatgccaccaccacccccaccgggcgtggaaatcaaaaagactgcagtgcaagatctctcattcaacaagaacttgcgggccgtagtctctgtgctgggcagttggctccaggatcatccgcaggacttcagggacccccccgcacatagtgacctcggcagcgttagaacttttttggggtgggctgctccaggaagcgctgaggcccagaaggccgaaaaactgcttgaagacttcctcgaagaggccgaaagggaacaggaagaggaaccaccccaggtctggacggggcccccccgagtcgcccagacgtctgatcccgattcctctgaggcctgcgctgaagaggaagaagggctaatgccccagggcccccagctcctggacttcagcgtggacgaagtggccgaacagctgacacttatcgatctcgaattattctccaaggtaaggctttacgaatgtctggggtcggtgtggtcgcagcgcgacagaccaggcgcagccggggcttcccctaccgtgcgcgcaactgtggcacagttcaacaccgtgacaggctgcgtcctgggaagcgtcctcggagctccaggcctggcagcgccacagagggcacagagactcgaaaagtggattcggatcgcccagcgttgccgtgagctgcgcaatttctcctcgctgcgggcaattctatctgctctacaatctaatccaatataccgcctgaaaaggagctggggggcagtgagtcgtgaaccactgagcacattcaggaaattgtcacagatcttttctgacgaaaacaaccacctctcaagcagagagatcctattccaagaagaagccactgaaggctcgcaagaggaggacaatactccaggatccctgccaagcaaaccaccccctgggcccgtaccttacctcgggactttcctgaccgatctggtcatgctagacactgcgctcccagacatgctggaaggagacttaattaattttgagaaacggcggaaagaatgggagattttggcccgaatccagcagttgcagcgcaggtgtcagtcctacaccttgtctccccaccccccaattttagctgcacttcatgcacaaaatcagctcaccgaggagcagtcctaccgcctgtcacgcgtgattgaaccacccgcggcatcctgcccatcctctccgaggattaggaggaggataagcctgactaagcgcttaagtgccaaattagctagggaaaaatcttcctcccctagtgggtcaccgggggaccccagctcgcccacttctagcgtttcccctgggtcaccaccttcatcaccccgctctcgggacgcacccgccggctcccctccggccagccctggcccacagggcccttccaccaagttgccactctcactggatcttccttcacctaggcctttcgcactccctcttggcagccccaggattccgttgccagcacagcagtccagtgaggcaagggtgatccgcgtgtcaatcgacaatgaccatggcaatctgtacaggtccattctcctcacctcacaggacaaggccccttccgtcgtccggcgggcgctgcagaagcacaacgtacctcagccttgggcgtgtgattatcagctctttcaggtgctgcctggggatcgggtcctgttgataccagataacgccaatgttttctatgccatgagccccgttgccccacgagactttatgctgcgacggaaagaggggactcgaaacaccctctcagtgtcccccagctag

SEQ ID NO: 50535 - DNA, 2151 bp, Artificial Sequence
  Description of Artificial Sequence: Synthetic coding sequence
atggagcggaccgccggcaaggagctggccctggcccccctgcaggactggggagaagagaccgaggatggtgcagtgtattctgtgtctttgaggcggcagcgctcccaacggaggagcccagccgagggtccaggggggtcacaagcaccatcccccattgcaaatacattcctgcattataggaccagcaaagttcgggtcttgcgggccgcgcggcttgagcgcctagtgggcgaactcgtctttggggacagggagcaggaccccagctttatgcccgcttttttggccacttatagaaccttcgtgcctacagcatgcttgctcggtttcttgctccctcccatgcccccaccgccccccccgggtgtggaaatcaagaagacagccgtccaggacctgtcctttaataagaatctgagagccgtggtgtctgtcctaggatcctggctgcaggatcacccacaggactttagggatccaccggcccattctgatctcgggtcagtccggacctttcttggatgggcagcaccaggctccgctgaagcgcagaaagctgagaagttactcgaagatttcctcgaggaggctgagcgagaacaggaagaggaaccaccgcaggtatggaccggaccgcctcgagtcgcccagacaagcgatcccgacagcagcgaagcctgtgccgaggaagaagaggggctgatgcctcaaggcccccagctgctggacttttccgttgatgaggtcgccgagcaactgacgcttatcgatctggagttgtttagcaaagtgcggctctatgagtgcctaggatccgtctggtcacagcgcgaccggcccggggccgctggagcatccccaacagtccgggcaaccgtggcccagttcaacaccgtgaccggctgcgttctcgggtccgtgttgggcgctcccgggctcgcggcaccccagcgagcacagcgattagaaaagtggataaggatcgcgcagcggtgccgggaactgagaaactttagtagcctgcgggctatactgtccgctctgcaaagcaatcccatttataggctcaaacggtcgtggggagctgttagccgtgaacctcttagtacttttcgcaagcttagccagatcttttccgatgagaataatcacctaagctctcgggagattcttttccaggaggaagcaacagaaggatcacaggaggaagataatacgcccggctctctgcccagtaagccaccacctggacctgtgccatacctggggaccttccttactgatctcgtgatgttggacaccgcgctgcctgacatgctcgagggcgatctgattaatttcgaaaaacgacgcaaggagtgggagattctagccaggattcagcagttgcagaggcgctgtcagtcatacacactgtccccacacccgcccatactggcggcactacacgcacaaaaccagctgaccgaagagcagagctaccgtctctcccgagttatcgagccccccgccgcatcctgcccttcctcccctcgcattcggaggaggatcagcctcacgaagaggctgtcagcaaagctggccagggagaaatccagctcccctagcggcagccccggcgaccccagctcacctaccagttctctgtgcattagtccatcagtcagccccggttcacctccaagctctccgcggtctcgtgatgcccccgcaggctcgccccccgccagccccggcccacaaggaccctcaaccaagctgccactgtccttggacctcccatcacctaggccttttgctctacccctgggctccccccgcattcccctcccggcacaacagagctctgaggcccgggtgatcagagtatccatagacaacgaccacggcaatctctacaggtcaattcttctgacatcccaggacaaggcaccatcagtcgttaggcgagctctgcaaaaacacaacgtcccgcagccatgggcctgtgactatcagctgttccaagtgcttccgggtgaccgggtcttactgatcccggacaatgcaaatgtcttctatgccatgagccccgtcgcacccagagatttcatgctgcggagaaaggaaggcaccaggaacactctcagcgtgagcccgtcatag

SEQ ID NO: 50536 - DNA, 813 bp, Artificial Sequence
  Description of Artificial Sequence: Synthetic coding sequence
atggagcggaccgccggcaaggagctggccctggcccccctgcaggattggggcgaggagaccgaggacggcgcagtgtattctgtctcattgcgccggcagcggagtcagaggcggtcacctgctgaggggcccggaggcagccaagccccctctccaatcgctaatacattcctgcactataggacctctaaggtaagagtgttgcgggccgccaggctcgaacggctggttggtgaacttgtattcggagacagggagcaggacccaagtttcatgcctgcctttcttgccacataccggacattcgtccccacagcttgtcttctgggctttctgttacctccaatgcccccccctccaccccctggtgtggaaattaaaaagaccgcagtgcaggatctgagtttcaacaagaatctgagactgttccgtggattacgcggcggtcgtggtagggcacacgcttctcggtcccctgccccaggcctgcagaggggccgtggaggccgagctgccgatccacatcgactgggggccctgttgcagggggaggcacttagagtgctagggctgagggtcgtggccgaggggcctgctgggggctgtaggcgcttacctcactgtgccagacatagaggccccgtccagcatcgagatcgcctctgcgccgggtttcgtgctcgttcaaccggactgggcaggcctgccgaaggtgcagccgcaggagaggtggatccgcatcgccccgctctgccccggactgctgaactcctcctgctggcacggcaccctgtgcggcccgccatctag

SEQ ID NO: 50537 - DNA, 258 bp, Artificial Sequence
  Description of Artificial Sequence: Synthetic coding sequence
atgaccggcaagacccagaccagcaacgtgaccaacaagaacgaccctaagagcatcaattcccgcgtcttcatcggcaacctgaacaccgccatcgtcaaaaaggtcgatatcgaagccatcttctccaagtacggaaagatcgtgggttgttcggtgcataagggttacgcatttgttcagtacatgagcgagagacatgctcgagctgccgtggccggtgaaaatgctcgagtcatcgctggacagcccctgtag

SEQ ID NO: 50538 - DNA, 876 bp, Artificial Sequence
  Description of Artificial Sequence: Synthetic coding sequence
atgaccggcaagacccagaccagcaacgtgaccaacaagaacgaccccaaaagcatcaactcacgagtgttcatcggcaatcttaacaccgccattgtcaagaaggttgacatcgaagccattttcagcaagtatggaaaaattgtcggttgttccgttcataaaggttacgcctttgtccagtacatgagcgagcggcacgcaagagcagccgtggcgggagagaatgcaagagtgatagcggggcagccactagacattaacatggccggcgaaccgaaaccctatcgcccaaaaccagggaataaacgtcctctcagcgcactctaccgactcgagtctaaagagcccttcttgtctgtagggggttacgtcttcgactacgactactaccgggatgacttctataatcgtcttttcgactatcacgggcgcgttcctccaccaccgagagcagtcatcccactgaaaaggccacgagttgccgtgaccacaacccgtcggggaaaaggagtcttttctatgaaaggcggctccagatctactgccagcggaagcactggcagcaaactcaaaagcgatgaactccagaccatcaaaaaagagctgacgcagattaagaccaagatagatagcctgctgggacgactggaaaagattgagaagcagcaaaaggcggaagcagaggctcaaaagaagcagttggaggagtctttggtgcttattcaggaggaatgcgtgtctgaaatcgcggaccacagtaccgaggagcccgcagaaggcggccctgacgctgacggggaggagatgacagacggtatcgaagaggacttcgacgaggatgggggccacgagctctttctgcagatcaagtag

SEQ ID NO: 50539 - DNA, 876 bp, Artificial Sequence
  Description of Artificial Sequence: Synthetic coding sequence
atgaccggcaagacccagaccagcaacgtgaccaacaagaacgaccctaagagcataaactctagagtgttcatcggaaatctgaacacggccatagtcaaaaaggtggacattgaggctatcttctctaagtacggcaaaatcgtggggtgttcggtccacaagggctacgctttcgtgcagtatatgtctgagcgtcatgcccgggccgcggtagccggcgagaatgctcgcgtgattgcaggtcagccattggacatcaatatggccggggagccaaaaccctaccgccctaagcctggaaataaacgcccgctgagcgcgctgtatagactagagtctaaagaaccctttctttcagtcggcggctatgtgtttgactatgattattaccgcgacgatttctacaacagattgttcgactaccacggcagagtgcctccccctcctcgggccgtgatccccctgaagcggcctcgggttgctgttacaacaacccgcagagggaaaggtgtcttctctatgaagggcggaagccgtagcacggccagcggctccactggcagcaaactgaaaagcgatgagctccaaaccatcaaaaaggaacttacccagattaaaaccaaaatcgactcactgctgggacgactggaaaagatcgagaaacagcagaaagcggaagcggaggcacaaaagaagcagttagaagagtccctagtcctcatccaggaagagtgcgtctcagagattgccgatcactcgactgaggaaccggccgagggtggaccagatgccgatggtgaagaaatgaccgatggaatagaggaagactttgacgaggacggagggcacgaactctttctgcagattaaatag

SEQ ID NO: 50540 - DNA, 876 bp, Artificial Sequence
  Description of Artificial Sequence: Synthetic coding sequence
atgaccggcaagacccagaccagcaacgtgaccaacaagaacgacccaaaatccatcaactcccgggttttcatcggaaatctcaatactgccattgtaaaaaaggttgacattgaagcgatcttcagcaaatacggaaaaatagtaggctgcagtgtacataaaggatatgcttttgtccagtacatgagcgagcgccacgctagagccgccgtcgctggcgaaaacgcaagagtgatagccggccagccactagatatcaatatggccggcgaacccaagccatatcgtccgaaacctgggaataaacgccccctatcggctctttacaggctcgagtcaaaggagccatttctgtccgtcggaggttatgtcttcgattatgactattaccgggacgacttctataacagactgttcgattaccacggcagggtgccacctcccccaagagcggtaattccactcaagagacccagagttgccgtgacgacaacacgaaggggaaaaggagtgtttagcatgaaaggcgggtcaaggtccactgcctccggcagtaccggctccaagctgaagtccgacgagctgcagaccataaaaaaggagttgacccaaattaaaacaaagattgattcgctgctgggacgtctagagaagatagagaagcagcagaaggctgaggccgaggcccagaaaaagcagctggaagaaagcctggtcctgattcaggaggaatgtgtgtccgagattgcagaccacagcacggaggaaccagccgaaggcgggcccgacgcagatggtgaggagatgactgatgggattgaagaagactttgatgaggacgggggacatgagttgtttttacaaatcaagtag

SEQ ID NO: 50541 - DNA, 258 bp, Artificial Sequence
  Description of Artificial Sequence: Synthetic coding sequence
atgaccggcaagacccagaccagcaacgtgaccaacaagaacgacccgaaatctatcaacagtcgcgtcttcattggcaacttgaacacagccattgtgaagaaagtcgacatcgaggctatttttagcaagtacggtaaaattgtcggctgctctgtgcataagggatacgccttcgtccagtacatgtctgagcgccatgctcgtgccgctgtggccggagagaatgcccgcgtgatcgctgggcagccgctctag

SEQ ID NO: 50542 - DNA, 657 bp, Artificial Sequence
  Description of Artificial Sequence: Synthetic coding sequence
atgaccatgtacaagagcaagcggcggcaccagcggtacatcaacatggccggtgagcctaagccctaccgtccaaagcccgggaacaagagaccactttctgccttgtaccggctggaatccaaagagccttttctgtccgtgggaggatacgttttcgattatgattactaccgcgacgatttctataacaggctgtttgattaccacggacgagtgcctcccccacctagagcagtgatccccctcaaaagacctcgcgtggctgtaaccactaccaggcgcggaaagggcgttttctcgatgaagggtgggtctcgcagcactgcctcgggctccacaggctctaaattaaagtcagacgagttacagacaataaagaaagagctcactcagatcaagaccaagatagatagtttgttggggaggctagagaagatcgagaaacagcagaaggctgaagccgaggcccagaagaaacagttagaggagtccctggttcttatccaagaagagtgcgtgagcgagatagccgaccatagcacagaggagccagccgaaggtggccccgatgcagacggcgaagagatgacagatgggatcgaggaagattttgatgaggacggcgggcatgaactgtttctgcagataaaatag

SEQ ID NO: 50543 - DNA, 1986 bp, Artificial Sequence
  Description of Artificial Sequence: Synthetic coding sequence
atgaagcccctggagaagttcctgaagaagcagaccagccagctggccggtcggaccgtagctgggggccccggagggggactcgggtcatgcggcggacctggggggggaggaggtcctggcggaggtggcgggccagccggcggccagcgttcactgcagcgcaggcagtctgtctcacggctgttgttgcccgccttcctccgcgaaccgcccgccgagcccggcctggagcctccacctgaggagggcggggaacctgcaggtgttgccgaagagcccggctcgggcggcccatgctggctgcaacttgaggaggttcccggtccaggccctctgggaggtggcggccctcttcggagtccttcatcctactcctcagatgaacttagccccggagaacccttgacatcccccccatgggctccactaggcgcccctgagcgacccgagcacctcttaaatcgcgtgctcgagagacttgcagggggagcaacacgggatagtgccgcttctgacattctcttggacgatatcgtgctgacacattctctcttcctaccaactgagaagtttctgcaggaacttcaccagtattttgtccgagctggcggtatggaggggccagagggactgggcaggaaacaggcctgcctggccatgctgttgcacttcctcgacacataccagggtctcctgcaagaggaggagggcgcaggacacatcattaaagacctgtatctcttgattatgaaggacgagtcactgtatcagggactgcgcgaggacaccctgcgcctgcatcaactggttgagaccgtggaattaaaaatcccggaagaaaaccagcctccatcaaagcaagttaagcccctctttcgccatttcagacgaattgatagctgtcttcaaacacgtgttgccttccgcggctctgatgaaatcttctgtagagtatacatgccagaccacagctacgtgacaatccgtagcagactgagtgctagtgttcaggatattttgggatccgtgacggaaaagttacaatattccgaagagcctgccgggagagaagattcgctaatcctagtagcagtctcttccagcggagagaaggtactattgcaacccacggaggactgtgtgttcacggcccttgggattaactcccacctgtttgcgtgcacaagggacagttacgaagccctagtacccttaccggaggaaattcaggtttcgcctggagatactgagattcacagggttgagcccgaggatgtggccaaccacctaacagccttccactgggagctattcaggtgtgtgcacgaacttgaatttgtggactatgtgtttcatggcgagcgcgggaggagagagaccgctaacttagagctgctccttcagcgttgctcagaggtcacccattgggtggccacagaggtgttgctttgcgaagcgcccggaaagagagcccagcttctgaagaaatttataaagatcgctgccctctgtaaacagaaccaagacctgttgtccttttatgccgttgtgatggggctggataacgctgccgtgtcgaggttgagactcacttgggagaaactgcctggcaagttcaaaaacctttttcggaaattcgagaatttgacggacccttgccggaaccataagagctacagggaagtgatctccaaaatgaagccgcccgttatcccgttcgtcccactgattctgaaggacctcacctttctacatgagggcagcaagaccctggtcgatggcttggttaacatagaaaaactgcattctgtggctgagaaagttaggactatccgaaagtatcgctctcgaccgttatgtctggatatggaagctagtcccaaccacctgcagaccaaggcctatgtgcgccagtttcaagtcatagacaaccagaacctgctatttgagctatcatataaactggaagccaattctcagtag

SEQ ID NO: 50544 - DNA, 1371 bp, Artificial Sequence
  Description of Artificial Sequence: Synthetic coding sequence
atggagggccccgagggcctgggccggaagcaggcctgcctggccatgttattgcacttcttggatacataccagggtctcctgcaggaagaggaaggagcaggacacatcattaaagatttatacctcctcattatgaaagatgagagcttgtatcagggcctgagggaggatacgctccggcttcaccagttagtggaaacggtggaactgaagatccccgaagagaaccaacctccatccaaacaggttaagcccttatttaggcatttcagacgtatagactcttgtctgcaaacgagagtcgctttcaggggctcagacgagatcttttgtcgggtttatatgcccgaccactcatatgtaacaatcaggagccgactaagcgcatcagtgcaagatattctggggtcagtcacagagaaactgcagtacagcgaggagccggctggcagggaggactctctcatactggttgccgtgagcagctccggagaaaaggtgctgctgcagcctactgaggactgcgtattcacggcactagggataaattcacatctttttgcttgtaccagggattcctacgaagcccttgtgcctctaccggaagaaatccaggtgtcacctggcgacaccgagatccaccgagtggagccggaggacgttgccaaccacttgacggcattccactgggagcttttccgctgtgtgcatgagcttgagtttgtggattatgtgtttcacggagaaagaggcagaagagaaactgccaatctggagctcctgctgcagcggtgctcagaggtcacacactgggtggctaccgaggttcttctctgcgaagctcccggaaaaagggctcagctgttaaaaaaattcattaaaatcgctgctctttgcaagcaaaatcaggatctcctatccttctatgcggtagtcatgggcttggacaatgctgctgtgtcgaggctgcggctgacttgggagaaattgcctggcaagttcaaaaacttgtttcgtaaattcgaaaacctgaccgacccatgcaggaaccataagtcctacagagaggttatcagcaagatgaagccacccgtgatacccttcgtaccactgatcctgaaagatctgacattccttcacgaaggctctaaaaccctcgtggacggtctggtcaatatagagaagctccatagtgtagcagagaaggtgcggacaatccgcaaatacaggagtcgtcctctctgtttggacatggaggcctcaccaaatcacctacagaccaaggcttacgtaaggcagtttcaagtgatcgataatcagaacctgctgttcgaactgagctataaacttgaggcgaatagtcagtag

SEQ ID NO: 50545 - DNA, 1371 bp, Artificial Sequence
  Description of Artificial Sequence: Synthetic coding sequence
atggagggccccgagggcctgggccggaagcaggcctgcctggccatgctcctgcatttcctggacacatatcaggggctgttgcaggaggaggagggagcgggccacatcataaaggacctctatttgttaattatgaaagatgaatccttatatcaaggcctgagggaggacacgctgcgcttgcaccaattggtcgaaactgtggaactgaagatcccagaagagaaccaacccccatccaagcaggtgaagccgctgtttcgacacttcaggagaatcgatagctgccttcagacccgagtggcctttagaggaagcgatgagattttctgtcgcgtctacatgccggatcactcctacgttaccattaggagcagattgtctgcctcggtccaggatatcctcggaagtgtgactgaaaagctccaatacagtgaggagcctgctgggagagaggattccctaatactggttgccgtgtccagctccggagaaaaagtgctgctacaacctacagaggactgtgtctttacggccctgggtattaatagtcatctattcgcgtgcacccgggatagctacgaagccttggtgcctttgccggaagagatccaggtctctccaggagatactgagattcatagagttgagcctgaagacgtcgcaaaccacctaaccgctttccattgggaactgtttagatgcgtccatgaacttgagttcgtggattatgtttttcacggagagcggggaagacgtgagacagcaaacctggagctcttactacaaagatgttcagaggtgacacactgggtggctacagaggtactcctgtgcgaagccccgggcaaacgggcacaactgctgaagaagttcatcaagattgccgccttgtgtaagcagaatcaagacttgcttagcttctacgccgtcgtgatgggacttgataacgccgccgtgtccagactgcggttgacctgggagaaattaccgggtaagtttaagaacttattccgtaagtttgaaaacctgaccgacccttgtcggaaccataaatcctatagggaggtcatcagcaagatgaaacctccagttatccctttcgtgccccttatacttaaggatctgactttccttcacgagggcagcaaaaccctggtcgatggattggttaacatcgagaagttgcactccgttgcggaaaaagtccgcacgatccgtaaatatcggtcacgaccactatgtttggacatggaagctagcccaaatcacctgcagacaaaagcctacgtgaggcagtttcaagttatcgacaaccaaaatttactatttgagttgagctacaagttggaagctaactcacagtag

SEQ ID NO: 50546 - DNA, 63 bp, Artificial Sequence
  Description of Artificial Sequence: Synthetic coding sequence
atggagggccccgagggcctgggccggaagcaggcctgcctggccatgctcctccacttctag

SEQ ID NO: 50547 - DNA, 306 bp, Artificial Sequence
  Description of Artificial Sequence: Synthetic coding sequence
atggagggccccgagggcctgggccggaagcaggcctgcctggccatgctcctgcacttcctggacacctatcagggcttactccaagaggaagaaggggcaggacatataatcaaagacctttatcttcttataatgaaagatgagtcattgtaccagggcctgagggaagacactctacgactacaccaactggttgagaccgtggaactgaagattcccgaagaaaatcagcccccgagcaagcaggtgaagcctctatttcgtcattttcgaaggattgactcctgtttacagactagatag

SEQ ID NO: 50548 - DNA, 450 bp, Artificial Sequence
  Description of Artificial Sequence: Synthetic coding sequence
atggagggccccgagggcctgggccggaagcaggcctgcctggccatgctgctgcacttcctcgacacctaccagggactcctgcaggaggaagaaggcgcaggccatatcatcaaagatttgtacctgctcattatgaaggacgagtccttgtatcagggactgagggaggataccctccggctccaccagctggtggagaccgtggagctgaagatccccgaggagaaccagccaccaagtaagcaagtgaaacccttgtttcgccatttccgtagaattgatagctgcttacaaaccagagtggctttccgcggaagcgacgagattttctgtcgggtttacatgccagatcactcatacgtgactatacgtagccggctgagcgcttcagtccaagatattttaggctctgtcacggaaaagctgcagtattctgaggagccttag

SEQ ID NO: 50549 - DNA, 1359 bp, Artificial Sequence
  Description of Artificial Sequence: Synthetic coding sequence
atgcccgacctgccccacctgctggccttcctgagcgccagccgggatgtgctgccaagaactcttctgttaccacccccaactttaggacccagagacgaacatacagatccagtgcagatcgggagagtgcaacaagatacccccgggaaggtgctctccatcgtgaatcagctttaccttgagacacacagaggatggggccgggaacagacaccccaggaaaccgaaccagaagccgcacagcgccatgacccggcaccaaggaatcccgcacctcatggggtgtcatgggtgaagggcccgctaagccctgaagtggatcacccaggccccgcactcgcttctttactggaagaggaagaagaggatctggaaggaaaggaggaaggccgtgaagacgatcctgaggaggaaggccccgaggatgtattgactatccacgtccaaagtctcgtcagggcaaggtcatcttatgtagcccggcagtatagatccttgcgagtgcgcattgcgagcgacagcggcggccctcatgggtcaggcgatcccgcaactgagttattgcaagacgtgagacacctgctcactgatctacaggatcacttagccaaagacagctacatcagagccgtcttcgggagccggggccccggcctgccaaaaaaagatgaagaccccgggccagctctggagactgctgtttgtcaggcagtactggctccccttaaacccgcactgtggacacgcctgaggaccctgcgggctccggagctgagacgacttcgtaggaggcagacagcactgcgggccggagctggtccccccggtgctcagggacctggtccggaaggtcagtctcccgctcccgccctgcgcagccgcattcatgagagactcgcacatctgcacgccgcctgcgcgcctaggagaaaagttgcgcttttattggaggtttgtcgggatgtgtatgccggattggctcgaggggagaatcaggacccattgggcgccgatgcatttctgccggctctcaccgaagagttgatctggtctccggatatcggcgatacacagctcgatgtggagttcctcatggagttgctggacccggacgagcttaggggagaagccggatattacctgactacatggttcggcgccctgcatcatatagcccattaccagcccgaaactgatagagcccctcggggtttatcatccgaggcgagggctagtctccaccagtggcatcgacggcgcactctgcaccgcaaggaccacccccgggcccaagccaatcttcctttcaaggagccatgggcagaagagacagtgaccgggacctctgacaactag

SEQ ID NO: 50550 - DNA, 1359 bp, Artificial Sequence
  Description of Artificial Sequence: Synthetic coding sequence
atgcccgacctgccccacctgctggccttcctgagcgccagccgggatgttctgccgcggactctcctgttgcccccccctacattaggaccccgggacgaacatacagatcccgtgcaaataggacgggtgcagcaagacacacctggcaaagtcctgagtatcgtaaaccagctgtacttagagacccaccgtggctgggggcgcgaacaaaccccccaggagacagagcccgaagcagcccaacgccatgacccagctccgcgtaatccagccccccacggcgtttcctgggtgaaaggaccgctgtcccctgaagtcgaccaccccggccccgctctcgcaagcctgctggaagaagaggaggaagatctggagggtaaggaggaaggtagagaggatgaccctgaagaggaggggcctgaggatgtgctcacgatccatgttcagtccctggtccgcgcacgatcatcgtacgtggccaggcagtatcgcagccttcgcgtgaggatcgcttcagattctggagggccacacggctccggcgatcccgctactgaactgctgcaggatgtcagacacctactgacggatctgcaagatcatctggccaaagactcctacataagagcagtgtttggctcaagaggccctggcttgcctaaaaaagatgaggatcctggtcctgccctggagacagccgtgtgccaagccgtcttggccccactgaaacccgcactgtggacaaggctgcgaactttgcgcgccccagagctcagacgactgagacgcaggcagacagccttgagagccggcgccggcccccccggtgcacagggcccaggccccgagggccagtcgcctgcacccgctttaaggtctaggatccatgagcggctggcccacctgcacgccgcatgcgcaccccgtaggaaagtggccttactgctggaagtgtgcagagacgtttatgccggcctcgccagaggcgagaatcaggatccactaggcgccgatgcattcctccccgccctcactgaggaactgatttggagccctgacattggcgatacacagcttgacgtcgagttcctcatggagttgctggatccggatgagctgcggggtgaggcagggtattatctgaccacttggtttggcgctctccatcacatagctcactatcaaccagagacagaccgggccccaaggggtctcagcagcgaggccagagccagtctgcatcagtggcataggcgacggactttgcatcgcaaggatcacccaagggctcaggccaatctgcccttcaaggaaccctgggcggaagaaacggtcaccggcaccagtgacaactag

SEQ ID NO: 50551 - DNA, 1260 bp, Artificial Sequence
  Description of Artificial Sequence: Synthetic coding sequence
atggagctgaaggtgtgggtggacggcgtgcagcggatcgtgtgcggggtgacggaggtgaccacctgccaagaggtggtaatcgccctggcacaagcgatcggcaggactggccgctacacgctgatcgagaagtggagggacactgaacgccatcttgcaccccatgagaatcccatcatcagtctcaacaagtgggggcagtacgcttccgatgttcaactgatcctgcgtagaactggcccctcactatccgagagaccaacttcagattctgtggctagaatcccggagcgaaccctttatcgtcagtcactgccccctctggccaaactgaggccacagatcgataaatctattaaaaggagggagcccaaacgtaagagtctaaccttcaccggcggggccaaaggactgatggatatcttcggcaagggtaaggaaaccgaatttaaacagaaggtacttaataattgtaagacgacggcagatgagctcaaaaagcttatacgtctgcagacggaaaagctgcaatcgatcgagaaacagctggagtcaaatgagattgagattcgtttttgggaacagaaatacaatagcaatctggaggaggaaattgttcgtctcgaacagaaaattaaaaggaatgacgtagagatcgaggaggaagagttctgggagaacgaattacagattgagcaggagaatgagaaacagctgaaagaccagttgcaggaaatccggcagaagatcaccgaatgtgaaaataaattgaaagattatctggctcagattcgcaccatggagtctggattagaggcagaaaaactgcagcgggaagtccaggaagctcaggtcaatgaggaggaggttaagggcaaaatcggcaaagtgaagggcgaaattgatatccagggccagcagagcctgagactggaaaacggcataaaagccgtagaaaggtccctagggcaggctaccaagaggcttcaggacaaggagcaggaacttgagcaactcacaaaggaactgaggcaggtaaacctgcagcagtttattcaacagacagggaccaaggttacagtgctacccgcagagcccatcgaaattgaagctagccatgcagatattgagcgggaggccccctttcaaagtgggagcctgaagagaccaggctcatctcggcaacttccctccaatctgcgcatcctgcaaaatccaatctcaagcggttttaaccccgaaggcatctatgtgtag

SEQ ID NO: 50552 - DNA, 1179 bp, Artificial Sequence
  Description of Artificial Sequence: Synthetic coding sequence
atggagctgaaggtgtgggtggacggcgtgcagcggatcgtgtgcggggtgacagaagttaccacctgtcaggaagttgtaatcgccttagcccaggccataggtcgcacaggccggtacacactgatcgagaagtggagggacacagagcgacatctcgcaccacacgagaatcctatcatctccctcaacaaatggggtcaatacgcctccgacgtgcagctgattctgagacggaccgggccgagcctgtctgagcgcccaacttcagattccgtggcgcggatacctgaaagaaccctttatagacagagtctcccgcctcttgccaaactaagacctcagattgacaagtccattaaacgccgagagcccaaaagaaagtccttaacattcactgggggtgccaagggtctaatggatatatttggcaagggaaaggagacagaattcaagcaaaaggtgctaaacaattgtaagactacagctgatgaactgaaaaagcttattaggctgcagaccgaaaaattacagtccattgagaagcaattggaaagtaatgagatcgaaattcgtttttgggagcagaagtacaactccaatctggaggaggagatcgttcggctggaacaaaagattaaaagaaacgatgttgagattgaggaagaggagttctgggaaaacgaactccagatcgagcaggagaacgaaaagcagctgaaagatcagctgcaggagatccgacagaaaatcactgaatgtgagaacaagctgaaggattacctggcacagattaggaccatggagagcgggcttgaagcagagaagctgcagcgcgaagtccaggaggcacaggtgaatgaagaggaggtcaaagggaaaatcggaaaggtgaaaggagaaatcgacatccagggccagcagagcttgcgccttgagaatggcattaaagccgtggagcgctctctcggtcaggcgacaaagaggttacaggataaagagcaagaactcgagcagttgactaaggagctgcgtcaggtaaacttacagcagttcatccagcagacaggcaccaaggtaacggtgctgcccgccgaaccgatcgagatagaagccagccacgccgatatcgagcggggaattatcatcttgagcgacaaacaggagtgtaaagattag

SEQ ID NO: 50553 - DNA, 1260 bp, Artificial Sequence
  Description of Artificial Sequence: Synthetic coding sequence
atggagctgaaggtgtgggtggacggcgtgcagcggatcgtgtgcggcgtgacggaggtgacaacatgccaggaagtcgttattgcccttgcacaggccatcggaaggaccggaagatataccttgattgagaagtggagagacacagaaaggcaccttgcaccccacgaaaatcctataatctctttgaataagtggggccagtacgcgtccgacgtccagctgatcctgcgcagaacggggccctccctctctgagcgccccacaagcgattctgttgcccgcatacccgagcggactctgtaccgtcagagcctcccacccctggcgaagcttcggcctcagatcgacaagtccattaaaaggcgcgagcctaaacgaaaaagcctcaccttcaccggtggcgcaaaaggcctgatggacatcttcggtaagggaaaggagaccgagttcaagcagaaagtccttaataattgtaagacaaccgccgatgaactgaagaaactgattcgactgcaaaccgagaaactgcagtctattgaaaaacaactggagtcgaatgagattgagatcagattctgggagcagaaatacaattccaatctggaagaggaaatcgtacgcttagagcaaaagatcaaaagaaacgacgtggagattgaggaagaggagttctgggagaacgagctgcaaatagaacaggaaaacgaaaagcagctgaaagatcagctgcaggaaatccggcagaaaatcacagagtgcgagaacaagctgaaggattatctagcccagattcgcactatggaatcggggcttgaagctgagaaacttcagagagaagtgcaagaggctcaagttaatgaggaggaagttaagggaaagatcgggaaggtgaagggtgaaattgacattcagggccagcagagtctgcggctggagaacggcattaaagccgtggaacgctcacttgggcaggctacaaagagactacaggacaaagagcaggagttagagcaactcactaaggaactgagacaggtcaatcttcagcaatttattcagcagactggaaccaaagtgacagttcttccagctgagcctatcgagattgaagctagccatgccgatatcgagcgcgaggccccatttcagagcgggtccctgaaaaggccagggagctcccggcagttgcctagcaatctacgcattctgcagaatcccatctcaagcggctttaatccagaggggatttacgtttag

SEQ ID NO: 50554 - DNA, 276 bp, Artificial Sequence
  Description of Artificial Sequence: Synthetic coding sequence
atggagctgaaggtgtgggtggacggcgtgcagcggatcgtgtgcggcgttaccgaggttacgacctgtcaggaggtagtgatcgccctcgcccaggccattggcagaacaggccgttataccctcatcgaaaagtggcgtgacaccgagaggcatctcgccccacatgaaaacccaataatctccctgaacaaatggggacagtatgctagtgacgtgcagttaatccttcggagaaccgggcccagcctctcagagcggcccacaagtgactag

SEQ ID NO: 50555 - DNA, 90 bp, Artificial Sequence
  Description of Artificial Sequence: Synthetic coding sequence
atggagctgaaggtgtgggtggacggcgtgcagcggatcgtgtgcggcgtgacggaggtgacaacttgccaggaagttgtgattgcatag

SEQ ID NO: 50556 - DNA, 627 bp, Artificial Sequence
  Description of Artificial Sequence: Synthetic coding sequence
atggagctgaaggtgtgggtggacggcgtgcagcggatcgtgtgcggcgtgaccgaggtgaccacgtgccaggaggtggtgattgcgcttgcacaggccataggacgaaccggcagatatactctcattgagaaatggagggacacagagcgccatctagccccacatgaaaacccaatcatcagtcttaataaatgggggcagtacgccagcgacgtacagctgatcctgcggaggaccggcccgtctctttcagaacgtccaacgagtgatagcgtggcgcggatccccgaacggaccctgtaccgccaaagtctgccccctttggcaaagctcaggcctcagatcgacaagagcattaagaggcgtgagcccaagagaaaaagcttaacctttacaggaggagctaaaggcctgatggacatttttggtaaaggcaaggaaactgagtttaagcaaaaggtgcttaacaattgcaaaactactgctgacgaactgaaaaaactgattaggctacagaccgaaaagctgcaatccattgaaaagcagctcgagtcaaatgagatcgagattagattttgggaacagaagtataatagcaacttggaggaggagatcgtgagatag

SEQ ID NO: 50557 - DNA, 1260 bp, Artificial Sequence
  Description of Artificial Sequence: Synthetic coding sequence
atggagctgaaggtgtgggtggacggcgtgcagcggatcgtgtgcggcgtcaccgaggtgaccacctgtcaggaggtcgtgattgccttggcgcaggccatcggaaggaccggccgatacacactgatcgagaagtggagagacacagagcggcatttggcgccccatgagaaccccatcatttctctaaacaagtggggccaatatgcgtcagacgtacagttgatactccgccgtaccgggccctctctgtccgagagacccacgtcagattccgttgcaagaataccagagcggacactttatcgccagagcctacctccgcttgcaaaactccggccacagattgataagtctatcaaacggcgggaacccaagcgaaagagcctaacctttacaggcggagctaagggactcatggacatcttcgggaagggcaaagagaccgagttcaagcagaaagtgctgaataattgcaagacgacagcggatgaactgaaaaaacttatcaggctccagactgagaagctgcagtcaattgagaaacagctggaaagcaacgagattgagattcggttctgggaacaaaagtataattcaaacctggaagaggaaatagtccggctggagcagaaaattaagaggaatgatgtcgaaatagaggaggaggagttctgggagaacgagctgcaaattgagcaggagaatgagaaacagttgaaagatcagctgcaggagattaggcagaagatcaccgagtgcgagaataaactgaaagattacctggcacagattcgaacaatggaatccggcctagaggccgagaagctccagagagaggtgcaggaggctcaggtgaatgaagaagaggtcaagggaaagatcgggaaagtgaagggtgaaattgacatccagggccagcagtcactaaggctcgagaatggtatcaaggccgttgagagaagtcttggtcaagccaccaaacgcctgcaagacaaggagcaagaattagagcagctcacaaaggagctgcgacaggttaacctgcagcagttcatccagcagacaggtactaaggtgacagtgctgccagctgagcccatagagattgaagcatctcatgctgatatagaacgcgaggcaccatttcaatccgggtcactgaaacgccccggcagctccagacaactacctagcaatctgcgtatactgcaaaacccgattagcagcggcttcaatcctgagggaatatacgtgtag

SEQ ID NO: 50558 - DNA, 330 bp, Artificial Sequence
  Description of Artificial Sequence: Synthetic coding sequence
atggagctgaaggtgtgggtggacggcgtgcagcggatcgtgtgcggagtgacagaagtcactacttgtcaggaggttgtcatagctctagcacaggctatcgggcggacaggtcggtacacacttattgaaaaatggagggacactgaacggcacctggcaccacatgaaaacccgattattagccttaacaagtggggccaatatgccagcgatgtgcagctgatcctcagacgaacaggtccttccttgagtgaaagacctacctcagattccgttgctaggatcccggaacgaacactgtaccgtcagtcactgcccctctcatag

SEQ ID NO: 50559 - DNA, 660 bp, Artificial Sequence
  Description of Artificial Sequence: Synthetic coding sequence
atggagctgaaggtgtgggtggacggcgtgcagcggatcgtgtgcggagtcaccgaggtaactacctgccaagaggtcgtgatcgccctggctcaggctatcggtcgaactgggaggtacaccctgatcgaaaaatggcgggacacagagcgccaccttgcgccacatgaaaatccgataatctccttgaacaagtggggccagtatgcatccgacgtccagctcatcctaaggcgaaccggtcccagtctctctgaaaggccaacatctgacagcgtcgctcgcatccccgaaagaaccttgtatcgtcagagcctaccgcccctcgcgaaactgcggccgcagatcgacaagtccataaagcgacgcgaaccaaaaagaaaaagcctgacgttcaccgggggggcaaaagggctgatggacattttcggaaaaggaaaggaaaccgagttcaagcagaaggtactaaataattgtaaaactacagccgatgagcttaaaaaattaattcggctgcagacggagaagcttcagagcattgagaagcagctggaatccaatgagatagaaattagattttgggaacagaagtacaactctaacctggaagaagagattgtccggctggagcaaaaaatcaagcgcaatgatgtggagtag

SEQ ID NO: 50560 - DNA, 369 bp, Artificial Sequence
  Description of Artificial Sequence: Synthetic coding sequence
atggagctgaaggtgtgggtggacggcgtgcagcggatcgtgtgcggggtcaccgaagtgacgacctgccaggaggtggtgatcgctctagctcaggctatcgggaggacagggcgatataccctcattgaaaagtggcgcgacacggaaaggcacctcgcacctcacgagaacccgattatttcactgaataagtggggacagtacgcatcagatgtccagctgatcttacggaggactgggcctagcctctccgaaagaccaacgtctgactcagtcgctagaattccggagagaacactatacagacagtctctgccaccccttgctaagctgcgcccacagatcgataagagcattaagaggtag

SEQ ID NO: 50561 - DNA, 1260 bp, Artificial Sequence
  Description of Artificial Sequence: Synthetic coding sequence
atggagctgaaggtgtgggtggacggcgtgcagcggatcgtgtgcggggtgacggaggtcacaacttgccaggaagtcgtgatcgcgctggctcaggcaataggacggaccggacgatataccctaatcgagaagtggagagacaccgagaggcaccttgcgcctcacgagaaccctataatctcccttaacaagtggggccagtatgcctcagatgtgcagcttattctgcggagaaccggcccctctttatccgaacggccaaccagtgactcagtggcgaggatcccggagaggactctttaccgacaatctctgccccccctcgcaaagctgcgcccacaaatcgacaagtcaatcaaaagaagggagcctaaacggaagtcactgacctttaccggaggagccaagggcctgatggatatcttcggtaaggggaaagaaactgagtttaaacagaaagttctcaacaactgcaaaacaaccgcagacgagctaaagaaactcatcagattgcagaccgagaaactccagtcgattgagaagcagctcgaatccaacgagattgagatccgattctgggagcaaaaatacaacagcaacctggaggaggaaattgtgaggctcgaacagaaaataaagcgcaacgacgttgaaatcgaagaggaggaattttgggaaaatgagctgcagatcgagcaggagaacgagaaacagctgaaagatcaactacaggaaattcggcagaagatcacggaatgtgaaaataaactcaaggactatctggcccagattaggacaatggagtccggtttggaggccgagaagctccagcgcgaagtgcaggaagcccaggtaaatgaggaagaagtgaagggtaaaatcgggaaggtaaagggcgagattgatattcagggacagcagagccttaggctcgaaaatggaattaaagctgttgaacgatccctaggccaggccactaaacgactgcaggataaggaacaagagctcgaacagctcacgaaggagcttcgccaggtaaatctgcagcagtttatccagcagacaggtactaaggttacagtgctccctgcagagcccattgaaatcgaggcttctcatgcggacatcgaacgagaggccccctttcagagcggaagcctaaagagacctggcagcagcaggcaactcccatccaatctgcgaatcctccagaacccaatatcttcgggatttaaccccgaagggatctatgtctag

SEQ ID NO: 50562 - DNA, 480 bp, Artificial Sequence
  Description of Artificial Sequence: Synthetic coding sequence
atggagctgaaggtgtgggtggacggcgtgcagcggatcgtgtgcggagtgaccgaggtcaccacctgtcaggaagtggtgatcgctctggcccaagcaattggtagaaccggccgatacaccctcatcgaaaagtggagggacaccgaaaggcacttagccccccatgaaaacccaattatctccctgaacaagtggggccagtacgccagtgatgtccaattaatcttgcgccgcactgggccttccttgagcgaacgcccaacgtcagactctgttgcacgcattcccgagcgcactctttacagacagagccttcctccactggcaaaactccggcctcaaattgacaaatctataaagcgccgggagcccaagagaaagtccctgaccttcactggaggtgctaagggtcttatggacatctttgggaagggaaaagaaaccgagttcaagcagaaagtgcttaataactgctag

SEQ ID NO: 50563 - DNA, 2412 bp, Artificial Sequence
  Description of Artificial Sequence: Synthetic coding sequence
atggccaagcggagcagcctgtacatccggatcgtggagggcaagaacctgcccgccaaagatatcacgggcagctcggatccctactgtatcgttaaggtagacaatgagccaatcattcgcacggctacagtgtggaagacactctgcccgttctggggagaggaatatcaggtccatctgcctcccaccttccacgcagtcgcattttatgtcatggacgaggatgccctctcccgggacgacgtcatcggcaaagtgtgtttaacaagggatacaatcgcgagccacccaaaggggttctccggatgggcacacctcacggaagtcgatccggacgaagaggtgcagggagagatccacctccggctggaggtgtggcccggtgcgcgcgcctgtcgtctgagatgctccgtgctcgaagctagggatctcgccccaaaagatcgcaacgggacctccgaccccttcgtccgagttagatataagggcaggacccgagagacttccattgtgaagaagtcatgttatccgcggtggaatgagaccttcgagttcgagttgcaggaaggcgctatggaagcactgtgcgtggaagcttgggactgggacctggtttcgcggaacgattttctgggaaaagtggtcatcgatgtccaacgactacgcgtcgtccaacaggaggagggttggtttcggctacagcccgaccagagcaagtcacgaaggcacgacgagggaaatctgggcagccttcagcttgaggtaaggctgcgtgacgagactgtcctgcccagcagttattatcagccattggttcatttgttgtgccacgaagttaaattaggaatgcaggggcccggccagctaatacctctcatcgaggagactacctctacagagtgcaggcaggatgtcgctactaatctcttgaagctgttcctgggccaggggctggctaaggactttctggatctgctcttccagttggagctgagccggacctctgagactaatacgctgttccggagcaattcgctggccagcaaatctgttgaaagctttctgaaagtcgccggcatgcagtaccttcatggcgtgttgggcccaatcattaacaaggtgttcgaggagaagaagtatgtcgaattggacccatccaaagtggaggtgaaagatgtggggtgcagtggcctgcaccggccccagacagaggccgaggtgctggagcagtccgcccagactttgcgagctcaccttggggctcttcttagcgcactcagcagaagcgtcagggcttgccccgccgtagtccgggcaactttccggcagctgtttaggcgcgttagagagcgcttccccggtgcccagcacgagaatgtgccattcattgctgtgacctccttcctgtgcttgcggtttttttcaccagctattatgagtcctaaactgttccacctccgcgagagacacgccgacgcaaggacctctaggacgctcctgctgcttgctaaagctgtgcaaaacgtcggaaatatggacactcctgcttcaagggcgaaggaagcttggatggaaccattgcagccaaccgtgcaccagggggtggcgcagcttaaggactttatcaccaaacttgtggacatcgaagagaaagacgagctggatctgcagcgaaccctcagtctgcaggctcctcctgtgaaagaaggacctctttttatccatcggaccaaagggaaagggccactcatgtcctcttcttttaaaaaactttatttctccctgactacagaagctctttcatttgcaaagaccccctcttctaagaagtcagcgttgataaaactggccaacattcgggccgcagagaaggtcgaggagaagtccttcggtggaagccatgtcatgcaggtcatttacaccgatgacgcaggccgcccccagaccgcctatttacagtgcaagtgtgtgaacgaattaaaccagtggctgtcagccctgcggaaagtttccattaataacacaggactgctggggtcttaccaccccggggtgtttcgaggagacaaatggtcgtgctgtcaccagaaggagaagaccgggcagggctgcgacaagacgcgctctagagtgacactccaagagtggaatgatcctcttgaccacgacctggaagcacagctgatctatcggcatctcctgggggtggaggcgatgctgtgggaacggcatcgagagctgtcagggggcgctgaggcagggacagtgccaacctcccccggcaaagttcctgaagacagcctcgccagactcctgagagttctgcaggacctgcgggaagctcatagttctagcccagcgggaagccctccttcagagcctaattgtcttcttgagctgcaaacttag

SEQ ID NO: 50564 - DNA, 2274 bp, Artificial Sequence
  Description of Artificial Sequence: Synthetic coding sequence
atggccaagcggagcagcctgtacatccggatcgtggagggcaagaacctgcccgctaaggatatcaccgggtcttctgacccttactgcatcgtgaaagtggacaacgaaccaatcattagaaccgctaccgtctggaagacactgtgtccgttctggggagaagaataccaggtgcatctccctccgactttccatgctgtagccttttacgtcatggacgaagatgcactgagtcgtgacgatgtgattggaaaggtatgtctgacgagagacacaatagcctcacaccccaagggcttctctgggtgggcgcacctcactgaagtggatcccgacgaagaagtccaaggggagatacacctgcggctcgaagtttggccaggagctagggcatgccgtctgagatgctccgtgctggaggctagggacttagcaccaaaggatagaaacggaaccagtgatcctttcgttcgggtgagatacaaaggccgcactcgcgaaacaagcatagtcaaaaagtcctgctacccccggtggaacgaaacattcgaattcgaattacaagagggggcaatggaggccttatgtgttgaagcttgggactgggatctggttagcagaaacgactttctcgggaaggttgttatcgacgtacagaggcttagagtagtgcaacaggaagagggctggttccgattacaaccggaccaatccaagagccggcggcacgacgaggggaatctcggaagcctccagctggaggtccgactgcgcgatgagactgtcctccccagctcatattaccagcctctggtgcatctcctctgccacgaggtgaagctcggaatgcaaggtccaggccagctgattcctttgattgaagagactacctcgacagagtgccggcaggatgtggccactaacctgttgaagctattccttggacagggattggctaaagatttccttgacttgctatttcaactggaattgtcccgcacatccgagacaaataccctgttcagatcgaactcactcgctagcaagagcgtagaatcttttctaaaagtggctggaatgcagtatctgcatggggtcctgggacctatcatcaacaaagtattcgaggagaagaaatatgttgagcttgatccctcaaaggtcgaggtcaaggacgtgggctgttccggcctgcaccggccccaaacagaagccgaagtgctggagcaaagtgctcagactctgagagcgcacctcggggcgctgctcagcgccttgtcaagaagtgtgagagcttgccctgccgtggtgagagctacgtttcggcagctattccgtagggtcagagagcgctttccaggtgctcagcatgagaatgtcccattcattgctgtaacgtcgtttctatgtcttagatttttttcaccagctatcatgagtccaaagctgttccacttgagagagcgacacgcagatgcaagaactagtcggactctcctgctgctggctaaggcggttcagaatgtcggcaacatggatacaccagcctccagggcgaaagaggcttggatggaaccactgcagccgaccgtacaccaaggcgtcgcccagctgaaagattttatcaccaagcttgtggatattgaggagaaggatgagctggacctgcagcgcacgctgtccttgcaagctcctcccgtgaaagaagggcccctgtttattcataggaccaagggcaaggggcccctgatgtcatctagctttaagaagttgtattttagccttacgactgaggcactctctttcgctaagacaccatcctctaagtgtgtgaacgaactcaaccagtggttatctgccctgaggaaggtgtctattaataataccggactgctgggaagctaccatcctggagtattccgaggcgataagtggagctgctgccatcagaaggaaaagaccgggcaggggtgtgacaaaacccggagcagggtgacactgcaggagtggaacgatccactggaccacgatctcgaagcgcaactgatctacaggcatcttcttggagtcgaggccatgttgtgggagcgtcaccgggaactgtccggcggagctgaggctggcaccgtacccacctcccctggaaaagttcccgaggattcgcttgcacgactgttacgcgtacttcaggatctccgagaagctcattccagctcacccgccggcagtcctccctccgaaccgaattgtctgctcgagttgcagacctag

SEQ ID NO: 50565 - DNA, 3774 bp, Artificial Sequence
  Description of Artificial Sequence: Synthetic coding sequence
atgcagaagggcatccggctgaacgacggccacgtggccagcctgggacttctcgctcggaaggacggcacccggaagggctacctgtcaaaaaggtcctcagataatactaagtggcagacaaagtggttcgcgctcttgcaaaacctcctgttctattttgagtcagatagttcaagtcgcccctccgggctgtatctgctggagggctgcgtctgtgaccgcgcaccctcaccaaagccggccttgtccgccaaggagcccttagagaaacaacactactttaccgtaaattttagccacgaaaaccaaaaagccctggaactgagaaccgaagatgcgaaggactgtgatgaatgggttgccgcgatcgcacatgctagctaccgtaccctcgctacagaacacgaagctctgatgcagaagtaccttcacctcctgcagattgtcgagacagagaagacagtagcgaaacagttacggcaacagatcgaggacggggagatcgagatcgagagactgaaagccgaaatcacaagtttacttaaagacaacgaacgaatccagagcacccagacagtcgccccaaacgacgaagactcagacattaagaagattaagaaggttcaaagcttcctcagaggatggctgtgtaggagaaaatggaagaccattatccaagattacatcagatcaccccacgccgattcaatgagaaagcgcaaccaggttgtgttttcaatgctggaggccgaagcggagtacgtccagcagctgcacatcctcgttaacaactttctgcgcccacttcggatggccgcctcaagtaaaaagccccccataacccacgacgacgtgtcctcaatctttttgaattccgagacgatcatgtttctgcatcaaatcttctaccaggggttgaaagccagaataagtagctggcctacactggttctcgctgatctgttcgatatcttgcttcctatgctaaatatataccaggaattcgtacggaaccatcagtacagtctgcagatactggctcattgtaagcagaaccgagactttgataagctgctgaaacactacgaggccaaacctgactgtgaggaacgtacgcttgagaccttcctcacataccccatgtttcagatcccacgctacatccttacattacacgagctgttggcccatacaccccatgaacatgtggaaaggaattctctcgattatgccaagtctaagctcgaagaactgagccgaatcatgcacgatgaggtctctgagaccgagaacatcagaaagaatcttgctatcgagaggatgattatcgaagggtgcgagatactgctggacacgagccagactttcgtgcgccaagggtctttaatacaagtacccatgtctgaaaaggggaaaataacgagaggacgcctcgggagtttgagcctcaagaaggagggggagcgccagtgcttccttttctctaagcacctcattatctgcacacgagggagcgggggtaagcttcatttaacgaagaatggcgtgatctccctgatcgactgcaccctactcgaggagcccgaatcaactgaggaagaggccaagggcagcggccaggacatcgaccacttagatttcaagattggcgtcgaaccaaaagacagcccaccatttaccgttatcctggtggcatcctccaggcaggaaaaggctgcctggacttccgatatttcccagtgtgtagataatatccgttgcaacggtctgatgatgaatgcgttcgaggaaaattctaaagtaacagtccctcagatgattaagtctgacgcctccttatattgcgatgatgtcgacatccgcttctcgaaaaccatgaatagctgcaaagtgctccagatccgctacgcctcagttgaaaggcttctggaacggctaaccgatctcaggttcctgtctatagatttcctgaacacattcctgcacagctatcgcgtgttcactacagcaatcgtagtgttggataagctgatcaccatctataagaagccgattagcgccatcccagccaggtccctggaactgttatttgcgagtggtcagaacaacaagttgttgtacggagagcccccaaagagcccacgcgcgacacgaaagttcagttctccacctccgcttagcattactaagacaagcagtccctctcgcagacggaagttaagcctgaatatcccaataattaccggtggcaaagctctggatctggctgccctcagctgcaattcaaacggttatacctcaatgtatagtgccatgtcacccttcagcaaagcaacgctggacacttctaaactgtatgtgtctagcagcttcaccaacaaaatccctgacgagggcgatactacccccgaaaaaccggaagatccttcggcgctatccaagcagtccagcgaagtgagcatgcgggaagagagcgacatcgatcagaaccaatccgacgatggagacactgaaactagccctacaaagagcccaacaacaccgaaatccgtgaagaacaaaaatagcagcgaattccctctattttcttataacaacggggttgtaatgaccagctgtagagaattggataacaaccggagcgcactgagcgctgcaagtgctttcgcgattgctaccgcaggggcaaatgaagggacccccaataaagaaaaatacaggcgcatgtccctcgcatccgcggggttcccccccgatcagagaaacggcgataaggagtttgtaattcgtagagccgcgactaacagggtgctaaacgtgctccggcactgggtgtctaaacactcccaggatttcgagactaatgatgaacttaagtgtaaagtgattgggttcttggaagaggtgatgcacgatccagaacttttgactcaggagcgcaaggcagcagctaacattatccggactctcacacaggaggacccgggggataaccagataacactggaggagattacacagatggctgaaggcgtgaaggccgaaccatttgaaaaccattccgctcttgaaattgcggagcaactaaccctactggatcatctagtgtttaaaaagatcccttatgaagagttcttcgggcagggctggatgaaactggagaagaacgaacgcacaccctatataatgaaaacaacgaagcacttcaacgatatctcaaatttgattgcttccgagattataagaaacgaggacataaacgccagagtttctgctattgaaaagtgggtcgccgtggcggacatctgtaggtgccttcataattacaatgccgtgcttgagatcaccagctcgatgaacaggagcgcaatcttcagactaaagaaaacatggttgaaggtgagcaagcaaactaaggcgctcattgataaactgcagaagctagtttcatctgagggacggtttaagaatctacgggaggcactaaagaactgcgatcctccatgtgtgccctacctgggcatgtatctgactgacctggctttcatagaggagggtaccccaaactatacggaagacggcctggtaaacttctctaagatgagaatgatatcacacattatccgcgaaattagacagtttcaacagacagcttacaaaatagagcaccaggctaaagtgacccagtacctgctggatcagtcttttgtgatggacgaggaaagcctctatgagtcatccttaagaatcgaaccgaagctgccaacatag

SEQ ID NO: 50566 - DNA, 1470 bp, Artificial Sequence
  Description of Artificial Sequence: Synthetic coding sequence
atgtacagcgccatgagccccttcagcaaggccaccctggacacctccaaattgtacgtatctagttcgttcaccaacaaaattccagatgaaggcgacacaacgcctgagaagccggaagaccccagcgcattatccaaacagtccagcgaggtgagcatgagagaagagtccgacatagaccagaaccagtctgacgacggggacaccgaaacatcccccacgaagagtccaaccaccccgaaatccgtgaaaaataagaatagcagcgagtttccactctttagctataacaacggggtcgtgatgacgagttgtcgagaattagataataaccgctctgctctgagcgcagccagcgctttcgccatcgctactgcgggagccaacgaggggacacccaacaaggagaagtataggcgcatgtcactagcctcagctggcttcccacccgatcagagaaacggcgataaggagttcgtgatccgcagagccgctaccaacagagtcctgaatgttctgcgccactgggtgtcgaagcactcccaagactttgaaaccaatgacgagctgaagtgtaaggtgataggattcttggaggaagtaatgcacgatcctgagctgttaacccaggagcgaaaagccgccgcaaacattattaggactctgacacaggaggatcctggagataatcagatcacattggaggaaattactcagatggccgaaggagttaaggccgaaccattcgagaatcacagtgccctcgagattgcggaacagctgacactgctggatcatctggtgttcaagaaaattccctacgaagaattcttcggacaggggtggatgaaattggagaagaatgaaaggactccctacattatgaaaaccaccaaacactttaatgacatctctaatctgatcgcatctgagatcattagaaacgaggacataaatgcacgggtgtccgccatcgagaagtgggtggccgtggctgacatctgtcgctgtttgcacaattataacgctgtgcttgagatcactagctctatgaatcggagcgccatcttccgcctgaaaaagacttggcttaaggtttcgaagcaaacgaaggccctgattgataagctgcagaagctggtgagttcagaagggaggtttaaaaatctccgtgaagctctcaaaaattgcgatccaccttgtgtgccttacctgggtatgtatttgacggacctggcgttcattgaggagggtacaccaaactacactgaagacggactagtcaacttttcgaagatgagaatgatcagtcacatcattagggaaattcgtcagttccaacagactgcttacaaaattgaacaccaggccaaggtcacacagtatctcctagatcagagtttcgtgatggatgaagaatctctgtacgagtcctccctgcgcatcgagcccaaactacccacatag

SEQ ID NO: 50567 - DNA, 3822 bp, Artificial Sequence
  Description of Artificial Sequence: Synthetic coding sequence
atgcagaagggcatccggctgaacgacggccacgtggccagcctggggctgctggccaggaaggatgggaccagaaaggggtacctcagcaagagaagttcagataacaccaagtggcagacaaagtggttcgctctgttgcaaaacctcctgttctatttcgaatctgattcctcaagccgcccctccgggctgtacctgctggaaggctgcgtgtgcgaccgagccccctctcctaagccagctctctccgccaaggagccattggagaagcagcattactttacagtgaacttttcacatgagaatcagaaggctctggagctgcgtacagaagatgctaaggattgtgatgagtgggtagcggctatcgcgcacgcctcgtatcgtactctggcaactgagcatgaggcactgatgcaaaagtacctacacctgttgcagattgtcgaaaccgagaagacagtggctaagcaactcagacagcagatcgaagatggtgagatcgagatcgagagactcaaggcagagataaccagtcttctcaaagataatgagcgaatacagtccacccaaacagtggctccaaacgacgaggactccgacattaaaaaaatcaaaaaagtgcagtccttcctccgcggctggctgtgtcgaagaaagtggaagactataattcaggattatatacgatcccctcatgcagacagcatgcgtaaacgcaatcaggtcgtcttttccatgctcgaagccgaagctgaatacgtgcagcagctgcacattttggtaaacaacttcctccgccctcttcgcatggcagcgtcgagcaagaagcctcccatcacccacgatgacgtgagtagcatcttcctcaactctgagaccatcatgtttctgcatcaaatattctaccagggccttaaagcacggatttcctcatggcccactctcgtgttagcagacttattcgatatcttgctgcctatgctcaatatctaccaggaattcgtccggaaccaccagtactccttgcagatcctggcccattgtaagcagaacagggacttcgacaagttgctgaagcactatgaagcaaaacccgattgcgaggagagaaccttagaaacctttcttacatacccaatgttccagatcccacggtacatactgacccttcacgagctactcgctcatacacctcacgagcacgtcgaacgaaactcacttgactacgcgaagagtaagctggaagagttgagcagaatcatgcacgatgaggtttccgagactgagaatattagaaagaatctcgcaatcgaaagaatgattatcgagggctgtgagatactgctggacaccagtcaaaccttcgttagacagggtagtcttatacaagtgcctatgtccgagaaagggaaaattacccgcggcaggttaggtagtctgagcctgaaaaaggaaggggaacgtcagtgttttctattcagcaaacacttgattatctgtacacgaggcagtggtggtaaactgcatctcactaagaacggggtaatttcacttatagattgcactcttctggaagagcccgagtccactgaggaggaggccaagggttctgggcaggatatcgatcatctagacttcaaaatcggagtggagcccaaggactccccaccattcactgtgatcctggttgccagctctaggcaagaaaaggcagcctggacaagtgacatctcacagtgtgtcgataacattcgctgcaacggcctcatgatgaacgccttcgaagaaaatagtaaggtgaccgtccctcagatgattaaacggaccagagaaggaacacgggaggccgaaatgtcgcgatccgatgcatctctctattgcgacgatgtagacattcgcttcagcaaaactatgaactcctgtaaggtactgcagatccggtatgcgtctgtggaaaggctgctggagagactgactgatctccggtttctctccatcgactttctaaacactttcctacattcttatcgggttttcacaacagccatcgtcgtgctggataagctgatcactatctataagaagcctatctctgcaatcccagctagatggctacgctccttggagctgctcttcgcatccggccagaacaacaaactgttgtacggcgagccccctaaatcacctcgagctacaaggaagttctcttcacccccacctctgtcaattacaaagacatcaagcccgagcagacgacgcaagctgtcactgaatatcccaatcataaccgggggaaaggccctggatctggctgcgttatcatgcaacagcaatgggtacacctctatgtactccgcgatgtcaccattttctaaggcaaccctcgacacctctaaactgtacgtcagcagctccttcacaaataaaattccagatgaaggggatacaactcccgaaaaacccgaggacccctctgcactgtcaaaacagtctagtgaggtgagcatgagagaagaatcagacatagatcaaaatcagagcgatgacggcgacactgaaacctcgcctactaagtctcctaccacacccaagtctgttaagaataaaaactcatccgaattcccccttttcagctacaacaatggcgtggttatgacttcatgcagagagttggataacaaccgctcagcactatctgctgcctcagcctttgcaatcgccactgccggagccaacgaaggcacaccaaacaaagagaagtatcggcgcatgtccctggcttctgcagggtttccacccgatcagaggaacggagataaggagtttgtcatccgccgagccgcaaccaaccgcgtgctaaatgttctcagacattgggtgtcaaaacactcccaagatttcgaaacaaacgacgaacttaagtgtaaagtgataggcttcctggaggaagtcatgcatgatccggaacttctgacacaagagagaaaggccgccgctaatatcatccggaccttgacacaagaggacccgggggacaaccagatcacacttgaagagattacgcaaatggcagagggcgtgaaagccgagccttttgagaaccacagcgcgttagaaattgccgagcagctgacccttctcgaccatctggtttttaaaaagatcccctacgaagagttctttgggcaagggtggatgaagttagaaaaaaacgagcgaacgccctacattatgaagacaactaaacacttcaatgacatcagcaacttaatcgcctcagaaatcatcaggaatgaggatatcaacgctagggtgtctgcaatagagaagtgggttgccgtggcagatatttgccggtgcctgcacaactataacgcggtcctggaaattaccagttccatgaataggtcggcaatttttcgtctgaaaaagacttggctgaaagttagtaagcagacaaaggcactgatcgacaaactacagaaattggtctcatctgagggccgtttcaagaacttaagggaagctctgaagaactgcgacccaccctgcgtcccataccttggaatgtacctcacagacctggcattcatcgaagagggtacccccaattacacagaagatggcctagtgaactttagcaaaatgcggatgatttcacatataatacgcgagattaggcagttccaacagaccgcttataaaatagagcaccaggcaaaggtaactcagtacctgctggatcagtcattcgtgatggatgaggagtccctctacgagtcctcactccgcatcgagccaaaactgcctacttag

SEQ ID NO: 50568 - DNA, 3783 bp, Artificial Sequence
  Description of Artificial Sequence: Synthetic coding sequence
atgcagaagggcatccggctgaacgacggccacgtggccagcctgggactcttggcacggaaagatgggaccaggaagggttatttaagcaagcggagctccgacaacacgaaatggcagaccaagtggttcgccctactgcagaaccttctgttttactttgaatctgactcgtcctcgcggcccagcggcctgtatctgttagagggctgcgtttgtgaccgggccccctccccaaagcccgcactcagcgccaaagaacccctggagaagcagcactattttactgttaacttctcccatgaaaatcagaaagcactcgaactccgtactgaggacgccaaggattgcgacgagtgggtcgctgcaatcgcgcatgcttcctacaggaccctggccaccgagcacgaggcactgatgcaaaagtacctgcacttattacaaatcgtggagacggaaaagactgtggctaagcagctgcgccagcagattgaggacggagagatcgagatcgagcggctcaaggccgaaatcacatcattgctgaaagacaacgaacgcatccaatctacgcagactgtcgcacctaacgatgaagatagcgacattaaaaagatcaagaaagtgcaatcttttctgaggggatggctctgtagacgcaaatggaagacaatcatccaggactatatcaggagcccacacgcagactccatgcgaaaacggaaccaggttgtgttttcaatgctcgaggcggaagccgagtacgtgcaacagcttcacattctggttaataacttcttgcggcctctaaggatggccgccagcagcaaaaaacctccaataacacacgacgatgtctctagtatcttcttgaattcggaaactatcatgtttttgcatcagatattctaccagggtctcaaagcgaggatttcttcttggcctactctggtgttagcggatctgttcgacatcttactgcccatgctgaatatttaccaggagttcgtgagaaaccaccaatactcactgcaaatcctcgcgcactgcaagcagaacagggatttcgacaagctgctgaagcactatgaagcaaagcctgattgcgaggagcgcactttggaaacattcctgacctaccccatgtttcagattccaaggtacattcttacactccacgagcttctggcccacaccccccatgaacacgtcgaacgtaactcgttagattacgctaagtccaaattagaagagctcagcagaatcatgcacgacgaagtctccgaaaccgagaatatcaggaaaaacctagccatagagcgtatgattatcgaaggctgcgaaattttgttggacacttcccagacctttgtccgacagggatcactaatccaggttcccatgtctgaaaaaggcaagataactagggggcggctaggcagcctcagcttaaagaaggaaggggaacgtcaatgcttcctctttagcaagcatttaataatctgtacaaggggaagtggtggtaagctccatctgacgaaaaacggggtgatctcgctgatcgactgcacattgttggaggagcccgagagcaccgaggaggaggcaaaggggtcaggtcaagacatagaccacttagacttcaaaatcggcgtggagccaaaggatagtcctcccttcacagtgatcctcgtggcttccagcagacaggaaaaggccgcctggacctcagacatttcacagtgtgttgataacattcggtgcaatggcctcatgatgaacgcctttgaagaaaattctaaggtaaccgtgccccaaatgataaaaagtgatgctagtttatactgtgacgatgtggatattcgcttcagcaagacaatgaactcatgtaaagtgttgcagattcgctatgcttcagtcgaacgcttactggagcgcctgacagacctgcgattcctcagcatcgatttcctgaatacgtttcttcacagctacagagtcttcacaaccgctatcgtggtgctcgacaagctgataacgatctataagaagccaatttctgctattccggcacgctggctccggtcactggaacttctgtttgcctctgggcagaacaacaaactactttacggggaaccccctaaaagcccccgcgccacaagaaaattttctagtccccctcctctgtctataaccaagactagctcccctagccggaggaggaaattgtcactgaatatccccatcatcacgggaggcaaggcgctcgatctagccgcgctgagttgtaatagtaatgggtataccagtatgtattctgcaatgagcccgttttcaaaggccacactggatacctcaaagctgtacgtgagcagcagttttacaaacaagattccagacgaaggcgatacgactccggagaagcccgaagacccttccgctctctcaaagcagagttccgaggtatccatgcgcgaagagtccgatatcgatcaaaaccagtccgatgatggggataccgaaacatctcccacgaagagtccaacaacgccaaaatctgtgaagaacaaaaattcctctgaattccccctctttagttacaacaatggcgtcgtgatgacgtcttgccgcgagctcgacaacaatcggagcgcgctctctgccgcctcagcattcgccatcgcaaccgccggcgcaaatgaggggaccccaaacaaggaaaagtaccgccgaatgagtcttgcttcagctggctttcctccggaccagagaaatggagacaaagagttcgtcatacggagggccgcgacaaatcgggtgctaaatgttctaagacattgggtttcaaagcatagccaggatttcgagacaaatgacgaacttaaatgcaaggtgataggtttcctcgaagaagtcatgcacgaccccgaactgttgacccaagaaagaaaggcagcagccaatatcatcagaacactcactcaggaggaccccggggataatcaaatcactctcgaggaaataactcaaatggccgagggtgtaaaggccgagccgtttgagaaccacagtgctctcgagatagcggaacaactgacgctcctcgatcacctagtctttaaaaagattccgtacgaggagtttttcggccaaggctggatgaaactcgagaagaacgaaagaactccttatatcatgaagactacgaaacacttcaatgatatctcgaatctcatcgctagtgagattatcaggaatgaagatataaatgcaagagtgtccgccattgagaagtgggtggctgtagctgatatctgccggtgtttacataactataatgccgttctggagatcacttcaagcatgaaccggtctgcaattttcagactaaaaaaaacctggttgaaggtgtctaagcaaactaaggctctcatcgacaaacttcagaaactcgtatcttcagaaggtcggttcaaaaacctgcgcgaagcactcaagaactgtgatccaccctgcgtgccctacttgggcatgtacctgactgatctggcgttcatcgaagaggggacacccaactacacggaggacggactggtgaatttcagcaaaatgcggatgatttctcatattattcgagaaattcgacagtttcagcagacagcatataagatcgagcaccaggctaaggttacgcagtatctcctggaccagtcttttgtaatggatgaagagagcctttatgagtcttctttaaggatcgagcccaagctgcccacatag

SEQ ID NO: 50569 - DNA, 1470 bp, Artificial Sequence
  Description of Artificial Sequence: Synthetic coding sequence
atgttcctggagccccaggagaccatgccccagaccagcgtggtgttctcctccattttaggaccgtcttgctctgggcaagtgcagccaggaatgggagagaggggtggaggagccggggggggcagcggcgatcttatcttccaggatggccacctgattagcgggtcacttgaggctctgatggagcatctagtcccgacggtagattattatcccgacagaacctacatttttacattcctgctgagtagccgcgtattcatgccgccacacgatctgctggcgagagtgggccagatctgtgtggaacagaaacagcagcttgaggccggtcccgagaaagctaaattgaagagtttttcagctaagattgtacagctgcttaaagaatggactgaagcatttccctatgactttcaggacgagaaagctatggcagagctcaaggctatcacacatagggtgacgcaatgcgacgaggagaatggcaccgtcaaaaaagctattgctcagatgactcagtcgctgctcctgagtcttgccgctcgctcgcagttgcaggagctgcgagagaaactgcgtccccctgctgtggacaagggccccatactcaagactaaacctcccgctgcacagaaggatatcctcggagtatgttgcgatccattagtgttggcccaacaactgacgcacatcgagctcgatcgtgtttcatccatctatccagaagacctcatgcagatcgtttcacacatggattccttagacaaccaccggtgtagaggggatctgacaaaaacatattcactggaggcatacgataattggttcaactgcctgagtatgctggtagcgacagaagtctgccgggtggtgaagaagaaacataggacacggatgttggaattttttatagatgtggccagagagtgttttaacatcgggaacttcaactctatgatggcaattatctctgggatgaacctgtccccggtggcaagactcaagaagacatggtccaaagtgaagaccgctaaatttgatgttctcgaacatcatatggatccatcatctaacttttgtaactaccggaccgctctacaaggagcgacccagcggtcacaaatggctaactcctcccgcgagaaaatagtgattccagtcttcaacctgttcgtgaaggatatctattttctgcacaagatacacacaaatcatttgcccaatgggcacattaattttaaaaagttttgggaaatatctcgccagattcatgagtttatgacatggacacaggttgaatgcccgttcgagaaagacaagaagatccaatcttacctacttacagctcctatttactcggaagaggcactgtttgttgcaagttttgaatcagagggccccgagaaccatatggagaaagacagttggaaaaccctgcgcactacactgttgaatagagcctag

SEQ ID NO: 50570 - DNA, 1446 bp, Artificial Sequence
  Description of Artificial Sequence: Synthetic coding sequence
atgccccagaccagcgtggtgttcagcagcatcctgggccccagctgcagcgggcaagtgcaacccggcatgggagagaggggcggaggggccggcggaggcagcggcgacctcatttttcaagatggccacttaatttccgggtcactggaagccctcatggagcatctcgtgcctactgttgattactacccagatcgcacttatatttttacgttccttttgtcaagccgggtgttcatgccaccacacgacctgctggccagagtggggcagatttgtgtagaacagaaacaacagctagaggcggggcccgaaaaagcgaagctgaaatcattcagtgccaagattgttcagttgctgaaggagtggactgaggcctttccttatgactttcaagatgaaaaagctatggccgaactcaaagctatcacacacagagtgactcagtgcgacgaggagaatggtaccgtgaagaaagctattgcgcaaatgacccagtcactgctgctcagtcttgcagcccgtagccaattacaagagctcagggagaaacttcgacctcccgccgtcgacaaaggaccaatacttaaaacaaaacctccagccgctcagaaagacatcttgggggtttgctgcgatcctctggtgctagcccagcagctgacccatatcgagctcgacagagttagctccatctaccccgaagacctaatgcaaattgtttctcatatggatagtttggataaccaccggtgcagaggtgacctaaccaagacgtactcactcgaggcatacgacaattggtttaattgcctttccatgctggtagctaccgaggtctgtagagtcgtgaaaaaaaagcatagaacgcggatgctcgaattttttatagatgttgcccgggagtgcttcaacattggcaattttaactccatgatggccatcatcagcgggatgaacctgtcccctgtcgccagacttaaaaagacctggtctaaagtgaagacagccaagtttgacgtcctggagcatcatatggatcccagcagcaatttttgtaactaccgcacagcgcttcagggagctactcagcgcagccagatggcaaatagctcccgcgaaaaaattgtgatccccgtgttcaatctatttgtcaaagacatttattttttacacaaaatccatactaaccacctccccaacggacacattaacttcaagaagttctgggagatttctcgacagattcacgagttcatgacttggacacaggtcgagtgtccctttgagaaagacaaaaaaatccaatcatatctattaactgcccccatctactcggaagaagctttgttcgtggcctcttttgagtcagagggccccgaaaaccatatggaaaaggattcatggaagaccctaaggacaactctgctcaatcgtgcgtag

SEQ ID NO: 50571 - DNA, 1446 bp, Artificial Sequence
  Description of Artificial Sequence: Synthetic coding sequence
atgccccagaccagcgtggtgttcagcagcatcctgggccccagctgctctggacaagtccagcctggaatgggagagaggggagggggcgctgggggagggagtggtgatctgatctttcaggacgggcatctcattagcgggagtctggaggcactgatggaacacctggtgcccactgtcgactattaccccgatcggacatatatattcacttttctgcttagtagcagggtattcatgcctccacacgatctgttggcacgggtagggcaaatttgtgtggaacagaagcagcagctggaggcgggcccagaaaaagcaaagctaaagagctttagcgccaagattgtgcagctcctgaaggagtggactgaggcctttccttatgacttccaagacgagaaggccatggcagaactgaaagcaataacacacagagtgacccagtgcgatgaggagaatggaacggtcaaaaaggctatcgcgcagatgacccaaagcctgctattgtcactggcggcaagatcccagctgcaggaacttcgggagaagttaagaccccccgcagtggataagggtcccatactcaagactaagccacccgccgcacagaaagacatcttgggcgtgtgctgcgaccctctggtcttggctcagcagttgactcacattgaattagaccgggtttcaagtatctaccctgaagacctgatgcagattgtctcccacatggattccctggataatcaccgctgtcgaggagacctcaccaagacttattctttagaggcctatgataactggttcaattgtctcagcatgctggtcgcaactgaggtttgcagagtcgtcaaaaaaaagcatcgcacaaggatgctcgaattcttcatagacgtggcaagagagtgctttaacataggaaactttaactcaatgatggcaataatttctggaatgaacctctctcctgtggcaagactgaagaaaacgtggtccaaggtcaaaactgcgaagtttgacgtgcttgagcaccacatggatcccagctcaaacttctgcaattataggaccgccctgcagggcgcgacccagcgctcccagatggcaaattctagcagagagaaaattgtgatccccgttttcaatctgttcgttaaggacatctatttccttcataagattcacactaatcatctgccgaatgggcacattaattttaaaaaattctgggagatctctcgtcagattcatgagttcatgacttggacacaggtggaatgccccttcgaaaaggataagaaaatccaaagctatttgctgactgcacctatttatagtgaggaggctctgtttgtggcatcctttgaaagcgaaggccccgagaatcacatggagaaggattcctggaagaccctacggactacattgctcaatcgtgcatag

SEQ ID NO: 50572 - DNA, 1422 bp, Artificial Sequence
  Description of Artificial Sequence: Synthetic coding sequence
atgccccagaccccccccttcagcgccatgttcgacagcagcggctataacagaaatctgtaccagtcggctgaagatagctgtgggggcttatactaccatgacaataacttgttatcaggatcccttgaggccctcatccagcacctggtgccaaatgtggactactacccggaccgcacctatatcttcaccttcctgctgagcagccgccttttcatgcatccttacgagctgatggctaaggtctgccacttgtgtgtggagcaccaacgcctgagtgaccccgactccgacaagaatcaaatgcgtaaaatcgccccaaaaatcctccagttgctaactgagtggaccgagaccttcccctatgacttcagagatgagagaatgatgcgcaacctgaaagacttggcccacaggatagcctcaggcgaggaacagacctaccggaagaatgtgcagcagatgatgcagtgcctgataagaaagctcgcagcactgtctcaatacgaagaggtgctcgcaaaaattagcagcacaagtaccgatagactgactgtgttgaaaaccaagccacagagcatacagcgggacattataactgtctgcaacgacccttacaccctcgcccagcaactgacacatattgaacttgagcgcctgaattacataggacctgaagagttcgtccaggccttcgttcagaaggaccccctcgataacgataaatcttgctacagcgagaggaagaagactcgcaacctggaagcatacgtggagtggttcaaccggctgtcatacctagtggccaccgagatttgtatgcctgttaaaaagaaacacagggctaggatgattgagtacttcatcgacgttgccagggagtgcttcaatataggcaactttaactcactgatggcaataattagcggtatgaacatgtcgcctgtgtccagactcaagaagacgtgggcaaaggtcaagacggccaagttcgatatcctcgagcaccagatggatcccagttcaaatttctataattataggacggccctgaggggagcggcccagaggtccttgacagcacactcctcaagagaaaagatagtaattcccttcttttccctccttataaaagacatatacttcctgaatgagggttgtgctaatcggctccctaatgggcatgtgaacttcgaaaaattttgggaattagcaaaacaagtttcagagttcatgacttggaaacaggtcgaatgtccgttcgaacgggaccgaaagatcctacaatacctactgacagtccccgtcttctccgaagacgctctgtatcttgcttcttacgaatcggagggtcccgaaaatcacatcgagaaagaccggtggaaatcattgcgcagcagtctcctgggtagggtctag

SEQ ID NO: 50573 - DNA, 1296 bp, Artificial Sequence
  Description of Artificial Sequence: Synthetic coding sequence
atgccccagaccccccccttcagcgccatgttcgacagcagcggctacaacagaaacctctaccagagtgctgaagatagctgcggaggcctgtactatcacgataacaacttactcagcggatcccttgaggccctgattcaacacctggtgccaaacgtcgattactatcctgacaaccaaatgagaaaaattgcccctaaaatactgcaactcctgacagaatggacggaaactttcccttacgatttccgcgacgaacggatgatgcgaaacttgaaagacctggcccatcggatcgcttcaggggaggagacctaccgcaagaacgtacagcagatgatgcagtgtctcatcaggaaactggcagccttgtctcagtacgaggaagtgcttgctaagatcagttccaccagtaccgacagacttacagtgctcaagacaaagccacaaagcatccagcgggacattattactgtgtgcaacgatccttatactcttgcccagcaattgacccacatcgagctggagaggctcaactatatcggccctgaggaattcgttcaagccttcgttcagaaggaccctcttgacaatgacaagagctgttatagcgaaagaaagaagacccgtaatctggaagcctacgtggaatggtttaatagattgtcatatttggtggcaaccgagatttgcatgcctgtcaaaaaaaaacatcgcgctcggatgatcgagtattttatcgatgtcgcccgggagtgttttaatatcggcaacttcaactcattaatggcgataattagtggcatgaacatgtcacccgtgtcgaggttgaagaaaacgtgggccaaagtgaaaactgcaaagttcgacattcttgaacaccaaatggatccgtcgagtaacttctacaattatcgcactgccttgcggggagcagcacagagatccctcacggcccactcgagtcgagagaaaatcgttatcccctttttctcgctgcttattaaagacatctatttcctgaatgaggggtgtgctaatcgactgccaaacgggcacgttaacttcgaaaagttctgggagcttgctaaacaggtgtccgagttcatgacctggaagcaggtcgaatgtccgttcgaaagagaccggaaaatcctgcagtacctactgacagtgccggtatttagcgaagatgccctatatctagctagctatgagagcgaaggcccagaaaaccacatagaaaaggatcggtggaagtctctcagatcgtccttgttgggacgagtctag

SEQ ID NO: 50574 - DNA, 633 bp, Artificial Sequence
  Description of Artificial Sequence: Synthetic coding sequence
atgccccagaccccccccttcagcgccatgttcgacagcagcggctacaatagaaacctttaccagagcgctgaggactcatgcggtggcttgtattaccacgataacaatcttttgtcaggcagtctcgaggctctgatccagcatctggtccctaacgtggactactacccagatcgaacgtatatctttacattcctcttatcctcgagactctttatgcacccatacgagttgatggctaaggtgtgtcatctgtgcgtcgaacaccagcgtttatctgacccagactctgacaaaaaccaaatgagaaagattgctccaaagattctccagttactgacagagtggacagagacattcccttatgactttcgggacgaacgcatgatgcgaaatctgaaggatctcgcgcacaggatcgcatctggcgaggaagtgggcaaccttaacttggcccgcctgctggagtttcccggaagagcgtgggtgggaaacggggctgaactctgcatcctgatttcgactgcctcatccctgttttgtttgtgggcctctcccccacaccatatactggtgtacctcgtctgccaggtgcggatgattattcccagtcatttcaaaggtatatag

SEQ ID NO: 50575 - DNA, 633 bp, Artificial Sequence
  Description of Artificial Sequence: Synthetic coding sequence
atgccccagaccccccccttcagcgccatgttcgacagcagcggctacaaccgaaacctgtaccagtctgccgaagattcatgtggagggctttactaccacgataataatttgttaagcggatcactggaagcactgatccagcacttggtgcctaatgtcgactactatcccgatcggacttacatttttaccttcctcttaagtagcagactgttcatgcacccatatgaactcatggctaaagtctgccatttatgtgtcgaacaccagcgcctgagtgacccagactccgataaaaaccagatgcggaaaatcgctcccaagatcctccaactcttaacagaatggactgaaacatttccttacgattttagagacgaaaggatgatgcgtaatcttaaagaccttgctcaccggattgcctccggagaagaagtgggaaatctcaatctggctcggctgctggagttcccagggcgcgcttgggtgggcaatggagctgagttatgcatcctaatttccacggcctccagcttattctgcctttgggccagccccccccaccacatcctggtttatcttgtatgccaagtccggatgattatcccaagccactttaaaggcatatag

SEQ ID NO: 50576 - DNA, 1419 bp, Artificial Sequence
  Description of Artificial Sequence: Synthetic coding sequence
atgccccagaccccccccttcagcgccatgttcgacagcagcggctataaccgcaatctgtaccagagcgccgaagactcttgtggcgggctgtattaccacgacaataatctcctgagtggcagcctcgaggctctgattcagcatctggttccgaatgtggactattaccctgatcggacatatatctttaccttcttgctttcctcccggctttttatgcacccatatgagttgatggccaaggtgtgccacctgtgcgtggagcatcagcgacttagcgacccagatagcgataaaaatcagatgagaaagattgcacctaagattctccagttacttacagaatggacggaaacatttccctacgacttccgggatgagcgaatgatgcggaatttgaaagatctggcacatagaatcgcatctggtgaagagacttatcgcaagaatgttcaacagatgatgcagtgtctcatcaggaagctcgctgccctctcccaatacgaggaggtactcgccaagatttcatctaccagtactgacagattgacagttttaaagaccaaaccccagagcatacagcgggacattataacagtgtgcaatgatccttataccttagcacaacagctaacccacatcgagttagagagattgaattacatcggtccagaggaattcgtgcaggcatttgtgcagaaggatccactggacaatgacaagagctgctattccgagcgtaaaaaaacccgcaacctagaagcctacgtggaatggtttaataggctgagttatctcgtcgccaccgagatttgcatgccggtgaaaaagaagcatcgggcgcggatgatcgagtatttcattgacgtggcccgagaatgcttcaacattgggaacttcaactccctcatggcaataatctcaggcatgaacatgtcccctgttagtaggctgaagaagacttgggccaaagtgaagacagctaaattcgatattctggaacaccagatggacccaagctctaacttttacaactacagaaccgccctccgcggtgccgctcaacgcagcctgacggcccattccagtcgcgagaaaattgtgattcctttcttctctttgttaatcaaggacatttacttcctgaatgaaggatgtgcaaatcggttgcctaacggacacgtgaacttcgagaaattctgggaactggccaaacaggtttcagaattcatgacttggaagcaggtggaatgtccattcgaacgggatcggaaaatccttcagtatttattaaccgtgcccgtgttttctgaggatgctctttacctggcatcctacgagtcagaggggccagagaaccatatcgaaaaggaccggtggaagtcactccgctcgagtttgttgggacgggtttag

SEQ ID NO: 50577 - DNA, 1401 bp, Artificial Sequence
  Description of Artificial Sequence: Synthetic coding sequence
atgccccagaccctgagcgccagcgacatggtgacccccggcagcttatctccaccaccaaccgagcctacagacggagaacaggcaggtcagcctcttctcgacggggctccctccagcgcaagtctggagacactgatccagcacttggtaccaaccgccgactattaccccgagaaggcttatattttcactttccttctttcgtcgagacttttcatcgaacctcgcgaactgctggcccgggtctgccacctttgcatcgaacagcagcagctagacaaacctgtgctcgataaagcccgcgtgcgcaagtttgggcccaagctgttgcagctcctggctgagtggacggagacgttcccccgggactttcaggaggaatcaactatcggtcacctgaaggacgtcgtgggccgaattgccccttgcgatgaagcgtatagaaagcggatgcaccagctgctgcaggcattgcatcaaaagctagccgcactcaggcaagggccagagggtctcgtcggcgctgacaaacccatctcataccgaaccaaacctcctgctagtattcatcgagagctgcttggcgtgtgtagtgatccgtacacactggcacagcagctcacccatgtcgagctagaaaggttgcgccatatcggacccgaagaatttgtccaggcatttgttaataaggacccactggcttctactaagccttgctttagtgataaaacatccaatctggaggcatatgtgaagtggttcaatcgcctgtgctacctggtcgcgacagaaatatgtatgcctgccaagaaaaagcaaagagcacaggtgatcgagtttttcatcgatgtggcccgcgaatgcttcaatatcggcaacttcaacagtttgatggccatcatatcagggatgaacatgagccccgtgtctcgccttaaaaagacctgggctaaggtgagaactgcgaagtttttcatcttggaacatcaaatggatcctactgggaatttctgtaactatagaactgccctgagaggcgctgcccatagatcactgactgcccatagttctcgcgaaaagattgtcatcccctttttctctctcctaattaaggacatttacttcctgaatgaaggatgtgccaatagacttccgaatgggcacgtaaattttgagaagttccttgaactggcgaagcaggttggggagttcatcacctggaaacaggtggagtgcccatttgaacaggatgccagcattactcattatctttatactgctcccatcttcagcgaggatgggctatatcttgcttcttatgaaagcgagtctccagagaaccagacagagaaggagcggtggaaggccttgcggtcaagcattcttggaaaaacctag

SEQ ID NO: 50578 - DNA, 1401 bp, Artificial Sequence
  Description of Artificial Sequence: Synthetic coding sequence
atgccccagaccctgagcgccagcgacatggtgacccccggcagccttagccctcctcccacagagcccaccgatggcgagcaagcaggccagccactgctcgacggcgccccttcatctgctagcctggaaaccctaatccagcacttggtacctactgccgactactaccccgaaaaagcatacatctttacgttcttactctcctctagacttttcattgaacctcgggaactcctggccagggtctgtcacctctgcatcgagcagcagcagttggataagcctgtcttggataaggcccgggtccggaagttcgggccaaagctgcttcagttgctggctgaatggactgaaacattcccccgggacttccaggaagagagtactattggccatcttaaagacgttgtaggaaggatcgccccttgtgatgaggcgtaccggaaacgcatgcaccagcttctgcaggcccttcaccagaagctggccgcattgaggcagggcccagaggggctggtgggagccgataagcctatatcctaccgtactaaacccccagcttctatacaccgggagttgctgggcgtgtgtagcgacccctacactctcgcccagcagctgacccacgttgaactcgaacgcctgaggcacatcggtcccgaggagtttgtgcaggctttcgtaaataaggaccccctcgcaagtactaaaccttgtttttcagataagacatcaaacttggaagcgtatgttaaatggtttaaccgtctgtgctacttagtggccactgagatctgcatgccggccaaaaaaaagcagcgggcacaggtaattgaattttttattgacgttgcccgcgagtgttttaacatcggcaactttaatagccttatggccataattagtgggatgaatatgagccctgtttcgagactgaaaaagacttgggcgaaagtccgtaccgccaaattcttcatcctggagcatcagatggatccgacaggcaatttttgcaattaccggaccgcgttgcggggcgccgcccacaggtcacttacagctcactcatctagggagaagattgttatccctttcttcagcctgttgatcaaggatatttatttcttgaacgaagggtgtgccaatcgattgcccaacggccatgtaaatttcgagaaatttttagagctggctaagcaagtaggagaatttataacctggaaacaggtggagtgcccgtttgaacaggatgcaagcatcacacactatctttatactgccccgattttctcggaggacggtctgtatctggcttcatatgaatccgaaagccctgagaaccagacggaaaaggaacgatggaaggctcttagaagttcaatccttggtaagacgtag

SEQ ID NO: 50579 - DNA, 1170 bp, Artificial Sequence
  Description of Artificial Sequence: Synthetic coding sequence
atgcgggtgctggtgcggcggtgctggggcccccccctggcccacggagccaggcggggacgcccatcaccccagtggcgcgctctcgctcgacttgggtgggaagactgcagggacagtagagtgcgcgaaaaacccccctggcgggtcttgttctttgggaccgaccaatttgcccgcgaagccttgcgggccctccacgcagcacgggaaaataaggaagaagagctcatagataagttggaagtggtgactatgccctccccatccccaaagggtctccctgtgaaacaatatgcggttcagagccagctgccagtttatgagtggccagacgtcgggtcaggggagtatgatgtgggagtggtcgcttcgttcggacgactccttaatgaggcgctgattttaaagtttccctatggtattctgaacgtgcacccaagctgcctgccacggtggagagggcccgctcccgtcatccacaccgttttacacggcgatacagtaaccggcgtgacaataatgcagattcgaccgaagagatttgacgtggggcccatcctgaaacaagagaccgtcccagtccccccaaaatcgactgccaaagagttagaagccgtgttaagccgcctcggagccaacatgcttatcagcgtgcttaagaatctgcccgagtcactgagtaatgggagacaacagcctatggagggagccacatatgccccgaaaatttcagccggtaccagttgcataaagtgggaggaacagaccagtgaacaaatcttcaggttatacagggctattggtaatattattccactgcagactctgtggatggccaacacaattaagttgctggatcttgtggaagtgaattcatcagttctggcagaccctaaactaacagggcaggctcttatccctggttctgtgatttaccacaaacagtcgcagatcctcctggtgtactgtaaggacggttggattggtgtccgttctgtgatgcttaagaaatcgctaacggccacagatttctacaatgggtacttacacccctggtaccagaaaaattcccaagcccagccatcccagtgccggtttcagacactccgcctacctaccaaaaaaaaacaaaaaaagactgttgccatgcagcagtgtattgagtag

SEQ ID NO: 50580 - DNA, 744 bp, Artificial Sequence
  Description of Artificial Sequence: Synthetic coding sequence
atgagcagcgtgttcggcaagccccgggccggcagcggcccccagagtgcacctctcgaggtgaacctggctatccttgggcgtaggggagctggcaaaagtgaggatacatatagctccgaagaaacagtcgaccaccagcctgtccacttaagagtgatggacactgctgatttggacacaccccgcaattgtgaacggtacctgaactgggcccacgctttcctggttgtgtattctgtcgatagcaggcagtcgttcgactcgagttcgtcctatttggaactgctggcactccatgcgaaagagacacagcgctcaatccctgctttgcttttaggcaacaagctggacatggctcagtaccgacaggtaacaaaagcggaaggcgtcgcacttgcgggtagattcggatgcttgttcttcgaggtgagcgcctgcctggactttgaacacgtacagcacgtgttccacgaggctgtgcgtgaggccagacgcgaactggagaaaagtccgctgactcgccccctatttatcagcgaggaaagagcacttcctcaccaagccccactgacagcacgccatggtcttgcatcctgcacctttaataccttgagtaccattaatctcaaggaaatgcccaccgtggctcaggccaaactggtcacagtgaagtcatctagagcgcagtctaaacggaaggctccaaccctaacactgctgaaaggatttaagatcttttag

SEQ ID NO: 50581 - DNA, 768 bp, Artificial Sequence
  Description of Artificial Sequence: Synthetic coding sequence
atggtgatcatgggccccgagctggtgggcagctggagcgacttcaaaaacgaggccgcagatccgcgggcgctgaccgtgaagttccttaccaaacgatttatctcagaatatgatccgaatctggaagacacttattccagtgaagagacggtggaccatcagccggttcacttacgcgttatggatacagcagacctagatacacctagaaactgtgagcgctacctgaattgggcccatgccttcttggtagtctattcagtagactcacgtcaaagcttcgactctagctctagttacctcgaacttctggccctccacgcaaaagaaacgcagcggtctatccctgctttactcttaggcaacaaattagatatggctcagtaccggcaggtcacaaaagccgagggggtcgcactcgctggtagattcgggtgtctgttttttgaagtcagcgcctgtctggactttgaacatgtccaacatgttttccatgaagccgtgcgcgaggctcgccgggagctggaaaagtctcctctgactcgccccttatttatctctgaagagcgcgccctgcctcaccaggcgcccctaacagctcgacatggcctcgcaagttgcaccttcaatacactttccaccatcaacttgaaggaaatgcccactgtggcccaagctaagctggttacggtgaagtcttcgagagcacagtcaaaacgcaaagcccccaccttgacgctcctgaaggggttcaagatcttctag

SEQ ID NO: 50582 - DNA, 1131 bp, Artificial Sequence
  Description of Artificial Sequence: Synthetic coding sequence
atggccgaggagcggcccggcgcctggttcggcttcggcttctgcggattcgggcaggagttggggagcggaagagggcgacaggtacatagcccgtccccactgagggccggcgtagacatttgccgcgtcagcgcatcctggagctacactgcttttgtaacacgcggcggacggctggaactgtctggcagcgccagtggtgcggccggccgctgcaaggacgcgtgggcctcagagggcttgttggctgtgctgcgggctgggccggggcccgaggccctcttgcaggtgtgggccgcggaatcagccctcaggggggagccattatgggcacaaaatgtagtccccgaggccgagggtgaggatgatcccgcaggggaagcacaggcaggtagactgcctctactgccctgtgctagagcttacgtctcacctcgggctccattttacagaccactagcccctgagctccgggcaaggcagttggaactgggggccgagcacgcactgctgctggatgccgcagggcaggttttcagttgggggggagggcggcatggccagttgggccatggcaccctcgaagcagaacttgagcctcgcctcctggaagcacttcagggactggtgatggctgaggtggccgccggcgggtggcactctgtatgtgtcagtgagaccggagacatctacatatggggttggaacgaaagcggccagctcgccttacctactcggaatcttgcagaggatggcgaaaccgttgcaagagaagctactgagctgaatgaggatggatcgcaagtcaaacggactggaggagccgaggacggggccccagctccttttattgccgtgcagccctttccggccttgcttgatttgccgatgggaagtgatgcagttaaagcctcatgtggctcccggcatacagcagtggttacacgaaccggagaattgtacacgtggggatggggtaagtacgggcaactagggcatgaggatacgactagcctggaccggccgcgtcgcgtggaatattttgtcgacaagcagctgcaagtgaaagcagtgacttgcggcccttggaacacatacgtttatgccgttgaaaagggaaagtcttag

SEQ ID NO: 50583 - DNA, 1131 bp, Artificial Sequence
  Description of Artificial Sequence: Synthetic coding sequence
atggccgaggagcggcccggcgcctggttcggcttcggcttctgcggattcggtcaggagctgggatcgggcaggggaaggcaggtgcactcaccatcgcctctgcgggctggcgttgatatctgccgcgtttccgcatcctggtcctacaccgccttcgtgactcgcggcgggaggttggagttgagtggaagcgcgagcggagccgccgggagatgtaaggatgcttgggcatccgaaggcctattggcagtgttgagggcaggcccaggccccgaggctctgttgcaggtctgggccgctgaaagcgccctgcgcggtgaacctctgtgggcacagaatgtagtgccggaagcagaaggtgaagacgaccccgccggagaagctcaggctggaagactacctttgctgccttgtgctcgggcctacgtgtcaccccgtgcaccgttttacagacccttggcccctgaactccgcgccagacaactggagcttggcgccgaacatgccctcctccttgatgccgcagggcaggtctttagctggggaggaggacgccacggtcagctaggccacggtactctagaagctgagcttgagccccgtctgctggaggcattacagggactggtgatggccgaggtggctgccggtggttggcattccgtgtgcgttagcgaaaccggcgacatttacatctggggatggaatgaaagcgggcagctagccctgccaacgaggaacctggcggaggacggagaaaccgtggctcgggaggctaccgagctgaacgaggatggatctcaggtgaagcggactgggggagctgaggacggcgcccccgccccctttatcgccgttcagccatttccggccctactagacctgcctatgggcagcgatgccgtgaaagcatcgtgcggtagcaggcacacagccgtggtcactagaacaggggagctgtacacatggggctggggaaagtatgggcagctggggcatgaggacacgaccagcctggacaggcctaggagggtcgagtactttgtggataagcagttgcaggtgaaggctgtaacatgtgggccctggaacacttatgtgtatgctgtggagaagggaaagagctag

SEQ ID NO: 50584 - DNA, 594 bp, Artificial Sequence
  Description of Artificial Sequence: Synthetic coding sequence
atggaggagcggcccgccgagaccaacgccaacgtggacaacagcgctagtccttccgtggctcagcttgcgggccgcttcagggagcaggctgcagcggcgaaagagactccagcctcgaaacccacccgccgaaaaccgccttgttccctgccattattcccacctaaggtagatctcggtcagaacggcgaagaagctaacctgaccttcgatcccgcagccctgttacccggcgccagtcccaaaagccctggcctgaaagccatggtctctccattccattccccacctagtaccccaagcagtccaggcgtgcgttcacggccatctgaggctgaggaagtccctgtctctttcgatcagcctccggagggcagccatcttccatgctataataaagtccggacaagggggtctattaaacgccgcccacctagtagacgctttaggaggtcccagtctgactgtggtgaactgggcgattttagggccgtcgaatcaagtcagcaaaacggagctaaggaagaagatggcgatgaggttctcccaagcaagagtaaggcccccggcagcccgctgtcgtctgagtag

SEQ ID NO: 50585 - DNA, 1251 bp, Artificial Sequence
  Description of Artificial Sequence: Synthetic coding sequence
atggaggagcggcccgccgagaccaacgccaacgtggacaacagcgcctcaccctctgtagcccagcttgccggccggttcagagaacaggccgccgcagccaaagagacacctgcaagtaagcctacccggcgtaaaccaccatgctctttgccactttttcctcccaaggtggaccttggccaaaacggagaagagaagtccccacctaacgctagtcacccaccgaagtttaaggtcaagtcaagcccattaatagagaagctccaggccaacctgacgtttgacccggctgcgctgcttcccggtgcctcacccaagtctcctggattaaaagccatggtgtctccattccatagtccacctagcaccccgagttctcccggtgtcagaagtaggccgagcgaagccgaagaggttccagtgtcatttgaccagccccccgagggttcgcacctgccatgctacaataaggtgcggaccagaggcagtatcaagagaaggccaccatctcgacgcttccggcgttcacaatccgattgtggcgaactgggggatttcagagcggtcgagagtagccagcagaacggcgcaaaggaagaggatggcgatgaggtgcttcctagcaaaagcaaggcccctggttctcccttgagctccgaaggagctgctggcgaaggcgtccgtactctgggcccagctgaaaaacctcccctgcggaggtcaccgtcccgtacagagaaacaagaggaggaccgtgccacggaggaggcaaaaaacggcgaaaaagccagaagaagtagtgaggaggtcgatgggcagcacccagctcaggaagaggtgccagagagccctcaaacgtcaggacccgaggcagaaaacagatgcggctccccgcgtgaggagaagcctgctggagaggaggccgagatggagaaagccacagaggtaaagggggaaagggtccaaaacgaagaggtcgggcctgagcacgactcccaggagactaagaagctggaggaaggagcagcggttaaggaaacgcctcacagtcccccaggaggtgttaaggggggcgacgtccccaagcaggaaaaaggcaaagaaaagcagcaggaaggagcagtgctagagcctggctgttctccacaaaccggcccagcacagctggaaacttcctccgaggtgcagagcgagcccgcagtacccaagcccgaggacgacaccccggttcaggacaccaaaatgtag

SEQ ID NO: 50586 - DNA, 1161 bp, Artificial Sequence
  Description of Artificial Sequence: Synthetic coding sequence
atggaggagcggcccgccgagaccaacgccaacgtggacaacagcgcaagcccctccgttgcacagttggccggtcgcttcagagagcaggcagcagcagccaaagaaaagtctcctccgaacgctagccacccccccaagttcaaagttaaatcctcccccctgatcgaaaaattgcaggccaacttgacattcgaccccgcggcactcctgcctggcgcatctccgaagagcccgggcttgaaagccatggtgagcccattccacagtccaccctctacaccatcttctcccggtgtccggtcccggcctagcgaggccgaagaagtcccggtgagcttcgatcaacctccagagggctcccatctgccttgttacaacaaagttcgtacccgaggctctattaagagacgaccgccatcccgaagattcagaaggagccagtccgattgcggtgaactgggagatttccgggcagtggaatccagccaacagaatggcgctaaggaagaggatggggacgaagtgctgccctcgaaaagcaaagccccggggagcccactgtctagtgaaggtgcggctggggaaggggtgcggactcttgggcccgccgagaaacctcctcttaggaggagcccgagccgaacagaaaaacaggaagaggatcgagccacagaggaggcaaaaaacggcgagaaagccaggagatcatctgaggaagtggacggccagcatcctgcacaggaggaggtaccagagtccccccagacgtccggccctgaagctgaaaaccgatgcggctcacctcgtgaggagaaaccagccggggaggaagccgaaatggagaaggcgactgaagtcaagggagagagggtgcaaaacgaagaagttggacccgaacacgatagccaggagacgaagaagcttgaagagggcgctgctgtcaaggagactccccactcacccccaggcggtgttaaggggggcgacgtgccaaagcaggagaagggaaaggagaagcagcaagaaggggctgtcttggagccaggctgctcaccacaaaccggtcctgctcagttagaaaccagtagcgaggtgcagtcagaacccgctgtaccaaagcccgaagatgacacaccggtgcaggatacaaagatgtag

SEQ ID NO: 50587 - DNA, 561 bp, Artificial Sequence
  Description of Artificial Sequence: Synthetic coding sequence
atggagcccacccgggactgccccctgttcggcggcgccttcagcgcgatcctccctatgggggccatagacgtatccgacctgagaccggtgcctgacaaccaggaagtgttttgtcatcccgtgactgaccagagcctaattgtcgagctgttggagctgcaagcccatgttcgcggggaggccgccgccaggtatcattttgaggatgtggggggcgtgcagggtgcacgcgccgttcatgttgaaagcgtgcagcccctcagtctggagaaccttgctttacgtggccgttgccaggaggcttgggtgctcagtggtaagcagcaaattgccaaggaaaaccaacaggtggcaaaagacgtgaccctgcatcaggcactcttaagactaccacagtaccagaccgatctcctgttgacattcaaccagccaccccctgataacagatccagcttagggccagaaaatctgagtccagccccgtggtccttgggtgatttcgagcagctggtgacctccttgaccctccacgacccaaacatcttcggcccacaatag

SEQ ID NO: 50588 - DNA, 870 bp, Artificial Sequence
  Description of Artificial Sequence: Synthetic coding sequence
atgagcgccttcagcgaggccgccctggagaagaagctgagcgagctgagcaactctcagcagtcggtccagaccctatccctgtggctcattcaccaccgaaaacactcccgacctatcgttaccgtttgggaacgcgagctgcgcaaagccaaacccaaccgaaagctcacatttttgtaccttgccaacgatgtgattcagaattctaaaagaaagggcccagaatttacaaaggattttgcacctgttattgtggaggccttcaaacacgtcagttccgaaacagatgagtcatgtaagaaacatctggggagggttctctccatatgggaggagcggagtgtttacgagaacgacgtacttgagcaacttaagcaggcactctacggagacaaaaaacccaggaagcgtacgtatgaacagattaaagtggatgagaacgaaaattgctctagcttgggaagcccatccgagccgcctcagactctcgatttggtgcgggccctccaagacctggagaacgctgcatccggcgacgctgctgtccaccaaagaatcgcttcactgcccgtcgaggtgcaagaggtgagcctgctcgataaaattacagataaggaaagcggcgagcgccttagcaagatggttgaagatgcatgcatgcttcttgctgattataacggtagactcgccgctgaaattgacgacagaaagcaactaacacgcatgctggcagatttcctccggtgccaaaaggaagccctggccgaaaaagaacacaaactggagattctagacatgggggtcagttctaacgacgtcgttaccatttccattttcttcctgcttaagatcaatatcaagccttag

SEQ ID NO: 50589 - DNA, 831 bp, Artificial Sequence
  Description of Artificial Sequence: Synthetic coding sequence
atgcggaacagcaactggcggttctgccagaccggcatctacagcaagccaaatcgcaaattaacgttcttgtacttagctaatgacgttattcagaactccaagcggaaaggcccagagtttacaaaggatttcgcaccagtaatcgttgaagcatttaagcatgtctctagcgagacagatgagtcctgcaaaaaacacctcggccgtgtccttagtatctgggaggagcgatccgtctacgagaacgatgtgctggagcagcttaagcaggcactgtacggcgataagaagcctaggaagcgcacttatgagcagatcaaggtcgatgaaaatgagaactgcagctctcttgggtctcccagcgagccaccgcagactcttgatttggtccgggctctacaggatctcgagaacgcagcttccggcgacgcagcagtgcaccagcggattgcctccctccccgttgaagtgcaggaggtatcactactcgacaaaattaccgacaaggagtctggggaaagactgtccaagatggtcgaagacgcgtgtatgcttctagccgattataacggtcgtctagctgctgaaattgatgacaggaagcagctcaccaggatgctcgccgattttttacgatgccaaaaggaagccctggccgagaaagagcacaaattggaagagtacaagcggaagctcgcgagggtgtccctggtccgtaaggagttacgatctagaatccaaagtctgcccgatctcagtcgcttgcccaacgtaacaggctcgcacatgcacctcccattcgcgggggacatctactctgaagactag

SEQ ID NO: 50590 - DNA, 939 bp, Artificial Sequence
  Description of Artificial Sequence: Synthetic coding sequence
atgagcgccttcagcgaggccgccctggagaagaagctgagcgagttgtctaactcccagcaaagtgttcagacactaagtctatggctgatacaccaccgaaaacactctcggccaatcgttactgtatgggaacgggagttgaggaaggccaagcccaatcgtaagctgacattcctgtacctggccaatgacgtgattcaaaattctaagaggaagggtcctgagttcaccaaggatttcgcccccgtcattgtagaggcctttaagcacgtctcatccgaaaccgacgaatcatgtaagaaacatcttggtagggtgctctcaatttgggaggagcgttctgtttacgagaacgatgtgctcgaacagctgaagcaagctctgtatggcgacaagaaaccacgcaaacggacctatgaacagattaaggtcgacgaaaacgaaaattgtagctcactggggtcgcccagcgagccaccccagactctggacttggttcgggcccttcaggacctggagaacgccgcttccggagacgcagccgtccatcagaggattgccagcctccctgtagaggtccaggaggtaagcctcctagacaaaattactgataaagagtccggggaaaggttgtccaagatggtggaggacgcctgcatgctattagcagactacaacggcagactcgccgctgagatcgatgatcggaaacagctcacacggatgctcgcggatttcctgcgatgccagaaagaagctttggccgagaaagaacataagctcgaggagtataaacggaaactagcaagggtctccttggtgaggaaggaactgaggtcccggattcaaagtttgcccgatctgagcagacttcctaatgttacagggtctcatatgcacctgcctttcgcaggggacatttacagcgaagactag

SEQ ID NO: 50591 - DNA, 939 bp, Artificial Sequence
  Description of Artificial Sequence: Synthetic coding sequence
atgagcgccttcagcgaggccgccctggagaagaagctgagcgagctcagtaattcccaacaaagtgtgcaaaccttgtccctctggctcattcaccaccgcaagcattccaggcctatcgtcacggtctgggaaagagaattacggaaggcgaagcccaacagaaagctcacctttctgtatctggctaatgacgttattcagaatagtaagagaaaagggcctgagttcacaaaagactttgcccccgtgatcgtggaggcctttaagcacgtcagctcagagactgacgaatcctgcaaaaagcatctcggtcgcgtactgagcatctgggaagaaaggtcagtctacgagaacgacgttttagagcagttaaagcaggcattatatggcgacaaaaagccaaggaagcgcacctacgagcagatcaaagtcgacgaaaacgagaactgctcgtcactcggctccccttcagaacctcctcagacacttgacctggtgcgtgctcttcaagacctcgaaaatgctgcttcaggagatgccgccgtgcaccagagaattgcctcgctgcccgtggaagtgcaagaagtgtctctcctagacaagattaccgataaggaaagcggcgagcggctgtccaagatggttgaagacgcctgtatgcttttggccgattataacggccggctcgccgctgaaatcgatgacaggaaacagctcactcggatgctggccgactttcttcggtgtcaaaaagaagccctcgcagaaaaagagcataagttggaggagtataagcggaaactcgctcgggtaagtctagttaggaaagagctgcggtctcggatccaatctctgccggacctgtctcgcctgcccaacgtcaccggaagccacatgcatctgccatttgctggcgatatctacagtgaggactag

SEQ ID NO: 50592 - DNA, 981 bp, Artificial Sequence
  Description of Artificial Sequence: Synthetic coding sequence
atgagcagcttcagcgagagcgccctggagaagaagctgagcgagctcagcaatagccagcagtccgtgcagacattatcactgtggctcatccatcatagaaagcatgccggcccaatcgttagcgtgtggcacagagagctgcggaaggcaaagtcaaacaggaagctgacattcctatacttggcaaacgatgtcatccagaactccaagcggaaaggacccgaatttacccgagagtttgagagtgttctagtggatgctttctctcacgtggctcgagaggccgatgaaggatgcaaaaagccactggaacgcctgctaaatatctggcaggaaaggtccgtatatggcggcgagtttatccagcagcttaaattatctatggaggatagcaagagtcctccccccaaagccaccgaggagaagaaatccctcaagcgcacctttcagcaaattcaggaagaggaggatgatgactaccccgggtcttactctccacaagacccttccgccggtccactgctgaccgaggagctaataaaagccctccaggaccttgagaatgctgccagtggggatgcaactgtgaggcaaaagattgcttcactgcctcaagaagtccaggacgtttccctgctagagaagatcaccgataaggaggctgctgagaggttgtccaagacagtggacgaggcttgtctgctgctggcagaatataatggacgcttggcagctgaactggaggacaggaggcaactggctagaatgctcgtggaatatacccagaaccagaaagacgtcctcagtgagaaggaaaagaaactggaagaatataagcaaaagctcgcacgggtcactcaagtacgtaaagagctcaaatcccacatccagtcactgcctgacctcagccttcttcctaatgtaacaggcggactagcccctctccctagcgctggcgatcttttttctaccgactag

SEQ ID NO: 50593 - DNA, 459 bp, Artificial Sequence
  Description of Artificial Sequence: Synthetic coding sequence
atggccgccggcggcggcggcggcagcagcaaggccagcagcagctccgcctccagtgccggcgcactggagtccagcctggatcgaaagttccagtctgtgaccaacacgatggaaagtattcaaggtcttagctcctggtgtattgaaaacaagaagcatcacagtacaattgtgtaccattggatgaagtggcttcgaagaagcgcgtacccgcacaggttgaatctcttctacctggctaacgacgtgatccagaattgcaaacgcaagaatgccattatcttccgcgaatctttcgctgatgtgctgcctgaagccgctgcgctggtgaaggacccgtccgtgtcaaagagcgtggaaaggattttcaagatctgggaagaccggaacgtgtatccagaagaaatgattgttgcactgagagaagctctctcaaagtgtttattcttgagctag

SEQ ID NO: 50594 - DNA, 4386 bp, Artificial Sequence
  Description of Artificial Sequence: Synthetic coding sequence
atggccgccggcggcggcggcggcagcagcaaggccagcagcagcagtgctagttcagctggcgccctagagtccagtttagaccggaagtttcaaagcgtgacgaacaccatggagtctattcagggtttatcctcctggtgtatcgagaacaagaagcatcacagcacgatcgtttaccattggatgaagtggctcagacgatcagcgtacccccaccgtctgaaccttttttacctcgccaatgacgtaatccaaaattgtaagagaaagaatgctataatttttcgcgaatcgtttgccgacgtgctgcccgaggctgctgccctcgttaaggaccctagcgtgagcaaatcagttgaaagaatatttaaaatctgggaggatcgcaacgtgtatccggaggaaatgattgttgctctgcgggaggccctgtccacaacattcaagactcagaagcagctgaaagaaaaccttaataagcagccaaacaaacagtggaaaaaatcccagacatcgaccaaccccaaggccgccttgaagagcaaaatagttgctgaatttcgctctcaggctcttatagaagaactgctcttgtataagcggtctgaggatcaaatagagctcaaggagaaacagctctctacgatgagggtggacgtctgtagcaccgagacactgaaatgtctgaaagacaaaactggcggtaagaaattttccaaagagttcgaagaggcttcctcaaaactcgaggaattcgtgaacgggcttgacaagcaggtgaagaacggaccaagcctcaccgaggccctcgagaacgcagggatcttctatgaagcacagtacaaagaagttaaggtggtcgctaacgcgtataagacatttgcaaacagggtgaacaacctgaaaaaaaaactggaccaactcaaaagcaccctgccggaccccgaggaatctcctgtgccttctcccagcatggacgcacccagccccaccgggtctgagtccccattccagggcatggggggcgaggagtcccagtcacccaccatggaatccgagaaaagcgccacccctgagccagtgacagacaatcgggatgtagaggatatggaattatctgatgtagaagatgatggtagcaaaattatcgtagaggatagaaaggaaaagcctgctgagaagtccgcggttagcacctccgtcccaactaagcccactgagaatattagcaaagcaagtagctgcacaccagtgcctgtaacaatgacagccacaccacctctgcccaagccggtcaatacatcactcagcccatcccctgcgctagccttgcccaatttggccaacgtggacctcgctaagatttcgagtatcctatcaagcctgacctctgtcatgaagaacaccggggtgagtcctgctagccgaccttcacctggcacaccaacaagcccctccaacttaacatcgggtttgaaaactcccgcacccgcgacaacaacttcccacaatcctctcgctaatatcctcagtaaagtcgaaatcactccagagagcatactaagcgccctgtccaagacgcagacacaatcggcccccgcccttcaaggactttcatcccttctgcagagcgtcaccggcaatccagtcccagcttcagaggctgcatcacagtccacgtccgccagtcctgcgaatactaccgtgtccactatcaaaggcagaaacctgccgtcgtctgcgcagcccttcatcccgaagagcttcaactacagtcctaattctagcacatctgaagttagtagcacgtctgccagcaaagctagtattggccagtcacccggactccctagcacaacattcaagctgccttcgaacagcctcgggttcacagcaactcacaacacctccccagccgcccccccaacggaagtaacgatttgccagtcatccgaagtgtcaaagcctaaacttgagagtgaatcaacttcaccaagcttagagatgaaaatccacaactttctcaagggaaatcctgggttcagtgggctgaacttgaacatccctatactcagttcactggggtcctcagccccttccgagtcgcacccaagcgattttcagcgaggcccaaccagcacttctattgataacatcgacgggactccagttcgagatgagcggagcggcactcctacccaggacgaaatgatggataagccaacatcttcatcggtcgacaccatgtccttgttaagcaagataattagccccggcagctccaccccatcttcaactaggtctccaccccccggccgcgacgaaagctaccctcgtgagctctctaatagtgtgtctacataccgaccatttggcctcggttcggagtcgccctataagcagcctagtgacggcatggagaggccatcttccctgatggacagcagccaggagaagttctatccagataccagctttcaggaggatgaggactatcgggatttcgaatatagcgggccccctccttccgcaatgatgaaccttgagaagaagcccgccaagagcattctgaagagtagcaaactctcagatactactgagtaccagcccatcttgagctcttacagccaccgagcccaggagttcggcgtgaagtccgcattccctcctagtgtcagggctctgctggactccagcgaaaactgtgaccggctcagctcctctccaggtctctttggggccttctcagtcagaggcaacgagcccgggagcgatcgctccccctcaccatccaagaatgattcattcttcacccccgattctaatcacaatagcctatctcagagtactaccggacacctcagtctgccccagaagcagtacccggacagcccccatccagtgcctcatcgctccttgttttcaccccagaatacacttgcagctccaacgggccacccccctacctccggggtggaaaaggtcttggcatccaccattagcaccaccagtacaattgaatttaagaacatgctcaagaacgcctctcggaagccgagcgacgataagcattttggccaggccccaagtaaggggaccccaagtgatggggtaagcctgagcaacttaactcagccctcacttacggctaccgaccagcagcaacaggaagaacattatagaattgagacacgggtttcatctagctgcctcgaccttcccgattccaccgaggaaaagggggcgccaatcgagacactgggctaccatagtgccagcaataggagaatgagcggcgagcccattcagacggttgaaagtatcagagtgccagggaaggggaatcgcggtcacggccgcgaggcttcccgggttgggtggttcgacctatctacatccggatcatcattcgataacgggcccagtagcgcgtctgaactcgcttctctaggcggaggcggatccggcggcctgactggcttcaagacagcgccctataaggagcgcgccccacagttccaggagtccgtggggagtttccggagtaatagcttcaattctacatttgaacaccacctgcctccaagcccccttgagcatggcaccccatttcagcgggaaccagtgggaccatcttccgctcctcctgtcccacccaaagatcatggcggcatcttctcaagggatgcacccactcatctgccctccgtggatctgtccaacccatttacaaaggaggccgctctagcacacgctgcaccaccaccgccaccaggcgaacactctggaattccctttcctacccctcctccccctcccccacccggcgagcactcaagctctggggggtctggcgtgccattctcaactcctccacccccccctccacctgtggatcacagcggggtcgtccctttcccagctccacccctggcggagcatggcgttgctggcgcggtggccgttttcccaaaggatcatagttcactgttacagggaactctggcggagcactttggcgtgctcccgggtcccagagaccacgggggcccaacacaaagagacctgaacggcccaggcctgtctcgcgttagagaaagtcttaccctcccgtctcatagtctggaacacttagggccgcctcatgggggcggcggcggtgggggatctaactcttcatctggcccccccctcgggccctctcatcgggatacaatatcccggtccggcattattcttagatcgccgcgtcctgattttcggccacgggagcccttcctgtctcgagacccttttcattctctgaaaagaccccgacctcctttcgcccgggggccccccttctttgctcccaagcggccatttttcccgccaagatattag

SEQ ID NO: 50595 - DNA, 4308 bp, Artificial Sequence
  Description of Artificial Sequence: Synthetic coding sequence
atggccgccggcggcggcggcggcagcagcaaggccagcagcagctctgcctcgagcgcaggcgcgctcgagtcttcccttgaccgcaagttccaaagcgtgacaaacactatggaaagtatccagggcctgtctagctggtgtattgagaacaaaaaacaccatagcaccattgtttatcactggatgaagtggttacgccgtagcgcctatccacaccgtttaaacctgttttacctcgccaacgatgtcatacagaattgtaaacgtaaaaatgctattatattccgggagtccttcgccgacgtcttgcccgaagccgctgcactcgtcaaggatccatctgtgtccaaaagcgtggagcgcatcttcaagatctgggaggataggaatgtgtatcctgaagagatgatagtggcgctgagggaagcacttacctccacaaaccccaaagccgctctaaaatccaagatcgtggccgagttcagatcccaggcactgattgaagagttactgttatacaagaggtccgaagaccagatcgaactcaaagagaagcagttgtctaccatgcgggtagacgtgtgcagtaccgagactcttaagtgtttgaaagacaagacagggggcaagaagttcagcaaagagtttgaggaggccagtagtaaactggaggaattcgtgaatgggttggataagcaggtaaagaatggaccttccctgacagaagctctcgaaaatgctggaatcttttacgaggcccagtacaaagaggtgaaagtcgtggcaaatgcgtataagaccttcgctaacagggtgaataacctcaagaagaaactggatcagctcaagtcgactctaccagaccccgaggaatcccctgtgccatcaccttccatggacgccccctcaccgaccggatccgaatccccgtttcagggaatggggggtgaggaatcccagtcccctaccatggagagtgaaaagtcagctacaccagagccagtcacggacaacagagacgttgaagacatggagctatccgacgttgaggacgacggtagcaagatcatcgtggaggatagaaaagaaaagcctgccgagaaaagcgcagtgtccacatccgtcccaaccaagcccacagagaatatttctaaggccagtagctgtacccccgtgccagtgacaatgacagccaccccaccgctgccaaagccagtaaacacttcactgtctcccagcccggccctcgccctccccaacctggccaacgtagacctcgcaaaaatttctagtatcctctcctccttgacaagcgtgatgaaaaacaccggcgtctcccccgcttctcgcccatcaccaggcaccccgaccagcccttccaacttaacatcaggccttaagacaccggcaccggcaaccactacatcccacaatcctttggctaatatcctgtcgaaagtggagattaccccagaaagcattctatccgcactgtcaaagacccagacccaatctgcccctgccctccagggcctcagctctctgctgcaatctgtgaccggcaatccagttccagcatccgaggccgcctcccaatccacgtctgcgtcccctgcaaacaccactgtctctaccataaaaggtcgcaacctgccttcttcggcacagccatttattcctaagtctttcaactactcaccgaattcctccaccagcgaagtgtcaagcacatccgcatctaaagcttctatcggccaatcacctggcttaccaagcactacatttaagctgccttcaaactctctaggctttactgcaacccacaacacttcacccgctgctcctccgacggaggttactatctgtcagtcaagcgaagtaagtaagccaaaactagaatcggaatccacatcacccagtcttgaaatgaagattcataatttcctgaagggcaatcctggatttagcggcctcaatctgaacatccccatactgtcaagtttagggtcaagcgcaccttccgaatctcacccttcagacttccaaagaggacctacttccacaagcattgacaatatagatggaacgcccgtaagagacgagcgctcaggaacacccacccaggatgagatgatggataagccaacttcttcgtccgtggacacaatgtccctgctcagtaaaataatcagtcccggttcttcaacccccagctctacccggtcccccccgccaggccgggatgagtcctatccgagagagctctccaattctgtatcaacatatcgcccttttggactcgggtcagaaagtccatacaaacagccaagcgacggcatggaaagaccttctagtctgatggattcctcccaggagaagttctatccagatacttcttttcaggaggatgaggactatcgagatttcgagtacagcgggccgccgcccagcgcaatgatgaacctggaaaaaaagcctgcgaaatcaatcctgaagtctagtaaattgtctgacacaacagagtaccagcctatcttgagctcttacagccatagggcccaggaatttggggtgaaaagcgcttttccccctagtgtgcgggcgctcctcgactcgtccgagaattgtgatagattgagcagctctccaggcctgttcggggcattttcagtgaggggtaatgaacccggttctgacagaagccctagcccatccaagaacgatagtttttttacccccgactccaatcataatagtttatcacagtccacaacgggccacctttctctgcctcagaaacaatatccagattcacctcatcctgtgcctcacagaagcctgtttagtccccagaatacactcgctgcccctactgggcacccaccaacaagtggcgttgagaaggtgctagcctctacgatctcgactacttcaaccatcgagttcaagaatatgctgaagaacgcctctaggaagccctctgatgacaagcactttggtcaggctccttcaaaagggacgcccagcgatggagtctccctctccaacttaactcagccaagccttaccgccacggatcagcagcagcaggaggaacactatagaattgagactcgcgtcagctccagttgtctggacctgcccgatagcactgaagaaaagggggctcccatcgaaacattgggataccatagtgcttctaatcggcgcatgagcggtgaacccatacaaaccgtggagagtatacgagtgccaggaaagggtaacagggggcatggacgcgaggcctcacgtgtaggctggttcgacttgtctacttcgggttccagtttcgataacggcccatctagtgcttccgagctagcctccctcggcgggggaggtagcggggggttgactggattcaagactgccccctataaagagagggctcctcagttccaggagtctgttggcagctttaggtctaacagcttcaattcaacattcgaacaccatctccctccaagccccctcgagcatggcactccctttcagcgggagccagtggggccatcgtctgcccctcctgttcctcccaaagatcacggcggcatattctcaagggacgcacccacccatctcccaagcgttgacctctccaacccatttacaaaagaggctgctcttgcacatgccgcccccccacccccaccgggtgagcattccgggattccattcccaacgccaccaccccctccacctccaggcgagcattcctccagcggaggtagcggcgtgcccttttccacaccccctcctccaccgccccctgtggatcattctggcgtagtgccattccccgcaccaccacttgctgagcacggggtggcgggagccgtggcggtgttcccgaaggaccattcttctctgctgcagggaactttagctgaacactttggcgtactgcccggacctcgtgatcacggcggccccacacaacgcgatttaaacgggcctggtcttagtcgggttcgcgagtctcttacccttcccagtcatagcttggagcacttgggcccccctcacggtggcggcggtgggggcggcagcaattctagctccgggcccccacttggcccttcacacagagacaccatctccagaagtggaattatcctgagatcaccaaggccggatttccggccaagagagccatttttatcacgtgatccctttcactctttgaaacgaccccgcccgcccttcgcaaggggtccacctttctttgctcctaagagaccctttttcccaccgcggtactag

SEQ ID NO: 50596 - DNA, 2805 bp, Artificial Sequence
  Description of Artificial Sequence: Synthetic coding sequence
atggccgccggcggcggcggcggcagcagcaaggccagcagcagcagtgccagttcagctggcgccctggagtcatcactagatagaaagtttcagtctgtgactaatacaatggaaagcatccaaggattatccagttggtgcattgagaataaaaaacatcatagcacaattgtgtatcactggatgaaatggctgcgtagatctgcatatccacacaggctgaacctgttttacctggccaacgacgtgattcagaactgcaagcggaagaacgccattatattccgggaaagtttcgccgatgtactgcccgaggccgccgccctggtcaaggatccctctgtttctaagtccgttgaacgcatattcaaaatctgggaggataggaatgtatatccggaggagatgattgtagctctccgggaagccttaacctcaacaaatcccaaagccgccctgaagtccaagattgtggcggagtttagatcgcaggcactgattgaagaattgctgctgtacaaacggtccgaagatcagatcgagcttaaggaaaagcagctgagcaccatgagagtggatgtttgttccactgagaccctaaagtgtttgaaagacaagaccgggggcaagaagttcagtaaagaattcgaggaagctagctccaagctcgaggagtttgttaacgggctcgacaaacaagttaagaatggcccttccttgaccgaggccttggagaatgctggcatattttatgaagcacagtacaaggaggtgaaagtggtcgccaacgcatataaaacattcgctaacagggtgaacaacctgaaaaagaagctcgatcaattgaaatcaacactgcccgaccccgaagagtcgccagtgccctccccctccatggatgctccttcgcccaccggctcagaatcccccttccagggtatggggggcgaggaaagtcagtcacctaccatggaatcagagaagtcagctactccagaaccagtgactgataaccgggatgtggaagacatggaactgagcgatgtggaggatgatggttctaaaatcatcgtggaggatagaaaagagaaaccagcagagaagtccgctgtgtccacttcagtgccaactaagcccacagagaacatatctaaggcttctagctgcacccccgtccctgttacaatgactgccactccaccccttcccaaacccgttaacactagcctgtcgccctctcccgctcttgccctgccaaatctggccaatgtggaccttgccaagatcagctccatcctgtctagccttacctccgtgatgaagaataccggggtgagccccgcgtcaaggcctagtccgggaacacctacatctccttccaacctcacctctggcctgaaaaccccagcgcccgcaaccacgacctcccataaccccctagcaaatattttgtccaaagtggagataaccccggaaagcatactgtcagctctatctaaaacccaaacccaatccgctcctgcgttgcagggactttcgagtctgctccagagtgttaccggcaaccctgttccggccagcgaagccgcaagccaatccaccagcgcctccccagcgaacaccactgtctcaactattaaaggcaggaatctgccaagcagcgcccagccctttatccccaaatcctttaactatagcccaaacagttccacatcagaggtgtccagtacaagcgcctctaaggcttcaattggtcagtctcccgggctgccctcaacgacatttaagctcccaagtaattcactgggattcaccgcaacacacaatacttcccccgccgcacctcctaccgaagtaaccatctgccagagttcggaggtctccaagcccaagctggagagcgagtccacctctcccagcttggaaatgaaaatacacaatttcctgaaggggaacccaggattcagcggactcaatctgaatatcccaattctatctagcctcggctcctctgcccccagtgagtcccatccatcagatttccagagaggtcccacttccacctcaatcgacaacatcgacggaactccagtgcgagatgagcggagcggcacaccgacacaggacgagatgatggataagccaacctcatcaagtgtcgacactatgagtcttctctctaaaattataagtcctggatctagcaccccctccagcacacggagcccgcctcccgggagagacgagagctatcccagggagcttagcaactccgtatcaacctatcggcccttcggcctggggagtgagtctccatataaacagccttcggatgggatggaacgcccctcttccctgatggatagttcacaagagaagttctatccagatacctcgttccaggaagacgaagattacagagacttcgagtactcgggaccccctccttctgctatgatgaacctcgagaaaaagcctgccaagtctatcctgaagagctccaagctgagcgacacaacagaatatcaacctattttgtcttcctacagtcatcgagcacaggagtttggggtgaagagcgcttttccccctagcgtgagagccttactcgacagctcagaaaattgcgaccgactgtcgtccagtcctggactctttggagcattttcagtccgtgggaacgagccaggctccgatcgctctccgtctccaaaacatccatgtagatcccatgggtctcctacacacgttcgcagaggggagagccccggactccaccacttccaccacgtggatgactag

SEQ ID NO: 50597 - DNA, 3231 bp, Artificial Sequence
  Description of Artificial Sequence: Synthetic coding sequence
atgagcagcgccgagatcatcggcagcaccaacctgatcatcctgcttgaggacgaagtctttgcagacttttttaacacttttctgagcctcccagtgttcggacagaccccattttataccgtggaaaacagccagtggagcctttggccggaaatcccgtgcaatttgattgcaaaatataagggcttactaacttggctggagaagtgccgccttccgtttttctgcaaaacgaacctgtgtttccactatatcttatgccaagagtttatttcttttatcaagtcccctgagggaggagaggagctggtggacttttggatcctagcagagaatatcctgagcattgatgaaatggatcttgaggtccgcgattactatctgtctctgctgcttatgctccgcgctacgcacctgcaggagggaagtcgcgtcgtgactttgtgcaatatgaacataaaatccctcctgaacctgtcgatctggcaccccaatcagtccactactcgccgggagatcctgtcgcacatgcagaaggtcgctcttttcaaactgcagtcgtactggctgcctaacttttacacacatacaaagatgacaatggctaaggaagaggcgtgccacggattgatgcaggaatacgagacccggctctatagtgtttgttatacccatatcgggggcctcccgctgaatatgtcaattaagaaatgccaccacttccagaagcggtactcatcccgtaaagccaagaggaaaatgtggcagttagtggacccagactcttggtccctcgaaatggatctcaaaccagacgcgatcggcatgcctttgcaggagacatgtccccaagaaaaagtggtcattcagatgcccagcttaaaaatggcatctagtaaagagacccggatcagcagtttagaaaaagacatgcactacgctaagatttccagtatggaaaacaaggcaaaatcccacttgcacatggaagcacccttcgagaccaaggtttctacacatctgcgcaccgtcatccctatcgtgaaccactccagtaagatgactattcagaaagccatcaagcaatctttcagcttagggtatattcacctggccctttgcgccgatgcctgtgcaggcaacccctttagggaccatcttaaaaaactgaatctaaaggttgagatccagttactcgatctgtggcaggacctgcagcattttttaagcgtcctgctcaataacaagaagaacggcaatgctatctttcggcatctcctgggcgacagaatttgcgaactgtacctcaacgaacagatcggaccttgtctgccccttaagtcccagaccatccagggtttaaaagagctgctcccctctggagacgttattccctggattcccaaggctcaaaaagagatttgcaaaatgctctccccctggtatgatgagtttttggacgaagaagactattggttcctcttgtttacaacacagaaccgattcattagctcacgacagcacaagcgggagtttattggaaaggaagaaaacatcttgctgtataagcggatccagcagagcctcgaactcagccaggcactggccgacatgaaagagatggattatcgacagtggcggaaaattgccacggaggatcttaagcagggtgggagtcttcaggtggagctgacgtcccccgtgttcctgaccgatattaccaagatgagctttgaggagctgtgctataagaatccaaaaatggctattcaaaagatctccgacgactataaaatctactgtgaaaaagccccaaagatagattttaagatggagattattaaggagacaaagacggtgtctagatctaaccggaagatgtcactgttgaagagaacactcgtccgcaaaccctcgatgcgaccacgaaatttgaccgaagtcctgctgaatacacagcacttggagttcttccgggagttcttaaaggaacgcaaagctaaaatcccgctgcagttcctcaccgcagtgcagaagatttcaatcgaaacaaacgaaaagatttgcaaatcgctcatcgagaacgttatcaaaacctttttccaaggtcaactcagccctgaggaaatgctccagtgtgatgctcccataatcaaagaaattgccagcatgcgccacgtcacaacgtctacattactcaccctgcagggacacgtaatgaagagcattgaagaaaagtggtttaaggattatcaggatctgttccctccacaccatcaggaggtagaagtgcagtcggaagtccagatctcaagcagaaaaccaagtaaaatagtgtcgacgtacttgcaggagagtcagaagaagggctggatgaggatgatctcattcatccgcagcttctgcaaatacaggcgattcatgttaaatccatcaaaacgccaggaattcgaggactacttgcaccaagagatgcagaatagtaaagaaaactttaccactgctcacaacacttctgggcgctcagctcccccatcgaccaacgtcagatccgctgatcaggaaaacggcgaaattacgctcgttaagcggcgcatcttcggacatcggataattacagtcaatttcgcaattaatgatctctacttcttcagcgaaatggagaagttcaacgatctggtgtcctccgcacacatgctgcaggttaatcgggcgtacaacgaaaatgatgtgatcctaatgcgtagtaagatgaatattattcagaagctcttcttgaactccgacatcccacccaaactacgtgtcaatgttcctgagtttcagaaggacgcaatactcgcagccatcactgaaggctacctggaccggagcgtgttccacggagccatcatgtctgtttttcctgtagtgatgtatttttggaaacgcttctgtttctggaaagccactaggagctacctgcagtatcggggaaaaaagttcaaggaccgaaagtcccccccaaagagcacagacaaataccctttttcatccggaggagacaatgccattctaaggtttaccctgctccgaggaatcgaatggctgcagccacagcgtgaggctatctcaagcgtccaaaattcctccagtagtaagctgacacagcctagactggttgtctcagccatgcaactccatccagtgcaaggtcagaagttgtcctacatcaaaaaagagaagtag

SEQ ID NO: 50598 - DNA, 309 bp, Artificial Sequence
  Description of Artificial Sequence: Synthetic coding sequence
atgctgagcgtgcggcgggtgagcgaggacatctgcagccggatctacgaatcagcacagagaatcgattccatcacctttctgccttcctctggcttccatctaaaatggaagattcaaacacggatcgcaaatgagaaatacctcagaacacataaggaggttgagtggctgattagcggatttttcagggagatttttctgaagaggccggataacatcctcgagttcgccgctgactactttaccgaccccagattgccaaataagattcatatgcagctcattaaagataaaaaggctgcatag

SEQ ID NO: 50599 - DNA, 1176 bp, Artificial Sequence
  Description of Artificial Sequence: Synthetic coding sequence
atggaccagtgcgtgaccgtggagcgggagctggagaaggtgctgcataaattctctggctatggacagctctgcgagcggggcctcgaagagttgattgactatacaggcgggttgaagcacgaaattcttcagtctcacggacaagatgccgaactgagtggaacactgtctttggtcctcactcagtgctgcaagaggatcaaggataccgtgcaaaagctggctagtgatcacaaggatatccattcaagcgtcagcagggtgggcaaggccattgacaaaaatttcgacagcgacatctcgtctgtaggcatcgacgggtgctggcaggcagacagccagcgtttgctaaacgaggtgatggtcgaacacttcttcaggcagggaatgctcgatgtggcggaggaattgtgccaggaaagtggcctgagtgtggacccatcacaaaaggaaccctttgttgagctgaacaggatcctcgaagctctgaaagttcgggtgctacgtcccgcattagagtgggctgtttctaaccgagagatgttgattgcccagaacagcagcctggaatttaaactgcaccggctgtacttcatcagtctccttatgggaggcactacaaatcagagggaggcgctgcagtatgccaaaaatttccaaccatttgctttaaatcaccagaaggatattcaagtccttatggggagcctcgtgtacctgagacaaggtatcgagaactctccatacgtgcacttgctggatgcaaatcagtgggctgatatctgcgacattttcactagagatgcttgcgcacttttgggcctgagcgtcgagtcccctctctctgtgagtttttctgcaggctgcgtagccctgccagctctcataaatattaaagcggtgattgaacagaggcagtgcaccggtgtgtggaaccagaaggatgagctcccaattgaggtggatctcggcaagaaatgttggtatcattccatttttgcctgtcccattctcaggcagcagactacagacaacaacccacctatgaaactggtgtgcggacacatcatcagtagagacgctttgaataagatgttcaatggttcaaagttaaaatgcccatattgcccaatggagcagtcccccggggatgccaaacagatttttttctag

SEQ ID NO: 50600 - DNA, 1182 bp, Artificial Sequence
  Description of Artificial Sequence: Synthetic coding sequence
atggagcagtgcgcctgcgtggagcgggagctggacaaggtgctgcagaagtttctaacctacgggcagcattgtgagcgctcccttgaggagctgctgcattacgtgggccaattacgcgccgagctcgcaagcgccgcacttcaggggacccctcttagcgccaccctttcactggtcatgtcccagtgttgtcggaaaattaaggataccgtccagaagctcgcgagcgaccacaaggacattcacagttccgtctctcgcgttggtaaggccatcgatcggaattttgacagcgaaatctgtggggttgtctcagacgctgtttgggatgcacgggaacagcagcagcaaatcctccagatggctattgtggagcatctgtaccagcaaggaatgctgagcgtagctgaggagctatgccaagaatccacacttaatgtcgatttggacttcaagcagccattcctcgagctcaaccgcatcttggaagccctgcatgaacaagacctgggccccgcactggaatgggccgtctcccaccgacaacggctcctcgagctgaactcaagcctggagtttaaattgcatcgcctgcacttcattcggctgctggccggaggacctgctaaacagctcgaagccttgagctatgctcgccattttcagccatttgcccgcctgcaccaacgagaaatccaggtgatgatggggtccctggtgtatctgcgcctgggcttggagaagtctccctattgtcatttgctcgattccagccactgggctgaaatttgcgaaacatttactagagacgcttgctcgcttttgggtttgagcgtggaaagcccattatctgtttccttcgcctccgggtgtgttgcactgccagtgctgatgaacatcaaagctgtgattgaacagcgtcaatgtacaggcgtctggaatcataaggacgaactgcccatcgagattgaactaggaatgaagtgttggtaccactcggtctttgcctgccccattctcaggcagcagacttctgactccaatcctcctatcaagctgatctgtggtcacgtgatttcgagggatgccctgaacaaattgattaacggcggcaagctgaaatgcccttattgtccgatggaacaaaatccagccgatggtaaaaggattattttctag

SEQ ID NO: 50601 - DNA, 345 bp, Artificial Sequence
  Description of Artificial Sequence: Synthetic coding sequence
atggagcagtgcgcctgcgtggagcgggagctggacaaggtgctgcagaagtttcttacctacgggcaacattgtgagcggtctttggaagaactgctgcattacgtgggccagctgcgagctgaacttgctagtgccgccttgcagggcacaccgctgagcgccaccctcagcctggtcatgtcccagtgttgtcggaagataaaggacactgtgcaaaaactggcaagcgatcacaaggatatccactccagtgtgagtcgagttggcaaggcaattgataggaatttcgactcagagatttgcggagtggtatccgacgcagtatgggacgccagagagtag

SEQ ID NO: 50602 - DNA, 447 bp, Artificial Sequence
  Description of Artificial Sequence: Synthetic coding sequence
atggagcagtgcgcctgcgtggagcgggagctggacaaggtgctgcaaaagttcctgacctacggacagcattgcgagaggagcttggaggagttgctccattacgtgggccaacttcgggccgaactggcgtccgctgctttgcagggtactcctctatctgctactttgagcttagtcatgtcccagtgttgcagaaagattaaggacacagtccagaaacttgctagtgaccacaaagacatccattcctcagtgtcacgcgtgggcaaagccattgataggaattttgatagtgagatttgcggcgttgtgtctgacgcggtgtgggacgctcgggagcagcagcagcaaatcctgcagatggctattgtggagcatctgtatcagcagggtatgctgagcgtggctgaggaactatgccaggaatctacactcaatgtttag

SEQ ID NO: 50603 - DNA, 174 bp, Artificial Sequence
  Description of Artificial Sequence: Synthetic coding sequence
atggagcagtgcgcctgcgtggagcgggagctggacaaggtgctgcagaagtttttaacttatggtcaacactgtgagcgctctcttgaggagctcctacactatgtggggcagctgagggctgaacttgctagcgccgctctgcagggaactcctctctccgctacgttgtag

SEQ ID NO: 50604 - DNA, 1182 bp, Artificial Sequence
  Description of Artificial Sequence: Synthetic coding sequence
atggagcagtgcgcctgcgtggagcgggagctggacaaggtgctgcaaaagttcctgacttacggccagcattgtgagcggagcctggaagagctcttacattatgttgggcagctgagagcagaactcgcttccgcagcactgcagggcacgcccctgtcggctactctgtcgctggtaatgagtcagtgttgcagaaaaattaaagacacggtccaaaagctggcgtccgaccataaggatatccattccagcgtgtcgcgtgtcggaaaggcaattgacagaaacttcgattccgaaatctgtggcgtggtgtctgatgcagtgtgggatgctcgagagcagcagcagcagatcctgcagatggcgatagtggagcatctctaccagcaaggcatgctatctgtggccgaggagctctgtcaggaatctactttgaatgtggaccttgatttcaaacagcctttcctagagctgaatcggattctggaagctctccacgaacaggacttaggacccgctttagagtgggccgtctcccatagacagaggctcctggagttgaattcaagtctcgagttcaagctccaccgactgcatttcatacggctgctcgccggggggcccgcgaagcagctagaggccttgtcatacgcaagacactttcagccgttcgctcgtctgcatcagcgagagatccaggttatgatgggcagcttggtttacctccgactcgggctggaaaagtctccctactgccaccttctggatagttcccactgggctgagatttgcgaaaccttcacaagagatgcttgctcccttctgggcctttcggtggagagccctttgtccgtctccttcgcgtcaggctgtgttgccctgccagtgttaatgaatataaaggcagtcatagaacaacggcaatgcactggcgtatggaatcacaaagatgagctcccaatcgagatcgagttaggaatgaagtgttggtaccatagcgtttttgcatgccccattctccgccagcagacttccgactccaatccaccaattaaactgatctgcgggcacgtgatctctagagatgccctgaataagctcatcaatggaggaaaattgaagtgcccttattgcccgatggaacaaaatccggccgatggaaagaggatcattttctag

SEQ ID NO: 50605 - DNA, 1143 bp, Artificial Sequence
  Description of Artificial Sequence: Synthetic coding sequence
atggccgactgcagcctggacctgcccggcagcagcagccccccctcccacctgtcactgctgcgcagttgggaccaccgacgtgtgcctccttgtcccgccctgcagggtactcctcttagcgccactttatccctggtcatgtcccagtgttgccgcaaaatcaaagatacagtacagaaactggcatccgatcacaaggatatacatagctctgtgagtcgcgtcggaaaggccattgacagaaacttcgattccgaaatttgtggcgtggtctcagatgctgtctgggatgcccgggagcagcagcagcagattctgcagatggccatcgtcgagcacctctatcagcagggaatgctgagcgtcgctgaagaactgtgccaagaaagcaccctgaacgttgacctggacttcaaacaacctttcttagagttaaaccgtattttagaagctctgcatgagcaggacctgggaccggcacttgaatgggcggtgtcccaccgacaacgtttgcttgaacttaactccagtctcgagttcaagttacaccgcctgcacttcatcaggctgctagcaggtgggccggcaaagcagctggaggcactctcctatgcacgccactttcagccattcgcccggctccatcagcgagagatccaggtgatgatgggcagcttagtgtatctccgcctcggacttgaaaagtcaccttactgccacctactggactcctcccactgggccgaaatttgtgagaccttcacccgcgacgcctgttcgcttttaggcctctccgttgaatcgcctttaagcgtttcattcgcctcaggctgcgtcgctttaccggtgctcatgaatataaaggccgtgatagagcagcggcagtgcactggggtttggaatcacaaagatgaacttcctatcgagattgaacttggcatgaaatgttggtaccactccgttttcgcctgcccgatcctgcggcaacagacctccgattccaaccctcctatcaagctgatctgtggccatgtcatttcaagggacgccctcaacaagttgatcaacggcggaaaactcaagtgcccctactgcccgatggaacagaacccagctgatggcaagaggatcattttctag

SEQ ID NO: 50606 - DNA, 804 bp, Artificial Sequence
  Description of Artificial Sequence: Synthetic coding sequence
atggtgctgggcaacagccacctgttcatgaaccggagcaacaagttggcagtaatagcatcccatatacaggagtcccggttcctctacccgggaaagaacgggcgactgggcgatttcttcggggaccctggaaatcccccagagtttaacccaagtggctccaaggatggtaaatatgagctcctcactagcgccaacgaggtgatcgtcgaggagattaaggacctgatgaccaaatccgatattaagggtcagcatacggaaaccttactcgccgggtcattggcaaaggccctttgctacattcaccgaatgaataaagaagtaaaagacaatcaggagatgaagagcaggatcctcgtcataaaggctgctgaggactctgcacttcaatacatgaacttcatgaacgtgatcttcgctgcccagaaacagaatattctgatcgacgcttgcgtcctggactccgactcaggactacttcagcaagcttgcgatattacaggaggattgtacctgaaagtgccgcagatgccatcgttactgcagtacttgctgtgggtgttcctgcctgaccaagaccagcgctctcagttaatcctgcccccgcctgtccatgtcgattatcgggctgcgtgcttctgccatcgaaatctgatcgagatcggatatgtctgctccgtttgcttgagcattttttgtaacttttccccaatttgtactacctgcgagacagccttcaagatttctcttcctcccgtactcaaagcgaagaagaaaaaacttaaggtttctgcatag

SEQ ID NO: 50607 - DNA, 864 bp, Artificial Sequence
  Description of Artificial Sequence: Synthetic coding sequence
atggccgagcacttcaagcagatcatccggtgccccgtgtgcctgaaggacttagaggaggccgtgcagctcaaatgtggatacgcctgttgcctccagtgtctgaatagcctacagaaggaaccggatggcgaaggtctcttgtgtaggttttgctcagtggtcagtcaaaaggatgacattaaaccaaagtataaattacgagccctggtgagcataatcaaagaactcgagccaaaactgaaatcagtgctgacgatgaatccccgcatgcgcaagtttcaggtcgatatgacttttgacgtcgataccgctaataattatctgataatttccgaagacctcagatcgtttcgctcaggagatttgtctcagaatagaaaagaacaggccgagagatttgataccgcgttatgtgtgttaggcactcctaggttcacgagcggtaggcattattgggaggtggatgtcgggactagtcaggtgtgggacgtgggagtgtgtaaggaaagtgttaatcggcagggaaagattgttctctcaagcgagcacggttttctgaccgtgggctgtcgggaggggaaggtctttgctgcaagcacggtgcccatgacaccactttgggttagcccacagctccatagggtggggattttcctagatgtagggatgagatctatcgctttctacaatgtgtccgatgggtgccacatatatacgtttatcgagatccccgtttgcgaaccctggagacccttcttcgcccacaaacggggctcccaggatgaccagtccatcctgagcatctgcagcgtgatcaatccgtccgccgcttctgctcctgttagctccgaaggcaaatag

SEQ ID NO: 50608 - DNA, 792 bp, Artificial Sequence
  Description of Artificial Sequence: Synthetic coding sequence
atggccaagcggctgcaggccgagctgagctgccccgtgtgcctggactttttctcttgctcgatttctctctcttgtacgcacgtcttctgttttgattgtatacagcgttacattctggagaatcacgacttcagagctatgtgtcccttatgcagggatgtagtcaaggtgcccgcgcttgaagagtggcaagttagcgtgctgaccttgatgactaaacagcacaactcaaggctggaacagtccctgcacgtgcgcgaggaactgagacacttccgagaagacgttacgcttgacgccgcgactgcttcctctcttcttgtgtttagtaacgatctgagatctgcgcaatgtaaaaagattcatcacgacttaactaaagatccacggctcgcttgtgttctgggcactccatgttttagctccggccagcattactgggaggtagaagtgggcgaggtcaaaagctggtcgctgggggtttgtaaagagcccgccgaccgaaagagcaatgatctattccctgaacacgggttctggatctcaatgaaggcaggcgctatccacgccaatacccacctggaacgcattccagctagcccgcgtctgcgacgcgttggcatttttttggatgctgatctggaggaaatccagttctttgatgtagataacaacgtgctcatttacacacatgacggattctttagcctggagctcttatgtccattcttctgtctcgagctgctgggtgaaggtgaaagcggtaatgtgctgactatttgtccttag

SEQ ID NO: 50609 - DNA, 597 bp, Artificial Sequence
  Description of Artificial Sequence: Synthetic coding sequence
atgcccctgttcggctggatgaagtggcccaagaacgacagctacaaaccgactcattaccctggtagcgacattgtgacgaagactctgctcagggagttaaaatggcatctgaaggagagagaacggctcatacaggagatcgagaacgagcagaaggttaagaaaacaggtgttgactataactggctccggaattaccagaatcctcataccacaattcctgtgaccgaacagcggcaactcgaagttctgtgcagccaggtgcagccatgccaaacaggaactatactctcccgatttagggaggttctggccgagaacgatgttctgccttgggagatagtttacattttcaaacaggtgctgaaggatttcctgtcctccagtgatcgtgggtctgaacaggaagatcttgaggacagtggaagcatggactgctctgcgccgagcgtcattcaaggagactcatccaaacgcgccgacaaagatgaaatcccaaccatctcctcttacgttgacaagaatacaaaggacagattccccgtgttcagccaccggatctggaaccttccttattaccacccgagctcatag

SEQ ID NO: 50610 - DNA, 4167 bp, Artificial Sequence
  Description of Artificial Sequence: Synthetic coding sequence
atgagcatccccctgcacagcctgcggttcaacaacaccatgcgggaagagaacgtggaaccacaaaacaagcaaatggccttctgtcgacctatgaccgaaactagagcagatgtgcagatcctgcactcacacgtgcaactgccaatcgtttctacatcagcctcagatccaggcgggacctcgactcaactgatgacaagccccgtttttgataccatgtcagcccctctcatgggagtaccgaactccggcgccctgtcaccccccctgatgcctgcgagcgatagcggggcactctcacctctgctcatgcccgcttccgattctggtgctctttctcccctattgatgccagctcttgattctggaacgttgtcccctctccttagcacatccgagtacggagtaatgtctccaggcatgatgacaattccagatttcgggaccatgagcgccaccctaatggtggcccccgattccgccgaaatatcaccactggccatgcccgccccttcatcaggagtcgtgtgtacgccaattatgagcaccagctctagcgaggccatgagcacccctcttatgctggccccagattctggtgaactgagccccatcctgatgcaggacatgaatcccggtgtgatgtccacccaaccagtgcccgccccttcctccgaggctatgtctcccttgcagatcaccgacgaagacacagaagcaatgagtaaagtgcttatgacggctcttgcttccggggaaattagctcactcctgatgagtggcacggattctgaggcaattagcagcttaatcatgagcgctgtggcctccggcggaacttcgccgcaacctaccagtactcagaatagcggcggcatccccactccattgatgagcgacctggattccggaataatgagtagcctgctaatgtccagccctggctctgaggtaatgtcaactcctttgctctcggtgcccgatgccggcgaaatgagcaccctcccaaagcccgcacccgacgctgaggccatgtctcccgcacttatgacggcactgcctagtggggtaatgcccacccaaaccatgccagcccctggaagcggcgcaatgtctccatggagtactcaaaacgtggactcagaaatgatgagcaaccctccagtcagggcaactgcatccggagtcatgagtgctccccctgtcagagctctagactcaggggcaatgtccactcccctgatgggggcccccgcatcggggaatatgagcacactgcaaaagactgtcccagccagtggggctatgacaacaagcctcatgacagttccctcatctggggtgatgtccaccgagcagatgtccgctaccgccagtcgagttatgtccgcacagctcactatggctaagacgagtggcgccatgcccactggcagcatgaaagcagtcgcaaaacaatacaaacgtgcgacagccagcggtaagatgtccaccccactcaggcgcgcccctacctctggcgcaatgtcaactcagccagttactgcaactgcttcggagaccatgtcgatgccccagctcacagtccccgccagcgggagcatgtcaatgctccaaatgcgcgcccccgtgtctgaagcgatgtcgatgccacagatgagaaccatggcctctggactgactagtgcagctcagatgaaagctatgacttctggcgcgatgtctacccccttgatgaccgctcagacgagtggcagcacctctactctgctgatgcgcgacactgctagtggcgtgatgtcctgtccccagatgcgctcactggcttctggcgcactgagcaagcctctgatgactccaaaggcttccggcaccatgttcactgagaagatgactaccaccgctagcgaagccatgcctacactcctgatgagagacacagtttccggtgccttgtccatgccccagatgactgacaccgcttccgggggcctctctgcttcacttatgcgagacactgcctctggtgctatgagcacaagtcagatgactgcaacagtaagcggggggatgagcatgccactcatgagggctcaggacccaggggtgatgccagcatcccttatgcgcgccaaagtgagtggtaaaatgctgtcccagccaatgagtacacaggaccccggaggcatgtcaatgtcaccaatgaagagcatgacggctggaggaatgcagatgaactccccaacatcagacgtcatgtccactcccaccgtgagggcttggactagcgagactatgtccacgccactcatgcgtacttccgatccaggtgagagaccgtcgcttttgaccagggccagtagctccggcgaaatgagcctccccctcatgagagcacctgcctccggagagatcgccactcctcttcggtcccccgcatatggcgccatgtctgcccctcagatgacagctaccgcgtcagggatgatgtcatctatgcctcaggtgaaggcccccatctcaggcgcaatgagcatgccactaaccaggtcaacagcatctggcggaatgtccatgcctcttatgagggcacccgactcaagggttacttctacatcccaaatgatgcctacagccagtggcgatatgtgcacacttcccgtgagggcgcccgcctctgggggtgtgtcttcaccactcgttcgggcaccagcaagcggaaccatgtccactccacttcggaggccgtctgcatgcgagaccgtctctacagaactcatgcgagcttctgcatctggccatatgtcaaccgcccagaccacggccatggtatctggtggaatgagtaagccactaatgagagctccggccagcggaaccatgccaatgcctcttatgtccgcgatggcttctggagagatgtccatgccattgatggaaaccatggccagtggcgccacatccaccctgcagacctctgttgcaaactctaggtctatgtccttgagccagactacctacacagtctctgggaggatggctacagctccgatccgtgcttccgcgagcggagcgcgctctacttccttcatgcgagcctccgtgtctggatctatgcctatgccacttcccagggccactgcctccggatgtggcatggggatgagtatgccacagatgactgcgacagactctagaggcatgtccacgcccctgatgcgtgcttccggacctgggacaatgagtacgccgcagacggcttttggggtgatgagcacacccgagatcaaagcaaccgactcaggggaggcctctacttcacacataaatattacggctagtgggtctaagccaacttcgcatatgacggccaccacaccagagacagcaaaaccaccacctaaggaagtgccatcttttgggatgctgacgcctgcactctgttacctcctcgaggagcaggaagctgcacgcggttcctgctccgtggaggaggagatggaaatagacgaggaaaaacagatgaaggggttcctcgacgatagcgagcggatggcattcctggtgtctctccatctcggcgctgccgaaagatggtttatcctgcaaatggaagtcggagagcccttaagtcatgagaataaatcattcctgcgtcgctcacagggaatctatgactcgctgtcggaaatagacatcttatccgccgtgctgtgccacccaaaacaggggcaaaaatcagttagacagtatgccaccgacttcctgctgctcgcccgccatctgtcttggtctgatgctatcctgagaaccaggtttcttgaaggccttagcgaggcagttacgacgaaaatggggaggatcttcctgaaggtggccggctcacttaaagaactcatcgaccgatccctgtatacagaatgccaactggccgaagaaaaagacagccccggtaacagctctcaggtgctaccaaccgcctgtaaaagaaataacgaggaggcaatgggtaatgaacttagttcccaacagcagaccgaggaacatcaacacgtatccaagcggtgttattacctgaaggaacatggggatccacaggaaggtcttcacgaccacctggggcagtccactgggcatcaccagaaggctcacaccaataagtag

SEQ ID NO: 50611 - DNA, 267 bp, Artificial Sequence
  Description of Artificial Sequence: Synthetic coding sequence
atgagcatccccctgcacagcctgcggttcaacaacaccatgcgggaagaaaatgtggaaccgcagaataagcagatggccttttgccgacccatgacagagacacgggctgacgtgcaaatcctgcatagccacgtccaactacctattgtgtcaaccagtgctagcgatcctggcggtacgagcacccaactcatgactagtcccgtcttcgatacaatgagcgcaccactcatgggggtgccgaatagcggagcactgagctag

SEQ ID NO: 50612 - DNA, 4167 bp, Artificial Sequence
  Description of Artificial Sequence: Synthetic coding sequence
atgagcatccccctgcacagcctgcggttcaacaacaccatgcgggaagagaatgtcgaaccgcaaaataagcaaatggcattctgtcgcccgatgaccgagactcgggccgatgtgcagatcctacactcacatgtgcagttgccaatagtgtctacaagtgcctctgatcccggcgggacttctacccagctcatgaccagtccagtgttcgataccatgtctgcgccactgatgggcgtgcctaactctggagccctcagcccgcctctgatgcctgctagtgacagcggggcactgtcccctctgctgatgcctgcatcagattccggtgcacttagccctctccttatgcctgccctggactccggaaccctaagccccttgctgtccacaagcgagtatggcgtaatgtccccgggtatgatgaccattcctgactttggaactatgtcggcaaccctcatggtagctcctgacagtgctgaaatcagtccccttgccatgccggccccttcttcaggtgtggtgtgtacacctatcatgtcaacatcctccagcgaagcaatgagtactccactgatgctcgccccagatagcggcgaactatctcctatcttgatgcaggatatgaatcctggcgttatgtcaacccagccagtcccagccccctcatctgaggcaatgagccctctgcagatcacagacgaggacaccgaagccatgtcaaaagttctcatgacggcgctggcgtccggagaaatatccagccttcttatgtcaggcaccgattctgaggctatctccagtctcattatgtccgccgttgccagtggcggaacatccccacagcccacgagcacacaaaatagcggcggtataccaaccccccttatgtcagatcttgactccgggattatgagttccttattaatgtcttctcctggcagcgaagttatgtcaactccactgctcagtgtgcccgacgcaggcgagatgagcaccttgcccaagcccgccccagacgctgaggccatgagcccggcactgatgaccgcgttgccgtcaggtgtgatgcccactcagacaatgccggcacccggaagcggagctatgagtccttggtctacccagaacgtagacagcgagatgatgagcaatccacccgtgcgagctacagcttctggtgtgatgagtgctccaccagttcgagcccttgattctggagcgatgtcgacaccacttatgggcgcacccgcgagcggcaacatgtctaccctgcaaaagacagtcccggccagtggcgcaatgacgacaagcctgatgaccgtgccctccagtggagtcatgagcacagagcagatgagcgctaccgcgtcacgcgtaatgtccgcccagctcaccatggctaagaccagtggcgccatgcccaccggatccatgaaggctgtggccaaacagtataagcgagctacagcatccggaaagatgtcaactcccctgagacgggcaccaacaagtggcgcgatgagtactcaaccggtgaccgcaacagcaagcgaaacaatgtccatgcctcagctaaccgtgcccgcaagcgggagtatgtccatgttgcagatgcgcgctcccgtgagcgaagccatgagcatgccacagatgaggacgatggcgagcggtctcacatcagctgcgcagatgaaggcaatgacgtctggggcaatgagtactcccctgatgaccgcgcaaacgtcaggctccactagcacactgctcatgagggataccgcgagcggggtaatgtcatgcccccagatgaggtcccttgcatctggagccctgtcgaagcccctgatgactcccaaagccagcggaacgatgttcacggaaaagatgacaaccacagcttctgaggctatgcccactctgctcatgcgcgacacagtaagcggtgccctatctatgcctcaaatgaccgatacagcgagcggcggcctgtccgcctcccttatgcgagatacagccagtggagctatgagcaccagccagatgactgcaactgtctccggaggtatgtccatgcccttgatgcgcgcccaagatccgggggtcatgccagctagcctgatgcgagctaaggtgagcggaaagatgctgtctcagcctatgagtactcaagaccccggtggcatgagtatgagcccaatgaagagcatgacagcagggggcatgcagatgaatagccccacaagcgacgttatgtccactccaaccgtgagggcctggactagtgagacgatgtccacaccgctaatgcggacctctgacccaggggaaagaccatcactgctcacccgggcttccagttccggcgaaatgagccttcccctaatgagggcacctgcctctggcgaaatagccacaccgctcaggtccccggcatacggcgcgatgagtgctccgcaaatgaccgcaacagcaagcgggatgatgtcatccatgcctcaggtcaaggcaccaataagtggcgccatgagcatgcccctgacgcgcagcacagcctctggtgggatgtcaatgcctcttatgagagctcccgactcccgggttaccagtacttctcagatgatgccgacagcttcaggggacatgtgcactctcccagtgcgagctccagcttcaggtggagtgtctagccccctcgtgagagctccagctagtggaacgatgtcgacacccttgaggcggccaagcgcttgtgaaaccgtttccactgagcttatgcgtgcttccgccagcggacatatgtccacagcccagacgacagcaatggtgtctggtggcatgtccaaacccttgatgagggctccggcatcgggcaccatgcctatgccacttatgtctgctatggcatccggagagatgtcaatgccccttatggaaaccatggcttccggggccacctcgaccctccagacctcagtagccaatagcaggagtatgtcactctctcaaactacatacacagtgtccggtaggatggctactgcccctatccgcgccagcgcgagtggggcaagatcaacctcgttcatgcgtgcctcagtgagcggcagcatgcccatgcctttgcccagggcaacggcgtcagggtgcgggatgggaatgagcatgccgcaaatgacagctacagatagtcgtggaatgtctacgcccctgatgagggctagtggtccaggaacaatgagcaccccgcagactgcattcggggtcatgtctacacctgagatcaaggcaaccgacagcggagaagcttccaccagccatatcaacatcaccgccagtggcagtaagccaacatctcatatgacagccactacacctgagaccgccaaaccacccccaaaggaggttccaagcttcggaatgctaacgcccgccttatgctacctcctcgaagagcaggaagcagcccgtgggagttgctctgtggaggaggagatggaaatcgacgaagaaaaacagatgaaagggttcctggacgacagcgaacgcatggcctttctggtgtctctccacctgggtgcggctgagcgatggtttattctgcaaatggaggtaggagagcccttatctcatgagaataagagcttcctcaggcgaagccaggggatttacgacagtctcagcgagattgatatcctgagcgcagtgctctgtcatcccaaacaggggcaaaaaagcgtcaggcagtatgctaccgattttttactgttggcgagacacctttcctggtcagatgctatattaaggacacgttttcttgaagggcttagcgaagctgtgacgaccaagatgggtaggatcttcctgaaggtggcagggagcttaaaggagcttattgaccgaagcttgtatacggagtgtcagcttgctgaagagaaagattctccaggcaatagcagtcaagttcttccaactgcttgtaagcgaaataatgaagaagccatggggaacgaactgtccagccagcaacagactgaggaacaccagcatgtctcgaagcggtgttattatctcaaggaacacggcgacccacaggaggggctgcacgatcaccttggccaaagcacaggccaccaccagaaagcccacactaataaatag

SEQ ID NO: 50613 - DNA, 2850 bp, Artificial Sequence
  Description of Artificial Sequence: Synthetic coding sequence
atgagcatccccctgcacagcctgcggttcaacaacaccatgcgggaggagaatgtggagccacagaataaacagatggccttctgcaggccgatgaccgaaacacgggctgacgttcagatactccacagccacgtgcagttgccaattgttagcacaagtgcaagtgaccctggaggcacctcaactcagcttatgaccagcccggtctttgacaccatgtccgctcccctcatgggcgtccccaattcaggagctctttcaccacctcttatgcctgccagcgacagcggagctctctcacccctccttatgcccgcctcagactctggcgccctcagtcctcttctcatgccggcgctggatagcgggactttaagcccactgctttctacgtcagagtatggcgttatgtcccctggcatgatgactattcccgactttggaacgatgtctgccaccctgatggtagcaccagattccgccgagattagtcctcttgcgatgccagccccatcttccggggtggtatgtactccgatcatgagcacaagttcaagtgaggcaatgtctactccccttatgctcgctcccgacagcggggagctatcccccatcttaatgcaggacatgaaccccggagtgatgagcacccaacctgtccccgctccttcatcagaggctatgtccccattacagatcacagacgaggacaccgaagccatgtccaaggtgcttatgaccgcactcgccagcggcgagatcagcagcctgctcatgtcaggcactgatagtgaagccatcagcagtttgataatgagtgccgtcgcttccggcggtacatccccacaacccacttcaacacagaattctggtggcatccccacaccacttatgtccgacttggacagcggtattatgtcttcccttctgatgtcttcccctggctccgaggtgatgtccacgcctctgttatctgtgccagacgctggagagatgagtacgttaccaaagccagctccggatgcagaggcgatgagccctgccttgatgactgcattgccaagcggtgtcatgcccactcagacaatgccagcccccggatctggagccatgtcaccctggtccacacaaaatgtcgatagcgagatgatgagcaatcctccagtgagggctacggcaagcggtgtgatgtcagcccccccggtgcgagccctggactctggcgcaatgtctactcccctgatgggtgctccagccagcggaaacatgtccaccttgcaaaagacagtcccggcatctggagcgatgaccaccagcctgatgaccgttccaagtagtggagttatgtcgacagaacagatgtctgcaactgccagcagagttatgtctgcccagcttaccatggccaagacctctggtgctatgcccaccggaagcatgaaggctgtggccaaacagtataagcgggccaccgcatctggcaagatgtctacacccctgaggcgggcaccaacatcaggtgctatgtcaactcagcccgtcacggcaaccgcctccgagaccatgtccatgccccagcttaccgtgcccgcatctggctctatgagtatgctgcagatgagagctcctgtttcagaggcgacttcaaccctgcagactagtgttgcaaattctcgatcaatgagtctgtcacaaacaacctatactgtgagtggacgtatggcaactgcacctatccgagcttccgcatccggcgccaggtctaccagctttatgagagcttccgtcagtggcagtatgcccatgccccttccaagggcaactgcttctggatgtgggatgggcatgtcaatgccccagatgactgccaccgactctaggggcatgtccacacctctcatgcgcgccagcggtccaggcaccatgagcacacctcagacggcctttggtgttatgtccacccctgaaattaaggctaccgactcaggagaggccagtacgagccatataaacattaccgcctccggttcgaagcccaccagccatatgaccgcaactacgcctgagactgccaagcctccaccgaaggaggtccccagttttgggatgctcacccctgcactgtgctacttgctcgaagaacaggaggcagcccgtggcagctgttctgtggaggaggaaatggagattgacgaagaaaaacagatgaaaggctttctcgatgactccgagagaatggcgttcctggtcagtctgcacctgggtgccgctgagaggtggtttatcttgcagatggaagtcggcgagcctctgtcccatgaaaataaatcattccttcgtaggagccagggaatctacgatagtctgagcgagatcgatatactttcagccgtgctctgccatcccaagcaaggccagaagtcagtacggcagtacgcaaccgatttcctcctgctggcccgccatctcagttggtccgacgcaatcctgcgcactcggttcctggagggtctgtcagaagccgtaacaacaaagatgggccgaatctttcttaaggtggccggctcacttaaagaattgattgatcgtagtctctatactgagtgtcagctggctgaggagaaggacagcccaggtaattcttctcaggtcctacccaccgcttgcaagaggaataacgaagaggctatgggaaacgagctctcttctcagcaacaaacagaagaacaccagcacgtgtctaaacgatgctattacctaaaggagcatggagatccacaggagggattacacgatcacctgggccagagcacgggacatcatcagaaagctcacactaacaagtag

SEQ ID NO: 50614 - DNA, 1710 bp, Artificial Sequence
  Description of Artificial Sequence: Synthetic coding sequence
atgagcgaggccagcggcaacctgaacagcctgcggatggccaacgtcgctctcagagaagagcttaacgccctgcgaggcgagaacgccaatctgggcttacaactgggtcgtgcactggctgaggtgaactccctgaggggcaacgtctccagttacatccggtggcctgtcccaatcgtgccggtccttgcagaggagaatctcgagtttgctttgtctgagattgaggtgattcctgggggtgagctaccatttctttgcagaccaccacctcgggccgaaccagattgtatttccgatgatctgctgattaacgtgatacaggacagatcaacccccgatgggcccgcagatccccctctacttccgattcccccaccacccgcgctccctccacctgccagtaaggaaccccctcctcagccaccgctggctccactggaaaggcctgagattgagcccttcagtggcgacccggtgtatctggcagaatttcttatgcagctggaaacgttcattgccgaccatgaggtgcactttcctgggggcgcagagcgggtggcctttctcatctctttttttacgggggaagccaaagactgggccatttctgttacccaggaaggctctccactgcacgcaaatttcccacggttccttgacgaaatcaggaaggaattttgcggccccatcccacccagggtggccaaaaaggccattcgaaaattgaaacaggggcactgcaccctgggcagctatgcagatgcattccaattcttagcccagtttctgtcttgggacgactgccggctccagaaccagtttctcaagggcctttccgagttctttaggaaagagctgctctggtctactgagatggccgacctagatgaattgatcctagagtgcgttgaaatcgaacgcaaggtccgcgtgccaaagccgattccgctcccgggcgttcgtaacattatctttccctttgctccttctcccaatgaggaggaaagtgaggatgaggagtactactccgaagatgaggatcaggaagcccggcgccaccgcctgcacagtaaggaccagaggaagagaatgcgtgcctttcagcaggaaatgaaagagaaagaggaggaagagatgaagaaagaggaggaaatgaagaaaaaggaggaaaaagaagaggaagaagaagaggagatgaaacagaaagaagaagaagaggaaatccgcaacaaaaacgaggaggaaggggagagcaaggatgaggaggacgaggatgaggacgggggacagaaacccgagggcgaacctcaacaggatcctggaactgaagaaacgtacggggaggtggaggaggagcccctggatgaagctcaagacgatgatctagatgagctgatggaaatggaaccaacattcgtacatgcttcctcccagaccagtggacctaccagtggatatcatgctgaaaactttctcggagcctcacctcccataatccagccatcacgtcgcaggaatcaaaatcgagtgccgttactggaagggttaccaggaacaaacagccctttctatagctccccccaacttatccgacgcacaggcagactcgggcaacgacaagtgcgccgccggcctccagtcctcttcaggcttacaccccggcagggcggacaccgcgccgcaagaggacggatccgtgtttag

SEQ ID NO: 50615 - DNA, 1710 bp, Artificial Sequence
  Description of Artificial Sequence: Synthetic coding sequence
atgagcgaggccagcggcaacctgaacagcctgcggatggccaacgtagctttgcgcgaagaacttaacgcgctgcgtggggaaaacgcaaacctaggtctgcagcttggcagggccttagcagaggtaaactcattgcggggaaacgtttcatcctacatccgctggccagtgccgatcgtacccgtgctggccgaggagaatcttgagtttgcactcagtgaaattgaggttatcccgggtggagagctgccttttctgtgtcgacccccacctagagccgagccagactgcatctctgatgatttactgatcaacgtcattcaagaccgtagtactcctgacggacctgcagacccacccttgctgcctattccccctcccccagcattaccaccacccgctagcaaggagcctcccccacagccaccgctggcaccgttagaacggccagaaatcgaacccttttccggcgatccagtgtacctggccgaattcctgatgcagctcgagacttttatcgcagatcatgaagtgcacttcccaggcggggctgaacgtgttgctttcttaatctctttcttcacgggggaggccaaagactgggctatctctgtcacgcaagagggcagcccactgcatgccaacttccctaggtttctcgatgagataagaaaggagttctgcggccctattccccctcgagtggctaagaaggctatccgcaagttaaaacagggccactgcacactgggctcatacgcggacgcatttcagttcctcgcccaatttctctcttgggacgattgccgcttacagaatcaattcctcaaaggactgtcggagttttttaggaaagaacttttgtggtccactgagatggccgacctcgatgaactgattctggagtgcgtggagatcgaacgaaaggtgagagtgcctaagcccatccccctccctggcgtgagaaacattatcttcccatttgccccgtctcccaatgaggaagagtccgaggacgaagaatattattctgaagacgaagatcaggaagcacggaggcatcggcttcattcaaaggatcagagaaagcgaatgcgagcgttccagcaggagatgaaggaaaaggaagaggaagaaatgaaaaaagaggaggagatgaaaaagaaggaagagaaggaggaagaggaggaagaggagatgaaacagaaggaggaggaagaggagattaggaacaagaacgaggaggagggagagagtaaggacgaggaagatgaagacgaagatggcggtcagaaacccgagggggaaccccagcaggatcctgggactgaagaaacctatggggaggtggaggaggagcctcttgacgaggcgcaagacgatgatctagatgagcttatggagatggagcctaccttcgtccatgcatcttcccaaacaagtgggccaaccagcgggtaccatgccgaaaatttccttggcgcctccccgccaatcatacagcctagcaggcggcggaaccaaaacagagttccactgctcgagggtctcccggggaccaattcaccgttttactctagcccacagctgatcaggcggacgggccgcttaggccaacgacaggtgcgcaggagacctcccgtgctgtttcgattaacaccccggcaggggggccacagggccgcacgtggtcggattcgagtgtag

SEQ ID NO: 50616 - DNA, 2028 bp, Artificial Sequence
  Description of Artificial Sequence: Synthetic coding sequence
atgctgcgggccaccgccccctgctggttcccccccggctaccccgaggccaaaaaagtggctgaggaagccgccctcgaggcttctaggcatctcggaggagaacaaagccaggctggcgccccggaaggatctaagatgcttcgggccactgcaccatgctggtttcggccaggatatcccgaggccaaaaaagtagcaaaagaggccgcccccgaggcctccaggcatctcggcgccgaacagtcacccgcgggggccccggaggggtctaagatgcttcgcgctactgcaccatgttggtttccccccggctacccagaagctaaaaaggtggccgaggaggccgctctcgaggcccccgaattccccctgccaagtcaccagcctgcccagtccttcgggctttgggtgccacagatgcataagcaggcctccgccttcgtggacattcaggccgagccacagaaccgcggcccggcagttccgccagcgtggcctaaaatggtgaccgagtcctgctacttccctgcgcagaggggaagcgcctgcaggctccctgccgctcccaggttgactgagcggccatctggagtaaggattagcgctccaaggaagagaaaaaccattgcgcactcttcatcaccctgccttgtaaccggctacaccgacgcaaagcgcacgcgggtggcatcaagctcccagaggtctcgcggctctaaagttggtcgccagcctggcaagacccgcaatcgtagtgggatggcttgtaaaactactgctacaacctcttctaagcggatcgttagaagagccagcctccccagtctgtcactgaagaagccaattatcctcaggagttcagggtgccaggttccaaccgttctccggcgcgggtatcttcagctctttaccgaagaatgtctgaaattctgtgcaagcaaacaggaggccgaagagaaggcgcttaacgaggaaaaagttgcttatgattgcagccccaataagaacagataccttaatgttgtgctgaatacgttgaagaggctcaaggggctcaccccctcctccatgcctggactatcccgggcagccctatattcccggttgcaagagttcttgctaacacaggaccagcttaaagagaatggctaccccttccctcaccctgaaaggcccggcggagctgtcttattcactggccagggcaagggtccaggcgacagctcctgcagagtgtgctgccggtgtgggacggaatacttggtttccagcagcggcaggtgcgtacgcgatcagctgtgctattaccactgggggagagtcaggtctagccaggtggccggaggccgggtttcacagtacacatgttgcgccgccgctcctggaagcgtcgggtgtcaagtggccaaacagcatgtgagggacggccgcaaggagagcctggatggcttcgtggagacatttaagaaggagttatcccgagatgcatatccaggaatttatgctctggattgtgagatgtgttataccacccatggcctcgaactgacgagggttacggtggtggatgccgacatgagggtcgtgtacgacacgtttgtcaagcctgacaatgagatcgtggactacaatacccgattttccggtgttaccgaggctgacgtagctaagacgtcaataaccctcccacaggtgcaggcaatcctactatcttttttctccgctcagacaatccttatcgggcacagtctggagtcagatcttctcgcgctcaagctgattcactctactgttgtagatactgctgtgctctttccccattatttgggttttccttataagagatccttgcgaaatctagctgctgattatctagcacagattatccaagacagccaggacggccacaactctagtgaggacgccaacgcgtgtctacaactggtgatgtggaaggttcgccagagggctcaaattcagccacggcaccgcagcgcctctcccgccgccttggcttgcccttag

SEQ ID NO: 50617 - DNA, 2028 bp, Artificial Sequence
  Description of Artificial Sequence: Synthetic coding sequence
atgctgcgggccaccgccccctgctggttcccccccggctaccccgaggccaaaaaggtggccgaggaggccgcattagaggcatctaggcatctgggcggagaacagtcccaggctggggcacccgaagggagcaagatgctgcgggcaacagcgccctgttggttccgtccagggtaccctgaggccaaaaaggtcgcaaaggaggccgcccccgaggcttctaggcacttaggagcggaacagtcacccgctggcgcgccagaaggctctaagatgctgagggcgacagcaccttgttggttccctcctggatatccagaggccaagaaggtcgccgaagaagccgcattggaagcccccgagttccctttgccatctcatcagccagcacagagttttggcctgtgggttccccagatgcacaaacaggccagtgcgtttgtcgacattcaggcagagccgcagaatcgtggcccagctgtcccgccagcttggcccaagatggtgacagagagttgctattttcccgcacagagaggctctgcatgcagactaccagccgcacctcggctgactgagcgaccaagcggggtgcggatatcagcacctcggaaacgcaaaacaatcgctcattcctcctccccctgtctggtgacagggtacacagacgctaagcgaacccgcgtagcttcaagctcccagaggtcgcgggggtccaaggtaggcagacaacctggcaagaccaggaataggtctggcatggcctgcaagacaacggccacaacgtctagcaagaggattgtccggcgggccagcctgccaagcctctcgctcaagaagcccataattttgagaagttctgggtgtcaggttcctaccgtgttgagaaggggttacctccaactgtttactgaagagtgcctgaaattttgcgcttccaaacaggaagccgaggaaaaggctcttaatgaggagaaggtcgcatatgactgtagccccaataagaaccgttaccttaacgtggtgcttaacactctaaaaaggctcaagggactgactccaagctcaatgcccggcctgtcccgagcagccctttattcccgactgcaggagtttcttttgactcaagaccagctgaaagaaaacggctacccgtttccccatccggagaggcccggaggcgctgtcctgtttactggacagggaaagggtcctggagacagtagttgccgcgtgtgctgcaggtgcggcacagaatacctggtgagctcaagcggacgctgcgtacgggaccagttgtgttactaccactggggaagggtgaggtcttcccaggttgcgggtggtagagtgagccagtatacctgctgtgccgctgcaccgggctccgttggctgtcaagtcgctaaacagcacgttagggacggccgcaaggaaagcctggatggcttcgttgaaacatttaagaaggaactgtctcgggatgcatatccaggaatctacgccctcgattgtgaaatgtgctataccacacacgggctggaacttactagggtgacagttgtggatgctgacatgcgtgtagtatacgacactttcgtcaaacccgacaacgaaatagttgactataacactcgattctcgggggttacagaggcagacgtcgccaagactagcattactctcccgcaagtgcaggctatactgttatcttttttcagtgcccagactatcttgattggtcatagtctggaatcagacctcctagccttgaagctgatacactcaactgttgtggacactgctgtcctgtttccccattatctggggttcccatacaaaaggagccttcgcaaccttgctgctgactacttagcccagattatccaggacagccaggacggtcataattcttcagaggatgcaaacgcctgcctacaactggtcatgtggaaggtccgacaacgcgctcagattcagcccagacaccgaagcgcctctccagccgcactggcttgtccctag

SEQ ID NO: 50618 - DNA, 3864 bp, Artificial Sequence
  Description of Artificial Sequence: Synthetic coding sequence
atggtggcccggagcaccgacagcctggacggccccggcgagggctctgttcagcccctccctaccgcaggaggcccttccgtgaagggaaaacccggcaaacgattgagtgctccgcgcggaccctttccccgactggctgactgcgcgcacttccactacgagaatgtggattttggacacattcagttgttgctgtctcctgacagggagggcccctccttgtctggagaaaacgaattggtctttggtgtgcaagtgacgtgccagggccggagctggcctgtactcaggtcttacgacgattttcggagtttggacgctcatctgcaccggtgtatcttcgatagacggttttcttgtctgcctgaacttcccccgccaccagaaggggctcgggctgctcagatgctggtcccccttctgttacagtacctagagacactctcaggtctagtggattctaatctgaattgtgggccagttctgacttggatggaactggacaatcatgggcgtcgcttgctactgagcgaagaagccagcttgaacataccagcagtggctgccgcccacgtcatcaaacggtataccgcgcaggcacctgatgagttgtctttcgaggtgggcgacatcgtgtccgtgattgatatgccacctaccgaagatcggtcatggtggcgtggcaaaagaggcttccaggttggatttttcccaagcgaatgtgtggagttgttcaccgagagaccaggtcccggcctcaaggcggacgctgatgggccaccttgcggcattccagcgcctcagggaatcagttcattaacttctgccgtgccacggcccagaggaaaactcgctgggctactgcgaacctttatgcgatctagacctagtagacaaaggctcagacagaggggcatcctgaggcaaagagtgttcggatgcgacctcggtgaacatttatcaaatagcggccaggacgttccgcaggtactgcgatgttgctctgagtttatcgaggcacatggagtggtcgatggaatttaccggctgtctggagtgtcaagtaatatccaacggttaagacacgagttcgattccgagaggatccctgagctgtctggtcccgcattcctgcaagatatccacagcgtttctagtctctgcaaactctactttcgagaactaccaaatccattactaacttatcagctgtacggcaagttctcagaagccatgtcagtgccgggcgaggaagaacgcctcgttagagtgcatgatgtcatacagcagctgccacctccccattaccgtacccttgagtatttgctgcgccatctggctcgcatggcacggcactctgccaataccagtatgcatgcacggaacctcgctatagtctgggcccctaatctgctcagatctatggaactcgaatctgtaggcatggggggcgctgcagctttccgggaggtgcgagtccagagcgtggtggtcgaattcctattgactcatgtggatgtcctgttctccgataccttcacgtcagccggcctggaccctgcaggtcgttgccttctgcctcggccgaagagtttagctgggtcctgcccaagtacgagattgttgaccttagaagaggcgcaagcccgcacacaggggcggctcggcactcccacggagcctaccacccccaaggcacccgccagccccgccgagaggcgaaagggtgaaagaggcgaaaaacaacgcaagccaggaggatcatcctggaagacgtttttcgctctgggacggggtcccagcgttccaaggaagaagccactaccttggttaggtggaaccagagctccccctcaaccgtccgggtcacggccagacactgtgactctgagaagtgcaaagagcgaagagagcctatcctcccaagcttccggggccggactgcaaagactgcatagattaaggaggccccacagcagctccgacgcattccccgtggggccagccccagccgggtcttgcgagtccttgtcctcctcatcctcaagcgagagctctagcagcgagtccagctccagctctagtgaatcctccgctgccggattaggtgctttatcgggtagccccagccacaggacgtctgcctggctcgacgatggtgatgaactggatttttcaccgccaagatgtctcgaggggttgaggggtctggacttcgatcctctcaccttccgatgctcctcgccgactcccggtgaccctgcccccccagcttcccccgccccccccgcacctgcaagcgcattccccccccgagtaactccccaggcaatctctccacgcggcccaaccagcccggcctcccccgcggccctcgacataagtgagccacttgccgtgtccgtgccaccggcagtgctggagctcctgggcgccggcggagcccctgcatcggccacccccacaccggccctcagccctgggaggagcctccgcccccacctgattcccctcttactgagaggggcggaggctccgctcaccgatgcatgtcagcaggaaatgtgctccaagctcagaggcgcccagggaccactggggcccgacatggaatcacccttgcctcccccccccctctcactgctgcggccaggcggtgctcctcctccgccacctaagaacccagcgagattgatggcattagcactagcagaaagagcccagcaagtggctgagcaacagtcccagcaggaatgtggaggaacacctcccgctagccagtctccatttcatcgctcgctaagcttagaggtcggcggcgagccactggggacctcaggttccgggccgcccccaaacagccttgctcatcctggagcatgggtgcccgggccacctccgtatcttccgcggcagcagagcgacggctcattgttgcggagccagagacccatggggacatccaggaggggcctccggggacccgcacaggtaagtgcacagctgagggctgggggcggaggcagagacgccccggaagctgccgcacaaagcccttgttcagttccgagtcaggttcccacccccgggtttttttcacccgcgcctagagagtgtctccccccgttcctgggagtcccaaagcccggcctttaccctctgggacccccaagctttcagccttcaagcccagccccggtctggcggtcatcattggggccacctgctcccctggatcgcggtgaaaatctatattacgagattggtgccagcgagggcagcccttacagtgggcccacacggtcatggtcaccattccgttcgatgccccccgatcggctcaatgcttcatacggcatgttaggtcagagccctcccttgcaccggagccctgatttcctgctgagctaccctccagcaccgtcctgttttcccccagatcacttagggtattccgcccctcaacatccagcacgccgacccactccgccggaacctctgtatgtcaatcttgctctaggaccccgggggcctagcccagcttccagctctagcagctcccctcccgctcacccgcggtcacgatccgacccaggccctcctgttccacggttgccgcagaaacagagagcgccctggggtccgcggacaccacacagggtgcccgggccatggggtcccccggaacctttacttttgtacagggctgccccccctgcctacggccgcggcggggagttacatcgtggatcactgtataggaatggtggccagaggggtgagggtgctggccccccaccaccctatcccacgccctcttggtcgttacattctgaaggccagacacgcagttactgttag

SEQ ID NO: 50619 - DNA, 2604 bp, Artificial Sequence
  Description of Artificial Sequence: Synthetic coding sequence
atgcggagccggagccccccccggcccaagtggcacagccgggacggttcatctcagagcgatagtggggaggagcagtcccgtggtcagtgggccagacggcggcggagggctcgatcatggtctccttcatcatcagcttcctccagtgctagccccggccgtagccagagtccacgtgcggctgccgctgcgctttcacagcagcagtccctccaggaacgtctccggctgcgcgaggagaggaaacagcaggaagaactgatgaaagctttcgaaacaccggaggaaaagcgtgccagaagacttgccaaaaaggaggccaaggagcgcaaaaaaagggagaagatgggctggggagaggagtatatggggtataccaacactgataatccgtttggagacaacaatctgcttgggacttttatctggaacaaggccctggaaaaaaaaggcatatcgcacctggaagagaaagagttaaaggagagaaacaagcgcattcaagaggataatagactcgagcttcagaaggtgaaacagctgcgcttagaaagggaacgcgaaaaagcaatgcgtgaacaggagcttgaaatgttgcagagagaaaaggaggcagagcattttaagacctgggaagaacaagaagacaactttcacctgcagcaggcaaagctacgctccaaaatcaggatccgcgatgggcgcgccaaaccaatagacctcttagccaagtacatcagcgccgaggatgatgatctcgccgtggaaatgcacgaaccatataccttcctgaacggactgactgtcgccgatatggaggaccttctcgaagacatacaagtgtacatggagcttgaacagggcaagaatgccgacttctggcgcgacatgaccacaattactgaggacgaaataagcaaacttagaaaactagaggcatccgggaaaggtcctggtgaaagacgggagggggtgaacgcgtcagttagttccgatgtccagtccgtgtttaaaggaaaaacttataatcaactgcaggtgatctttcagggcattgaagggaagatacgagccggcggccccaatctggacatgggctactgggaatcgctcctgcagcaattacgcgctcacatggcccgggcacgcctgagggagcgacatcaggacgtgctccggcaaaaactgtacaaacttaaacaggagcagggggtggaaagtgagcccttattccctattctgaagcaggagccccagtctccctcccgttcgcttgagcccgaggacgccgcacctacaccacctggacccagcagcgagggcgggccagccgaagctgaggtggatggtgccacccccacagagggtgatggggacggggacggcgagggtgaaggagaaggggaagccgttctgatggaagaagacttaatccaacagtcactagatgactatgatgcgggacggtatagcccccgtctgttaactgcccacgaactgcccctcgatgcacatgtgctcgaaccggacgaggatttacaacggttgcaactgtctaggcagcagctccaggtgactggcgatgcctccgaatcagccgaggacattttcttccgaagggctaaggaaggcatggggcaagacgaggcccagttctccgtagagatgccgctgaccggtaaagcatacttgtgggcggacaagtatcggcccagaaagccccggtttttcaatagagtgcatactggattcgaatggaacaagtacaaccagacccactacgatttcgacaaccccccacctaaaatcgtgcaaggatacaaatttaacatcttttatcccgacctgattgataaaaggtctacccccgagtacttcctggaagcctgcgcggacaataaggacttcgccatcctgcgctttcatgccggtcctccttacgaggacatcgcgttcaagatagtgaatagggagtgggagtattcccataggcatggatttagatgtcaattcgcaaacgggatctttcagctctggttccacttcaagcgctacagatacaggcgcccaggtccatgttggaggcccatccgccactgtaggcgcgatccactttggacacctaccttgtgtagagattggccaccaactcatcccgtgctcgccgggggtgtgcacttcccggcggccggaatcccaccccctggactcctgacgggaccgtggtcaatgagaccggtcaccccctcattcgcccacatccgaacagttgctccgagccactcaccattcagcggccaagaaggcaggggtccacacggatgtcacagtcccggaagatccggacctgccggcaggctagttctgcagcaccccactggaactagtcctacagaagcaaaacggaaggtgccaccagggccccctgagggtcacccgacctcccccgttacctcacccagacccccgaccgccccccctcgccatcctgcgagcagtgggaattcctctgtttgtttctcaaaaaaaacgtgcagatgggagaagaaaagtttcgttctgatggagctggcctactggcaggatcgcatgtttttttag

SEQ ID NO: 50620 - DNA, 3381 bp, Artificial Sequence
  Description of Artificial Sequence: Synthetic coding sequence
atggtggcccggagcaccgacagcctggacggccccggcgagggctccgtgcagccactccccaccgcaggcggcccatcagtcaaaggtaaacctggcaagaggctgtcagcaccaaggggacccttcccccgtctggctgactgtgcacacttccattacgaaaacgtggatttcggacacattcaattactgctgtcacccgaccgtgaaggaccgagcctgagtggggagaatgagcttgtttttggtgtacaagtgacttgccaggggcgctcgtggcccgtgctgcgtagctatgacgattttcggtccttggacgcccatttacatcgctgcatattcgaccgtagattttcttgcctgccagagctgccaccaccccccgagggcgccagggcggcccaaatgctggtgcccctgctactacagtacctggagactttaagcggcctggtggacagcaacctcaactgtggccccgtactgacctggatggaactggataatcacggccgccgcttactgttaagcgaagaggctagtcttaacatacccgctgtcgctgctgcccatgtaatcaagcggtatacagcacaggcccctgacgaattatccttcgaggttggagacatagtgagcgtaatcgacatgcctcctaccgaagataggagttggtggcggggcaagcggggcttccaggtcggattcttcccatccgaatgcgttgagctcttcacagagcggccaggccccggcctgaaagcggatgccgatgggccaccttgtggcatccctgctccacaggggatctcttcactgacgtcggctgtgcccagaccccgtgggaagctagccgggctcttgaggacatttatgcgttcacgtccaagtaggcagcggcttaggcagagaggaatactcaggcagagagtctttggctgcgatttaggggaacacctctctaattctggtcaggacgttccccaggtcctgcggtgttgtagtgagttcatcgaagcccatggcgtggttgacggcatctatcggctctcaggtgtgtcctcaaacatccagaggttgaggcacgagtttgattcagagaggattccagagctctcagggcctgcatttttacaggacatacatagcgttagcagtctgtgtaaattgtactttagagagttaccaaaccccctcctcacctaccagctttacggcaagttcagcgaagccatgtctgtccccggagaagaggaaaggctcgtacgcgtacatgacgtaatacagcagctaccaccaccccattatcgtaccctggagtacttgctgagacacctggcccggatggctagacacagtgccaatacatctatgcacgcccgcaacctggctattgtctgggcccccaacttactgcgttccatggagctggagagtgtgggcatgggaggcgcggccgccttccgcgaagtgcgcgtgcagagtgttgtggtagaattcctgctcacacacgtcgatgttctcttcagcgatacattcactagtgccgggttggatcctgccgggcgttgcctcctgcccaggcccaaatcactggccggctcttgtccgtccacaagactgctcactctggaggaggcccaggcgaggacacagggtcggcttggcacaccaactgagccaaccacccccaaggctccagcatcgcccgcagagaggcgaaaaggtgagcgcggtgaaaagcagcgcaaaccgggcggaagtagctggaaaacgttcttcgccctcggcaggggtccaagcgtgccacgcaagaaacctctgccatggctcggaggaaccagggcaccaccacagcctagcggatccagacccgacacagttactttaagaagcgccaaaagcgaggaaagtttatccagccaagcatctggtgctgaactcctgggggccggtggagcaccggctagcgcaacccccacgccagctttaagcccagggcgctctctgcgtccgcatctcatcccactgctgcttagaggtgcggaggcacccttgaccgatgcctgccagcaggaaatgtgctctaagttgagaggggcccaaggaccgctcggacctgacatggagagccctcttcctccgccacctctctcgctgctgcgtcccggaggagcaccacctcccccgcctaagaatcctgcccggttgatggcgcttgccctggccgaaagggcacagcaagttgctgaacagcaatcccagcaggagtgtggaggcacaccccccgcaagccaaagtccttttcataggagcctttctctggaggtaggtggcgaacctctcggcacatctggaagtggccccccaccaaactccctggcccatcctggagcctgggtccctgggccccccccatacctacctagacaacagtccgatggatcgcttctacgttctcagagacctatgggtactagtcgtagaggactgcggggacccgcgcaagtgtccgctcagctcagagcaggaggcggtggccgagatgctcccgaggccgccgcacagagcccatgttccgtcccttcccaggtccctacaccgggatttttctcccctgcaccaagagagtgcttacccccattcctgggtgtcccaaaaccaggactttaccccctcggccccccctcattccagcctagctctcccgctcccgtctggcgatcatccctgggacctccagctcccctggatcggggcgaaaacttgtattatgaaattggagcttctgaaggatccccatactcaggcccaacccgctcatggtcaccgttcaggtccatgccccccgatcgccttaatgcgtcttacgggatgctggggcaaagtcccccccttcatcgatctcctgacttcctcctgagctatccacctgctccatcctgtttccccccggatcacctgggctattcagcccctcagcatcctgctcgacgtccaaccccgcccgaaccactatacgtaaatctggcactcgggcctaggggaccctcccccgcttcatctagtagctcatcacctccagcgcatccccggtcaagatcagacccaggccccccagttccccgcctgccacaaaagcagcgggctccatggggaccacgaacgccccaccgggtgcccgggccctggggcccaccagaaccacttctcctgtatagagccgctccacctgcctatggtcgtggcggcgaactgcatagagggtcactgtacaggaatggggggcagagaggagagggtgccgggcccccacctccttaccccacccctagttggtcccttcactcagagggacaaacaagatcctactgctag

SEQ ID NO: 50621 - DNA, 3372 bp, Artificial Sequence
  Description of Artificial Sequence: Synthetic coding sequence
atgctggtgcccctgctgctgcagtacctggagaccctgagcggcttggtcgattccaacctaaattgcggacccgtgctgacctggatggagctggacaaccatgggagaaggctgctgctctccgaagaggccagcttaaacatccccgccgtcgctgccgctcacgtcattaagcgatacacggcccaggccccagacgaactgtctttcgaagtcggcgatatcgtgtccgtgatagacatgccacccaccgaggaccgctcctggtggcgcggaaaacgtggtttccaggttggcttctttccctctgagtgcgtcgagctgttcacagagcggccagggcccgggctgaaagcagacgccgatggacccccctgcggcatcccggcacctcaagggatcagctcgttaactagtgccgtacctaggccacggggtaagctcgcgggactattgaggacatttatgcgatctagaccttcacggcaacgcctgaggcagcggggtatcctccgccagcgcgttttcgggtgcgatctgggagaacacttgtccaacagcggacaggatgttccacaagtgctccgctgttgttcagaattcatagaagcccatggcgttgtggacggtatctaccgactgtccggagtttcatctaacatccagcgcttgcgtcacgagttcgatagcgaaagaataccagaactgagtggtccggcgttcctgcaagatatacattccgtgtctagcctttgcaagctgtatttcagagagctgcccaacccactgttgacgtaccagctgtacggcaagttttccgaagccatgtccgtgcccggagaagaggagaggttggtgagggtgcacgatgtaatccagcagttgccccccccccactacagaaccctagaatatctgttacgccacctcgcccgcatggcacggcattccgcaaatactagcatgcacgctcggaatcttgctattgtgtgggctccaaacctgctgcgctctatggaactcgagtctgtcggcatgggcggcgcagccgcgtttcgggaggtgcgagtgcagtccgtggttgtcgagtttctactgactcatgtggatgtcctgttttctgacacgttcacttcagccggcctggatcccgcagggagatgtctgttgccccgtcctaagagcctggccggatcctgcccatcgacccggctcctcactctcgaggaagcccaggcgcgcacgcagggacgcctagggacaccaacagagcctacaacccccaaggcaccagcttcccccgccgaacgtcgaaaaggcgagcggggcgagaaacagagaaagcccggaggaagttcttggaagaccttcttcgcgctcggccgcggaccaagtgtgccccggaaaaagcccctgccttggcttggggggacacgggcaccgcctcagccttccggatccagacccgacactgttactctcagatctgcgaagtctgaagaaagcctgagcagtcaagcttcaggggctgggttacagcgtttgcaccgactgagacgcccccactcttcaagtgatgccttccctgtcggacctgcccctgccgggtcgtgtgagtccctctcttcttctagctcctcagagtcatcatcatcagagagctctagctcttcaagcgagagctcagctgccggactcggagcattaagtggatctccctctcacagaacatcagcatggctggacgatggggatgaactggattttagcccccccaggtgccttgagggcttgcgcgggcttgattttgaccccttgacttttcgctgctctagccctacacccggggatccggctccacccgcatcacctgccccacccgcccctgcctcagccttcccccctagagtcaccccccaagccattagcccaagaggaccaacttcacctgcgtcccccgccgctctggatatctctgaaccattggccgtgtccgttccacccgccgttctggaactccttggcgctgggggcgcaccagcaagtgccacacctactcccgcgttaagcccaggacggtcactcaggccccatctgattcccctgctgcttaggggagccgaagctcccctgactgacgcatgtcagcaggaaatgtgctccaaattgcggggggcccagggtcccttaggacccgacatggaaagtcccctgcctcctccccctttatcattgctgaggcccggcggcgcccctccacctccaccaaagaatcccgcaaggcttatggcccttgcccttgccgaacgagcccaacaagttgccgagcagcagtcgcagcaggagtgcggcggcaccccgcctgccagccaatccccgttccaccgtagcctgtctctggaagtgggcggggagcctctggggacttccggctccgggccacctcctaattcgctcgctcatcccggcgcatgggtgcccggtccgcctccatatctgccacggcagcagtcagatggaagtttgcttaggtcccagagacctatgggtactagccgacgcggacttagaggcccggctcaggttcctacccctggcttcttcagccctgcccccagagaatgtcttcccccttttcttggcgttccaaagcccgggctgtatccccttggacctccatcgtttcagccgtcctccccagcccctgtgtggaggtcaagcctcgggcctccagcacctcttgatcggggcgagaacctctactacgagattggggcttccgagggctccccatactctgggcctacccggagctggtctccattccgcagtatgcctccagacagactaaacgccagttatggaatgctcggacagtcaccaccactgcaccgcagcccagactttctgctgtcatacccccctgcccctagctgttttccacccgaccatctaggatactctgccccacagcaccctgccaggagacccaccccccctgagcccttatacgtgaacctcgcactgggtccgcgtgggcccagccctgcctccagttcgagctctagcccaccagcccatccacggagtcggtccgaccctggccccccagtaccccgtttaccccaaaagcagcgtgccccctggggaccccgaactcctcatagagttcctggaccttgggggcctcccgagccccttctcctgtaccgggccgctccgccagcctacggcaggggcggcgagcttcatagaggatcactctaccgaaacggcggccagaggggcgaaggggccggaccgcctcccccctatcctactccatcctggagcctgcactctgagggtcagacgagaagttattgctag

SEQ ID NO: 50622 - DNA, 2625 bp, Artificial Sequence
  Description of Artificial Sequence: Synthetic coding sequence
atgggcctgcccaccctggagttcagcgacagctacctggacagccctgacttccgcgagagattacagtgtcacgaaattgaactggagagaacaaataaattcattaaggagttgatcaaagatggcagccttctaatcggcgccctacgaaatctatctatggctgtacaaaagttcagccagtctcttcaggactttcagtttgaatgcattggcgacgcggagacagacgatgaaatctctattgcccaaagcctcaaggagtttgctcggctgctgatcgccgtcgaagaggaacggcgaaggctaatacaaaacgccaatgacgtcctgatcgcccctttggagaagttccggaaggaacagatcggcgctgcaaaagacggcaaaaagaagtttgataaggaatctgaaaagtattatagtattttggagaagcacctgaatttaagtgccaagaagaaagagagccacctgcaggaagctgatacgcagattgacagagaacatcagaatttctatgaggcaagcctcgagtatgtgtttaaaatccaagaagttcaggaaaagaagaagtttgaatttgtggagcctctgcttagctttctccagggtctgtttaccttttaccacgaaggctacgaattggcccaggagtttgctccttacaaacagcagctgcagtttaacctccagaataccaggaataatttcgagtctacgaggcaggaagtggagcggctgatgcagcggatgaagtctgcaaaccaagactacaggcccccaagtcagtggactatggagggctacctgtatgtgcaggaaaagaggcccttaggctttacttggatcaaacattactgcacctacgacaagggcagtaagacgtttaccatgtcggtctccgaaatgaaaagctccggaaaaatgaatggactggttacctcatcacctgagatgttcaaactcaagtcttgcatacggcggaagactgattcaatcgataaacgcttctgtttcgatatcgaggtagtggaaagacacggcataataaccttgcaagcctttagtgaagcaaatcgcaagctgtggcttgaagccatggacggcaaggaacccatatatacactaccggccataatctccaagaaggaggagatgtacctgaatgaggcaggcttcaactttgtccggaagtgtatccaagctgtggagacgagaggaatcactatcctgggtctctacagaattggtggggtgaactccaaggtacagaagctgatgaataccactttttccccaaagagcccaccggatatagatattgacatcgagctttgggacaacaaaaccatcacaagcggattgaagaactatctgcgatgtctagcagagccactgatgacatacaaacttcacaaggatttcatcatcgcggtaaaaagcgatgatcagaattacagggttgaggccgtgcatgcccttgtgcacaagcttcccgagaagaatcgtgaaatgctggacattctcatcaaacacctggtcaaggtgtccctgcattctcagcagaacctcatgaccgtgagcaatcttggagtcatcttcggtcccacactcatgcgggcccaagaagagacagttgccgccatgatgaacattaaatttcaaaacatcgtggtcgaaattcttatcgagcattacgaaaagatcttccacaccgcccccgacccctccatacccctgccacagccacaaagtcggtcaggatcacggaggacgcgggcaatttgtcttagcaccggctcacgaaagcctaggggacgctataccccatgtttagccgaacctgacagtgattcatactctagctcccccgatagcacacccatggggtccatcgaatcccttagcagtcattcgtccgaacagaatagtacgaccaaaagcgcatcctgtcagcctcgagagaaatctggcggcattccctggattgcgaccccgagctcctcaaacggacagaaatctctcgggttgtggactacgagtcccgaatcttcttcccgtgaagacgctacgaagacagatgctgaatccgactgtcagagcgtagcttctgtgacaagtcccggggatgtatccccacccatagacctggtcaagaaagaaccctacgggttaagcggtttgaagcgcgcatcagcatcctctctccggagtattagcgccgcagaaggcaacaagagctattccgggtccatccagtctctaacaagtgtgggcagtaaagagacgcctaaggcgagccctaatcctgacctgcctccaaaaatgtgcaggcggctgaggttagacaccgcgtctagcaacggctaccagcgccccgggtctgtggtggcagccaaggcacagcttttcgaaaatgtcgggtctccgaaacctgttagttcggggagacaggctaaagctatgtattcatgcaaagcagagcatagccatgagttgtcctttcctcagggtgccatattttctaatgtataccctagcgtcgagcctgggtggttaaaagctacttacgagggcaaaactggcctggtccccgagaactatgtggtgttcctttag

SEQ ID NO: 50623 - DNA, 1647 bp, Artificial Sequence
  Description of Artificial Sequence: Synthetic coding sequence
atgcagcccggcctgagccccggcagccccggcgacccccggccccccacacctgagactgactatcctgagtctctcactagttatcccgaggaggactacagcccggttgggagctttggagagccgggccccacatctccgcttaccacacctcctggatggagctgccacgtctcccaggacaaacagatgctatataccaatcatttcacacaagagcagtgggttagattggaggatcctcacggcaagccttacttttataatcccgaagactccagtgttcgttgggagttaccccaggttcccgtacccgcccctaggagcatccataagagctcacaggacggggataccccggcccaagcctcacccccggaggaaaaggtgccggccgagttggatgaagtcggtagctgggaggaggttagtccagcaactgctgcagttagaacaaagactctggacaaagccggcgtgctgcatagaaccaagacggctgataagggaaagcgtctgcgcaagaaacattggtcagcttcgtggactgtcttggaagggggcgttctcacattcttcaaggattctaagacctccgctgccgggggcttgcgacaaccatctaagttctcaacacccgagtacaccgtggaacttcgcggggctacattgagttgggccccaaaggataagtcatcacgaaaaaatgtgctcgaactgagaagtcgcgacggaagtgagtacctgatccagcatgatagcgaggccattatctccacatggcacaaagctattgcccagggcattcaggagctatctgcagaactgcctcccgaggagagcgaatcaagtcgtgtggatttcggttcgagcgagagactgggctcttggcaggaaaaggaggaggacgccagacccaacgcagcagccccagcccttggacccgtgggcttggaatccgaccttagcaaggtacgccataaactccgtaaatttttgcagcggcgcccaacattacagtctctgagggagaagggatacataaaagatcaggtatttggatgcgctctggctgccctgtgtgaacgcgaacgatctagagtgcccaggtttgtgcagcagtgtatcagagccgttgaggcgcgaggcctcgacatcgacgggctctaccggatctccggtaatctcgcaacaatccagaaattgcggtataaggtggaccatgacgaacgactggatttagacgacggacggtgggaagacgtgcacgtgattaccggggctctcaagcttttcttccgcgagttgcccgagcccttgttccctttctctcatttcaggcagttcattgccgccatcaagcttcaggaccaggcccgccgctcaagatgcgttagggatttggttcgaagtctccccgccccaaatcacgataccctgcggatgctgtttcagcacttatgtcgagtgatcgaacacggtgagcagaaccggatgagcgttcaatccgtcgcgatcgtctttggacctactctgttacgtccagaggtcgaggagacaagcatgcctatgactatggtcttccagaaccaggtggtagagttaatcctgcaacagtgcgccgacatttttccccctcattag

SEQ ID NO: 50624 - DNA, 1200 bp, Artificial Sequence
  Description of Artificial Sequence: Synthetic coding sequence
atggtggacatcatcgccaaggtgacccggcggcagagccgggccctgccagcgcaggtggacgatcctccggaacccgtgtatgcaaacatcgaacgccaaccaagggccacgagccctggtgccgctgctgcccctctccccagcccagtctgggagactcataccgatgccgggacaggtcgcccctactactacaaccccgatacaggggtcacaacatgggaatcccctttcgaagccgcagagggggcggcttccccagcaacttcacctgcttcagtcgacagtcacgtaagcttggagaccgaatggggacagtattgggatgaggaaagcaggcgcgtatttttttataatccactgacaggagagacggcctgggaggacgaggctgaaaacgaaccggaagaggaactggagatgcagccgggcctgtctcctggtagtccaggggacccgcgcccacctacgcctgagaccgattaccctgagtcactgacctcttatccggaagaagattacagtccggtggggtcattcggagagcccggccccacatctcccttaacaacaccacctggctggtcttgtcatgtgtcccaggataagcagatgctgtacaccaaccacttcactcaggagcagtgggttcgactggaagatccacatggcaaaccctacttttacaatcccgaagattctagcgtccggtgggaactgccccaagtccctgtccccgctcctcgcagcattcataaatccagccaggacggggatacacccgcccaagcctctccaccagaggagaaaacaaaaactctggacaaagccggggtcctgcatcgcacaaagacagccgacaaaggcaagcgcctgcgcaaaaagcactggtccgcctcctggacagtgctggaaggcggagttcttacctttttcaaggactctaagacctccgctgcgggtgggttgcggcagccaagtaagttttcaacacccgaatacactgtggaattgcgcggcgccaccttgtcttgggcgccgaaggacaaaagttccaggaaaaatgtcctagagctccggagcagagatggctccgagtatttgatccagcacgattcagaggccatcatcagcacgtggcacaaggctatcgcacagggcatccaggaactagtgagcagagctcagggcctctag

SEQ ID NO: 50625 - DNA, 1647 bp, Artificial Sequence
  Description of Artificial Sequence: Synthetic coding sequence
atgcagcccggcctgagccccggcagccccggcgacccccggccccctacgcccgaaacagactatcccgagagtctgactagctaccccgaagaagactatagccctgtagggagcttcggcgagccgggccctacaagtcccctgacaaccccccctggatggtcatgccacgtctcacaggacaaacaaatgctatacactaaccacttcacccaggagcagtgggtgcggctggaggaccctcatggcaaaccatatttctacaatcctgaggactcgagcgtgcggtgggaactaccgcaagttcccgttcctgctccacgatcaattcataaatcatctcaagacggcgatacgccagcccaggcaagccccccagaggaaaaagtgcccgccgaactcgacgaagtcggaagctgggaagaggtgagccccgctacagcagccgttcgaactaaaacgctggacaaggctggggtgctccaccgcacaaaaacggctgataagggaaaaaggctcagaaagaagcactggtctgcctcatggacagtgcttgagggtggagtgctgacattcttcaaagatagtaagactagtgccgccggaggtctgaggcagccttctaaattcagtacgcctgagtacacggtggaattgcgcggcgctacactcagctgggcccctaaggataagtcctccagaaaaaacgtgcttgagttgcgtagccgcgacggatctgagtacttgatccagcacgattctgaagcaatcatatctacatggcacaaagctatcgctcagggaattcaggagctgtccgctgagcttccgccagaggaatcagagtcttcgagagtggatttcgggtccagtgaacgtctggggtcttggcaagaaaaggaggaggacgcccggccaaatgcggcagcaccggccctaggacccgtgggcctggagtccgatctgtccaaggttcgccacaaactgaggaaattcctacagagaaggccaacacttcagtctttgcgagagaaaggctacatcaaagatcaagttttcggatgtgcccttgccgctctgtgcgagcgagaacgaagcagggtgcccagattcgtgcaacagtgtatccgggccgtcgaggccagaggcctcgatattgacgggctgtacagaatcagcggtaacctcgccaccatccagaagctccgctataaggtggaccacgacgagagattggacctggacgatgggaggtgggaggacgttcatgtgataaccggtgccctgaaacttttttttcgggagctgcccgagcctctgttcccattcagtcatttcaggcaattcattgcagccatcaaactccaggatcaagcccgacgatctaggtgcgtgagggacttagtccggtcacttccagctcccaaccacgacaccctgcgaatgctgtttcaacacctttgtcgagtgatcgaacacggagagcaaaaccgcatgtcagtgcagagcgttgcaatcgtgttcggccccacacttctgaggccagaagtggaggagacatccatgccaatgaccatggtcttccagaatcaggtcgtggaactgattctgcagcaatgcgccgatatcttcccgccccattag

SEQ ID NO: 50626 - DNA, 2589 bp, Artificial Sequence
  Description of Artificial Sequence: Synthetic coding sequence
atggccgccgacgtggtgggcgacgtgtacgtgctggtggagcacccctttgaatacacagggaaggacggacggcgcgtggctatacggccaaatgaaagatataggctgcttcgaaggtccaccgagcactggtggcatgtccggagagagcccggcggtcggccgttctacctgcccgctcagtacgtgagggaactacctgccttagggaatcctgcggctgcagcacccccggggccccatccatcccctgccgccccagagccacttgcatacgactataggtttgtctcggccgcagcaactgcgggcccagatggagcgcctgaggagtctggcggaaggacaagtagtctatgcgggccggcacaaaggggggccgcgacgcaaagaagcagcctggcacccggtctccctgcctgtctctatctgagacccgctgcgcccgttagaccagcccagtctctgaacgatttggcatgcgcagccgtgtcgccacccgcggggctgcttggatctagtggctcttttaaagcttgcagcgtggctggcagctgggtatgcccccgtccactggctagatctgactcagaaaatgtgtatgaagtgatccaagatctgcacgtccctccccgagaggagtctgccgagcaggtggatgaccccccagaaccagtctatgcgaatatcgagcgacagccccgcgcgactagccctggcgccgcggcagctccactgcctagccccgtgtgggaaacccatacagatgcgggcacaggtagaccctattactacaatccagacaccggagtgaccacttgggagtcccccttcgaagcagccgaaggcgccgcttcacctgccactagccccgcgagtgtcgacagccacgtctcgttagaaacagagtggggacagtattgggatgaggagtctagacgcgtattcttttacaacccgctgacgggtgaaaccgcatgggaagacgaggccgagaacgagcctgaagaggagctggagatgcagccaggtctgagtcccggatcccccggtgatccccgtccccccactcctgagacagattaccctgaatcactcacctcctatcccgaagaagactacagtccagtgggtagctttggagagcccggaccgacttcaccgctgacgactcctccgggttggtcgtgccacgtcagccaagataagcagatgctatatacaaaccactttacccaggagcaagtgcctgtgcctgctccgcgaagcattcataagtcctctcaggatggtgacactccagcccaggccagcccacctgaggaaaaggttcctgctgaactggatgaagtggggagctgggaggaagtttcgccagctacagccgcagtgagaacaaaaaccttagataaagctggagtgctgcatcgtaccaagactgccgacaaaggtaagcgactgaggaagaaacattggagcgccagctggactgtcctggagggcggcgtgctgaccttctttaaagattccaagacctcagccgctggcggcctgagacagcctagcaagttctcaactcccgaatataccgtggagttgagaggggcgaccttgtcgtgggcccctaaggataagtcctcaagaaagaacgtgcttgagttgaggtctagagatggctccgagtatctcatccagcacgacagcgaagctattatcagtacttggcacaaggcaattgcccaggggattcaggagctgagtgcagaattgcctccagaagaaagcgaaagttcccgggttgatttcgggtccagcgaaaggcttggctcttggcaggagaaagaagaggatgctcgcccaaacgccgcagccccagccctgggccctgtgggcctggaatctgatttgtctaaagtgcgccataagctgcgtaagtttctacagaggaggccaactctgcagagccttcgcgagaaaggctatattaaagatcaggtgttcggctgtgcactagctgccctgtgcgaacgagaaaggagccgcgtcccacgatttgtgcagcaatgcatcagggcggtggaggcacgcggcctggacatcgacggactgtaccggatcagcgggaatctcgccactatccagaagctaaggtacaaggtcgatcacgacgagagactagacctcgatgacgggaggtgggaggatgttcacgttattactggagcattaaaacttttttttcgggagttgcctgaaccgttgttccctttctctcactttcgccaatttattgcagctattaaactccaggaccaggcacgccggtccagatgcgtgagagacttggtcagatctctacctgccccaaaccatgacacactgcggatgcttttccagcatctttgcagagtgatcgagcacggagagcaaaacaggatgtctgtgcagtcagtagccatcgtctttggaccaactctcttgaggccagaggtcgaagagaccagtatgcctatgacaatggttttccagaatcaggtcgttgaactgatcctgcagcagtgcgctgacatatttccacctcactag

SEQ ID NO: 50627 - DNA, 792 bp, Artificial Sequence
  Description of Artificial Sequence: Synthetic coding sequence
atggccgccgacgtggtgggcgacgtgtacgtgctggtggagcacccattcgagtatacagggaaggatgggaggagggtggccatccgcccaaacgagcgatacaggcttcttcgccgaagtacggagcactggtggcacgtacgccgcgagccaggggggagaccattttacttgcccgcacagtatgtaagagagctgccagccctcgggaaccctgctgcagccgcccctcccgggccacatcccagtccagccgcaccagagcctttggcctatgactacaggtttgtctccgccgctgcaacagccggaccagatggggcccccgaagaaagcggcggacggacgtcctccctgtgcgggcctgctcagcgtggggctgcaactcagcggagctcactggcccctggactgccggcttgtctgtaccttcgtcccgcagctcccgtacgaccagcccagagcctgaatgatctggcctgcgctgccgtaagcccgccagcaggcctcctgggaagtagcggatccttcaaagcttgtagcgtggctggcagctgggtgtgtccccggcccctcgcccgatccgattcagagaacgtgtacgaggtaatccaggatctgcacgtaccacccagagaggaaagcgcagaacaggtgcccccacgcgccttgggacggggaggaggctggcgtgccagggatcgggctcgcaccgagcccggtaggaaagagacccgttcagctcaaagacgcgcccgccgcccccccctttctgaagattttggctag

SEQ ID NO: 50628 - DNA, 2526 bp, Artificial Sequence
  Description of Artificial Sequence: Synthetic coding sequence
atgagcgcccagagcctgcccgccgccaccccccccacccagaagcctcctcgtatcattcgaccacgccctccctccaggtccagagccgcacagtccccgggccccccacacaacgggtcatcaccgcaggaattgcctcgtaatagcaatgacgctcccaccccgatgtgcaccccaatcttttgggagcctccagccgcctccctcaagcctcctgcattgttgcccccctccgcgtcccgcgcctccctggactcacagacttcccccgactccccatcctccaccccaactccctcccctgtatcccgcaggtcagcttcccctgaacctgccccccggtctccagtgcctccccctaagcccagcggctccccctgtacccccctgttgccgatggcaggcgttctggcccagaacggcagtgcatcagcccccggcactgtgaggaggctcgccggcagatttgaaggcggcgccgaggggagagcgcaggacgccgatgcgcccgagcccgggctgcaggctagggctgacgtcaacggggagcgtgaggcccctttaaccgggtcaggtagccaggagaacggcgccccagacgccggactggcctgtcctccctgttgtccgtgtgtgtgccacacgacgcgtcctgggttagagctgcggtgggtccccgtcggggggtacgaggaggtaccccgtgtccccaggagggcaagccctcttcggacatccaggagcaggccccacccgccctctatcggccatcccgcggtagtgctgacatcatatagaagcacagcagagcgaaagctcctgcctctgctgaaacctccaaaaccgacccgagtgcgacaggatgccacaattttcggtgatcctcctcaacctgacctggacctgctgtctgaagacggaatccagaccggcgatagtccagacgaagcccctcagaacactccccctgccactgtagaggggcgcgaagaggagggactggaggtactgaaggaacagaattgggaactccccctgcaggatgagccactttaccagacttaccgcgcagcggttttgagcgaggaattatggggggttggcgaagacgggagtcccagcccagccaatgccggagacgctccaacctttcctcggccgcccggcccgaggaatacactttggcaggagctgccggccgtgcaggccagcggactgctggacaccctctctccacaagagaggaggatgcaggagagcctatttgaagtggtgacttccgaagcttcctacttaaggtcgctgaggctgctcaccgacacatttgtcctgagccaagctttaagggacactctgactccgcgcgaccatcacaccctgttctcaaacgtccagcgcgtgcagggtgtctcagaacgtttcctggcaaccctcctgtctcgggtacggagcagccctcacatcagcgacttgtgtgacgttgtacacgcccacgccgttggcccctttagtgtttatgtcgactacgtgcgaaaccaacagtatcaggaagaaacctattcacggctgatggataccaatgtgagattctcggcagaactgcggaggcttcagtctctgccgaaatgcgaacgacttccccttcctagttttctgctgttacccttccagagaattacaaggctcaggatgctgctgcagaacatcctgcggcagacagaagaagggtcatccagacaggagaatgctcagaaagcacttggcgctgtatctaaaatcattgagaggtgcagtgctgaggtgggacggatgaagcagacggaagagttgattcgcctcacacagagacttagatttcacaaagtgaaggctctcccactcgttagttggtcccgaagactggagttccagggcgagttgactgaactgggatgcaggcgggggggcgtgcttttcgccagtagaccacgtttcacacctttgtgtctgcttcttttctctgatctgttgctcatcacccagccaaaatcagggcaacgtcttcaggtccttgactacgctcatcggtcactcgtccaagcccagcaggtgcccgatccgtcggggcctccgactttcagattgtctctattgtccaaccatcaaggccggcctactcataggctgctccaggcctctagcctcagcgatatgcagcgttggctgggtgcgttcccaactcccggacctctgccttgctctcctgatacaatctacgaagattgcgactgctcgcaggagctgtgcagtgaatcctctgctcccgctaaaactgagggccggtctctcgagagcagggcggcacctaaacatctgcataaaacccctgaggggtggctgaaggggctgccaggagcttttcctgcgcagctcgtttgtgaggtgactggagagcacgagcgcagaaggcacctgcgacagaaccagcggctgttagaggctgtcggctccagttccgggacacccaacgcgcccccaccctag

SEQ ID NO: 50629 - DNA, 2526 bp, Artificial Sequence
  Description of Artificial Sequence: Synthetic coding sequence
atgagcgcccagagcctgcccgccgccaccccccccacccagaagcctccacgaataattcgccccaggccaccatctagaagccgcgccgcacagagccccggtcccccccacaacggctcatctccccaagaactgccgcggaacagtaacgacgcacctacccccatgtgtaccccaatcttttgggagcctcccgccgcctcactgaaaccccctgccctgctccccccttctgcgagccgggcctccctcgacagccagacatcaccagactctccctcttctacacctactccttcacctgtaagccggcggtctgcttcaccggagcctgcgccccgatcgcctgtccccccgccaaagcccagtggctctccctgtactccgctcctcccaatggctggtgttttggcccaaaatggttccgcttccgcacccgggacagtccgtaggttggccggcagattcgaaggcggggccgagggacgcgcccaggatgccgacgcccctgagccaggcctgcaggcccgtgcggacgtgaacggggagcgggaagcgccccttaccggttcaggttcacaggaaaacggagcacccgatgcaggcctggcatgccctccctgctgtccttgcgtatgccacaccacacgccctggtcttgagctccggtgggtgccagtgggggggtatgaagaggtaccacgggtgccccgccgggcatcgcctctgaggacttcccgtagccgcccccaccctccatcaattggacaccccgccgtggtcctgacttcatacaggagcactgccgagcgcaagctgctgcctttactcaaacccccaaaacctacccgggtaagacaggatgcaactatctttggggatcctccccagccggacttagacttactctctgaggacggcatccagactggtgactcccccgatgaggcacctcagaatacacctcctgcaacggtggaagggagggaggaagagggcctggaagtgctgaaggagcagaactgggaattacctttgcaagatgaacctctgtaccagacctatagagcagctgtgttgagcgaggaactttggggggtgggtgaagacggaagtccttccccggcgaacgccggagatgcacccacctttcctagaccccctggtcctcgtaacaccctgtggcaggagttgccagctgtacaagcaagtggcttactggatactctttcgcctcaggagagaaggatgcaggagtcgctttttgaggtcgtcaccagtgaggcctcctacctgcgatcactgcggctcctgaccgatacatttgtgctgtcccaggctttgcgggatactttaactcctcgagatcatcatacgttgttttctaatgtgcagagggtgcagggcgtctccgagcgcttcctggcaactcttctttccagagtccgctccagccctcatatttcagatctgtgcgacgtcgtgcacgcgcatgcagttggaccatttagtgtttatgtcgactacgtccgcaatcagcagtatcaggaagagacttacagtaggctgatggacactaacgtgcggtttagtgccgagcttagaagattacagagtttacccaagtgtgaacggctgcctctgccctctttcctactcctgcctttccagcgcatcacaagactccggatgttgctgcaaaacattctcagacagaccgaagagggcagctctaggcaggagaatgcccagaaggcactaggagccgtgagcaagattattgagcggtgttctgccgaagtcggtagaatgaaacaaaccgaggagttaatccgacttacacagcggcttcgcttccacaaggtgaaagcattgcctctggtcagctggtcgcggcgtctagaatttcagggggagctcaccgagttaggatgcagacgtgggggagtgttgttcgcatctcgcccacggttcacaccgctctgcctgttactctttagcgatcttctgctgattacccaacctaagagtgggcagagactgcaagtcttagactatgcgcacaggtcacttgttcaagcccagcaggtcccggatccctcgggcccccctacgttcagattgtccctactgtctaatcaccaaggcagacctactcatcggctgctccaggccagcagtctttcggatatgcagaggtggctcggcgctttccctaccccaggaccactgccatgctcacccgacactatctatgaagactgcgattgctcccaggagctctgcagcgaaagttccgcccccgctaagaccgaggggagaagcctggaaagccgggcggccccaaagcacctacataagacccccgaaggctggctcaaggggctcccgggggcgttcccggctcagctggtctgtgaagtaacaggggagcacgaacgccgcagacacctcaggcagaatcagagactcctagaagccgtgggatcttcatccggcacccctaatgccccccccccttag

SEQ ID NO: 50630 - DNA, 1896 bp, Artificial Sequence
  Description of Artificial Sequence: Synthetic coding sequence
atggcccccctgcacaagaactaccccgagacccccatgatgcaccagccacagtgtgcccccccgtcttctggatccccacagctgcaccccagcagccctctcctcttctgtccaccccagaacggctcggcctctgccccaggaaccgtgcgcagattggctggcagattcgaaggaggcgctgaagggagagcccaagacgccgatgcccccgagccgggactccaggcccgcgctgacgtgaatggcgagcgggaagcacccttgacaggttcgggttcccaagaaaacggtgctcctggtgatagtcccgatgaagcaccacagaatacccctcctgccacagtggaaggaagagaggaggaaggtctcgaagtgttaaaagagcagaattgggaactgccacttcaggacgagccgctgtaccagacttatcgggcagcagtgctgtctgaagagttgtggggggtcggggaggacggcagcccttccccggctaacgcaggtgacgctcccacattccccagaccaccaggccctcggaacactctatggcaagagctcccggccgtgcaagcctctgggttgctcgataccctcagtcctcaggaaaggaggatgcaggaatccctgtttgaggtggtcacttccgaggcttcctatttacgaagcttacgtctcttgacagacactttcgtcctgagccaggccctgcgcgatacactgacccctcgcgatcatcacacactgttcagcaatgtacagagagttcaaggtgtctctgaaagattcctcgcaaccctgctctcgcgcgtgcgctccagcccacacatctcagatctttgtgatgtcgtgcatgcacatgccgtcggccctttctctgtgtacgtggactacgtcagaaaccagcagtaccaagaagaaacgtatagtagactgatggatactaatgttagattttcagcagagctgagacgcctgcagtctcttccgaaatgtgagcggctgcccctgcccagtttcctgcttctgccctttcagagaatcaccaggctcaggatgttgctgcagaatatcctgaggcagacggaggagggaagcagccggcaggagaatgcccagaaggccctaggcgccgtgtccaagatcattgagcgttgcagtgcggaggtgggccgtatgaagcagactgaagaacttattcgtcttactcaaaggctcaggttccacaaagtgaaggcgcttccactggtcagttggagtcgcagactggagtttcaaggcgagctgactgagttggggtgcaggaggggtggcgttctcttcgcctcccgtccacgcttcacccctctgtgcttgcttctgttctccgatctgctgctaatcacccaaccaaagagcggccagcggctccaggtgttggactacgcacatagaagcctggtacaggcacagcaagtgccggacccttccggcccacctacgtttcggctctcgttgctaagcaaccatcagggacgaccgactcatcgactccttcaggcctcttcattatccgatatgcagagatggctaggggcgttccctactcccgggccactgccttgtagtcccgacaccatctatgaagattgtgattgtagtcaggagctgtgcagtgaatcttctgcccccgctaagaccgaagggaggagtctggagtccagggcagcgcccaagcatctgcataagactcccgaaggttggctgaagggcctgcccggcgccttccccgcccagttggtatgcgaggtgacaggagagcacgaaaggcggagacatctccggcagaatcagcgcctcttagaagctgtggggtcttcttctggaacgccaaacgcccctccaccctag

SEQ ID NO: 50631 - DNA, 2616 bp, Artificial Sequence
  Description of Artificial Sequence: Synthetic coding sequence
atggacggcgagagcgaggtggacttcagcagcaacagcatcaccccactgtggcgacggcgctccataccccagcctcatcaggttctgggccgaagtaagccaaggccccagtcttaccagagcccgaacgggttattgatcacggatttccctgtagaggatggaggaaccctgctggcagcccagataccagcccaggtgcctacagcctctgacagccgcacagtccatcggtcacctttgctgttgggagcccaaagacgggcggttgcgaacggcggaacagccagtcctgagtacagggcggcctctccacggctgcgccgcccaaaatcacctaagctgccaaaagcagttccgggagggtcccccaagagtcctgccaatggtgcagtaactctccccgctcctccgcccccaccagtgctgagacctccccgtacacctaacgctcccgcaccatgcacgcccgaggaggatctcaccggcttaacagcctcacctgtgccctctcctacggccaatggactggccgccaacaacgactcccctgggtccggatcccaatctgggagaaaggctaaagaccccgaaagggggctattccccgggccccaaaagtcatccagtgagcagaagctgcctctgcaacggctcccttcgcaagaaaatgaattgctggaaaacccttctgttgtactgagcactaactcccccgctgctctgaaggtcggaaaacagcaaatcatccctaagtctctggccagcgaaatcaaaatctccaagtctaacaaccagaatgtggagccccataaaagactgctgaaagttcgctccatggtcgagggtctgggaggccccttggggcatgccggggaagaaagtgaagtggataatgatgtggattccccgggctccctcagacgaggtctgcggagtacatcctatcggcgtgcagttgtgagtggctttgatttcgacagccccacctccagcaagaaaaagaaccggatgtcccagcctgtactgaaggtggtgatggaggacaaggaaaaattctcttctctgggcaggattaagaagaagatgctgaagggacagggcacttttgacggggaagagaacgctgttctatatcaaaattataaagagaaggctctggatatagattcagacgaggaaagtgagcctaaagagcagaagagcgacgaaaagatcgttatccaccataaacccctgcgctccacatggtcacaactgtccgccgttaagaggaaggggctgagtcagacagtatctcaggaggaaaggaagaggcaagaggcaattttcgaggtcatttctagtgaacactcttacttactgtctttggagattctgatacgcatgtttaaaaactctaaggaactgagcgacactatgaccaagaccgaacgtcaccatttattttcaaatattaccgacgtatgtgaagcatccaagaagttctttatcgaacttgaagcacgccatcaaaataacatcttcatcgacgatatttctgacattgtggagaaacatactgcgagtacgttcgatccatatgttaagtactgcacaaatgaggtctaccaacaaagaaccctacaaaaactcctcgccacaaatccgtcattcaaagaagtgttatctcggattgaatctcacgaggactgtcgtaaccttcctatgatcagctttctgatcttgccaatgcagcgcgtaactcgactgcccctcctcatggacacaatctgccagaaaacacccaaagacagccccaaatatgaggtgtgcaagcgcgcactgaaggaggtgtcaaagcttgtgcgcctctgcaacgagggagccaggaagatggaaaggactgaaatgatgtacacgatcaattctcagttagagtttaaaatcaagccattcccactggtgtcttcttccagatggctggttaagaggggtgagctgactgcctacgttgaagacacagtgttgttctctagaaggacttccaagcaacaggtatacttcttcctttttaacgacgtgctcatcattactaaaaagaaatcggaagaatcgtataacgtcaacgactactcattgagagaccaactgctggtggagtcgtgtgacaacgaagaattaaatagttcaccagggaagaactcttccaccatgctgtatagtcggcagtcctccgcttcccatctattcaccctcacggtgttgagcaatcacgctaatgagaaggtggagatgttattaggcgccgaaacgcagtccgagcgagcacgatggataaccgctcttgggcatagcagtggtaaaccccctgccgatcgcaccagcctgactcaggtcgagattgtgcggagttttactgcaaagcagcctgacgaactgtccctgcaggtggccgacgtggtgctgatatatcagagagtgagcgacggctggtacgagggagaaagactgcgagacggagagcggggctggtttccaatggagtgtgcaaaagagatcacctgccaggccacaattgacaaaaacgtggagagaatgggcagactcctcgggttagagactaatgtgtag

SEQ ID NO: 50632 - DNA, 2616 bp, Artificial Sequence
  Description of Artificial Sequence: Synthetic coding sequence
atggacggcgagagcgaggtggacttcagcagcaacagcatcaccccactctggcgccgaagatcaataccgcagccgcaccaggtcctgggccgttccaaacctcgtccccaaagctaccagagccccaacggactgttaatcactgatttccccgtagaggacggcgggacgctactcgcagcgcagattcctgcccaggtgcccactgcctccgatagtagaactgttcaccggtctcctctgctgctcggggcccaacgccgcgcagtggcaaatggagggactgcttcccccgagtaccgcgcagcatcccctcggttacgaaggcccaagagccccaaacttcccaaggctgttcccggagggagccccaagagccctgctaacggggctgtcacactcccggccccccctccccccccagtcttgcggcccccccggaccccaaatgcacccgccccttgcacgccagaagaagacctgactggactaaccgctagcccggtaccctccccgacggccaacggcctggcggccaacaacgacagtcctgggagtggtagccaaagtgggaggaaggcaaaagatccagaacgtggactgtttccaggacctcagaagagctcttctgagcagaagttgcccctccaacgtctcccgtcgcaggaaaatgaattactggaaaacccatctgtagtactcagcaccaatagtccggcggccctgaaggtcggaaaacagcagatcattccaaagtctctcgccagcgagattaaaattagcaagtcaaataaccaaaacgtcgagccacacaaaaggcttctgaaggtgcgctcgatggtagagggtctgggcggaccactgggacacgccggagaggaatctgaggtggacaacgatgtcgattcaccaggcagcttgcgcagaggcttaagatctacatcctaccgtagggccgtggtgtctggattcgattttgactctcccacaagttcaaagaagaagaatcggatgagccagccagtgctgaaagtggtcatggaggacaaagagaaatttagctctcttgggagaatcaagaaaaaaatgctgaagggccagggaacattcgacggcgaagagaacgccgtgttgtaccagaactacaaagaaaaggcccttgacattgactctgatgaggagagtgagcctaaagaacagaaaagtgatgaaaagattgtcatacaccataagcccctgcggtccacatggtcacaactcagcgcggttaaacgtaaaggcttgtcccagaccgtgagccaggaggagaggaaacgccaggaggcaatctttgaggtaatctctagtgagcactcctacctgctgagtctggagatactgatcagaatgtttaagaactccaaggaacttagtgatacaatgaccaagacagagcgccaccatctgttctctaatatcacagatgtctgtgaggctagcaaaaagttctttatagagctggaagctcgccaccaaaacaatatctttattgatgatatttctgacatcgtcgagaagcacaccgcgagcacctttgatccttatgtgaaatactgcacaaatgaagtttatcagcaacggacactccagaaactgctcgcaacaaatcccagcttcaaggaggtcctttcccggatcgagtcacatgaggactgcaggaatctgccgatgatctcctttctgatcctgcctatgcaacgagtaactcgcctccccctgctaatggatactatttgccagaaaacccccaaagacagcccaaaatacgaagtgtgcaagagagctctcaaagaggtgagtaaactggtgagattatgtaatgaaggagcacggaaaatggagcgtactgagatgatgtacaccatcaactcgcagctggagttcaaaattaaaccgtttcctttagtttccagtagtcgttggttggtgaagcgtggggagcttacagcttatgtggaggatactgtcctgttctcccgccgaactagtaaacagcaggtgtatttctttctctttaacgacgtcttgatcattacgaaaaaaaaatcggaagagagctataacgtgaacgactactcactgcgcgaccagctcctcgtggaatcatgtgataatgaggagcttaatagcagccccggaaagaacagctcaacaatgctctatagcaggcagtccagtgcatctcatctgttcaccctgaccgtactctctaatcacgccaatgaaaaagtagagatgttgttaggtgccgagactcagtccgaaagagcaaggtggatcaccgctctggggcattcatccggaaagccaccagctgaccgtacttccctaacacaagtagagatcgtgcgctctttcaccgctaagcaacccgatgagctgagtcttcaagtcgcggacgtcgtactaatctatcagagggtgtctgatggttggtatgagggcgagcgcctgagagatggagagcgggggtggttcccaatggaatgcgctaaggaaattacgtgccaggcgaccattgacaagaacgtggagcgtatgggccgattgctcggcctcgagacaaacgtatag

SEQ ID NO: 50633 - DNA, 1341 bp, Artificial Sequence
  Description of Artificial Sequence: Synthetic coding sequence
atggacggcgagagcgaggtggacttcagcagcaacagcatcacccccctctggaggcggcgctctattcctcagccccaccaggtgttgggcagaagtaagccaagaccccaatcataccagagtccaaatggcctactaattaccgactttcctgtagaagacggaggtaccctgctagcagcacagattccagcccaggtcccgacagcaagtgattcgcggactgtacacaggtctccactgctgctcggcgcacaacggcgcgccgttgccaatggaggaactgcttcaccggaatacagggcggcaagtcccaggcttagaaggcctaaatcgccaaaacttcctaaagccgtgcccggcggcagtcccaagtctcctgccaacggcgctgtgactctgccagctcctccacctcccccggtgctcaggccaccaaggaccccgaacgcacccgctccttgtacgcctgaagaggacctgaccggcctgacagctagtcctgtccctagccctacagctaacggtttagcagcaaacaacgactcaccagggtcgggatctcagtccggtaggaaagcgaaagaccctgagcgaggcctgttccccgggcctcagaagagcagctccgagcagaaactacccttacagaggttaccttcacaagagaatgagctgttagagaaccccagcgtggtgctgagtacaaattccccggccgcccttaaggttggcaagcagcagatcatccccaaatccctggcgtctgagatcaaaatctctaagtctaataaccaaaatgtggaaccgcacaagcggctgctgaaggtacggagtatggttgaagggttgggcggcccccttggccatgcgggggaagagtccgaagtagacaatgatgtagacagtccaggaagtctgagaaggggacttaggtctacctcttaccggcgggccgtcgtttctggcttcgactttgattctcctacgagctccaagaagaaaaatcggatgtcccaaccggttttaaaggtagtgatggaggacaaggagaagttctcatcacttggtcgaatcaagaagaagatgttaaaaggccagggcacctttgatggagaagagaacgccgtcctctatcagaattacaaagagaaagccctagatatcgacagcgacgaggaatccgaacccaaagaacagaaaagtgacgagaagattgtcatacatcacaaacctctgcggagcacttggtcgcagctcagcgccgtgaagcgtaaggtgatcttgatcgttggcttcatggagatgaaagacggacgactgcgcggcggaaaatag

SEQ ID NO: 50634 - DNA, 2376 bp, Artificial Sequence
  Description of Artificial Sequence: Synthetic coding sequence
atggacggcgagagcgaggtggacttcagcagcaacagcatcaccccactttggcgtagacgctctatcccccaaccgcatcaagtcctgggccgttctaagcctcggccccagtcctatcagagccccaacggcctgttaatcactgatttcccggtggaggatggcgggactttgctagcagcccagatccctgcacaggtgccaacagcgtctgactctagaacggtacatagatctcccctcctcctcggagctcagcgacgcgctgttgctaatggggggacagcttcccctgagtatcgagcagcatctcctcgtctgaggcgcccaaagtcccctaagttacccaaggcggttcccggcggcagtcccaaatcccctgccaatggtgcggttaccctcccagctcccccaccacctccggttctcagaccccctcggacccctaacgcgcccgcaccttgtacgccagaggaagacctcacaggtctgacggcttccccggtgccttcccctactgctaacggactcgccgcaaacaacgattcgccggggagtggcagccaatctggacggaaagccaaagatccagagagggggcttttccccggtccacagaagtcaagctctgaacagaagctgccactccagagactgcctagccaagaaaatgagctcctcgagaacccaagcgtggtcctctcaaccaattctcccgcagctctgaaggtggggaaacagcaaataattccgaagagtctggcatctgagataaagatttccaaatccaacaaccagaacgtggagcctcataaaaggctgctgaaggtgcgaagcatggttgagggacttggaggcccactcggtcatgcaggcgaagaatcagaagtagacaacgatgtggacagccctggtagcctacggcgtgggctgagatctacgtcttacagacgcgctgtggtgagcgggttcgatttcgatagcccgacatcatccaagaagaagaacagaatgtctcagcccgtgctcaaggtagtcatggaagataaagagaagttttcatctctaggacgcatcaagaagaagatgcttaaaggacagggtacctttgatggtgaggagaacgccgtgttgtaccaaaattataaggagaaagcgcttgatattgattccgacgaagagagtgaaccaaaggaacagaagtctgacgagaaaatagtcatccatcataagcccctccggagcacctggtcacagctgtcagctgtcaagcggaagggcctctctcagacggtgagccaggaggagaggaaaagacaggaggccattttcgaagttatcagcagtgaacactcttacctgttgtcgcttgaaattctgattcggatgtttaagaatagtaaagaactctcagacacaatgaccaaaacagagcggcaccacttattttctaacattaccgatgtgtgcgaagcctcaaaaaagtttttcatcgagctggaggcccgccaccagaataacatattcattgacgatatctccgacatcgttgagaaacatacggcctccaccttcgacccatatgtgaagtattgcactaacgaagtttaccaacaacgcaccctgcaaaagttattagccacgaacccttcttttaaggaagttttgtcacggatagagagtcatgaggactgccgtaatctgcccatgatttcattcttaatcttacccatgcagagagtcactcggctgcctcttcttatggatacgatatgccagaagacacctaaagattcccccaagtacgaggtatgtaagcgagccctgaaagaggtgagcaaactggttcgcctgtgcaacgagggtgctcggaagatggagcggacagaaatgatgtataccatcaactctcaactcgaattcaagatcaagcctttccctctggtcagtagctctcgatggctagtgaaaaggggcgagctgacagcttacgttgaagacaccgtcctcttctctcggaggacatccaagcagcaagtttattttttcctctttaatgacgtcctgataataacgaaaaagaagagtgaagaatcctataacgtcaatgattattccttgcgagaccagctgctggtcgagagttgcgacaatgaagagctcaactctagtccaggcaaaaacagctcaaccatgttatactctcgacagtcgtcggcatctcacctgtttaccctcactgtattatcgaatcatgcgaacgagaaggtggagatgctgcttggtgccgaaacgcaaagcgagcgagccaggtggattaccgccctggggcatagtagtgggaagcctcctgctgaccgaacctgcggatag

SEQ ID NO: 50635 - DNA, 2613 bp, Artificial Sequence
  Description of Artificial Sequence: Synthetic coding sequence
atggagaagaccaagaccaagcagggcgagaacgagcacatgcccgtgaacaacccatccacccaaatctaccaattacaggctctggcctccgagttaaagacaggattcactgaggccatgcaggaactgagccgaatccaacacggcgagtacgctctggaagagaaggtgaagtcctgtaggtgctcgatggaggagaaggtgaccgagatgaaaaactctctgaactactttaaagaagaactgagtaacgccatgtctatgatacaggcaattacgtctaagcaggaggagatgcagcagaaaattgaacaacttcaacaggaaaagaggagagagtcgcgcaaggtgaaagctaagaagacccaaaaagaagaacattcaagccaggccggacccgcccaggctcaaggttcccctttcaggagtatcaatattccagaacccgtgctgccttctgaagatttcactaatctgctgccctcccaggcttatgagaaggcccaagaatcccggtcagtccatgtgggcgattccaacgtcaaagggatgatgggaccaggagtgaaccctacaaccccagaggccgaggagaacctgaaaagttgtctgtctgccgatatccaaagcaaaggccacctcccctcaggcatgtggagacagcccaaggatggcaaagaatggggcgaggagtacgtgaccaaggatcacccagataaattgaaggaagccgggcagggacgccattcctccctggaaaatgtactctgcgaaacaagtctggctgcgaagcgacaaaccgtagccctggagcttcttgagtccgagcgcaagtatgtcattaatatcagcctgattctgaagattaaagctaccttccagggttctgatggcaaacggaatagcaaggagcgctccttatttcctgggtcccttagatatctcgtacagcaacacctcgatctgttgcacgcacttcaggagcgggtcctgaaatggccaagacagggcgtgctgggtgacctattccttaagctcacaaacgatgagaataacttcctggactattatgtcgcgtacctccgcgatctgccagagtgtatctccttggtacacgtcgtggtcctgaaagagggagacgaggagattaagagtgacatatatacactcttttttcacattgtgcaaagaattccagagtatctgatccacctccagaatgtgctgaaatttacggagcaggagcacccagattattacctactgttagtctgtgttcaaaggctgcgggtctttatcagtcactacactcttctgtttcagtgcaatgaagacctgctaattcagaagcgcaaaaaactgaagaagtcttccatggcaaagctgtataaagggctcgcctcccaatgcgccaacgccgggcaggacgccagcccaactgctggccctgaggccgtacgagatactggcattcatagcgaggaactgcttcagccgtatccttctgcaccttcatccggacctgctataacccatctgatgccacccgtcaagaagagtcagcagcagcagagccttatggaatctatgcaaccgggcaagccatccgattgggaactagaaggacgcaaacacgaacgcccagaaagcctgctggcccctactcaattttgtgccgccgagcaggacgtcaaggccctggcaggcccacttcaggcaatccccgagatggacttcgaaagctcacccgcagagccacttggaaacgttgaaaggtccctgagggcgcctgcagaactgctcccggacgctcggggtttcgtcccagctgcctacgaagaatttgaatatggcggtgagatctttgcactgccggctccatacgacgaggaaccgttccaggctccagctttgtttgaaaattgttctcccgcgagctcggagtcatctctggacatatgcttcctgaggccagtaagctttgccatggaagcagaacggcccgagcaccccctgcaaccactgcccaaatcagctacaagtcctgcgggtagctcctctgcctataagctggaggcggcagcacaagcccacggtaaagctaagcccctgagcagatctctcaaagaatttccccgggcgcccccagcagatggcgttgccccacgactgtattcgaccaggtccagttccggaggacgcgcccctatcaaagcagagcgggccgctcaagcacacggacctgccgctgcagctgtcgctgcgcggggagcaagtcggaccttctttccacagcagcggagccagtctgagaaacaaacatatctcgaagtgaggagggagatgcacctagaggatactaccaggttctgtccaaaggaagaaagggagagtgagcagacctcattctctgatcaaaatcctcggcaggatcagaagggtgggttccggagctcctttcgtaagctattcaagaaaaagtcaagtggaagcgaatacagggagaagacaaatgaaaatccaagtatggatccatcacccactaagcaggatttttttcgtaaccgcctggcgctggcgaatgatttggaccaggggactgcagtctag

SEQ ID NO: 50636 - DNA, 2535 bp, Artificial Sequence
  Description of Artificial Sequence: Synthetic coding sequence
atggagaagaccaagaccaagcagggcgagaacgagcacatgcccgttaataacccttcaactcagatatatcaattacaggctctagctagtgaactgaagaccggattcacagaagctatgcaggagcttagtaggattcagcacggagagtacgccttggaagagaaggtgaagagctgccgctgttccatggaggaaaaggtgaccgagatgaagaactccctgaactacttcaaggaggagctctccaatgcaatgagtatgatccaggctatcactagcaaacaagaggagatgcaacagaagatcgagcagcttcagcaggagaagaggcgcgaatcaagaaaggtgaaagcgaaaaaaactcagaaggaggagcattccagtcaggcaggacccgcccaggctcagggcagccctttcaggagcataaacattcccgagcctgtgttaccgagtgaagacttcacaaatctgttaccatcacaagcctacgagaaggctcaagaatcaaggtccgtccacgtaggtgattcaaatgtcaaggggatgatgggacccggggtgaacccgaccaccccagaggctgaagaaaacctaaagagttgcttgagtgctgatatccagtctaaagggcatctcccgtcagggatgtggagacagccaaaggatggcaaagaatggggtgaggaatatgtgacaaaggaccatccagataagctgaaggaagccggccaggggcgacactcctccctcgaaaatgtgctgtgtgagacatcgctggcagctaaaaggcagaccgtggcactggagctcttagaatctgagcggaagtatgtcataaacataagtttaatcttaaagattaaggctaccttccagggaagcgacggcaagcggaatagcaaagagcggtctttgtttcccgggtccctgagataccttgttcagcagcatcttgatttgctgcacgccctacaggagcgcgtcctgaagtggccgcggcagggcgtgcttggggatctgttcttaaagctgactaatgatgagaataattttctcgattattatgtggcttacttgcgcgatttacccgaatgtatcagcctggtgcacgtcgtagttctgaaggaaggagatgaggaaatcaaatctgatatttacacactgtttttccacatcgtccagcgcatcccagaatacctaatccacctgcagaacgtcttgaagttcacagagcaagaacaccccgactactacctgctcctagtgtgcgttcagagactcagagtgttcatctctcattacacacttctctttcagtgcaacgaggacttgctgatccagaagcgaaaaaaactcaagaagtcttctatggccaagctgtacaagggcttagctagtcagtgtgcaaacgccggacaggatgcctctccaacggcagggccagaagcggtaagggacacgggaatccacagcgaggagttgcttcagccatacccaagcgctccaagctccggaccagcaatcactcacctaatgcccccagtcaagaagtcccagcagcagcagtcattgatggagtccatgcaacccggaaagccatctgactgggaactggagggacgcaagcatgagcgacctgagtctctgctggccccaacacaattttgtgctgccgaacaagatgttaaagccttagcggggccgcttcaggccatccccgagatggactttgagtcaagtcccgctgaaccgctggggaatgtcgaacgaagtctccgcgctcccgcagagctcctgccggatgcccgaggttttgtgccagcggcatacgaggagttcgagtatggcggtgaaatctttgctcttcccgctccctacgacgaggagccttttcaggctcccgccctgttcgaaaactgcagcccagcttctagtgagagctcgctggacatctgttttttacggccagtgtcatttgccatggaggcagaacggcctgaacacccactccagccactgcctaagtcagcaacgtcccctgcagggtccagctctgcctataaactggaagccgcagcgcaagcacacggcaaggctaagcccttaagcaggagtcttaaggaattcccacgcgcccccccagctgatggcgtggcaccacgcttgtactcgacaaggtcttcctccggtggccgcgctccgatcaaagctgagcgggcagcccaggctcacgggcccgctgccgctgcagttgctgcgaggggagctagtcggactttcttcccacagcaaagaagccagagcgaaaaacagacatatcttgaggtgcggcgggagatgcaccttgaggacacaacccgattttgtccgaaggaggaacgggagagtgagcagactagcttctctgaccagaacccacgccaagatcagaaggggggcttccggtcatcctttcgaaagttgtttaaaaagaagaatgggaatgctacaggtgaagatttctgtggaccctggggttggtggtag

SEQ ID NO: 50637 - DNA, 2613 bp, Artificial Sequence
  Description of Artificial Sequence: Synthetic coding sequence
atggagaagaccaagaccaagcagggcgagaacgagcacatgcccgtgaacaatccctccacccagatttaccaactgcaggccctagcatccgaactcaagacaggattcactgaggccatgcaggagttgtcgcgcatccagcacggggaatatgccttggaggaaaaggtaaagtcatgtcgatgctccatggaagagaaagttacggagatgaagaactcgctcaattacttcaaagaagaactgtcaaatgctatgtcaatgatccaagcaatcacatccaaacaggaagagatgcagcagaagatcgagcaactgcagcaggagaagcggagagaatcgagaaaggtgaaggctaagaaaacccagaaagaggaacactcttcccaggcaggacccgcccaggcacagggctctcctttccgttctatcaacattccagagcctgtgctgccttccgaagactttacaaatctcctgccctcacaggcctacgaaaaggctcaagagtccaggtccgtgcacgtcggcgactcaaacgtgaaggggatgatgggtcccggtgtgaatcccacaacacccgaagccgaagagaatctgaagagttgcctgtccgctgacatacagagtaagggacatttgccttccggcatgtggcgtcagcccaaggacggcaaggagtggggagaagagtacgtgacaaaggaccatccggacaagctgaaggaagcgggtcaaggaaggcattcctccttggagaatgtgctctgtgagacatctcttgcggctaaacgccagacggtggctctcgagctgctagagagcgagcggaaatacgttatcaacatatcattgatattaaagatcaaggcaactttccagggctccgatgggaagcgcaattcaaaagaacgctcactgttccccggaagtctgcggtatctggtgcagcagcacctcgatctcctccacgctctccaggaaagagtcctgaagtggccccggcaaggtgtgctcggagacttgttccttaaactgaccaacgatgagaataactttctggactattacgtcgcatatttaagggacctaccggagtgcatttcccttgtgcacgtggtggttctgaaggaaggggacgaggagatcaagagcgatatctacaccctgttcttccacattgtgcagagaatcccggaatacctgatccaccttcagaacgtgctaaagttcaccgagcaggagcatcccgattactatcttctgttggtgtgtgtgcagcgtctaagagtgttcatcagccactacaccctcctgtttcaatgtaacgaagaccttctgatacagaaacggaaaaaactgaaaaaatcaagcatggctaagctatataaaggtctcgccagccagtgtgcgaatgccgggcaggacgccagtcccactgctggcccggaggcagtgcgcgataccggaattcattcagaagagctgctgcagccctatccatccgccccatcctccgggcccgcaattacacacctgatgcctccagtgaaaaaatcccagcagcagcaatctctgatggagagtatgcagcccggcaaaccaagtgactgggaattagagggccggaagcatgagagaccggagagcctactcgccccaactcaattctgtgctgcggagcaagacgtgaaggcactagctggccccttacaggccattccagaaatggactttgagtcaagtcctgccgagccattggggaacgtggaacgctccctacgcgctccagctgagcttctgcctgatgctagagggttcgtccctgctgcttatgaagaattcgaatatggcggggaaattttcgcgctcccggccccatatgatgaggagccattccaggccccagcactgttcgaaaactgcagcccagcctccagtgaatcctcgctggacatctgcttccttcgcccggtctccttcgcaatggaggccgaacggcctgagcatcccctgcagccgctccctaagtctgcaacctcaccagcaggcagttcttctgcttataaactggaggccgccgcccaggcacacggaaaggcaaagccactcagccgctcactgaaggaatttcccagagccccaccggcggacggggtcgcgcctagactctatagcactaggtcgagctccggaggaagagccccgatcaaggccgaacgagcagcacaggcacatgggcctgcggccgcagccgtggcggccaggggggcatcaagaactttctttccccagcagcgtagccagagcgaaaaacagacctacctagaggttaggagggagatgcatctcgaagatactacccgcttttgtccgaaggaggaaagagagagtgaacagactagcttctcggatcagaatccgaggcaagatcagaagggaggctttcgctcctcattcagaaagctgtttaaaaagaagtctagcgggagcgaatatcgcgaaaagacgaacgagaaccccagtatggaccctagccccaccaagcaagatttcttccgaaatcgcctcgctttagcaaacgatttggaccaggggactgcagtctag

SEQ ID NO: 50638 - DNA, 1455 bp, Artificial Sequence
  Description of Artificial Sequence: Synthetic coding sequence
atggaggccgaggaggcccagcacggcgccagcccccccatcagcgccatcgaggagttcagcattatcccagaggccccaatgcgaagtagtcaggtcagcgcgctgggtctggaagcacaggaggatgaagaccctagctacaaatggagagaagagcacagactgagtgccacccagcaatctgagctccgcgatgtgtgcgactacgcaatcgaaactatgccgtcctttccaaaggaaggtagtgccgacgtcgagcctaaccaagaatccctggtggccgaagcctgcgatacacctgaacattgggaggcggtgcctcaatccctcgccgggagacaggcccgaactctggcgccacctgagttgtgggcatgtcctatccagtccgagcacctggacatggccccattttcatcagacctggggtctgaggaggaggaagtcgaattctggccagggcttacctctctgactttgggaagcggccaggcggaggaggaggaggagacttcctctgataatagcggccaaacccggtattactcaccgtgcgaggagcatccggccgaaaccaaccagaacgagggggctgagagcgggaccatccgacaaggggaagagctgccgtccgaagaactgcaggagtcacaaggcctgctacacccgcaggaggtgcaagtactggaggaacaaggccagcaggaagcaggctttcggggcgaagggactctgcgggaggatgtgtgtgccgatgggctgctgggggaggagcagatgatcgagcaggtaaatgatgaaaagggcgaacagaaacagaagcaagagcaggtccaagatgtaatgttggggcggcaaggtgaacgcatgggcctgaccggggagccagagggcctcaatgacggcgagtgggagcaggaggatatggaacggaaggcccagggacagggtggtcccgagcagggcgaggaacgaaaaagggagctgcaggtgcccgaggaaaacagggcagactctcaggacgagaaatcccagaccttcttgggtaaaagcgaagaagtgacagggaaacaggaggaccacggaattaaagagaagggggtccccgtgagtgggcaggaggccaaggagcctgaatcctgggacggagggcggctgggtgctgtgggacgcgccagatcgcgggaggaagaaaacgagcaccatggccccagcatgcctgctctaatcgcaccggaggatagccctcactgtgacttgttcccaggtgctagttacctggtgactcaaatcccaggaacccaaacggaaagtagggccgaagagcttagccctgcagctctatcaccactattagagcccattaggtgcagtcaccaacctattagcctcctgggatccttcttgaccgaggaatcacccgataaggagaagctcttgagtgtgctgtag

SEQ ID NO: 50639 - DNA, 1455 bp, Artificial Sequence
  Description of Artificial Sequence: Synthetic coding sequence
atggaggccgaggaggcccagcacggcgccagcccccccatcagcgccatcgaggagttttctataataccggaggcgcctatgaggtcctctcaggtgtcagcgctgggacttgaagctcaggaggatgaagacccttcctacaagtggcgcgaggaacatcggctgtccgctacacagcagtcggaactgcgggatgtgtgcgattatgccatcgaaaccatgccaagcttccccaaagagggtagcgccgacgttgaacccaatcaagagtctttggtggcagaggcgtgtgataccccagaacactgggaggcagtgccacagagtctggcgggccgacaggctcgcaccttggccccaccagaactgtgggcttgtcctatacaaagtgagcacctcgacatggctccattctcaagcgacctgggttccgaggaagaggaggtggagttctggcctggcctgacttccctgacactgggtagtggccaggcggaggaggaggaggagactagtagtgacaattcaggccagacccgatactattctccatgcgaagagcatcccgccgagaccaatcaaaacgagggtgccgagagtggcaccatacgccaaggagaggagttaccttcagaagagcttcaggaatctcagggactcttacacccccaggaagtgcaggttctggaggagcagggccagcaggaagcaggattccggggcgaaggaaccctgcgggaagacgtatgcgctgacggcctgcttggtgaagagcagatgatagaacaggtgaatgatgagaaaggtgagcagaagcagaaacaagaacaggtgcaggacgtcatgcttggcaggcaaggagagcggatgggcctgacaggagaacccgagggtcttaatgacggggagtgggagcaggaggacatggagagaaaggctcagggccaagggggccctgagcagggcgaggaaagaaagagggaacttcaagtgcctgaagagaaccgggctgatagccaggacgagaagtcccaaacatttctgggtaaatcggaggaggtcacaggcaagcaagaagatcacggcattaaagagaagggagtgccggtcagcggccaggaggcaaaagaacccgagtcatgggacggcgggcgtttgggggccgtcgggagagctagatctcgtgaggaggaaaacgagcatcatggcccatccatgcccgccctcattgcacctgaggatagtcctcactgcgatctgtttccaggggcttcatatctggtgactcagatcccaggaacccaaacagagagccgcgccgaggaactgtcgcccgccgctctgtctcctcttctggaaccgatccggtgctcccatcagccgatatctctgcttggatcatttttgaccgaagaaagccccgacaaagagaaactgctgtcagtgctgtag

SEQ ID NO: 50640 - DNA, 672 bp, Artificial Sequence
  Description of Artificial Sequence: Synthetic coding sequence
atgctgggcgtgaccaccgtgcggagccggatgcggcgggccctggtcttcggaatggtcgttccatcagtgctcgtgccatggctgctcctgggagcctcctggctgatcccgcagacgtcatttttatccaatgtctgcgggctgtcgattggactggcctacgggcttacctattgttatagcatcgatctcagtgagcgcgtggctctcaagcttgaccaaacattccctttcagcctgatgcgacgaatttcagtatttaagtacgtgtcggggtcaagtgcagagcgccgggcagcccagagccgaaagctgaaccctgtgccagggtcataccctacccagagttgccaccctcatctgtcaccctcccaccccgtatcgcagacacagcacgcatcaggccagaaactggcgtcatggccatcatgcacgcccggccatatgcccacacttcctccctaccagccagcaagtgggctgtgttacgtacaaaaccatttcgggcctaaccccaccagctcaagtgtgtatcctgcaagcgcggggaccagtctgggcatccagccccccacacctgttaacagccctggcaccgtctactctggtgctctcggcaccccaggagccgctggtagtaaggagagctcacgtgtgcctatgccttag

SEQ ID NO: 50641 - DNA, 2013 bp, Artificial Sequence
  Description of Artificial Sequence: Synthetic coding sequence
atgatcctggaggagcggcccgacggcgccggcgccggcgaggagtctcctagactccagggctgtgactccctgacacagatccagtgcggtcaactacaatctcgccgcgcccagattcatcagcagattgataaggagcttcagatgagaacaggcgccgaaaacctatatcgcgcgacaagcaacaacagagttcgtgagaccgtcgccctggaactctcgtatgtcaactccaacttgcagctattgaaggaagagctggaggagcttagcgggggcgtggaccccgggcgccatggatcagaagccgtgacggtgcccatgattcccctgggtctgaaagagactaaggaactggattggagcacccccctcaaagagttgataagcgtgcatttcggggaagacggcgcttcttatgaggccgagatccgcgagctggaggctttaagacaggctatgcggacaccaagccgaaatgaatcgggcttggagctgctaaccgcatactacaaccagctgtgcttcttggacgctcggtttctcactccagcacgaagtctgggactcttcttccactggtacgattctcttactggggttcctgctcagcagcgggcactggcattcgagaaaggtagtgtgctgtttaacataggcgcactgcatacgcagattggcgccaggcaagatcggagttgcactgaaggtgctcggcgcgcaatggaggcgtttcaacgtgccgctggggccttcagcctgctcagggagaatttttcccacgcacctagtcccgatatgagcgccgcgagcctttgcgcgttagagcagctcatgatggcccaagcgcaggaatgcgtattcgaggggttgagccctcctgcctcgatggcgcctcaggactgtcttgcccagctgagactcgcacaggaggctgcccaggtagctgctgaatataggctggtgcaccgcacaatggcccagccccctgtgcacgattacgtgccagtgtcatggacggcattagtgcacgtgaaagccgagtatttccgttctctagcacattaccatgtcgccatggcgttatgcgatggctctcctgcgacagaaggcgaactgcctacacacgaacaggtgttcctgcagcccccgaccagtagcaagcccaggggaccggtactgccccaagagttggaggagaggcgtcagcttggcaaagcgcacctcaaaagggccatactcggacaggaggaggcactccgactgcatgcattatgccgagtgctccgggaagtcgacctactgagggcagtgatcagtcagaccctgcagcgctccctggcaaagtatgccgaactggaccgcgaagacgacttttgtgaggccgccgaagcccccgacattcagcctaagacacatcagaaaccagaggcccggatgcctaggctcagccaaggcaaaggcccagacatcttccaccggctcgggcctttatcagtcttcagcgccaagaaccggtggagactggtgggtcctgtgcatcttacccgcggcgagggcggctttggtctgacgctacgcggtgatagtcctgtgctcatcgccgctgtgatccccggctcccaggccgctgccgctggcctcaaggagggcgactacatagtctctgtgaacggtcagccctgtaggtggtggcgccacgccgaagttgtcaccgaactgaaagctgccggagaagcaggtgcctcacttcaggtcgtgtcattgctcccaagcagtcgcctgccatcactcggcgaccgacggccggtccttctgggtcccagaggtttattgcgatcccagcgggagcacggatgcaaaactccagcctcaacttgggcatcaccgagacctctgctcaactggtccaggaaggcgcagcaggggaagacagggggatgcccccagccatgtgctcccgtgaaaccagcccccccgtctagcctaaaacatccaggctggccgtag

SEQ ID NO: 50642 - DNA, 546 bp, Artificial Sequence
  Description of Artificial Sequence: Synthetic coding sequence
atgtacaacatcaagcagagcaccgacaccaaggaggccgccgccattgaggcccgcagaaatcgcgagaaagaaaggcaaaacagatttttcaacgtgcgcaaccgggtcatgggggtggacgttcaggctctgaacaaccaggtcggagatagaaagaggagggaggccgccgagcgttcgaaagaggccgcgtacggcacttcgcaggtccagtacgacgtggtggtgcagatgctggaaaaggaagaggccgatcggacccgccagctcgccaaaaaggtgcaagagtttcgagaacagaaacaacaactgaagaacggtagagaattcagcttatgggaccccggacaggtgtggaaaggattgccaacatatctgagttactctaacacatatcctggacccgcttcattacagtattttagcggagaagacctcgatagggacacaagattgcggatgcaacagggacagtttaggtacaaccttgaacgccaacaacaagaacagcagcaggcaaaggtggacgaaaattacacgtag

SEQ ID NO: 50643 - DNA, 1140 bp, Artificial Sequence
  Description of Artificial Sequence: Synthetic coding sequence
atgtacaacatcaagcagagcaccgacaccaaggaggccgccgccattgaagcaagacgaaatcgcgagaaagaaagacagaacagatttttcaatgtaagaaaccgggttatgggtgtcgatgtccaagcattaaataatcaggtgggtgaccgcaaaaggagagaggcagccgaacggtcaaaggaggccgcttacggcacatctcaggtgcagtacgacgtcgtggtgcagatgcttgagaaagaggaagcagaccggactcggcagttagccaagaaggtgcaggaattccgcgagcagaagcagcagcttaagaatggcagggaatttagcttgtgggaccctggccaggtatggaaaggtctgcccacttatctgtcctactccaacacataccctggccctgcaagtttgcagtacttttctggcgaagatctggaccgagatacaaggttgagaatgcaacaaggccagtttagatacaaccttgagagacagcagcaagagcagcaacaagccaaagtggatgaaaattacacggatgctctcagtaaccagttgcggttggcgatggatgcccaagctacacatctggcacgcctggaagaaagctgtcgtgcagccatgatgtgcgccatggccaacgccaataaggctcaagcggccgtccaggcaggacgacaacggtgcgagagacaaagagagcagaaggcaaacttggctgagatacagcaccagtccaccagtgacctgctgaccgaaaacccacaggtcgcccagcatcctatggccccgtaccgggtgctaccctactgctggaagggaatgacacccgaacaacaggctgctatcaggaaggagcaggaagtgcaaagaagtaagaaacaagcccacagacaggccgagaaaacactggataccgagtggaagagtcaaaccatgtcgtcggcacaggcagtgctggagctcgaggagcaggaacgagagctgtgcgcagtattccagcgtggattagggagcttcaaccagcagctggccaacgaacagaaagctcaacaggactacctgaatagcgtgatctacaccaatcaaccaacagcccagtatcaccaacaatttaacacaagcagccgctag

SEQ ID NO: 50644 - DNA, 717 bp, Artificial Sequence
  Description of Artificial Sequence: Synthetic coding sequence
atgtacaacatcaagcagagcaccgacaccaaggaggccgccgccatcgaagcgagaaggaaccgggaaaaagagagacagaatcgattcttcaatgttaggaaccgggtgatgggagttgatgtacaggctctgaataaccaggtcggggacaggaaaagacgagaggccgccgagcgttctaaagaagccgcttacgatgccttgtctaatcagcttagactggctatggacgcccaggcgacacatttggctcgcctggaggagtcatgtcgggcagctatgatgtgtgccatggccaacgcgaataaggcccaggctgccgtgcaggctgggagacagcggtgtgagcgacagcgcgaacagaaagcaaatctggctgagatccaacatcagagcacttctgacttgctgactgagaatccacaggtggctcaacatccaatggcgccgtaccgggttctgccatactgttggaagggtatgacaccagaacagcaggccgccattcggaaggagcaggaggtgcaaaggagcaagaagcaggcccaccgccaggcggagaaaaccctcgacacagagtggaaatcacaaaccatgtctagtgcccaggccgttcttgagttggaggagcaggagagagagctatgtgctgtgttccagaggggactgggcagctttaaccaacaactcgcaaatgaacaaaaggcacagtag

SEQ ID NO: 50645 - DNA, 579 bp, Artificial Sequence
  Description of Artificial Sequence: Synthetic coding sequence
atgtacaacatcaagcagagcaccgacaccaaggaggccgccgccattgaggcccgtcggaaccgggaaaaagagcgtcagaatcgattttttaacgttaggaacagggtgatgggcgtggacgttcaggcactgaacaatcaggtcggtgaccgaaaacgacgggaagccgccgagcgcagcaaagaagccgcctacggcacttcccaggttcagtacgacgtggtcgttcaaatgctcgaaaaagaagaggcggacagaacccgccagctcgccaagaaagtgcaggagtttagggagcagaaacagcagctcaagaatggtcgagagttttctctgtgggatcccggtcaggtgtggaaggggctccccacctatctgagctattcaaatacttaccccgggcccgccagcctccaatacttctctggagaggatctggaccgggatacccggctccggatgcagcagggccaattcagatacaacctcgaacgacagcagcaagaacagcagcaggctaaggtcgatgaaaactataccggtaaacagcccggcccaccagattccgaaacatag

SEQ ID NO: 50646 - DNA, 930 bp, Artificial Sequence
  Description of Artificial Sequence: Synthetic coding sequence
atgcggcagaacgacaagatcatgtgcatcctggagaaccggaagaagagggatagaaagaacttgtgcagagctataaatgatttccagcagtcatttcaaaagcctgaaaccagaagagaatttgatctctccgacccgctcgcgctcaagaaggacctccccgctcgccagtcagacaatgatgtgcggaatactatcagtggtatgcagaagttcatgggtgaagacctgaactttcacgagaggaagaagttccaggaagaacagaatcgagagtggtcactccagcagcaacgggaatggaagaatgcgcgggctgagcagaaatgtgctgaggcgctctacacagagaccagactacagtttgacgaaacagccaagcacctgcagaagctggagagcacgacacgaaaggcggtatgtgccagtgtgaaggactttaacaagtcgcaggccattgagtccgttgagcgtaagaaacaagaaaaaaagcaagagcaggaggacaaccttgcagaaatcactaacttgctccgcggcgacctactgtctgagaatccccagcaggcagcctcttcctttggcccacaccgcgtggttcccgatcgatggaagggtatgacgcaagaacagctcgagcaaatcaggcttgttcagaagcaacagatacaagagaagctgagactccaagaggagaaacggcagcgtgacttagattgggaccggcggcgtattcagggtgctcgcgccacactcttatttgagcgccagcagtggcgccgccaacgcgatctcagaagggccttggacagctcaaacttgtcattggcaaaagagcagcaccttcagaagaagtacatgaatgaagtgtacactaatcagcccaccggcgattatttcacgcagttcaacacaggctcacgctag

SEQ ID NO: 50647 - DNA, 1134 bp, Artificial Sequence
  Description of Artificial Sequence: Synthetic coding sequence
atggccgtggccctgccccgggacctgcggcaggacgccaacctggctaagaggcgccatgccgagctctgccgtcaaaaaagggtctttaatgctcgcaacagaatcattggaggcgacaccgaggcctgggacgtccaagtacacgaccaaaagattaaggaggctaccgaaaaggcccggcacgaaaccctcgcagcagagatgcgacagaatgacaaaattatgtgcattcttgagaatagaaagaagagggaccgcaaaaatctgtgtcgcgcgattaatgattttcagcaatccttccaaaaaccggaaacaaggcgcgagttcgatttgagcgacccactcgcattaaagaaggacttgccagctcgtcagagcgataatgacgtgcggaatacaatctccggtatgcaaaagttcatgggcgaagaccttaactttcacgagcgcaaaaagttccaagaggaacaaaatcgggaatggtcgttgcagcagcagagagagtggaaaaatgcacgtgcggagcagaaatgtgccgaagctctttacacggagacaagattgcaattcgacgagaccgctaagcatctacaaaaattggaaagcacgactcgtaaagcagtctgcgcctcagttaaagattttaataagtctcaggctatcgagtcagtcgagcgaaagaaacaagaaaaaaagcaagagcaggaggataacctcgcggaaattacaaacctgcttagaggcgatcttttgtctgaaaacccacaacaggctgccagttcattcggcccacatagagtcgttcctgatcgctggaagggcatgacacaagaacaactcgagcaaatccggcttgtacagaaacaacaaatccaagaaaaactgcggctccaagaggaaaaacgacaaagagacctcgattgggatagaagacgcattcagggggctagagccactctgctgtttgagcggcagcagtggaggcggcagagggacctgaggcgggccctggactcatctaatctttccctggccaaagaacagcaccttcagaagaagtacatgaatgaagtgtatacgaaccagcccacaggcgactactttacccagttcaataccggtagcagatag

SEQ ID NO: 50648 - DNA, 432 bp, Artificial Sequence
  Description of Artificial Sequence: Synthetic coding sequence
atggagaccttccccctgctgctgctgagcctgggcctggtgctggctgaagcttcagagtccacgatgaagattatcaaggaggagtttaccgatgaggaaatgcagtacgacatggccaagtcgggacaagagaaacagacaatcgaaatcttgatgaaccccatactcttggtgaagaacaccagtctcagcatgagtaaggacgacatgagttccacgcttctcacatttcgcagcctccactataacgatcccaaaggtaattcatccgggaacgataaggaatgctgtaatgacatgacagtgtggaggaaggtcagtgaagctaacgggtcttgtaagtggagcaacaactttatcaggtcctcgactgaagttatgaggagggtgcatagggctcctagctgtaaattcgtgcagaacccctag

SEQ ID NO: 50649 - DNA, 555 bp, Artificial Sequence
  Description of Artificial Sequence: Synthetic coding sequence
atggtgcggtacagcctggaccccgagaaccccaccaagagctgcaagtcaaggggtagcaacctgagagtacacttcaagaatactagggaaacagcacaggcaattaagggaatgcacatcaggaaagcgaccaagtatctgaaggacgttactcttcagaagcagtgtgtcccctttaggcgctacaatggtggcgtgggcaggtgtgcacaggcaaagcaatggggatggacacaagggcgatggcccaagaagtcagcagaattccttttgcatatgctcaagaacgctgaatccaatgctgagttgaaaggactcgatgtcgattccctcgtgatcgagcacatccaggtcaataaagcccccaaaatgcgccgacgaacataccgcgcacacggaagaattaatccatacatgtcgtcaccttgccatattgaaatgatattgaccgagaaagagcagatagtgccaaagcccgaagaagaagtcgctcagaagaaaaaaatcagccagaaaaagctgaagaaacagaaacttatggcccgcgaatag

SEQ ID NO: 50650 - DNA, 441 bp, Artificial Sequence
  Description of Artificial Sequence: Synthetic coding sequence
atgcacatccggaaggccaccaagtacctgaaggacgtgaccctgcagaagcagtgcgtaccatttaggaggtacaatggaggcgtggggcgttgcgcccaggccaagcagtggggctggacacaaggccgctggccaaagaaatccgctgaatttctcctgcacatgcttaaaaacgccgagtccaacgctgagttaaaggggctggacgtggactccctagtcattgagcatatccaagtgaataaggctcctaagatgcgaagacgcacttaccgcgcgcacggacggatcaatccatacatgtccagtccttgtcatattgagatgatactcacggaaaaggaacaaatcgtgcctaaacccgaagaggaggtcgcccaaaaaaagaagatatcgcagaagaagctcaaaaaacagaagctgatggctcgggagtag

SEQ ID NO: 50651 - DNA, 525 bp, Artificial Sequence
  Description of Artificial Sequence: Synthetic coding sequence
atggtgcggtacagcctggaccccgagaaccccaccaagagctgcaagagcagagggagcaacctgcgcgtacacttcaaaaacaccagagaaaccgcacaggctatcaaggggatgcacatcaggaaggccacaaagtacttaaaggacgtgacgctgcagaagcagtgcgtgccttttcggcgctacaatggcggtgtcgggcggtgtgcccaggctaagcagtggggctggacgcagggccgttggcccaagaaaagcgcagagttcctgcttcacatgttgaagaatgccgaatcaaatgctgagctgaaagggctagacgttgattccttggtgatagaacacatccaagtgaacaaggctcccaagatgcgcagacgtacctacagagcacacggaagaatcaatccttatatgtcctcgccatgccatatagagatgattttaacagagaaggaacagatcgtccctaaacctgaagaggaggtagcccaaaaaaaaaaaatttcacagaaaaagtag

SEQ ID NO: 50652 - DNA, 585 bp, Artificial Sequence
  Description of Artificial Sequence: Synthetic coding sequence
atgcccgtggcccggagctgggtgtgccggaagacctacgtgaccccgagacggccctttgaaaagagccgcctggaccaggagttgaaactgatcggtgagtacgggcttcggaataagagggaagtgtggcgggtgaagtttactcttgccaagatccggaaggctgcgagggaactgctgactctcgatgagaaagacccgagacggttgttcgaaggaaatgcactgttgcggaggcttgtgaggatcggtgtgctggacgagggtaaaatgaagttagactacatccttggattgaaaatagaagatttcctggaacggagactacagacgcaggtgttcaagctagggctggccaagagtatccatcatgcaagggtactgatccggcagcgtcacataagagtgcgcaagcaagtggtcaatatccccagcttcatcgtgcggttggattcacagaagcacatcgacttttctctgcggagtccctacggtggagggaggccaggaagggttaagagaaagaacgccaagaaaggccagggaggagccggtgcgggggatgacgaggaagaagattag

SEQ ID NO: 50653 - DNA, 888 bp, Artificial Sequence
  Description of Artificial Sequence: Synthetic coding sequence
atgagcggcgccctggacgtgctgcagatgaaggaggaggacgtgctcaagtttctggccgctggcacccatctgggtgggacaaaccttgattttcagatggagcattacatctataagcggaagtcagacgggatatacattatcaacctgaaacggacatgggaaaagctcctgctcgcagcccgggctattgtggcaattgagaaccctgccgacgtaagtgttatctcgtctcgaaataccggccaacgggcagttctgaaatttgctgcagccacaggcgctactccaattgccggcagatttacccccgggactttcaccaaccagatccaagccgcattctgggagcctagattgttagtagtgaccgatccacgcgctgatcatcagcccctgaccgaagcttcatatgttaacctgcctaccatagctttatgcaacacagattccccactcaggtacgttgatatcgctatcccttgtaacaataagggcgcccactctgttggcctgatgtggtggatgctcgcccgagaagtgctgcgcatgaggggtaccataagtagagagcacccgtgggaggtcatgcccgatctttatttttatagagatcccgaagaaattgagaaggaggaacaggccgccgcagaaaaggcagtgacaaaggaggagtttcagggcgagtggactgccccatcgccggaatttacagcaacccagcctgaggtggccgattggagtgagggggtacaagtcccatccgtgcccatccagcagtttcccaccgaggattggagcgcacagcctgccaccgaagactggtctgccgccccaacggctcaggctaccgagtgggtcggggccaccacggactggtcctag

SEQ ID NO: 50654 - DNA, 843 bp, Artificial Sequence
  Description of Artificial Sequence: Synthetic coding sequence
atggtggcccggcggcggaagtgcgccgcccgggaccccgaggaccggattccatcccccctgggttatgctgctattccgatcaagtttagcgaaaagcagcaggcttcgcattacctgtatgtgagggcacatggggtccgacagggtactaagagtacgtggcctcagaaacgcactcttttcgttctgaacgttccaccgtactgcacagaggaatccctcagccgcctgctcagtacttgcggtctggttcagagcgtggagctgcaggagaaacctgacctggcagagagccccaaagaatctcgcagtaaattctttcacccaaagcccgttccaggatttcaggtggcatacgtggtgttccaaaagcctagcggtgtctctgccgccctggccctaaagggccctctactggtgtccactgaatcgcatcccgtgaagagcggaattcacaaatggatatcagactacgctgattctgtaccagacccagaggcactgagggtagaggttgacacttttatggaggcatacgatcaaaagatcgccgaggaggaggctaaagcaaaagaggaggaaggagttccggacgaagagggatgggttaaggttactcggcgcggccggcggccagtgctgcctcgtaccgaggcagcctcacttagggttctggagcgggagcggagaaagcgctctcgcaaagagctgctgaatttttacgcatggcaacacagggaatccaaaatggaacacctggcacagctgaggaagaaatttgaagaggataagcagcgaatcgaattgctcagggcacagcgtaaattccgcccatactag

SEQ ID NO: 50655 - DNA, 735 bp, Artificial Sequence
  Description of Artificial Sequence: Synthetic coding sequence
atggccgcccccagcgacggcttcaagccccgggagcggagcggcggcgagcaagctcaggattgggacgctctgcctcctaaaaggcctcgattgggtgccggcaataagatcggggggaggaggctcattgtggtgctggaaggcgcatccctggaaaccgtcaaagtgggtaaaacatatgaactccttaattgtgacaagcataagtcgatcttgttgaaaaatgggcgcgaccccggcgaagcccggccggacatcacacaccagtcgctcctgatgttgatggatagcccccttaatagagcaggattgctgcaagtatacatccacacgcaaaagaacgttctgattgaggtcaatcctcagacacggatccctcgcacattcgacagattctgcgggctaatggtccagctgctccacaagctcagcgtcagggcagctgatggacctcagaagctattaaaggtgattaaaaaccccgtgtccgaccatttccctgtcggctgcatgaaggtgggaacctccttttccatcccagttgtgtcagacgtgcgcgaactcgtaccgtcttccgatcccatcgttttcgtggtgggcgcatttgcccatgggaaagtttccgttgagtatacagaaaagatggtcagtatctccaattatcccctgagtgcagccctgacctgcgccaagctgacaaccgcctttgaggaagtgtggggggtgatctag

SEQ ID NO: 50656 - DNA, 474 bp, Artificial Sequence
  Description of Artificial Sequence: Synthetic coding sequence
atgaacctggacggcagcgcccaggaccccgagaagcgggagtacagtagcgtctgtgtggggagagaagacgacattaagaagtcagaacgaatgaccgcagtggtccacgacagggaggttgtgatcttttatcacaagggagaataccacgcaatggatattcgttgctaccattctggcggcccactgcacttgggtgacatcgaagatttcgacggaaggccgtgcatcgtctgtccatggcacaagtataaaattacactggccacaggagagggcctttaccagagcatcaaccccaaggatccctctgcgaagcccaaatggtgctctaagggtatcaagcagagaatccatacagtgactgtggataacggcaacatctacgtgacgctgtcaaatgagcctttcaagtgcgatagcgatttctacgccaccggggacttcaaggtgattaagtccagttcatag

SEQ ID NO: 50657 - DNA, 633 bp, Artificial Sequence
  Description of Artificial Sequence: Synthetic coding sequence
atgctgaagtgcttccggaactgcctgcggcccagcagcctgagcacactgccactccagtatggtatcctctttccaaagctgctggcttgtcttgtgcatctccattttggtcatttttcgagcgccgtgataagcgtgaccagtttttacctatccatgaacttggacggcagcgcccaggatcccgaaaagcgtgagtatagcagcgtttgtgtcggccgggaagacgacatcaaaaagagtgaacggatgacagcagtggtccacgaccgcgaagtagttattttttaccataagggggagtaccatgctatggacatcaggtgctatcattccggcgggccactgcatctcggggacatcgaggatttcgatggacggccgtgcattgtctgcccctggcacaaatataagataactttggccactggagaaggcctgtatcagtcaataaaccctaaggacccatctgccaaaccgaagtggtgttcaaagggaataaagcagcgcatccacaccgtgaccgttgataatggcaatatctatgtgacactgtccaacgaaccttttaagtgtgacagtgacttttacgccaccggagattttaaagtgattaaatctagcagctag

SEQ ID NO: 50658 - DNA, 633 bp, Artificial Sequence
  Description of Artificial Sequence: Synthetic coding sequence
atgctgaagtgcttccggaactgcctgcggcccagcagcctgagcaccttgcccctgcagtatgggatcctttttcctaaactgctcgcgtgcctagtccacttacacttcggacatttttcctccgccgtgatatctgtcacctcattctatctgagtatgaatcttgatggtagcgctcaggaccctgaaaagagggaatacagtagcgtatgtgtgggacgcgaggacgatatcaagaagtccgaacggatgacagcggtggtacatgacagagaagtagtgattttttaccacaagggcgaatatcatgccatggacatccgctgttatcacagcggcggtccactgcacttgggagacatcgaggattttgacggtaggccttgtattgtgtgcccttggcacaaatataagatcacgctagcaaccggagaaggcttgtatcagtccatcaatcctaaagatccttccgcaaaacccaaatggtgttctaaaggcatcaagcagcggattcacacagtgacggtagataacgggaatatttacgtcaccctgtccaatgagccttttaaatgtgattcagacttctacgcaaccggggatttcaaggtgatcaaatcatcgtcatag

SEQ ID NO: 50659 - DNA, 357 bp, Artificial Sequence
  Description of Artificial Sequence: Synthetic coding sequence
atgaacctggacggcagcgcccaggaccccgagaagcgggagtactcctctgtatgtgtgggccgggaagatgatatcaagaagtccgagcggatgactgctgtcgttcatgaccgagaagttgtaatcttttaccacaaaggcgagtatcatgctatggacatcaggtgctaccattcagggggacccttgcatctaggcgacatcgaggatttcgacggtcgaccttgtattgtgtgtccgtggcataaatacaagatcacactggctacaggcgagggcctgtaccagtcgatcaatccaaaagacccatcagcgaagccgaaatggtgctctaaaggcattaaacaacggtag

SEQ ID NO: 50660 - DNA, 1032 bp, Artificial Sequence
  Description of Artificial Sequence: Synthetic coding sequence
atggccgagcagctgagccccggcaaggccgtggaccaggtgtgcacctttctgttcaaaaagcctggccgtaaaggtgccgcagggcgacgcaaacggcctgcctgcgaccctgagcccggcgagagcggctcgtcaagtgatgaggggtgtactgtcgtgcggccagaaaagaaaagggtcactcataaccccatgatacagaagacacgagattctgggaagcagaaagccgcctacggtgacttaagctctgaggaagaagaggagaatgagccagagtccctgggcgttgtttacaaaagtactaggagcgcgaagcccgtagggcctgaagatatgggggctacagctgtgtacgaactggacactgagaaagagagagatgctcaggccatttttgaaaggagtcaaaaaatccaggaggaactgagagggaaggaggacgataagatttacagagggatcaataactatcagaagtacatgaagcccaaggatacctccatgggcaatgcaagttccggcatggtaagaaaaggtccaatacgcgcccccgaacacctccgcgcaacggtaagatgggactaccaaccagatatctgtaaagactataaggaaaccgggttctgcggttttggggatagttgcaagttcctccatgaccgttccgactacaagcacggatggcagatagaaagagagctagacgaaggacgatatggcgtgtatgaggacgaaaattacgaagtaggctctgatgatgaggaaattccatttaagtgttttatttgccgacagtcattccagaaccccgtggtgactaaatgtcggcactatttttgcgaatcttgcgctcttcagcatttccgaacaacaccccgctgctatgtgtgtgatcagcagaccaacggtgtatttaatcccgcaaaggaactgatcgcaaaactggaaaagcaccgcgccacgggagaaggaggggcttctgatctgccggaagaccccgatgaggacgccatccccattacatag

SEQ ID NO: 50661 - DNA, 969 bp, Artificial Sequence
  Description of Artificial Sequence: Synthetic coding sequence
atggccgccccccccagccccggccggaccgccgaccaggccgaccaggtgtgcacttttctgttcaaaaagccaggccgaaagggtgctgccggcctccgtaagcgtccagcgtgtgaccccgaacatggagagtcgtcttcatccggggatgaaggggacaccgtcgcccagcccccccgtgttgcgccgcgccccaggggtttgcatagctggcagaaggctgctcatggagaccggagaggggaagaagctgctcctgagtccctggatgtcgtgtacagaagcacccggtctgccaagccagtgggaccggaagacatgggagccaccgcagatttcgagcaggacactgaaaaggagcatcatacacccacgatcctgaagtgctcacaacgcgtgcaggaggcactgaggggacgagaacatgaccacatatatagagggatacatagttatctgcggtaccttaaaccaaaggatacatcaatggggaactcctcgtcaggtatggcaagaaagggaccaattagggcacccgggcacctgagagcgaccgtgcgatgggattaccagccggacatctgtaaggattataaagaaactggcttttgcggctttggcgactcttgtaagtttctgcacgacaggagcgattacaagcttggttgggagatcgagcgagaactggaggaaggcaggtactgcatctgcgaggatgagaaccacgaagtgggatctgaggaagaagaaatcccgtttaggtgtttcatttgccgtcaggcatttcagaacccagtagtgacgaagtgtcgtcactacttttgtgaaagctgcgccctggagcattttagggccacccctagatgttacatatgtgaccaacctactggagggatttttaaccctgctaaggagctgatggcaaagttgcagaagttgcaagcagccgaaggtaaaaagagatag

SEQ ID NO: 50662 - DNA, 516 bp, Artificial Sequence
  Description of Artificial Sequence: Synthetic coding sequence
atgagcagcaagcggaccaagaccaagaccaagaagcggccccagagagctacctcaaatgtgtttgcgatgttcgatcagtctcagatacaggagttcaaggaagccttcaatatgattgaccagaaccgggacggattcattgacaaggaagacttgcacgatatgctcgcatcactgggtaaaaatcctactgatgaatacttggacgcaatgatgaatgaagcgcctggtcccatcaacttcacaatgtttttaaccatgtttggggagaagctcaatggaaccgatcctgaggatgtgattcgtaatgccttcgcatgctttgacgaagaagccacagggacgattcaagaggattatctgagggaacttttaacaacgatgggagaccggtttacagatgaggaagtcgatgagctgtatcgagaggcccccattgacaagaaagggaattttaactatattgaattcaccaggatcctcaaacatggcgccaaggacaaggatgactag

SEQ ID NO: 50663 - DNA, 936 bp, Artificial Sequence
  Description of Artificial Sequence: Synthetic coding sequence
atggccgaggccagcccccaccccggccggtacttctgccactgctgcagcgtcgaaattgttccacggttgcctgattacatttgtccaagatgtgagagcggattcatcgaggagctaccagaagagacccgctcaacagagaatgggtcagctccatccaccgcacctacagaccaatccaggccacccctagaacatgtcgatcaacatctcttcacacttccccagggctacggtcagtttgcctttggaattttcgacgactcatttgaaattcctacatttccacctggggcacaagccgatgatggaagagacccagagtctaggagggagagagaccatccatcccgtcaccgctacggggcacgtcagccgcgggcccgcctgacaaccagacgggccaccggccgccacgaaggggtgcctaccctcgagggaattatacagcagctggtgaacggcattattacgcctgccacaatcccatccctgggcccctggggcgtccttcatagcaatccaatggactacgcgtggggagcaaatgggctggacgccatcatcacccagctgttgaatcagttcgagaacactggccctccacccgccgataaggaaaaaatccaggcactgcccaccgttccagtcactgaggaacacgttggttccggactggagtgtccagtgtgtaaagatgattacgctctgggagaaagagtgcgacaactgccctgtaaccacctgttccacgatggatgtattgtgccctggctcgagcagcacgatagctgtcctgtctgcagaaagtccctcactgggcagaataccgcgactaatcccccaggactgacaggggtgtctttcagctcgtcttcaagctcaagctcttcgtccagtccctccaacgagaatgccactagcaatagttag

SEQ ID NO: 50664 - DNA, 984 bp, Artificial Sequence
  Description of Artificial Sequence: Synthetic coding sequence
atggccgaggccagcccccaccccggccggtacttctgccactgctgtagcgttgaaattgtgcctagactgcctgactatatttgccccaggtgtgaatccggctttatcgaggagctcccagaagaaaccagatcgaccgaaaacggtagcgcaccttcgaccgcgcccaccgaccagtccaggccccccctggagcatgtcgatcaacacttgtttactctcccccagggctatggacagttcgcctttggcatcttcgacgactcattcgaaatccctacatttccgccgggcgcccaagctgacgacgggcgtgaccctgaatctcggagggagagggaccacccatcacgacatcgatacggagcgaggcagcccagggctcggctcacaaccaggagagccaccggaagacatgagggagtgccaaccctcgaaggaattattcagcagcttgtgaacgggattattaccccagccactatcccaagcctgggtccatggggggtgctacactctaaccctatggactatgcctggggcgcaaatggactcgatgccataattacacagttactcaaccagtttgagaacacaggaccaccgccagctgacaaagaaaaaatccaggctctccctacagtgccagtgacagaggagcacgttgggtctgggttagaatgcccggtgtgtaaagacgactacgccttaggtgagagagtgaggcaattgccatgtaatcatctgttccacgatggctgcatcgtcccctggttggagcaacacgatagctgcccggtgtgtcggaaaagcctgacaggacaaaatacagctaccaatcctcccgggctcaccggcgtgtctttctctagtagcagttcttcctcatcctcaagctcccctagcaatgagaacgccaccacttggtcgcctttgggccgacctcagccaccccgtcccctgtcaaatctcacactgtag

SEQ ID NO: 50665 - DNA, 456 bp, Artificial Sequence
  Description of Artificial Sequence: Synthetic coding sequence
atggccgaggacctgagcgccgccaccagctacaccgaggacgacttctattgcccagtctgtcaggaagtcctcaaaaccccagtgcggactaccgcctgtcaacacgtgaacaggtctgagacctctacctccgacaataccgagacttatcaagagaatacatcatcttcaggacatcctacattcaagtgcccactttgtcaggaatccaactttactagacagcgcctccttgaccactgtaattccaaccacctgttccagatcgtgcctgttacctgtcccatctgtgtatccctgccctggggtgacccatcgcaaattacccgcaacttcgttagccatctgaaccaacggcaccagttcgattacggggaattcgttaacctgcaactcgatgaggagactcaatatcaaactgcagtcgaggaaagctttcaagtaaacatttag

SEQ ID NO: 50666 - DNA, 738 bp, Artificial Sequence
  Description of Artificial Sequence: Synthetic coding sequence
atggccgaggacctgagcgccgccaccagctacaccgaggacgacttttattgccctgtgtgtcaagaagtgctcaagacccccgtgagaacgactgcgtgtcagcacgtcttttgcaggaaatgctttcttacggctatgcgggaatcaggcgctcactgtcccctgtgtcggggaaatgttaccagaagagagcgagcttgtcccgagcgggcactagatttggagaatatcatgcgcaaatttagtggtagctgccgatgttgcgcaaagcagattaagttctacaggatgaggcaccactataagtcttgcaaaaagtaccaggatgaatatggcgtgagcagtataatccctaattttcagatctcgcaggatagtgtgggcaactctaacaggtccgagaccagcacatcagacaacacagagacttaccaagagaacactagttcgagtgggcatcctacattcaagtgccccttgtgccaggaatctaattttacaaggcagcgcctgctcgaccattgtaactccaatcatctgtttcagatagtgccagtgacctgtccaatctgcgtatccctcccgtggggagacccctcccagataaccagaaattttgttagtcacctgaaccagaggcatcaattcgactacggggagtttgtcaacttacagctagacgaggaaacacagtatcagactgcggtggaagaaagcttccaggtcaacatatag

SEQ ID NO: 50667 - DNA, 693 bp, Artificial Sequence
  Description of Artificial Sequence: Synthetic coding sequence
atgggccagcagatcagcgaccagacccagctggtgatcaacaagctcccggagaaggtcgcgaaacatgtcactctggttcgggagagcgggtcactgacatacgaagagttcttgggacgcgtggccgaacttaatgatgttacagccaaagttgcatccggacaggagaagcaccttctattcgaggttcagcctgggtccgacagctccgccttctggaaggtggtggtccgcgtggtgtgtacgaaaattaacaaatcaagcggaatcgtcgaagcctcacggatcatgaacctctatcagttcatacagttgtacaaggacattactagtcaggccgccggggtcctcgcccagtcgtcgaccagcgaggaacctgatgagaactcttcctctgtgacgtcttgtcaggcctcattgtggatggggagagtgaaacaacttacagacgaggaggagtgttgtatctgtatggatgggagggctgacctcattctgccatgtgctcatagtttttgccagaaatgtatcgataaatggtccgatcgccataggaattgtccaatctgcaggctccaaatgactggtgcgaatgaatcctgggtggttagcgacgcccccaccgaggatgatatggccaattacattctgaatatggcagacgaggcaggccaaccccatcgtccatag

SEQ ID NO: 50668 - DNA, 543 bp, Artificial Sequence
  Description of Artificial Sequence: Synthetic coding sequence
atgggccagcagatcagcgaccagacccagctggtgatcaacaagttgcctgaaaaggttgcaaaacacgttaccctagtgcgggaatcgggctctctgacctacgaggagtttctgggacgagtggcagaattgaacgatgtaacagcaaaagtggctagcggtcaggagaaacatttgttattcgaggtccagcccggaagcgattcctccgcattttggaaagtggtggtgcgggtcgtgtgtaccaagattaataaaagctcagggattgtggaggcctctaggatcatgaacttgtaccagttcattcaattgtacaaagacattacaagccaagccgctggggttctggcacagtcctccacctccgaggaaccggatgagaatagctctagcgtaacttcttgtcaggcttctctctggatgggaagggtaaagcaactgaccgacgaagaggagtgctgcatctgcatggacgggcgcgccgatctgattttgccttgtgctcactccttttgccagaaatgcattgacaagtag

SEQ ID NO: 50669 - DNA, 2040 bp, Artificial Sequence
  Description of Artificial Sequence: Synthetic coding sequence
atgggcgccctgaccagccggcagcacgccggcgtggaggaggtggacattccaagtaattctgtatatagataccctcctaagtctggctcctactttgcctcacactttattatgggaggcgagaagtttgactctacacaccccgagggatacctgtttggggagaattccgatctgaattttctgggcaatcgaccagttgtttttccctatgctgccccacccccacaggagcctgtcaagaccctccgcagcctggtgaatatccggaaggacacacttcgcctggtaaagtgtgcagaagaggtcaagtctcccggggaggaggcctccaaagctaaagttcactataacgtggaatttacttttgacactgacgctagggtagcgattacgatttactaccaggctacagaggagttccagaacggtatcgcaagttatattccgaaagacaatagcttacagtcggaaaccgttcagtacaagcgcggcgtatgccagcagttctgtctgccttcacacacggtggaccccagcgagtgggccgaggaggagctcggatttgacctagatcgcgaagtctaccctctggtcgtacacgctgtcgtagatgaaggagatgagtattttggacattgtcacgtactccttgggacctttgagaaacacactgatggcactttttgcgttaaaccgcttaaacaaaaacaagtggtagacggcgtctcttacttactccaggagatctatggcattgagaataaatataacacacaggacagcaaggtggctgaggacgaggtgagtgacaacagcgccgaatgcgtagtgtgtctgagcgacgtacgggacactctgatattgccgtgtcggcatctttgcctttgtaacacgtgtgccgataccctccgctaccaggctaacaattgtcctatatgcaggctgccattcagagcactgctacagattagggccatgagaaaaaaactgggacccctaagtcctacctcctttaaccccataatctcttcacagactagcgatagtgaagaacatccatcctccgagaatataccccctggttatgaggttgtgagcctgctagaggccctgaacggtccactgactccctcccccgcggtgcctcctctccacgtcctgggtgatggtcacttgtcaggaatgctccccagttacggatccgacgggcatctgcccccagtaagaacgatctctcccctggatcggctctccgactcgtcttcgcagggcttaaagctgaaaaagagcctgagcaagtctacatctcagaacagctctgtgttacatgaggaagaggacgaacactcttgcagcgagagtgagacgcaacttagtcagcggccgagcgtgcaacacttgggcgaggagtgcggagttactccagaatccgaaaacttgaccctttctagctcgggagccatcgatcaaagttcctgcactggaacgccgctcagttcgactatctctagcccggaaggccctgcatcctcttcactggcacagtcagtgatgtccatggccagcagccagataagcaccgatactgtctcctcaatgtctggcagctatattgccccaggcacagaggaggagggagaggccttatcttctccacagcctgccagtcgggctccgtctgaagagggagagggtctccctgcagagtctccagactcaaatttcgcaggtctgcctgctggcgaacaggacgcagaaggaaacgacgtgattgaagaagaagacggctcgccaactcaggaagggcaaagaacttgtgcctttctagggatggagtgcgacaacaataacgattttgatattgcgagtgtgaaggctttagacaataaactgtgctcagaagtgtgccttccaggcgcgtggcaagcagatgacaatgcagtttctagaaacgcacagaggcggcgtctgtcatctagcagcctggaagactctgaaacaaggccctgcgtgtgggggcctctcgctgtctag

SEQ ID NO: 50670 - DNA, 1143 bp, Artificial Sequence
  Description of Artificial Sequence: Synthetic coding sequence
atgggcggcgagaagttcgacagcacccaccccgagggctacctgtttggagagaattcagacctgaattttctcggcaacagacctgtcgtcttcccgtatgccgcccctcccccacaggaaccggttaagaccctgcgctcactggtaaacatcagaaaagataccctgcggctggtcaagtgcgcagaggaggtcaagagtccgggtgaagaggcgtccaaggcaaaggtgcactacaatgttgagtttaccttcgatacagatgcgagagtggctatcactatctattaccaggctacggaggagttccaaaatggcatcgcctcctacatccctaaggataactccctgcagtctgaaacggttcaatataagcgaggggtgtgtcagcagttctgtctgccatcacacaccgtggatccaagcgagtgggctgaggaggaacttggtttcgacttggaccgggaggtttaccctcttgtggtccatgccgtcgtagacgagggggacgagtatttcggccactgtcatgtcctgctgggaacctttgaaaaacacaccgatggcacgttctgcgtcaagcccctgaaacagaagcaggttgtggacggagtgagctacctgcttcaggagatctatgggatagagaacaaatataatactcaggattccaaagtggccgaagacgaggtctctgacaactccgccgaatgcgtggtgtgtttatctgatgtgagggacaccctgattctcccttgtaggcatctgtgtctttgtaatacctgcgcagatacgttacgctaccaagctaacaattgccctatctgcaggcttccattcagagcactcttgcagatccgggctatgcgcaaaaaattgggccccttatctcctacctcatttaatcctatcatttccagccagacatccgattctgaggagcaccccagctctgagaacattccacctggatacgaggtggtgtccctgctggaggctctcaacggcccattgacacctccttcccttctgaaaattcagaagatctcctgggcttggcttcaggcacctgttgtgcccgcgacctgggaagctgaggctggagagtggccggagccaggtcgaagatcgctccagtag

SEQ ID NO: 50671 - DNA, 1974 bp, Artificial Sequence
  Description of Artificial Sequence: Synthetic coding sequence
atgggcgccctgaccagccggcagcacgccggcgtggaggaggtggatatcccgagcaatagcgtgtatcggtacccacccaagtctggctcatacttcgctagccattttattatgggcggcgaaaagttcgactcaacccaccctgaaggatatctgttcggtgagaacagtgacctcaactttttgggcaatagacctgtagtttttccttacgcggccccaccaccccaggaaccagtaaagacactccgttcgcttgtgaacatccggaaggatacactgcgtctcgttaagtgcgctgaggaagtgaagagccctggagaggaggcctccaaagccaaggttcactataacgtggaattcaccttcgacaccgacgcccgagttgccatcactatttactaccaggccactgaggagtttcagaacggcattgcctcgtacataccaaaagataattccctccagtccgagacagtccaatataaaagaggggtgtgccaacagttttgcctgccatctcacacagttgatccctccgaatgggctgaggaggagctaggctttgacttagacagggaggtctacccactagtggtccacgcggtggtggacgagggcgatgagtattttggacattgtcatgtgctgcttgggacctttgagaaacacacggacggaaccttctgcgtgaagccactgaagcagaaacaggtggtggatggagtttcttacttgttacaggagatttacggtattgaaaataagtataacacccaggacagcaaagtggcagaagacgaagtttctgataatagcgccgaatgtgtagtgtgtctgagcgatgtacgtgacacccttatcttgccgtgccggcacctgtgtctctgcaacacctgcgccgacaccctgcgttaccaggccaacaactgtcccatctgtagattgccttttcgcgcattgctgcaaatcagagccatgcgaaaaaaattggggcctttatcaccaacatctttcaaccccatcatctcctcacagacaagcgacagcgaggaacatccatcttcagaaaatatccctcctgggtatgaagtggtttcccttctggaagctctaaacgggcctctaactccttccccggccgtgcctcctcttcatgtgcttggcgacggacatttgtccgggatgttgccaagctacgggtccgacggacacctcccacccgttcgcacgatcagcccgctggaccgtctctctgactcctctagtcagggtttgaagctaaagaagtccttgtccaagagtaccagccagaactcgtcagtcttgcacgaagaagaggatgagcattcctgttctgaatcggagacccaactcagtcagcgtccctcagtccaacacctgggagaggagtgtggcgtcacgcctgagagcgagaatctgaccctgtctagctcaggcgcaatagaccagagctcatgcactgggacgccactgtcaagcacaatttcgagccctgaaggccctgctagtagctctctcgcgcaaagcgtaatgtcaatggcgtccagtcagatctctaccgatacagtctcgtccatgagtggcagttacattgcccccggtacggaagaggagggagaagcattgagtagcccgcaacccgcttctagagctcctagcgaggagggggaggggaacgacgtgattgaagaagaggatggcagccccactcaggaaggtcagcggacctgcgctttcctggggatggaatgcgacaataacaacgatttcgatattgccagtgtaaaagcactggacaacaagttgtgttctgaagtctgcctgccgggcgcatggcaggccgatgataatgcagtcagccgtaacgcccagagacgtagactttcgtcttccagtttggaagattcagagactagaccatgcgtttggggaccgcttgctgtgtag

SEQ ID NO: 50672 - DNA, 1041 bp, Artificial Sequence
  Description of Artificial Sequence: Synthetic coding sequence
atggtgctggtgcacgtgggctacctggtgctgcccgtgttcggctccgtgcggaatagaggagctcctttccaacgctctcagcatccccacgctacgtcctgccggcatttccatctggggccaccccaaccccagcagctcgcacctgactttcccctagcgcaccctgtgcagtctcaacctgggctctccgcccatatggctccagctcatcaacatagcggcgccttacaccaatctctgactcccctccccactctgcagttccaggacgtgactggccccagtttcctccctcaggcccttcatcaacaatacttactccaacagcagttgcttgaagctcagcaccgtagactggtttcccacccaagaagatcacaagagcgtgtttctgtccacccacaccggctgcatccctcgtttgatttcggtcagctgcagaccccgcagcctaggtatttagccgagggcaccgactgggatctttcagtggacgccgggctaagccccgcccaatttcaggtgcgaccgatacctcaacactaccagcattatctcgctacacccaggatgcaccatttcccacggaatagtagctctacgcagatggtggtgcacgagatcagaaattatccctatccacagttgcacttcctcgccctgcaaggactaaacccatccaggcacacttcagctgtgagagaatcatacgaagaactgctccagctagaggaccggctgggtaacgtcacacgaggtgctgtgcaaaatactattgagagattcacatttcctcacaagtacaaaaagagacgacctcaggacggcaaaggaaagaaagatgaaggcgaagaatccgacacagatgagaagtgcactatatgcctctctatgctcgaggatggcgaggatgtgaggcgccttccctgcatgcacttgtttcatcagttatgtgtggatcagtggctcgccatgagtaaaaagtgcccgatttgccgtgtggatatcgagacacaattaggagctgattcctag

SEQ ID NO: 50673 - DNA, 465 bp, Artificial Sequence
  Description of Artificial Sequence: Synthetic coding sequence
atgcaccacttcccccggaacagcagcagcacccagatggtggtgcacgaaatccgcaactacccctacccacagctgcacttcctggctctgcagggactgaacccatcacgacacactagcgctgtgcgggagagctacgaggaattgcttcagctcgaagatcgcctcggcaacgtgacccggggcgctgtgcagaatactatagaaagatttacattcccccacaaatacaaaaaacgccgaccccaagacggcaaaggcaaaaaggacgaaggagaggagagtgatacagatgagaaatgcaccatttgcctaagtatgcttgaggatggcgaggacgttcgaagacttccttgcatgcatctgttccaccaattgtgcgtggatcaatggctcgcaatgagcaagaaatgtcccatttgccgcgtcgatatcgaaacacagctgggagctgactcctag

SEQ ID NO: 50674 - DNA, 87 bp, Artificial Sequence
  Description of Artificial Sequence: Synthetic coding sequence
atggtgctggtgcacgtgggctacctggtgctgcccgtgttcggctctgtgagaaaccgaggaatcagcgtgtggatgctggcctag

SEQ ID NO: 50675 - DNA, 714 bp, Artificial Sequence
  Description of Artificial Sequence: Synthetic coding sequence
atggccatgttccggagcctggtggccagcgcccagcagcggcagccgccagcgggtcctgccggtggcgacagcgggcttgaggctcaatacacctgtccaatttgcctagaggtttatcaccgtcccgtagcaatcgggtcgtgcggacacactttctgtggggaatgcctacagccttgtctccaggtgccttcgcccctttgccctctgtgtcgcctgccattcgacccaaagaaggtcgataaggccacgcatgtcgagaagcagctgagcagctacaaagctccatgtcgcggatgtaataagaaagtgacattggccaagatgcgagttcacattagctcttgcttgaaagtgcaagagcagatggctaattgccccaagtttgtgcccgtagtgccgaccagtcagcccatcccaagcaacatccctaatcggtctacctttgcatgtccatattgtggagcacggaatctggaccagcaggaactggttaagcattgcgtggaatcccacaggtccgatcctaatcgcgtggtttgtccaatttgcagtgctatgccctggggggatccttcatataagtcggcgaactttctgcaacatttactccatagacataagttcagctacgacacatttgtggattactctatcgatgaggaggcggccttccaagcagctctcgcactatcgcttagcgaaaactag

SEQ ID NO: 50676 - DNA, 471 bp, Artificial Sequence
  Description of Artificial Sequence: Synthetic coding sequence
atggccatgttccggagcctggtggccagcgcccagcagcggcagcccccagcgggccctgctggaggtgattccgggttggaggcgcagtacacctgtccaatctgtttggaagttcaagagcagatggccaactgcccaaaattcgtgccggtggtaccaacttcccagcctatcccatctaatataccaaaccgatcgacttttgcttgtccctattgtggcgcgcgcaatttggaccagcaggaacttgtgaagcactgcgtggagtctcatcggtcagatcccaatcgagtggtttgcccgatctgtagtgccatgccttggggcgacccgtcttacaaatctgccaacttcctgcagcacctgctgcatagacacaagttctcatatgacacctttgtcgactactcaatagacgaggaagccgctttccaagcggccctcgccctttcactttccgaaaattag

SEQ ID NO: 50677 - DNA, 387 bp, Artificial Sequence
  Description of Artificial Sequence: Synthetic coding sequence
atgcgggtgcacatcagcagctgcctgaaggtgcaggagcagatggcgaattgtcctaagtttgtccctgttgttccaacctcacagccaatcccgagcaacatccctaacaggtctacattcgcctgcccttattgcggggcgagaaatctggaccaacaggaactggtcaagcattgcgtggagtctcatcggagcgatcctaatcgggtcgtttgtcccatttgttcagctatgccctggggggatccaagttataagagcgctaactttttacaacacctgttgcacagacacaaattctcttacgatacatttgtagactacagcatagatgaggaggcagcttttcaggccgccctggcattgtcgctgtctgaaaactag

SEQ ID NO: 50678 - DNA, 471 bp, Artificial Sequence
  Description of Artificial Sequence: Synthetic coding sequence
atggccatgttccggagcctggtggccagcgcccagcagcggcagccgcctgctggaccagccgggggagactctgggctggaggcgcagtatacctgccccatctgcctcgaggtgcaagaacaaatggccaactgccctaagtttgtgcccgtggtgccaacctcacagcctatcccctctaatatccctaatcgatcgacgttcgcctgcccatactgtggcgctaggaatctggatcagcaggagctcgtaaagcactgtgtggaatcacaccgctcagacccgaatagggtagtttgtcccatctgctcggcaatgccgtggggtgaccctagctataagtctgctaattttctacagcacctgttgcacagacacaaatttagctacgatacattcgtggattactccatcgacgaggaagccgctttccaggccgccctcgccctgtccctgtccgaaaactag

SEQ ID NO: 50679 - DNA, 2127 bp, Artificial Sequence
  Description of Artificial Sequence: Synthetic coding sequence
atggccgccgccggccccagcacccgggccagcagcgccgccgccgcggctgcactctctagacgtgggcgccgaggacgatgtgatgagactgccgcggcaaaaaccggggccccaggacctgctagcgggccaagtctcctggtactctcccccccgttgttgcagcccccacttccccccaggcccgaagagagcggctgcgccggatgtttagagccacccggagaggcagccgcgcttccgtgcggccactcattgtgtcgagggtgtgcccagcgtgcagcggatgccgcgggcccaggctgccccagatgcagggcccggggaccagggtgggcgcggaggcgcgccagggatgacggccaggcagacagtgaagtgctgggcgagtgcgcccgaaggtcacagcccgaacgctgcagaccaaggcgggacggtggcgccgctgctgccggacctcgtcccgaacaggagccgcgggctgctccagccgaacccgattttatcttcagagcccctatcaaactctcaaagcccggcgagctgcgcgaggagtatgagagtctcaggaagctgcgcgaggaaaagcttcaggaggaaaagcccagtgaggatcagattcacaaactgctacccgaagacacagagacaggcaagcggaagatggacgagcagaaaaagcgggacgagcctttagtgttgaaaactaacttggaacgatgccccgcacggttgtccgacagtgagaacgaggaaccttctagaggccagatgacacagacacaccgtagtgctttcgttagcaaaaacaacagttactcccttgccttcttggccggcaaactgaactctaaagtggagcgatcccagtcatgttccgataccgcacaggagcgcgccaaatctcgcgtgcgggcagtcccagggaacaaagctaaagtgacaaccatgaccccagcctccaatccaattattggcgtattgctctcaacacagaacaaccgatgtgtgtcagcgcccgatcttaccattgagaaacggctgcctttttcctcactgagcagtcttgccagtctgcacaaacccgagcggtccgtgtcccctgagagtaatgattccataagcgaggagctgaatcatttcaagcctatcgtttgcagcccctgtacaccacccaagagactgccagatggccgagtgttatccccactcattatcaagagtacgccccggaacctgaaccgctctctgcagaaacaaacttcctatgaggcaagccccaggattctgaaaaagtgggagcaaatattccaagagaggcagattaaaaagaccctgtcgaaggccactctgacgtccctggctcccgagatgggggaggaactactgggcagcgaaggaatacatagtagtaaggagaagcctctagtcgccgtcaacacccgcctttccggcgggcaggtactgtctgagtatactggcccaacgtccgccgaccttgaccacttcccatctgttagccagactaaggccgaacaagatagcgataataaaagcagtaccgaaatccctcttgagacctgctgttcttccgaattaaagggcggcgggtccggcactagtctggagcgggagcagttcgagggtctggggtccacaccagacgctaaattagataaaacctgtatctcccgggcgatgaagataaccacagtaaacagcgtgttgccgcagaattctgttctgggtggcgtgttaaagaccaaacagcagcttaaaacgctgaaccacttcgatctcacaaatggagtgttagtggaatccctttctgaagagccccttcctagcctgcgcagagggcggaagaggcactgcaagacgaagcacttggagcaaaacggttcgctcaagaagctgcgacagacttcaggagaggtaggtctcgcacccacggacccagtactcagggagatggaacagaaattacagcaagaggaggaggatcggcagctcgccctgcagctccagaggatgtttgacaatgagaggcggactgtgagcaggcggaagggcagtgtggatcagtatctcctgcggtcctcaaatatggccggtgcgaagtag

SEQ ID NO: 50680 - DNA, 240 bp, Artificial Sequence
  Description of Artificial Sequence: Synthetic coding sequence
tgactggagcagaacggcagcctgaagaagctgcggcagaccagcggggaggtgggcctggcccccacggatcctgtgctcagggagatggagcaaaagctacaacaggaggaggaagacaggcagttggcattgcagctccagcggatgttcgataatgaaagaaggacagtgagtcgccggaagggatccgtggaccaatacttactgcgctcaagtaacatggctggcgcaaagtag

SEQ ID NO: 50681 - DNA, 579 bp, Artificial Sequence
  Description of Artificial Sequence: Synthetic coding sequence
atggccgagcagcagggccgggagctggaggccgagtgccccgtgtgctggaatcctttcaataatacttttcatacaccgaaaatgctggattgctgccatagcttctgtgtggaatgtctggcccacctatccctggtgaccccagcacgcaggaggttgctgtgccctctctgtcggcagcccacagtcctcgcctctggacagcctgtaaccgaccttccaacagacacagctatgctggcgctgcttagattggagcctcaccatgtgattctggaaggccaccagttgtgcctgaaggaccagccaaaaagcaggtacttccttaggcagccacaggtctatacgctggacctcggaccacagccggggggacaaaccggcccaccgcctgatactgcgtccgccactgtctctactcccatcctgatcccctcccaccactctctgagggagtgcttccggaaccctcagttcagaatctttgcttatctcatggctgttatcctttccgtcactttattgctcatcttcagtattttctggactaaacaatttttatggggggtggggtag

SEQ ID NO: 50682 - DNA, 579 bp, Artificial Sequence
  Description of Artificial Sequence: Synthetic coding sequence
atggccgagcagcagggccgggagctggaggccgagtgccccgtgtgctggaatcctttcaataacacgtttcatactcctaaaatgctagactgctgtcattcattttgtgtggagtgtctggcacacctgagtctggtgacgccagcccgccgcagactgttgtgtccactgtgccggcagcccacagtcttggccagtgggcagcctgtgaccgatttacctaccgacacggcgatgctcgccctgcttagattagagccccatcatgtcatccttgagggtcaccagttgtgtctgaaggatcagccgaaatccagatacttcttgaggcagcctcaggtgtatactttggacctggggccccagcctgggggccagactgggccgcccccagacacggcgagcgccacagttagcacccctatcttaattccatctcaccactccctgagagaatgctttcgaaatccacaattccggatttttgcctaccttatggctgtgatactgagtgttacacttttgctgatattttcaatcttctggacaaagcagtttctgtggggagtgggctag

SEQ ID NO: 50683 - DNA, 579 bp, Artificial Sequence
  Description of Artificial Sequence: Synthetic coding sequence
atggccgagcagcagggccgggagctggaggccgagtgccccgtgtgttggaatccctttaacaatacattccacactcctaaaatgctcgactgctgccactccttctgcgtcgagtgcctagcgcacctgtcacttgtgacacctgctcgccgccgcttactgtgtccattatgtaggcaacctaccgtcctagcctcaggccaacctgtgacagacctgcctaccgataccgccatgctcgccctccttcgtctcgaaccacaccatgttatcctggagggacaccagttatgtctaaaggaccaaccgaagtctcgatacttcctaaggcagccccaggtgtacactcttgacctcggacctcaaccaggaggccagacaggcccccccccggacaccgcatccgccacagtctcaacccccattcttataccctcccaccacagtctgagggaatgctttcggaatccacaattccggatttttgcgtatctgatggctgttatcctctctgtgacactgttgctgatctttagcatattctggacaaagcagtttttgtggggcgtaggatag

SEQ ID NO: 50684 - DNA, 579 bp, Artificial Sequence
  Description of Artificial Sequence: Synthetic coding sequence
atggccgagcagcagggccgggagctggaggccgagtgccccgtgtgttggaacccattcaataatactttccatactcctaaaatgctcgactgctgtcactcgttctgtgtggagtgccttgcacatctttctcttgtgaccccagcccgcagaaggctgctttgtcccctgtgtcgacagcctacggtcttagcttcagggcagccagtgactgacttgcctacagatacagccatgctggccctgctgcgacttgagcctcaccacgtgattttggagggacaccagctttgtttgaaggatcagcctaaaagccgctacttccttcgccagccacaggtgtacaccctggatttgggaccacagcccggcggacaaactggtcccccccctgatactgcaagcgccactgtctccaccccgatcctgatccctagccaccattctttgcgggagtgtttccgaaatccgcagttccgaatcttcgcttatttgatggctgtcatcctgagtgtgacgctgttgctcatcttctcaattttctggacaaagcagtttctatggggcgtaggatag

SEQ ID NO: 50685 - DNA, 1905 bp, Artificial Sequence
  Description of Artificial Sequence: Synthetic coding sequence
atgagcggcgccatcttcggccccctggagggccccagcagcctggatgcaccttcgatccacccactcgtgtgcccattgtgtcatgtccagtacgagaggccctgtcttctcgattgcttccacgatttttgcgctggttgtcttaggggtcgcgccaccgacggcagacttacctgccccctgtgccagcatcagactgtgctgaagggcccatctggcttacctcctgtcgataggctcttgcagtttctcgttgattcctccggggacggcgtagaggccgtgaggtgcgccaactgcgacttggagtgctccgaacaggacgttgaaacaacatatttttgcaatacttgcggccagcctctctgtgcccggtgcagggatgagactcatcgggctaggatgtttgcaaggcacgacattgtagcactgggccagagatctcgggacgtgcctcaaaagtgtactctgcacgccgaaccttatttgctctttagtacagacaagaagctgctgctgtgcatccgatgtttcagggacatgcagaaagagtcacgcgctcattgtgtggacttggaaagcgcatacgttcaaggttgtgagcgcctcgagcaggctgttctggccgttaaagccttacagacagctacacgcgaagcaattgcgctcctccaggccatggtcgaggaagtgaggcattccgctgccgaagaggaggacgctattcacgcactgttcgggtctatgcaggatagacttgcagagcgcaaggccctcctactccaggcagtgcagtctcagtatgaggaaaaagataaagccttcaaggaacagctcagtcacctggccaccctgttgccgacactgcaggttcatcttgtaatctgctcttcttttttaagtcttgccaacaaagcagaatttctagatctcggctacgaattgatggagcgtctgcaggggattgtcaccagaccgcaccatcttagaccaatccagtccagcaaaattgccagcgatcacagggccgaatttgctcggtgtcttgaacctctcctgttgctcggccctaggagggttgccgcagccgccagtggagctaatacccttgcaggggggcttggccctaaggccctgaccgggcctcactgtccgagtcccgtaggcaagatgtctggttctcccgtgcagaaacccacactacatcgcagcataagcactaaagtgctactggctgagggagagaacactccctttgccgagcactgccggcactacgaagattcttatcgacatctgcaagccgaaatgcagtcactgaaagaccaggtgcaagagctccacagagatctcaccaagcaccactctcttattaaggcggaaatcatgggagacgtcctccataaatccctgcagcttgatgtgcagatagcatcagagcacgcctctcttgagggcatgcgggttgtctttcaagaaatctgggaagaggcataccagagagtggcaaacgagcaggagatctatgaggctcagcttcatgatttacttcagctccgccaagaaaacgcttacctaacaaccatcaccaaacaaattactccttatgttcgctcgatcgccaaagtgaaggagaggctggagcctcgcttccaggcccccgtcgacgagcaaagcgagtcgttgcagaacactcacgatgattcgaggaacaacgctgcgagcgctcggaacaatcctggcagtgtccctgagaaaagggaaaaaacttcggagcctaaaggcaattcctgggcacccaatggcctgtcggaggaaccgctgctgaagaatatggaccaccatcgtagtaaacaaaagaatgggggggacgttcccacctggcgagagcatcccacctag

SEQ ID NO: 50686 - DNA, 435 bp, Artificial Sequence
  Description of Artificial Sequence: Synthetic coding sequence
atggtggaggaggtgcggcacagcgccgccgaggaggaggacgccatccacgcattgttcggtagcatgcaggacagacttgccgagagaaaagccctgctgttacaggcagtgcagagccagtacgaagagaaagacaaggccttcaaggaacagttatcccatctagccacactgctgcctaccctccaggtgcacttagtcatttgcagcagttttctgtctcttgccaataaggccgaattcttggacctgggttatgctggacggggattgcggccgcagggcgcggatggggccccgctgccactgcccagccggaaagacgtgggcgtgacgaggccaaaggcgcacgccgcgcctgtgcaccaacatcaaggagcggcaggcggggggcgggaacacgctttgagacgcgccctcccgcctctgtag

SEQ ID NO: 50687 - DNA, 786 bp, Artificial Sequence
  Description of Artificial Sequence: Synthetic coding sequence
atgcccagcgaccccggccccgaggccggcagcggctggcccggcctgcttatgtcttgcctcaaaggtccacatgtaattctgaaaatggaagcgatgaagatcgtacaccctgaaaaattcccagagctgcctgccgccccgtgctttccgcctgcgccccgccctacaccaactctggcccccaagcgcgcctggccctctgatacagagataattgtaaaccaggcgtgcggaggagatatgcctgccttggagggtgcacctcacacaccccccctccctagaagaccaagaaagggtagtagtgagctgggctttccccgggtggcccctgaggacgaggtgatcgtcaaccaatacgtgattagaccaggaccttctgcgagcgccgcttcatccgctgccgccggggagcctctggagtgccctacctgcggtcactcctataatgttacccaaaggcggccgagagtcctgtcttgtctacacagcgtttgcgagcagtgtttgcaaattctctacgaatcatgtcctaaatataaatttatatcatgtccaacttgccggagggagaccgtgttgttcacagactatggcttggcagccctggcagtgaacactagcattctatcgagattaccaccagaggcattaactgctccttccggtggacaatggggcgccgagcccgagggctcctgctatcaaaccttcagacagtactgcggagccgcctgcacttgccacgttagaaatcctcttagcgcttgcagcatcatgtag

SEQ ID NO: 50688 - DNA, 786 bp, Artificial Sequence
  Description of Artificial Sequence: Synthetic coding sequence
atgcccagcgaccccggccccgaggccggcagcggctggcccggcttgctgatgagctgcttgaaggggccccacgtgattctgaagatggaggccatgaagatcgtccacccagagaaatttcctgaacttccagccgcgccatgtttccctcccgcacccaggcctacccccactttggcacccaaaagagcatggccatcggatactgagataatcgtgaaccaggcatgtggaggggatatgcccgctctggagggcgcaccacataccccacctctcccacgacggcctcgcaaaggatccagcgaactgggattccctcgggtagcccctgaggatgaagtcattgtgaatcagtatgtaattcggcctggtccatcagcctccgctgcaagttctgcggcagctggtgagccacttgaatgccccacgtgcggacactcgtacaatgtaacccagcgtagacctagggtgctttcatgcctgcattccgtctgcgaacagtgccttcagatcctttatgagagctgtcctaagtataagtttatttcatgcccaacctgtaggcgggagacagttctcttcacagactacggtctggccgcgctggcagtgaatacatcaattctgagccgattgcctcccgaggccctgaccgcaccatccggagggcagtggggtgccgagcctgagggatcatgttaccagacgtttcgccagtattgcggcgcagcttgcacctgtcacgtcagaaatcccctgtctgcttgctctatcatgtag

SEQ ID NO: 50689 - DNA, 2112 bp, Artificial Sequence
  Description of Artificial Sequence: Synthetic coding sequence
atggccgccagcgaggtggccggcgtggtggccaacgcccccagccctccagaaagtagtagtctttgtgctagcaaatccgatgaaggactgcctgacggactgtcaaccaaagattccgctcaaaagcagaaaaactctccactgttgtccgtgtcaagccagaccattaccaaggaaaacaatcgaaacgtgcacctcgaacacagcgagcagaaccccgggtcatctgcgggcgacacatcggccgcccaccaggttgtgctcggggaaaacctgatcgcaacagccctgtgcttgtccggttctggatcccagagcgacctgaaggatgtggcatccacagcaggagaggagggtgataccagcttaagggagagtcttcaccccgtcacgagaagcttaaaagcaggatgccacaccaagcagctcgcctccaggaactgctccgaagagaagtctccacagacttcgatcttgaaagaaggaaaccgagataccagtctcgactttcgccccgtggttagcccagcaaatggtgtagagggtgtgagagttgaccaggatgacgaccaggattctagctctctgaaactgtctcaaaacattgccgtgcagacagacttcaaaacagccgatagcgaggtcaacactgatcaagatatcgagaaaaacttggataaaatgatgacagagagaaccttgctcaaagaaagatatcaggaagttttggacaaacagagacaggtagagaatcagttgcaagttcagctgaagcagctccaacagaggagagaggaggaaatgaagaaccatcaggaaattctgaaagccatccaggacgttaccataaagagggaagagacgaaaaaaaagatagagaaagagaagaaggaattcttgcagaaggaacaggatctgaaggccgagatcgagaagttgtgcgagaagggcagacgtgaagtttgggagatggaactagatcgcttgaaaaaccaagacggggaaattaatagaaacatcatggaagaaactgagcgcgcctggaaagccgaaatccttagtcttgaatccagaaaagagctcctggtcctgaaactggaagaagcagaaaaagaggctgaactgcatctgacctacctcaagagcactcccccgactttagaaaccgtccgttctaagcaagagtgggaaactaggctcaacggcgtccgaatcatgaagaaaaatgtgcgggaccaattcaactcacacatccagctggtgcggaatggtgccaaactgtcatcccttcctcagattcccacgcccacactgccgccgccacccagcgagaccgattttatgctgcaggtgttccagccatccccttctttggcacctaggatgcccttcagcatcggccaggtgacaatgccaatggtgatgcccagtgcggaccccaggtcactgtcttttccgatactgaacccagcactgtcacagcccagtcagcctagtagccctcttcccggaagccatggccgcaattcccccgggctaggttccctcgtgagccctcacggtccacacatgccacccgccgcttcaatcccgccaccacctgggttgggaggcgtgaaggcatcagccgaaacgccacggccccaaccagtcgacaagctcgaaaaaattttggagaagctgttaacacgattcccccagtgtaacaaggcacagatgactaatattctgcaacagatcaagacggcaagaactaccatggccggactgacaatggaagagctgatccagctggttgcagctaggttagctgagcacgagagagtggccgcctcgactcagcctttggggcgaattagagcactctttcccgcaccattggctcagataagtacccccatgttcctgccgtcagcccaggttagctatccagggaggtcctctcacgctcccgcaacctgtaagctatgcctgatgtgtcaaaagcttgtgcaaccatcagagctgcatcccatggcatgcacgcatgtgctccacaaggagtgtatcaagttctgggctcagactaacactaatgacacatgtccgttttgtccaaccctaaagtag

SEQ ID NO: 50690 - DNA, 2112 bp, Artificial Sequence
  Description of Artificial Sequence: Synthetic coding sequence
atggccgccagcgaggtggccggcgtggtggccaacgcccccagccctccagagtcgtcttcactgtgtgcgagcaagtcggatgaagggttgccggacggtctgtctaccaaagactccgcccagaagcagaaaaatagccctttactatctgtttcgtcgcagactataaccaaagagaacaaccgcaacgttcatttagagcattctgagcagaacccgggctcttccgccggcgatactagcgccgcccaccaagtggtgttaggagagaatctaatcgcaacagctctctgcctctcagggtccggctctcagagtgacctcaaagacgtggctagcactgccggtgaggagggggacacctctctaagggaatctttgcaccctgtcacccgctccctcaaggcgggatgccatacaaagcagctagcctcccgaaattgctccgaggaaaaatctccccagactagcattctgaaagaggggaaccgggatacaagcctcgatttccggcccgtcgtgagtccagctaatggagtggaaggggttagagtggatcaggatgacgatcaggactctagctccttgaaactgtcccaaaatattgccgttcaaacggacttcaaaactgcagattctgaggtcaacaccgatcaggatatcgagaagaacctggataaaatgatgactgaaagaacccttctgaaagagcgctatcaggaagttttagacaaacagcgacaggtggagaaccagctgcaggtccagttgaagcaattgcagcagcgaagggaggaggagatgaagaaccaccaggagattcttaaggccatccaggacgtgaccatcaaaagggaggagacaaaaaaaaaaattgaaaaagagaagaaggaatttttacagaaagaacaagacctgaaggccgaaattgagaaattgtgtgaaaaaggccggagggaggtgtgggagatggagttagacagactgaaaaatcaggatggagagataaatcgtaacatcatggaggagacagagcgagcgtggaaagctgagatactgagcttggagtctcggaaagagctgctagtgctgaagttggaggaggcggaaaaggaggctgagttgcacctaacttacttgaagtctacaccaccaactctggagactgttcgcagcaagcaggagtgggaaaccagattaaatggtgtgcggattatgaagaaaaacgtccgcgaccagtttaattctcatatccagttggtgagaaacggagccaaactaagttcactgcctcagattccaacccccacactgcccccaccgccttcagagaccgattttatgctccaggtatttcagcccagtccctcactggcaccgcggatgcctttttccatcgggcaggtgaccatgcctatggtgatgccctctgctgaccccagaagtctgagtttccctatcctgaatcccgccttgtcacaaccgtcgcaaccatcttcacctctgccaggaagtcatggccggaacagtccgggtctggggtccctcgtatcaccacatgggccacacatgcccccagcggcgtccattcctcccccccctggtttgggaggtgtcaaggcttccgccgaaacccctcgcccccaaccagtggacaaactggagaaaattctagagaagttgctgaccaggttccctcagtgtaataaggcacagatgactaacattctccaacaaataaaaacagctagaaccaccatggccgggttgaccatggaagaacttattcagttggtcgcagcccgtctcgccgaacacgagcgcgtcgccgcctccacacagcccctggggaggattcgcgctctgttccctgctcctctggcacaaatctcgaccccaatgtttctcccatccgctcaggtgtcatatccaggacggagcagccacgcgccagccacttgtaaactgtgtctgatgtgccaaaagctcgtgcagccctccgagctacatccaatggcatgcacccatgtcctgcataaggagtgtattaaattttgggctcagactaacaccaatgatacatgccccttttgtcctactctgaagtag

SEQ ID NO: 50691 - DNA, 441 bp, Artificial Sequence
  Description of Artificial Sequence: Synthetic coding sequence
atggccgccagcgaggtggccggcgtggtggccaacgcccccagccctccagagagcagctccttgtgcgcctctaagtccgacgagggactcccggatgggctgagcactaaagatagcgcgcagaagcagaaaaactcccctctgctatccgtctcttcccagacaatcactaaggagaataatcgcaatgtacacctagaacacagcgaacagaatcccggctcatctgctggcgacacatcagcagcacaccaggtggttctgggcgaaaatctgatcgccacagccctgtgcctttccggaagcggaagccaaagtgatctaaaagacgtcgcctcaacagcaggggaggagggcgacacttctcttcgggagagcttgcatcccgtgaccaggagtctcaaggccgggtgtcacaccaagcagctggcttcctag

SEQ ID NO: 50692 - DNA, 2181 bp, Artificial Sequence
  Description of Artificial Sequence: Synthetic coding sequence
atggcccagaccgtgcagaacgtgaccctgagcctgaccctgcccatcacctgtcacatatgtctcggaaaggttaggcaacccgtgatttgcatcaacaatcatgtcttttgttcgatctgtatagacttgtggctgaaaaacaacagtcagtgtcctgcgtgcagagtgcctattacccccgagaacccgtgcaaggaaatcattgggggaacttctgagagtgaaccaatgctctcacataccgtgcgaaagcacctgcgtaaaacgcggctcgaactactgcacaaggagtatgaggatgaaatcgactgccttcagaaggaggttgaggagctgaagagcaagaacctcagtctggaatcacagatcaagacgattctcgatcccctcacattagtccagggcaaccagaacgaagataaacatctcgtcaccgacaaccccagtaagatcaaccccgaaaccgtcgctgaatggaaaaaaaaactgcgcaccgcaaatgagatctatgaaaaagttaaagatgacgtagacaaactgaaagaagctaacaaaaagctgaagctggagaatggaggcttagtgcgggaaaacttgaggctgaaagcggaagtggacaaccgtagcccgcagaaattcgggagattcgctgtggctgcgctgcaatccaaggtagagcagtacgaacgggagactaaccgactcaagaaagcattagagagaagcgataaatatattgaagagctggaatctcaggttgctcagctgaagaactccagcgaggagaaagaggcaatgaatagcatttgtcaaacagccttaagcgctgacggcaaaggaagcaagggctcagaggaagacgttgttagtaagaatcaaggtgacagtgcccggaagcagcccgggtcaagtacatccagtagctcccacctggccaagccttcaagctccaggctgtgtgacacctcttcagcacgccaggagtctacctccaaggcagatttaaattgtagtaagaataaagatctttaccaagaacaggtagaggtcatgctggacgtcacggacacatctatggacacttacctggaacgcgagtgggggaacaagccctccgattgcgtgccttataaagacgaagagctgtacgatctacctgctccgtgcactcctcttagtttaagctgcctccagctttcaactccagagaatagggaatcatctgtcgttcaagctggcggttccaaaaagcattccaaccatttacgcaagcttgtgtttgacgatttttgtgacagttctaatgtttcaaataaggactcaagcgaggacgatatctcgcgctctgagaatgagaagaagtcagagtgtttcagctcccctaaaacaggcttttgggattgctgcagtaccagctacgcccagaatctggatttcgaatccagcgaaggcaacaccattgctaattctgtgggagaaatctctagtaaacttagcgaaaaatccggactatgtctgagcaagagactgaactctatccgatcctttgagatgaacagaaccaggacgtccagcgaagcctctatggacgccgcgtacttagacaagataagtgagcttgattccatgatgtctgagagcgacaacagtaagagcccatgcaacaatggtttcaagagcttggatctggacggcctaagcaaaagctcccagggctcagaattccttgaggagcccgacaaacttgaggaaaagacagagttgaacctgtctaaaggatcattgaccaacgaccagctcgagaacgggtcagaatggaaacccacatccttttttctcctgagtccttctgatcaagaaatgaacgaagatttctcactgcatagctctagctgtccagttactaatgagattaaacctcccagttgtctatttcagactgaatttagtcaaggtatattgctgtcatcatcccatcggctattcgaggaccagcgcttcggctccagcctgttcaagatgagctccgagatgcactctttacataaccatttgcagtcaccttggtctacaagtttcgtcccagagaagagaaacaagaatgttaatcagagcactaagcgcaaaattcagtcttcactctcctccgcctccccttcaaaagcaactaaatcttag

SEQ ID NO: 50693 - DNA, 663 bp, Artificial Sequence
  Description of Artificial Sequence: Synthetic coding sequence
atgagcgagggcgagagcaaggacagcagcggcagcgagtgccccgtctgttatgagaaattccgtgacttagagggcgccagccgtaccttgtcctgtggccacgttttctgccacgattgccttgtaaagtatctgctgagcacccgggtcgatgggcaggtgcagcggaccctcgtatgcccaatctgccggtacgttacattcctgtccaaaaaatcaagccgatggcccagtatgctggacaaatcatctcaaactcttgccgtgcccgttggcctaccttctgtgccccccctggacagcctaggccacaccaaccccttagccgctagctcacctgcttggcgcccccctcccggacaggctcgtcctcctgggtcgcccggtcagtctgctcaactgccactcgacttgcttcctagcctgccccgggagagccagatattcgtgatctccagacatgggatgcccctaggggaacaggatagtgtcctaccacgtaggagtcttgccgagctgagtgaggcctccctcgcaccacgttcagcccgtgccttttgttgccggtcacgggcactgcttctgatcaccttgattgcagtagtagctgttgttgcagcaattctgccttgggtgctccttgtgaggaagcaagcctag

SEQ ID NO: 50694 - DNA, 663 bp, Artificial Sequence
  Description of Artificial Sequence: Synthetic coding sequence
atgagcgagggcgagagcaaggacagcagcggcagcgagtgccccgtttgctatgaaaagtttcgcgacctcgaaggggccagcaggaccctttcctgtggtcacgtgttctgccatgattgtctagtgaaatatttactttcaacacgggtggatggccaggtgcagcgcacccttgtgtgcccgatttgtcgatatgtgacattcctgagcaaaaaaagcagcagatggccttctatgctggacaagagcagccagactctggccgttcccgtggggctgccaagtgtccctcccctcgactctttaggacatacgaaccccctggctgcttcctctcccgcttggaggcctccccctggccaggcacggccaccaggcagtccaggacaatctgcgcagctccctcttgacctattaccttctctaccgagggagagccagatcttcgtgatctccagacacggaatgcccctaggagagcaggatagcgtgctaccaagacgaagtctcgccgaactctccgaggccagcttggctcctaggtcagcacgtgcattctgttgtagatcacgggccttgctgctgattactctcattgctgtcgtagcagtcgtcgctgctattctcccatgggttctgctggtacgaaagcaggcctag

SEQ ID NO: 50695 - DNA, 471 bp, Artificial Sequence
  Description of Artificial Sequence: Synthetic coding sequence
atgcaggacgccgccgccggcggcccccccggcctgggcggcggcgggcctcctgaagagcgcacagattgcattatatgttgtagcgcctatgacctttctggtcatctgccccggcggctttattgcggacacactttctgtcaggcttgcgtgagacgacttgatacgcctgcccctgagcagcggtggatcccttgcccacagtgccgccagagtacccccacacctcgagggggagtggccatgcttgatctcgatctcgcggctttcttggccgtgaaagccgaaagagagccagcccgcctcgagcccctgccacttacttcactgaagggatcagccatcacaagacagccagcgggactgtgtccggcgctggggcctcagccacacttccctcagccaagatactgctgctggggctgcggcagcctgtgctgtccacctcttggatcacctgaggtctag

SEQ ID NO: 50696 - DNA, 954 bp, Artificial Sequence
  Description of Artificial Sequence: Synthetic coding sequence
atgggctacgacgtgacccggttccagggcgacgtggacgaggacttaatctgccccatttgctccggggtgctcgaggagcctgtgcaggcgcctcactgcgaacatgcattctgcaacgcatgcattacccaatggttctctcagcagcagacttgtccagtggacaggtctgtcgttaccgtcgcgcatctccgaccagtgcctaggattatgcggaatatgctgagcaaactccaaattgcctgtgacaacgcagttttcggctgtagtgcggtggtccggctggacaatcttatgagtcacctgtccgactgcgaacataatcctaagaggcccgtgacctgcgagcaggggtgtggtctggaaatgcctaaggatgaactcccaaaccataattgtatcaaacatctacggtccgtggtgcaacagcagcagactagaatcgcggagctggagaagacttcggccgagcataaacaccaactggccgaacaaaaacgagatatacaactgctcaaggcttacatgcgggcaatccgatctgtgaaccctaacctccagaacctggaggaaactatagagtacaatgagatcctggaatgggtgaacagtttgcagcccgctcgagtcactaggtggggggggatgattagtaccccagatgcggtgttacaagctgtgattaaaagaagtctcgtggaatccgggtgccctgcttcgatcgtcaatgagttgattgaaaacgcgcatgagagatcatggccacaaggactcgctacattggagactcgccagatgaaccgacgttactacgagaattacgttgccaaaaggatccccggcaagcaggcagtggttgtgatggcatgcgaaaatcagcatatgggcgatgacatggtgcaggagcctggcctggtcatgattttcgctcacggcgtcgaggagatatag

SEQ ID NO: 50697 - DNA, 741 bp, Artificial Sequence
  Description of Artificial Sequence: Synthetic coding sequence
atgcggaacatgctgagcaagctgcagatcgcctgcgacaacgccgtcttcggatgtagcgctgtggttcggctggacaacttgatgagccacttgtccgactgcgaacataaccccaagagaccagtcacttgcgagcaggggtgtggtctcgaaatgccaaaggatgaactccctaaccacaattgtatcaagcacctcaggtcagtggtgcagcaacagcagacccggattgctgaacttgaaaagacctccgccgaacataagcatcagctggccgaacagaaacgtgacatccaacttcttaaagcctatatgcgtgcaattaggagtgtcaaccccaacctgcagaacctggaagaaaccatcgaatacaacgagattctcgagtgggtcaacagtctgcagcccgcgagagtcacaagatggggcggcatgattagcacgcccgatgctgtactccaggccgtgataaaaagatcactggtggaaagcggatgccccgcgagcatagtcaatgaactaatagagaacgcacatgagaggtcctggccacaggggctggctactttggagactcgccagatgaacaggagatattacgagaactatgtagcaaagaggattccaggcaaacaagccgtcgtcgtaatggcttgcgaaaatcagcacatgggagatgatatggtgcaggagcccggccttgtcatgatcttcgctcatggtgtcgaagaaatctag

SEQ ID NO: 50698 - DNA, 915 bp, Artificial Sequence
  Description of Artificial Sequence: Synthetic coding sequence
atgggctacgacgtgacccggttccagggcgacgtggacgaggacctgatttgcccaatctgctccggcgttctcgaagaaccggtgcaggcccctcattgtgagcacgccttttgtaatgcatgtatcacccagtggttttcccagcagcagacatgccctgtgcctcggatcatgaggaacatgctgtcgaaactgcagatcgcatgcgataatgcggtattcggttgcagcgccgtggtgcgattggataacctcatgagccacctgtcagactgtgaacataacccaaaacgtccggtgacctgcgagcaaggttgcggactcgaaatgcccaaggacgagctcccaaaccacaattgcataaaacacctgagaagcgtggtccagcagcagcagactaggattgcggagttagagaaaacttctgctgagcataaacatcagttagccgaacagaaaagagatatccaattactgaaagcctacatgcgcgcaatacgctcagtgaaccctaacttgcagaacctggaggagacaatcgagtataacgaaatcctcgagtgggtgaacagtctacagccagccagggtgacccgctggggagggatgatttcaacccccgatgccgtgctccaggctgtcattaaaaggtcactggtggagtcgggctgccccgcatccatcgttaatgagttgattgagaacgcccacgagaggtcttggccccaaggtcttgcaacccttgagacacgccagatgaaccgcaggtactatgagaattatgtggccaagcggataccaggtaagcaggcagtggtagtgatggcctgtgaaaatcagcacatgggtgatgacatggtgcaggaacccgggttggtgatgattttcgcacatggggttgaagagatatag

SEQ ID NO: 50699 - DNA, 573 bp, Artificial Sequence
  Description of Artificial Sequence: Synthetic coding sequence
atgggctacgacgtgacccggttccagggcgacgtggacgaggaccttatctgccctatctgctccggcgtgctggaggagcctgtgcaggcgccgcactgcgaacatgcattttgcaatgcttgcatcacacagtggttttcgcagcagcagacctgccccgtggatagatcagttgtcaccgtggcccatctgcgcccggtgcctaggatcatgcgcaacatgctatccaaattgcagattgcatgtgacaatgcagtatttgggtgcagcgccgtcgtgaggcttgacaatctgatgtcacacctgagtgattgtgaacataacccaaagcgtcctgtaacatgtgaacagggttgtggccttgaaatgccaaaggacgagttgccaaatcacaattgcatcaaacatctgcgttctgtggtgcagcagcaacagactaggatcgcagagcttgagaagactagtgccgaacacaagcaccaactggccgagcagaagagagacattcagttgttgaaggcgtacatgcgggccatccgctctgtgaatcccaatttgcaaaatttgtag

SEQ ID NO: 50700 - DNA, 441 bp, Artificial Sequence
  Description of Artificial Sequence: Synthetic coding sequence
atgcggaacatgctgagcaagctgcagatcgcctgcgacaacgccgtgttcggctgcagcgctgtagtgaggctggataacctgatgagccacctcagcgattgtgaacacaacccaaaaagaccagtaacctgcgagcaggggtgcggtcttgagatgccgaaggatgagctgcccaatcacaattgtataaaacatctccgaagtgtagtgcaacagcagcagaccaggatcgccgagctggagaaaactagtgcggagcacaagcatcagctggcggaacagaagcgagacatacagctgctcaaggcctacatgagggcaattcgctcggtcaaccctaatctgcagaatctcgaggaaaccatcgagtacaacgaaatcttggaatgggtaaacagcttacagcctgctcgcgtgactcgatggggaggcatgtag

SEQ ID NO: 50701 - DNA, 606 bp, Artificial Sequence
  Description of Artificial Sequence: Synthetic coding sequence
atgggctacgacgtgacccggttccagggcgacgtggacgaggacctgatatgtcctatttgtagtggcgtgttagaggaacctgtccaagcccctcattgtgagcacgccttttgcaatgcatgcatcacacagtggtttagccagcagcaaacctgtccagtggacagaagcgtcgtgacagtagcccacctgcggcccgttccacggattatgaggaacatgctgagcaaactccagattgcatgtgataatgctgtttttggttgcagtgcagtagttcgactggacaatctcatgagtcacttgagcgactgtgagcataacccaaaaagacccgtgacctgtgaacaaggctgcgggctggagatgcccaaagatgaactgcccaatcacaattgtatcaagcacctccgtagtgtcgtgcagcaacagcaaacccgaatagcagagttggagaaaaccagcgctgagcacaaacaccagctggcagagcaaaaacgagatatccagctcctgaaggcttatatgagggctatcagaagtgtaaaccctaacctacaaaatctggaagagacaatcgaatacaatgagattctggaatag

SEQ ID NO: 50702 - DNA, 954 bp, Artificial Sequence
  Description of Artificial Sequence: Synthetic coding sequence
atgggctacgacgtgacccggttccagggcgacgtggacgaggacctcatatgcccgatttgctctggagttctagaggagccagtgcaggccccacactgcgaacatgctttttgcaatgcatgcattacccagtggttcagccaacaacaaacctgtcccgtagatcgctccgtggttaccgttgctcatctacggccggtaccccgcataatgagaaacatgctgtccaagctccagatcgcctgtgacaatgccgtgttcgggtgctctgcagttgtgcgactggacaatttgatgtcgcatctgtctgattgcgaacacaacccaaagcgacccgtgacatgcgagcagggatgtgggttggagatgccaaaagatgagctgcctaaccataactgtattaaacacctgagaagcgtggtccagcaacagcaaaccagaatagccgaactggagaaaaccagtgcagagcacaagcaccagttggcggagcagaagcgcgacatccaactattaaaagcctatatgcgcgcgatccgttccgtaaatcccaatttgcagaaccttgaagagactattgagtataatgaaatcttagagtgggttaatagtctgcagcctgctcgggtgacccggtgggggggaatgatttccacaccagacgcagtactccaagcagtcatcaaaaggtcactcgtcgagtccgggtgtcccgccagcatcgtaaatgagcttattgagaatgcccatgagcgatcctggccacagggactggcaactctcgaaacgcggcaaatgaatagacgttactacgagaattacgttgccaaacggatccctgggaagcaggcagtggtggtcatggcttgcgaaaaccagcacatgggggacgacatggtgcaggaacccggccttgttatgattttcgcccacggtgtcgaggagatttag

SEQ ID NO: 50703 - DNA, 1299 bp, Artificial Sequence
  Description of Artificial Sequence: Synthetic coding sequence
atgcggccctgggccctggccgtgacccggtggccccccagcgccccagtgggccagcggcggttttccgctgggccagggtcgacccccggccagctgtggggtagtcctggccttgaggggcctctcgcgtcacccccagcccgggacgagaggttaccaagccagcagcctcctagccgtccaccgcacctgccagttgaggaacggcgagctagtgcccctgccggaggttcccctcgaatgctccacccggccacacagcagtcacctttcatggttgatctccacgagcaagtccaccagggacccgtgcctctttcttacactgttacaaccgtcacgacccaggggtttccattacccacagggcaacacatccccggctgttccgcccaacagctgccggcctgttcagttatgttctccggccagcattatccactctgttgtcttccccctcctctgattcaggcatgtacaatgcaacagctgcccgttccctatcaggcataccctcacctcataagttccgatcactatatcctgcatccccctccacctgctccccctccccaaccaacccatatggcgcctctagggcagttcgtgtctttacagactcagcaccctcgcatgcctttgcagcggctggataacgatgtggatcttagaggcgaccagccttcgctcggatccttcacttattctacaagtgcccctgggcctgcattatcaccttccgtaccattgcactacctgccccatgacccactgcatcaggagctgtcattcggagtcccttactcccatatgatgccacggcgcctttccacacagcggtaccgcctccagcagccattgcctccaccacccccaccccccccaccccccccatactacccatctttcttgccttactttttgagcatgttgcctatgtctccaaccgccatggggcccaccataagcctcgacctggacgtggacgatgttgaaatggagaactacgaggcccttctgaatctggctgagcgcttaggggacgccaagcctcgtgggctgactaaggccgatatagaacagctgcctagctatagattcaatcccgacagtcatcagtctgagcagacactgtgtgtggtatgcttttccgactttgaagcccgccagctgcttagagtgctcccatgtaaccatgaatttcacaccaaatgtgtggataagtggcttaaggcaaaccggacttgccccatctgtcgggccgatgcgtcagaagtccccagggaggccgaatag

SEQ ID NO: 50704 - DNA, 1056 bp, Artificial Sequence
  Description of Artificial Sequence: Synthetic coding sequence
atgctgcaccccgccacccagcagagccccttcatggtggacctgcatgaacaggttcatcaagggcccgtcccgctgtcctataccgtgaccacggtgacaacccaggggtttccgttgcccacaggccagcacatccctgggtgtagcgcacagcagctccctgcgtgctccgtgatgttttccgggcaacactacccactgtgctgcctgccccctcctttaatacaggcctgcaccatgcagcaactccccgtgccttaccaggcctacccacacctgatttcaagtgatcactatatccttcatcctccaccccctgcaccacctcctcaacccactcatatggcacccctcggacagtttgtctctctgcagactcaacacccccggatgcccctccagcgtctggataatgatgttgacttgcgcggcgatcagcctagcttgggcagcttcacgtattcaaccagtgctcctggccctgctctgagtcctagcgtgcctctgcattacctgccacatgatcccctgcaccaagagctcagttttggggtgccatacagtcatatgatgccccgacggctctccacacaacgataccgcctgcaacagccactgccgcctccaccccctccgccgcctccaccaccttattacccctcattcttaccatacttcctcagcatgttaccaatgtcccctacagccatgggcccaacaatatctctggacctagacgtggatgacgtagagatggagaactacgaggctcttctcaatttggccgagaggctgggagacgccaaaccacggggactgaccaaagccgatatagagcagctgccaagctacagattcaatcccgactctcaccagtctgaacagacactctgcgtggtgtgtttttctgacttcgaggctcgacagttactgcgcgtgcttccgtgtaatcacgaattccacacaaaatgtgtggacaaatggctaaaagccaaccgtacatgtcctatctgtagagctgatgcaagtgaagtgcctagggaggctgagtag

SEQ ID NO: 50705 - DNA, 1707 bp, Artificial Sequence
  Description of Artificial Sequence: Synthetic coding sequence
atggactaccggcggctgctgatgagccgggtggtgcccggccagttcgacgacgccgactcaagcgattcagaaaatagagatctcaagactgtgaaggagaaagacgacattttgttcgaggacctccaggacaacgtcaacgaaaacggcgaaggtgaaattgaggacgaagaggaagagggctacgacgacgatgacgacgactgggattgggacgaaggtgtaggtaagttagctaaaggttacgtgtggaacggagggagcaatcctcaggcaaaccggcagacgagcgatagcagtagcgccaagatgtccacgcctgcggataaggttcttcggaaatttgaaaacaaaattaacctggacaagctgaacgttaccgatagcgtgattaataaagttacggagaaatccaggcagaaggaagctgatatgtacaggatcaaggataaagcggacagggcgaccgtagaacaggtcctggacccgagaacccgtatgatccttttcaagatgttgacccgtgggatcatcacagaaatcaacggatgtatctctactggtaaagaagcaaatgtctaccacgcctcaacagcaaatggtgagtctagagctatcaagatctacaagacatccatcctagtcttcaaagacagggacaaatacgtctccggtgaattccggttccgccatgggtattgcaaaggcaacccgcgaaagatggttaaaacctgggccgagaaagagatgcggaatctgattaggctgaatacggcagagattccatgcccagagccaatcatgcttcgctcacatgtcctggtcatgagtttcatcggaaaggacgatatgccggctcctctgttgaagaatgtgcaactctcagagtccaaagcaagagagctttatctacaggttatacaatatatgcggcggatgtaccaggacgcacggttggttcatgcggatctgagcgaatttaacatgctctatcatggtgggggagtctatattatcgatgtttcccagtccgtggaacacgaccatcctcatgcgctggagttcttacgcaaggattgtgccaatgtgaacgatttttttatgcggcattcagttgcagtgatgaccgtacgcgaacttttcgagtttgtcacagacccatcaattacgcatgaaaatatggacgcatacctttcaaaagccatggaaattgcctctcagcgtacgaaggaagaacggagcagccaagaccatgtggacgaagaagtgttcaagcgcgcttacatccccagaaccttgaacgaggttaagaactatgagagggatatggacattatcatgaaacttaaggaagaggacatggccatgaacgcacagcaggacaatatactgtaccagactgtgacaggcttaaaaaaggatctatcaggcgtccaaaaggttcccgctctgttggagaatcaagtcgaggaaaggacctgtagtgattctgaggacattggctcttccgagtgttcagacactgactcggaggaacaaggggaccacgcccgtccaaaaaagcacacaacagatccagatattgacaagaaggaacgtaagaagatggtgaaggaagcacagcgggagaaaaggaagaacaagattcccaagcacgtgaaaaaaagaaaggaaaagaccgcaaagaccaagaaagggaagtag

SEQ ID NO: 50706 - DNA, 1659 bp, Artificial Sequence
  Description of Artificial Sequence: Synthetic coding sequence
atgggcaaggtgaacgtggccaagctgcggtacatgagccgggacgatttccgtgtgctgaccgctgtggagatggggatgaaaaaccacgaaatagttcctggcagcctgattgcatctatcgctagcttgaaacatgggggatgcaacaaggtcctgcgagaattggtgaagcacaagctgatcgcatgggagaggactaaaaccgtgcagggatatcgccttaccaatgcagggtacgattatctggccctgaagaccctgtcgtcaagacaggtggtagagtccgtcggaaaccagatgggtgtgggaaaagagagtgatatctatattgtcgcaaacgaggaaggacagcaatttgccctgaaactgcatcgactgggccgtaccagtttcagaaatctcaaaaataagcgtgattatcacaaacaccgccataacgttagctggctgtacctgtcacgtctctcagccatgaaagagtttgcatacatgaaggcactctatgaacggaagtttcccgtccctaagcccatcgactataatcggcacgctgtggttatggagttgatcaacgggtaccctctttgtcagatccaccatgtggaggatccagcaagtgtgtatgacgaagcaatggagcttatagtgaagcttgccaatcatgggctaatacacggagatttcaatgagttcaacctgatcctcgacgagtccgatcacatcaccatgatcgatttcccccagatggttagcacctcgcatcctaacgcggaatggtactttgatcgcgatgtgaagtgcatcaaagacttttttatgaaacggttctcctacgagagcgagctcttccccacatttaaggacattaggagagaggacactctggatgtagaggttagtgctagtggttacacaaaggagatgcaggctgacgacgaattacttcaccccctgggacctgatgataagaacatcgaaacaaaagagggaagcgagtttagcttcagcgacggagaggtggctgaaaaagctgaagtctatggttctgagaacgagagcgagcgcaactgtcttgaggaaagcgagggttgttattgtcgatccagtggggatccagagcagatcaaggaggattccttgtccgaggaatccgcggatgctcgcagcttcgagatgactgagttcaaccaggcgctcgaagagatcaagggccaagttgttgagaacaatagcgtcactgagttttctgaagagaagaaccgaaccgaaaactacaacaggcaggacggccagagggtccaaggaggcgtgcccgccggaagcgatgaatacgaggatgaatgcccacacctgatcgccctgtcgagcctcaaccgcgagtttaggcctttcagggacgaggagaacgtaggcgccatgaaccaatatagaacccgaacgctctctataacatcatcagggagcgcagtgtcgtgctctacaattcctcccgaactggtaaaacagaaggtaaaaaggcagctgacaaagcagcaaaagtctgcagtacggcgacgtcttcaaaagggcgaggccaacatcttcaccaagcagcgccgggagaatatgcagaatattaaatctagccttgaagccgcctctttttggggggagtag

SEQ ID NO: 50707 - DNA, 1425 bp, Artificial Sequence
  Description of Artificial Sequence: Synthetic coding sequence
atgggcaaggtgaacgtggccaagctgcggtacatgagccgggacgacttcagggtgcttaccgccgttgaaatgggtatgaagaatcatgagattgtcccagggtccctaattgcatcgatcgcaagtttgaagcatggcggatgtaacaaagtcctgcgagaactggtgaaacacaagcttattgcttgggagagaacaaaaactgtgcagggctaccgcctcacaaacgcaggctatgactacctcgcgctcaagactctgtcaagccggcaggtcgtggagagtgtcgggaatcagatgggtgtgggcaaggagtcagatatttatattgtcgccaacgaggaaggacaacagtttgctctcaagttgcacaggctgggccgcacatccttcaggaaccttaagaataaacgggactatcataaacacaggcacaatgtgtcctggctttatctgagccgcctgagcgccatgaaggaattcgcatatatgaaagctctctatgagaggaaattccctgtacccaagcctattgattacaacagacatgcagtggtgatggaactcattaacgggtatcccttatgtcagattcaccacgtagaagaccctgcttctgtgtatgacgaggctatggagttgatcgtgaaattagcaaaccacggactgattcatggcgactttaatgagtttaatctcatactggatgaatccgaccacatcacaatgatagacttcccacagatggtaagtacttctcaccctaatgctgagtggtacttcgatagagatgtaaaatgtataaaagacttcttcatgaagcggttctcatacgagagcgagttgttccctactttcaaagatattcgcagggaagacaccttggacgtagaagtcagcgcgtccggctatactaaagaaatgcaggcggacgacgagctgttacatcctctgggacccgacgataaaaacatagaaaccaaggagggtagcgagttttcattttcagatggtgaggtggccgaaaaggctgaggtttacggatctgagaatgaatctgaaagaaattgtctggaagaaagcgaagggtgttactgccgctcatctggagaccccgaacagattaaagaggactcactctccgaggagtcagcagacgcacggagctttgagatgacagagttcaatcaggcactcgaggagataaagggccaggtcgtagaaaacaatagcgtgaccgagttttcagaggagaagaacagaaccgaaaattataatcggcaggatgggcagagagtgcagggaggtgttcccgcagggagcgacgagtatgaagatgaatgtccacaccttattgctcttagcagcttgaatagagaatttaggcctttcagatatagactgctaagtatcgctttctag

SEQ ID NO: 50708 - DNA, 1560 bp, Artificial Sequence
  Description of Artificial Sequence: Synthetic coding sequence
atggacctggtgggcgtggccagccccgagcccggcaccgccgccgcatggggaccttcaaagtgtccttgggccatcccccagaacaccatttcttgctcattggcggatgttatgtcggagcagttggctaaagaactgcagctagaagaggaggctgcggttttcccggaggttgctgtcgccgagggaccatttattacaggcgagaacatagataccagcagtgatttgatgttggcccagatgttgcaaatggagtacgaccgggagtatgatgcacaactgaggcgggaagagaagaaattcaatggagattctaaagtgtcaataagcttcgagaactaccgtaaggtccacccctacgaggacagcgacagctcggaggatgaagttgactggcaagatacacgtgacgatccctatcggcccgccaaaccggtaccaacacccaagaaggggtttataggaaaaggtaaggacattacaacaaagcacgatgaggtggtgtgcggccgaaaaaacacagcccgtatggaaaattttgctccggagtttcaggtgggtgacggtatcggtatggacctcaagctcagcaaccacgtgtttaacgcacttaaacagcacgcatattccgaggagcggcgatccgcacggttacacgagaagaaggagcatagcaccgccgagaaggctgtggacccgaagacacgattgcttatgtacaagatggtaaattcgggcatgcttgagacaataacaggctgcatcagtacaggaaaggagagcgtggtctttcatgcatacgggggcagcatggaggacgagaaagaagactccaaggtcatcccaaccgagtgtgccatcaaggtatttaagacgactctcaatgagtttaaaaacagggacaagtatatcaaagatgacttccgtttcaaagataggttttctaaattaaatccccgaaagatcattcggatgtgggcagaaaaggagatgcataaccttgctaggatgcagagagcaggcatcccctgccctaccgttgtgctcctgaaaaagcacattctcgtgatgtccttcataggacacgaccaggtgcctgcccctaagttgaaggaagtgaagctcaatagcgaagagatgaaggaggcctactatcaaacgttgcatctcatgagacagttgtaccacgaatgcacccttgtccatgcagatctcagcgaatacaacatgctgtggcatgcaggcaaggtgtggctcatcgacgtgagccaatctgtggaacctacccatccccatggcttagagttcttatttcgcgattgtcgcaacgtttcccagttctttcagaagggcggggtgaaggaggccctctccgaacgagagttgttcaatgcagtgtctggcctcaacattactgctgataacgaggccgactttctggcagagatcgaagcgttagaaaagatgaacgaggatcatgtgcagaagaacggacgaaaggcagcctctttccttaaggacgacggtgaccccccactgctgtatgacgaatag

SEQ ID NO: 50709 - DNA, 1248 bp, Artificial Sequence
  Description of Artificial Sequence: Synthetic coding sequence
atgaacgtgaccagcatcgccctgcgggccgagacctggctgctggccgcttggcacgtgaaagttcctcctatgtggctggaggcgtgtatcaattggatccaggaggagaataataacgtgaacctcagtcaggctcagatgaataaacaggtgtttgagcaatggttactcactgatctgcgggacctggaacatccgctgttgccagacggcatactcgaaatcccaaagggagaactgaatggtttttacgctttacaaattaactccttggtcgacgtgtcccagcctgcttatagccagatacaaaagctgcgcggcaagaacaccactaacgacctggtgacagccgaggcacaggtgactcctaagccgtgggaggctaagccaagtcgcatgctcatgctccagctgacggatggcatcgtgcagattcagggcatggagtaccagcctatcccaatccttcactctgaccttccacctggcaccaaaattctcatctacggaaatatcagtttcagactgggcgtactgctgctgaagcccgagaacgtgaaagtgctgggcggcgaagtggatgcactcttggaggaatacgcacaggagaaggtcctggcacgcctgatcggggaacctgacctggtggtaagtgtcatccccaacaactctaacgagaatattcctagagtgactgatgtcttagaccccgcattgggaccttctgatgaggaactgctggctagcctggatgagaatgacgagctcacagctaataacgatacttcttctgagagatgctttaccacaggatcctcctccaataccatccctacacggcagagttcttttgaacccgagttcgttattagtccaaggccaaaagaagagcctagcaacctttcaatccacgtgatggacggtgagctggacgattttagcctggaagaggcactgcttcttgaagagacagtgcagaaggagcagatggaaacgaaggaacttcagcctctcactttcaatcggaacgccgaccgatcaatcgaacggtttagccacaacccaaacactacaaataactttagtctcacctgcaaaaatggcaacaataactggagtgaaaaaaacgttagtgagcagatgacgaatgaggacaaaagcttcgggtgtccttcagtaagagatcagaataggtccatcttttcagtgcattgcaatgtgccactcgcccatgattttacttag

SEQ ID NO: 50710 - DNA, 1020 bp, Artificial Sequence
  Description of Artificial Sequence: Synthetic coding sequence
atgagcagcgagatgctgcccgccttcatcgagaccagcaacgtggacaaaaaacagggtatcaacgaggaccaggaagaatcccagaagcccagactgggcgagggctgtgagccaatcagtaaacggcagatgaagaagctgatcaagcaaaaacagtgggaagaacagagagaactgcgcaagcaaaagcgtaaggaaaaaaggaagaggaagaagctggaaaggcagtgccaaatggaacctaactctgacggacacgaccgcaagagggtccgccgtgacgttgttcatagtactctgagactcattattgactgcagcttcgaccacctcatggtgttaaaagacattaaaaaactccacaagcagatccagagatgttacgctgagaacaggcgagccctccacccagttcagttctatctcacctctcacgggggacaactgaagaaaaatatggacgagaacgacaaaggctgggtgaattggaaggacattcacattaaaccagagcattactcagagctgatcaaaaaggaagacctaatatatctgacaagcgatagtcctaatatcctgaaggagctggatgaatctaaggcctacgtaatcggcggcctagtggatcacaatcaccacaaaggtctgacatacaagcaggcgtccgattatgggataaatcatgcccagctgcccctgggcaactttgtgaaaatgaactcacggaaggtgcttgcagtgaatcacgttttcgagatcattcttgagtacctggagacccgcgactggcaggaggcattttttactattttgccccagaggaagggggccgttcccacagacaaggcatgcgaaagcgcctcccacgataaccagtcagttaggatggaggagggaggcagtgactcagactccagcgaggaggaatactccagaaacgagctagacagtccgcacgaggaaaagcaggacaaagagaaccacactgagagtacagtgaactcccttccccactag

SEQ ID NO: 50711 - DNA, 1020 bp, Artificial Sequence
  Description of Artificial Sequence: Synthetic coding sequence
atgagcagcgagatgctgcccgccttcatcgagaccagcaacgtggacaagaagcaggggatcaatgaagaccaggaggagtcacagaagcccagactcggggaaggatgtgagccaatttcaaagagacagatgaaaaagttgataaagcaaaagcaatgggaggagcaaagggaactgcggaaacagaagcgcaaagaaaagcgaaaaagaaagaagctggagcgtcagtgccagatggaacctaatagcgacggccacgatagaaaacgcgtccgcagagacgttgtacactccactctgaggctgattatcgactgctccttcgatcacctgatggtccttaaagatatcaaaaagctacataagcagatccagcgatgttatgccgagaaccggcgggccctccaccccgttcagttttacttgaccagccatggagggcaattgaagaaaaacatggacgagaacgacaaaggttgggtgaactggaaagatatccacattaagccagaacattattctgagctaattaaaaaagaagacctgatatacctgacgtcagattcacccaatattttaaaagagctggacgaaagcaaagcatacgtgattggaggcctggtggatcataaccaccataaaggacttacctacaaacaagcaagcgattacggcattaatcacgcccaactcccactgggcaacttcgtgaagatgaactctcgcaaagtgcttgcagtcaaccatgtattcgagatcatacttgagtatctggagacccgcgactggcaggaagcgttcttcaccatattgccccaacgtaagggggcagtgccaaccgacaaggcatgtgagtctgcctcccacgataatcagagcgtacggatggaggagggaggctccgattccgatagctccgaggaggagtacagccggaatgaactggacagcccacatgaagagaaacaggacaaagaaaaccatacggagtcaacagttaacagcttgccacactag

SEQ ID NO: 50712 - DNA, 1020 bp, Artificial Sequence
  Description of Artificial Sequence: Synthetic coding sequence
atgagcagcgagatgctgcccgccttcatcgagaccagcaacgtggacaaaaagcaagggattaatgaggatcaggaggagagtcagaaacccaggctgggtgaaggctgcgagcccatttccaaacggcaaatgaaaaagctgataaaacaaaagcagtgggaagagcaaagagagctgaggaagcaaaagcgcaaagaaaaacgcaagcgtaagaagctcgagcgacagtgccagatggagccaaatagtgacggtcatgaccggaaaagggtgagaagggacgtggttcactctacactgaggctgattatcgactgtagcttcgaccacctgatggtcctcaaagacattaagaaactgcacaagcagatccaaagatgctacgccgagaaccgacgtgctctccacccggttcagttttatttaactagccacggggggcaactgaagaagaacatggatgagaacgacaagggatgggttaactggaaggatattcacattaaacccgagcactatagcgaattaatcaagaaggaggacctcatttatctgacctccgatagtcctaatatattgaaggagctcgacgagtcgaaagcctatgttatcggaggactcgtcgatcacaaccaccataagggtctaacgtacaaacaggcatcagactacgggatcaaccatgcgcagctgccactcggcaacttcgtgaaaatgaattccaggaaggttctggctgtgaaccacgtctttgaaatcattctggaatatctggagacgagggactggcaagaagccttcttcacaatcctcccccagcgcaaaggagcggtccctactgacaaagcatgcgagagtgcatcgcacgataaccagagtgttagaatggaagagggagggagtgattctgatagctctgaagaggaatattcgagaaacgaacttgatagccctcatgaggagaaacaggataaggaaaaccacaccgaatcaaccgtaaactccctaccacactag

SEQ ID NO: 50713 - DNA, 621 bp, Artificial Sequence
  Description of Artificial Sequence: Synthetic coding sequence
atgagcagcgagatgctgcccgccttcatcgagaccagcaacgtggacaaaaaacaagggatcaacgaagaccaagaagagagccaaaagccaaggctaggggagggctgtgaaccgatttcaaaaagacagatgaagaaactcatcaagcagaagcagtgggaagagcaacgcgagcttaggaagcagaaaagaaaagaaaaaagaaagcgcaaaaagctagaacgccaatgtcagatggaacccaacagtgatggccacgatcgcaaacgggtaagacgcgacgtcgttcacagtactctgcggctgatcattgactgctcatttgatcatctgatggtgctgaaggacatcaaaaagctgcacaagcagatccagaggtgctacgctgaaaacagaagggcactgcatcccgtgcaattctacttaaccagtcacggcggccagctgaagaaaaatatggatgagaatgataagggctgggtgaattggaaagacatacacattaaacccgaacactactcagagcttatcaagaaggaagatctaatttatctgacgtccgactcacccaacatccttaaagagctggacgagtccaaagcttacgtgattggatag

SEQ ID NO: 50714 - DNA, 603 bp, Artificial Sequence
  Description of Artificial Sequence: Synthetic coding sequence
atgagcagcgagatgctgcccgccttcatcgagaccagcaacgtggataagaagcaggggatcaacgaggaccaggaggaatctcagaagccaaggctgggagaaggctgcgaacctatcagcaagcgtcaaatgaagaaactgatcaaacagaagcaatgggaagagcagagggagctccgaaagcagaagaggaaggagaagagaaaacgaaagaaactggaacgacagtgtcaaatggagccgaattcagacgggcacgaccgtaagcgcgtgcggcgagatgtggtgcactcgacactgcgactgatcatagattgttcctttgaccacctgatggttctaaaagatattaagaagctgcataagcagattcaacggtgctacgctgagaacagaagggctttgcaccccgtgcagttctacttgaccagccacggcggtcagctcaagaaaaacatggacgagaatgacaagggctgggtaaactggaaggatatccatatcaaacctgaacattattcagaactgattaagaaggaagacctgatttacctgaccagcgacagcccgaatatcctgaaagagctggacgagagttag

SEQ ID NO: 50715 - DNA, 951 bp, Artificial Sequence
  Description of Artificial Sequence: Synthetic coding sequence
atggactggaagctggagggcagcacccagaaggtggagagccccgttctgcaagggcaggagggaattcttgaggaaacaggcgaagacgggctgcccgagggcttccagctcctacagatcgatgccgagggagaatgccaggagggagaaattctggcaacagggtccactgcgtggtgttctaaaaacgtgcaacgcaagcagaggcactgggaaaagatcgtggcggcaaaaaaaagcaaacgaaaacaggaaaaagaaaggagaaaggccaaccgcgctgagaaccctggtatctgccctcagcactctaagcgctttttaagagcgctcaccaaagacaagttattggaggcaaagcactctggccctcgtctatgtatagacttaagcatgacccattacatgtccaagaaagagctgagccgcctggctggacagattcggcgtctgtatggcagcaataaaaaggccgaccgacctttttggatttgtctgacaggcttcactacggattcgcccctatacgaggagtgtgtgaggatgaacgacggcttctccagctacctccttgacattactgaggaggattgtttctctttattccctctggaaaccctcgtgtacctgacgccagattctgaacacgcactcgaagacgtcgacctgaacaaagtctatattctaggcggcttagtagacgagtccatccagaagaaggtaacatttcaaaaggcacgggagtacagtgtgaaaacggctcgactgccaatacaggagtacatggtccgaaaccagaatggcaagaactaccacagcgaaatcctcgccataaatcaggtgtttgacatactttcgacatatctggaaactcacaactggcctgaggccttgaaaaagggtgtcagcagcggtaaggggtacatcttaagaaacagcgtggaatag

SEQ ID NO: 50716 - DNA, 690 bp, Artificial Sequence
  Description of Artificial Sequence: Synthetic coding sequence
atggactggaagctggagggcagcacccagaaggtggagagccccgtactgcagggtcaggaggggatactggaggaaacgggcgaagatgggctccccgagggctttcagctgctgcagattgacgccgaaggggagtgccaggaaggagagatcctcgcaacgggctctaccgcttggtgctccgagctctccaggctggcagggcagatccgccggctttacggctctaataaaaaagccgatcgccccttttggatttgcttgacagggtttactacagactcgcctctgtacgaagagtgcgtgagaatgaatgatgggttttctagctacctactcgatattacagaagaggattgcttctccctgttcccgctggagactcttgtgtacctaacccccgacagtgagcatgctcttgaggatgtcgacctcaacaaggtatatatccttgggggtctggtcgatgagtctattcagaagaaagtgacattccagaaagcccgtgaatactcggtcaagacagctcgccttccgatccaagagtatatggtacgtaatcagaacggcaagaattaccatagcgagatccttgccatcaatcaggaaacacacaattggcccgaagctctgaagaaaggagtgagttccggcaaaggatatatcctcagaaattcagtagaatag

SEQ ID NO: 50717 - DNA, 771 bp, Artificial Sequence
  Description of Artificial Sequence: Synthetic coding sequence
atggactggaagctggagggcagcacccagaaggtggagagccccgttctgcaggggcaagagggtatccttgaagaaaccggtgaggacggactgccagagggttttcagctgcttcagatcgacgcagaaggagagtgtcaggagggggaaattcttgcaactgggtcaaccgcttggtgtagcaaaaacgtgcagcgcaaacagcgccactgggagaaaattgtcgccgctaagaagagtaagcggaagcaggagaaggagcggcgcaaagccaacagagcagagaaccctggtatatgccctcagcactccaaacgtttccttagagccctaactaaagacaaattactcgaggcgaaacatagcggtccacgtttatgtatcgacctgagtatgactcactacatgtcaaaaaaactggatataactgaggaggattgcttctcgctgtttccacttgagacactagtttatttgaccccagactccgaacatgccttggaagacgtggacctgaacaaggtatatattctcgggggtctagtggacgaaagcatccagaaaaaggtgacatttcagaaagctcgagaatattcagtaaaaaccgcccgactgccgatccaggagtatatggttcgaaaccagaatgggaaaaattatcatagcgagatattggcaatcaatcaggagacccacaattggcccgaggcgctaaagaaaggtgtcagcagtggcaagggttacatcctgcgcaactcagtagagtag

SEQ ID NO: 50718 - DNA, 474 bp, Artificial Sequence
  Description of Artificial Sequence: Synthetic coding sequence
atgagcagcgaggagggcaagctgttcgtgggcggcctgaacttcaacaccgacgaacaggcccttgaggatcacttctcgtcttttggccccattagcgaagttgttgtagtaaaggaccgggagacccagcgcagccgaggttttggtttcatcacattcacaaatccagaacatgcttccgttgcaatgagggcaatgaacggcgagtctctggatggaaggcaaatccgagtggatcacgcaggaaaaagcgcccgcggaaccaggggagggggtttcggggcacacggtcgagggcggtcctatagcagggggggaggcgaccaaggttacgggagcggtaggtattacgacagcagacccggtggttacggttacggatacggacgatctcgggactacaatggtcgcaaccaagggggctatgaccggtattccggcggcaactaccgggataactatgacaactag

SEQ ID NO: 50719 - DNA, 846 bp, Artificial Sequence
  Description of Artificial Sequence: Synthetic coding sequence
atgttccccgcccaggaggaggccgaccggaccgtgttcgtgggcaacctcgaggcgagggtccgagaggaaattttatacgagctgtttctccaggcgggaccactgaccaaggtcacaatctgtaaggaccgtgagggaaagcccaaatctttcggctttgtgtgctttaagcatcctgaatcggtttcctacgcgatcgccttgcttaatggcattagactgtatgggagacccatcaacgtgcagtacagattcggtagcagccggagctccgagcctgccaatcagtcattcgagtcttgtgtgaagatcaattcccacaattaccggaacgaggagatgctggttggcaggagcagtttccccatgcagtacttccccattaataatacctctctacctcaggaatacttcttgttccagaagatgcaatggcatgtttacaatcctgtgctgcagctgccgtattatgaaatgacagcacccctgcccaattccgcaagcgtcagttccagcctgaatcacgtgccggatctagaggctggcccgagtagttataagtggacacaccagcaaccttcagattctgacctgtatcagatgacagcaccattgcccaatagtgcaagcgtgtcttccagcctgaatcatgtcccagacctagaagccggcccctcctcttacaaatggacccaccagcagccttcggattcagacctctatcagatgaacaaacggaaacggcagaaacagacctccgactctgacagctcaaccgataacaatagaggtaatgaatgctctcagaaatttcggaagtctaagaaaaagaagcggtattag

SEQ ID NO: 50720 - DNA, 3006 bp, Artificial Sequence
  Description of Artificial Sequence: Synthetic coding sequence
atggccgtggtgatccggctgctgggcctgcccttcatcgccggcccagtggatatccggcatttttttaccggcctgaccattccagatggaggtgtgcacataatcgggggagagatcggtgaggcctttatcatttttgccactgatgaggatgctcgtcgggctatcagtcggtcggggggctttattaaagacagtagcgtagaattatttctgagcagcaaggcggagatgcagaagaccattgaaatgaagaggacagaccgcgtcggccgcggcaggccaggcagtggaacttctggcgtggattcgctctccaatttcatcgagtccgtgaaagaagaggctagtaacagcggctatggttcaagcattaatcaagatgcagggtttcacacaaatgggaccggacacggaaatttacggccgagaaagacacggcccctcaaagcggagaacccatacctgtttctccgaggccttccttacctggtgaacgaggacgatgtgcgcgtgttcttttctggcctgtgcgtggatggcgtgatcttccttaagcaccatgacgggcggaataacggtgacgccattgtgaagtttgcctcctgtgtggacgcatcaggcgggctgaagtgtcacaggagctttatgggttcaagatttatcgaggtgatgcaggggagtgagcagcagtggatagagtttggcggaaatgccgtgaaggagggtgacgtcctgagacggtctgaagaacacagcccacccagaggcatcaatgaccgtcactttcgaaaacgtagtcacagcaagagtccccggcgcacaaggtcgagaagtcctctgggtttttatgttcacctcaaaaacctatctctgagtatcgatgagagggacctgcgcaacttctttcggggaactgatctcaccgacgagcagataagatttctctataaagacgaaaaccggactcggtacgcctttgtaatgttcaaaaccctgaaggactataacacggcgctgtccctccataaaacggtgctgcagtaccgcccggtacacattgacccaattagtcggaaacagatgcttaagttcatcgcccgctacgagaaaaagcgctcggggagcttagagagggaccgacccggccacgtgagccagaagtactcacaagagggcaacagcggccaaaagttgtgcatttacatccgcaattttccatttgatgtgaccaaggtcgaagtccagaaattcttcgccgacttcttgctcgccgaagatgacatttacctgttgtacgacgacaagggggtgggtctgggggaagcactggtcaagttcaagtcagaagagcaagcgatgaaagccgagagactaaacagacggcggttcctcggcaccgaggtactcctgcggctgatctccgaagcacagatccaagagttcggagtgaattttagtgtcatgagttctgaaaaaatgcaggccagatcccagtcccgggagagaggcgaccattcacacttgtttgacagtaaagatccccctatctactctgtcggagcattcgagaatttccgccatcaactggaggacctccggcagctagataactttaagcacccacagagggactttcgacagcctgaccgccacccccccgaggacttccggcactctagtgaggactttagatttcctcctgaagattttaggcattcccctgaggatttcaggcgccctcgtgaagaggattttcgcaggcccagtgaagaggatttccgcaggccgtgggaagaggacttcaggcggccaccagaagacgattttaggcaccccagggaagaagattggagaagacccttggaggaggactggcggcgaccattggaagaggacttccggagaagtccaaccgaggactttagacagctccctgaagaagactttagacagccacctgaagaggacctgcgctggctaccagaggaggactttcgtagacctcctgaggaggactggagaagaccgccggaggaggacttcagacggcccctgcagggagagtggaggcgccccccagaagacgacttcagacgaccgccagaagaagactttagacactcacccgaggaagatttccggcagtcgccacaagagcactttcggcggccacctcaagaacattttcgacggcccccccctgagcattttcgaaggccgccaccagagcatttccgtcgaccacccccagagcacttcagacgtccccccccagagcattttcgccgacccccaccggaacacttcaggaggcctcctcccgaacatttccgccgtcccccccaggagcacttcaggagaccacctcaagaacatttccggcgcagccgagaggaagactttcggcacccacctgacgaagattttcggggacctcccgacgaggacttccggcaccctccagacgaggatttcaggtctcctcaggaggaggactttcgctgtccatcagacgaggactttcgccagttgccggaggaagatttgcgggaagcacctgaggaagaccctaggcttccagataactttcgtccccctggagaagattttagatctccacctgacgactttcggtcccatcgtccttttgtcaactttggaaggccggagggggggaaattcgacttcggtaaacataacatgggctcttttcctgaaggtagattcatgcccgaccctaaaatcaattgtgggagcgggagggtgaccccaatcaagataatgaacctcccttttaaggcgaatgtcaacgagatattagatttctttcatggttatagaatcatacctgacagtgttagtatccagtacaacgaacagggtttgccaaccggagaggctatcgttgcaatgataaactacaacgaagccatggcagcaatcaaggatctgaatgatcggcccgtgggaccccggaaggtgaagctgaccctcctgtag

SEQ ID NO: 50721 - DNA, 2646 bp, Artificial Sequence
  Description of Artificial Sequence: Synthetic coding sequence
atggccgtggtgatccggctgctgggcctgcccttcatcgccggccctgtggatattcgccatttttttaccggcctcaccattcctgatggtggggtccacattatcggcggcgaaataggcgaggccttcataatatttgccaccgacgaggatgccagacgagcaatctccaggagtggcgggtttataaaggattcctcagtggaactttttctgagctcgaaggctgaaatgcagaagaccatagaaatgaaaagaactgacagagtcgggagggggcgcccagggagcgggactagtggcgtagattcgttgagcaatttcattgagtccgtcaaagaggaagccagtaactccggctacggttccagtattaatcaggacgccggctttcacacaaatggaaccggccacggcaatttaagacccagaaagacacgtcctttgaaagcagaaaatccctacctattcctgcggggcctgccctatcttgtgaatgaagatgatgtccgcgtcttcttctctggattatgcgttgatggcgttatctttctcaagcaccacgatgggagaaacaacggagacgccatcgttaagttcgcttcttgtgtcgatgcatctggggggctgaagtgccaccgttcctttatggggtcgcggttcatcgaggttatgcagggcagcgagcagcagtggattgaattcgggggaaacgctgtaaaagagggagacgtgctcagacggagcgaagaacactctcctcctcgaggaatcaatgaccggcacttccgaaagcggtcacactcgaagtcacccaggagaacccgctcgcgtagtccattgggtttctatgttcaccttaagaacctgtcattgtctatagatgagcgagacctccgcaattttttcagaggtacagatctgacagatgagcagatacgatttctctacaaggacgaaaaccggaccagatacgcgttcgttatgtttaaaaccctaaaggactacaataccgctctgtcactccataagaccgtgctacagtaccggcccgtgcatatcgatccgatctctcggaagcagatgcttaagttcattgcccggtatgaaaagaaacggtcaggcagcttggaaagagaccgtccgggacatgtctctcaaaaatactcgcaggagggtaatagcggtcagaaactgtgtatctatatcaggaactttcccttcgatgtgacaaaagttgaggtccaaaaattcttcgccgacttcctcctggcagaggatgatatttacctcctttatgatgataaaggagtaggcctcggcgaggctctggtcaaattcaagtcagaagagcaagccatgaaggccgagaggttaaacagacgtcgttttcttggtactgaagtccttctgcggttgatttccgaggcgcaaatacaggaattcggcgtcaatttttccgtgatgtcaagtgaaaaaatgcaggcccgatcccaaagcagggagcgcggtgaccattctcacctcttcgatagtaaagatccgccgatttacagtgttggcgcctttgagaacttcaggcatcaactggaggatttacggcagttagacaattttaagcaccctcagcgcgattttcggcagcccgacaggcacccaccagaggactttaggcactcttctgaggatttcagattcccgcccgaggatttccgacactctccggaggattttagaagacccagagaggaggactttagaaggccctccgaagaggacttccggcgaccatgggaagaggatttccggcggccacctgaagacgatttccgccatcctcgggaggaggactggcgccgacccccacctgagcattttcgtagacctccacctgaacattttcgcaggcctcctccggagcacttcaggcgccccccccctgaacacttcagaaggccgccccccgaacacttccggagaccccctcaagaacatttccgtaggccacctcaggagcatttccgccggtcaagggaagaggacttccggcatccaccagacgaggattttagaggtcccccagatgaggactttcgccaccccccggatgaagatttcaggtcccctcaggaggaagatttccgctgcccgtccgacgaagacttccgacagctgcccgaagaggacctcagggaagcccccgaggaggaccctagattgcctgataacttccgaccaccaggcgaagactttagaagtccaccagacgactttagaagtcatcggccctttgtgaatttcgggcgccctgagggtggcaagttcgactttggcaagcacaacatggggtcatttccagaaggaaggtttatgcctgatccaaagatcaactgtggaagcggtcgggtaacacccattaaaataatgaacctgccattcaaagctaatgtcaacgaaattctcgacttttttcacggctataggattatccccgactcagtatccatccagtacaacgagcagggattgccaactggagaggctatagttgccatgatcaactataatgaagccatggcagccattaaggatttgaatgatcgccctgtcggtccgcgcaaggtcaagctgaccctgctttag

SEQ ID NO: 50722 - DNA, 432 bp, Artificial Sequence
  Description of Artificial Sequence: Synthetic coding sequence
atggccgtggtgatccggctgctgggcctgcccttcatcgccggccctgtggatattagacatttctttactggtctaacaatccctgatggaggcgtgcatataatagggggcgaaattggggaagcattcatcatctttgcaaccgacgaggacgctagaagggctatcagcaggtctggtgggttcataaaggatagctcggtggagttgtttctgagttccaaggctgagatgcagaaaaccatagagatgaagcggacagatagggtcgggagaggtaggcccggatccggaacaagcggggtggattccttgtcaaacttcatcgaatctgtaaaggaggaggcatctaattcaggctacgggtcctcaattaaccaagacgctggttttcacactaacggcacagggcacggcaacctgaggtag

SEQ ID NO: 50723 - DNA, 450 bp, Artificial Sequence
  Description of Artificial Sequence: Synthetic coding sequence
atggccgtggtgatccggctgctgggcctgcccttcatcgccggcccggtagacatcagacatttctttacagggctgactattccagatggaggtgtgcatataatcggcggagagatcggtgaggccttcatcattttcgctaccgacgaagatgctcggcgcgctatttcgcgcagcggaggcttcatcaaggattcttccgtggagttgttcctatcctctaaggcagagatgcagaagactatcgaaatgaaacgaacggaccgggtggggcgcggaagaccaggctctggtacttctggcgtcgatagtctcagcaacttcatcgaatccgtgaaagaagaggcctctaacagtggatacggttcctcaattaaccaggatgctgggttccacaccaatggcaccggacacggcaacttgagaccgcggaagacacgtccctag

SEQ ID NO: 50724 - DNA, 369 bp, Artificial Sequence
  Description of Artificial Sequence: Synthetic coding sequence
atggccgtggtgatccggctgctgggcctgcccttcatcgccggcccagtggatatcagacacttcttcacagggctgaccatcccagacggcggagtgcatattatcggcggggagatcggggaggccttcatcatttttgcaaccgacgaagatgcccggagggcaatctcacgcagtggtgggttcatcaaggactcaagtgtggaactgttcctgtcctcaaaggccgagatgcaaaaaaccattgaaatgaagcgcacggatcgggtcggtcgtggacggccaggaagcggcacttctggcgtggacagcctgtcgaatttcattgagtcagtgaaggaagaggcatctaactctggatattag

SEQ ID NO: 50725 - DNA, 249 bp, Artificial Sequence
  Description of Artificial Sequence: Synthetic coding sequence
atggccgtggtgatccggctgctgggcctgcccttcatcgccggcccggtagacatccgccacttctttacaggcctcactatcccggacgggggggtgcacattatcggtggcgagatcggagaggctttcatcatttttgccacggacgaggatgcgcggcgagctattagtaggtccggcggattcatcaaggattcatctgtggagctatttctctctagtaaggccgaaatgcaaaaaacttag

SEQ ID NO: 50726 - DNA, 573 bp, Artificial Sequence
  Description of Artificial Sequence: Synthetic coding sequence
atggaggccgagaccaagaccctgcccctggagaacgccagcatcctctctgaagggtccctgcaggaggggcatagactatggattggtaaccttgacccaaaaatcacagagtaccacctgctgaaactgctccagaaattcgggaaggttaaacaattcgatttcctgttccataaatcaggggccctcgaaggccaacccaggggctactgcttcgtaaattttgagactaaacaagaagcagagcaggcaatccaatgcctgaacggcaagctcgccctttcaaagaaactggttgtgcggtgggctcacgcgcaggtgaagcgctacgatcataacaagaacgacaagatcctccctatttcccttgagccctcgtcctccactgagcccacccagtccaacctgagtgtgacagctaaaattaaagctattgaagccaagctcaaaatgatggcggaaaatcccgacgccgaataccctgccgccccagtgtacagttactttaaacctcccgacaaaaaacggacaactccttacagcaggaccgcttggaaatcccggaggtag

SEQ ID NO: 50727 - DNA, 2943 bp, Artificial Sequence
  Description of Artificial Sequence: Synthetic coding sequence
atggtgagcaagatgatcatcgagaacttcgaggccctgaagagctggctgtctaaaaccctggaacctatctgcgacgctgaccctagcgccctggcaaagtatgtcttagccctcgtgaagaaggataagtctgaaaaggagctaaaagccctctgtattgaccagctcgatgtgttcctccagaaagagactcagatttttgtagaaaaacttttcgacgccgtcaacactaagtcctacttgccacctccagaacagcccagctcaggctctttgaaggtcgagttttttccacaccaagaaaaggacataaagaaggaagagatcacgaaagaggaggaacgggagaaaaagttctcccgtaggttgaaccattctccccctcagagctcgagcagataccgggagaatcggtcacgcgacgaacgaaaaaaagacgatcgctcccggaaaagagactatgaccggaatcctcctaggcgagactcctaccgcgacaggtataacaggagacgaggacggtcccggtcctacagtcggagtagaagtcggtcctggtctaaggagcgacttcgggaaagagacagagaccggtcgcgaaccaggtctaggagtcggaccagatcacgagaacgggacctcgttaagcctaagtacgaccttgatagaactgacccactggagaacaattacacacctgtctcgtctgtgccatcgatttcctcgggccactaccctgtcccaacactttcctctaccatcaccgtcatcgcccccactcatcacgggaataataccactgagtcctggagcgagtttcacgaggaccaggtggaccataattcctacgtgagacctcctatgcccaaaaagagatgtagagactacgatgagaagggattttgcatgagaggggatatgtgccctttcgaccacggatccgatcccgtggtggtcgaggacgtcaacttgccaggtatgcttccctttccagcccaaccccccgtcgtggagggcccaccccctcctggactacctccacctccccctatccttacccccccacccgtgaatctgcgacctcccgtgccacccccagggccccttcctccgtctctgcctcctgtcaccggaccaccccccccgctcccgccgctgcagccgtcaggaatggatgcccctcccaacagtgccacctcgagcgtccctaccgtagtcacgacgggtatacaccatcagcccccccccgccccaccttctttgttcaccgctgacacctatgatacggatgggtacaacccggaggccccctcgataacgaacacctctcgacctatgtacagacaccgggtgcacgctcagcgccccaacctaatcgggctcacttccggagatatggatctgccacctcgagaaaaacctcccaacaagtcctcaatgagaattgtggtagattccgagtctcgaaagcggacaattgggagcggggaaccgggagttcccaccaaaaaaacatggtttgataaacccaattttaatcggacgaactcccctggctttcagaagaaggtccagttcggcaatgagaacacaaagcttgagttaaggaaggtccccccagaactgaataacatcagcaagctgaacgagcatttcagcagattcggaacgctggtcaatcttcaggtcgcttacaatggcgatcctgagggagcactaatccagttcgctacctatgaagaagcaaagaaagcgattagctctaccgaagccgtgctgaacaatagattcatcaaagtttattggcacagggaaggtagcacccagcaactccagactacttcacccaagcctcttgtgcagcagccgatacttcctgtggtcaaacagagtgtcaaggaacggctgggaccagtgcctagcagcactatcgaacccgcagaggctcagtctgcttcatccgacctgccacaagtgctctccacttccactgggctgaccaagacagtatacaacccagctgcactgaaggcggcgcagaagacattactggtgagcactagcgcagtggacaacaacgaggcacagaaaaaaaagcaagaggccctcaagctccaacaggatgtgaggaagcggaagcaagagattctggaaaagcacattgagacccaaaagatgctgatcagtaaactggagaaaaataaaacaatgaagagcgaggacaaggccgagatcatgaaaacccttgaggtcttgacaaagaatattaccaagttgaaggatgaggtgaaggcggcatcaccaggccgctgtctgcccaagagcattaaaaccaagacccaaatgcaaaaagaactcctagacacagaactagatctctacaaaaagatgcaggccggcgaagaggtgacagaattgcgacgtaagtatactgagcttcagctggaagcggccaagcgtgggatcctgagtagcggtcgagggagaggaatccactcacgcggtaggggagccgtgcatggacgtggccggggccggggtagaggtagaggcgtcccggggcatgccgtggtggaccatcggccacgggccctggaaattagcgctttcactgaaagtgatcgcgaggacttgctgccccattttgctcaatacggagaaattgaggactgccagattgacgacagctcgctgcatgcagtcattacattcaagacacgggcagaggccgaggctgccgccgtccatggagcgagattcaagggacaagacctgaaattggcctggaataagcctgtcacgaatatctccgccgttgagaccgaggaagtggagccagacgaggaggagttccaggaagagagcctggtcgacgactcactgctccaggatgacgacgaagaggaagaggacaacgaatcccgtagttggaggcgatag

SEQ ID NO: 50728 - DNA, 3024 bp, Artificial Sequence
  Description of Artificial Sequence: Synthetic coding sequence
atggtgagcaagatgatcatcgagaacttcgaggccctgaagagctggctgtctaagactctggagccaatttgcgatgccgatccaagtgccttggccaagtacgtgcttgcccttgtgaaaaaggacaagtctgaaaaagaactgaaggctttatgtatcgatcagttggacgtgttcttacagaaagagactcagattttcgttgagaagctattcgatgcagtaaatacaaaaagttacctgccaccccccgagcagccatcttcaggctctctcaaggttgagtttttcccccaccaagaaaaagatataaagaaggaagagataacaaaggaggaggagcgtgagaaaaaattcagtcggaggctgaaccactcaccgccgcagtcctcaagtcggtatcgcgagaatcgttcccgggacgaacgaaaaaaggatgacagaagcaggaaaagggactacgatcggaacccgccgcgcagggattcttaccgggataggtacaataggcggcgcgggagatcacgtagctactcacgctctaggagtcgctcttggtccaaagagagattacgggagagggatcgtgatcgctcacggacacgttctaggtctcgcacacgcagcagggagcgtgacctggtgaaacccaagtacgacctagacaggactgatccactagagaacaattatacgcctgtgtcctctgttccttccatctcttcgggccattaccctgttccgacactgtcctctaccataacagtaatcgctccgactcaccatggcaataacaccacggagagttggtcagaatttcacgaggaccaggtcgatcacaattcatacgtgcgaccacctatgccaaaaaaaaggtgtcgtgattacgatgagaagggcttttgtatgcggggtgacatgtgtccgttcgatcacgggtctgaccccgtggtggtcgaggatgtgaacctgccagggatgttaccatttcccgcccagcctcctgttgttgaaggaccccctccacctggactcccgcctcctccccccatattgacacctcctcctgtcaacttaaggccacccgtgcctccaccgggacccctcccacccagtctccccccagtgaccgggccccctccacccttaccacctctacagccatctgggatggatgcgcccccaaacagcgccacctcctctgtgccgacagtggttactactggtatccatcaccagcctcctccagcccctccaagcctcttcacagctgatacttacgacacggatggctacaacccagaagccccgtctataaccaatacaagccgacccatgtataggcaccgagtccatgcacagcggccaaacctcatcgggctcaccagtggagacatggacctgcccccacgcgaaaaaccacctaacaagtcatccatgcggattgtcgtcgacagtgaaagccgcaagagaacgattggatcaggcgaaccaggagtgccaactaaaaagacctggttcgacaagccgaatttcaaccgcacaaactctcctggattccaaaaaaaggtgcaattcggcaacgagaatactaaactggagctgcggaaagtacctccggaactgaataatatttcaaagctgaacgaacatttctccaggttcggcacactcgtgaacttacaagtggcttataatggagaccccgaaggagccctcatccaattcgccacatatgaagaggctaagaaggccatatcctctacagaagcagtgctcaacaatcgtttcattaaggtgtactggcatcgggagggaagtacgcagcagctccaaacaacttcacccaaagtgatgcagccactggtccaacagccgatcctgccagtcgtgaagcaaagtgtaaaggagcgactaggtccagtgcccagctctaccatagagccagcagaggctcagtccgcatcctccgacctgccccagaacgtgacaaaattgagtgtgaaggaccgactgggcttcgtgagtaaaccctccgtgtccgccaccgagaaggtgctctcaacctcaaccggcctcaccaagaccgtctataaccctgccgctcttaaagcggctcaaaagacgctgctggttagcacctctgcggtggacaacaacgaggctcagaagaaaaaacaggaggccttaaagttgcaacaggacgtgcggaagcgcaagcaggaaattctagaaaagcacatcgagactcaaaagatgctgatcagcaaattagagaagaacaagacgatgaagtctgaggataaagcagaaatcatgaagaccctcgaggtgctgacaaagaacatcaccaaactcaaagatgaggtgaaagcggcttctccgggcagatgtctgccgaagtccattaagacaaaaacccagatgcaaaaggagctgctggacaccgaactggatctctataaaaagatgcaggctggggaggaagtgactgaattgaggcggaagtatactgagttgcaattagaagccgccaaaagaggaattttatcctcagggcgggggcgcggcattcactccaggggaagaggcgcagtgcacgggcgaggacggggcagagggcggggcaggggagtccccggtcacgctgtcgtggaccaccgcccccgggctcttgagatctcagctttcacagaatcggatcgcgaggatcttctgcctcatttcgcccaatacggggagatcgaggattgtcagatagatgatagcagtctccatgccgtgatcacgttcaaaactagggccgaggctgaagccgccgccgtccacggcgctcgttttaaagggcaggacctgaagctcgcctggaacaagcctgttactaatataagcgccgtcgaaaccgaagaagtggagcctgatgaagaggagttccaagaggagtccctagtggatgatagcctgctgcaggatgatgacgaagaggaggaggacaatgagagtcgctcttggaggaggtag

SEQ ID NO: 50729 - DNA, 2952 bp, Artificial Sequence
  Description of Artificial Sequence: Synthetic coding sequence
atggtgagcaagatgatcatcgagaacttcgaggccctgaagagctggctgagtaagacactggagccaatatgtgatgccgatcctagcgccttggccaagtatgtgctcgccctcgtgaaaaaagacaagtcggagaaagagctgaaggccctgtgtatcgatcagctggacgtgttcttgcagaaagaaacccaaatctttgtggagaaactattcgatgcagtgaacactaagagctacctgcccccaccagaacagccgtccagcgggagcctgaaagtggagttctttccccaccaggagaaagatattaagaaggaggagatcacaaaggaggaagaacgggagaaaaagtttagccgtaggctgaatcatagtcccccccagtctagcagccggtatcgtgagaatagatcaagggatgagcggaagaaagacgaccgctcccgcaagagggattacgatcgaaatccacccagaagagactcttatcgggatagatacaatcggagaagaggaaggtcccgatcctactcacgttccagatcaagatcgtggagcaaagagcgcttgagggaacgggatagggataggagccgtactcgtagccgttcaaggacccgatcgcgcgagagggatctggtaaagccaaagtacgacttagacagaacggatcccctggaaaacaattatacacctgtcagttcggttccttcaattagctctggccactacccagtgcccacactgtcatccacaatcacagtcatcgctccaacccaccatgggaataatacgaccgaatcgtggtccgagttccatgaagatcaggtcgatcataatagttatgtgcggcccccaatgcctaaaaaacgctgtagggattatgacgaaaagggcttctgtatgcgtggagatatgtgtcctttcgaccatgggtcagatcctgtggttgtggaggatgtgaacctcccgggcatgttaccgtttccagctcaacctcctgttgttgaaggaccgccaccccctggattgccaccccctccccccattctgacaccgccccctgtgaacttaagacctccggtgcccccacctgggccgctccccccgtcgctgccacccgttactggcccccctccacccctacctcctctccaaccatccggcatggatgcccctcccaactccgccaccagcagcgtgcccacagtggtgacgaccgggatccatcaccagccccccccagccccgccatccttattcacagctgatacctacgatactgacggctataaccccgaagccccatcaattactaacacctccaggccaatgtatcgccacagagtgcacgcacaaaggccaaatctgatcggactcacctctggtgatatggatctgcccccgcgcgagaaacccccaaataaaagctcaatgcggatcgtggtggactctgaatctcgcaagcggacaattggatctggagagcccggagttcctactaaaaagacctggtttgataaaccgaacttcaataggaccaacagcccggggttccagaaaaaggtgcagtttggtaacgaaaacaccaaactggaattgcgtaaggtcccccccgagctgaacaatatcagtaagcttaatgaacacttttcccggttcggaacccttgtgaacttgcaggtggcgtacaatggagatccagagggtgctttgatccagtttgcgacgtatgaggaggctaagaaggccatcagcagcaccgaggctgttctgaataatcggttcatcaaagtgtactggcatcgagagggatctacccaacagttgcaaactaccagtcccaaagtgatgcagccactggttcaacagcccatcctgcccgtggtcaaacagagcgtgaaggagaggctgggaccagtgcccagttctactatagagcccgccgaagcacagagtgctagctccgatctcccccaggtgctgtccacgtccacgggattgacaaagactgtatataatcctgctgcgttgaaagctgcacagaagactttgcttgtttcaacctcagcagtggacaataacgaagctcagaagaagaagcaggaggccctgaagctgcagcaagacgtgcgaaagagaaaacaggagatcctcgaaaagcacattgaaacccagaagatgctaattagcaaactggaaaagaacaagacaatgaagtctgaagacaaggctgaaataatgaagaccttggaggtactgaccaagaatataactaagctgaaagatgaggtgaaggcagcttctcccgggcgatgtctgcctaagagtattaagaccaaaacccaaatgcagaaagagcttctggataccgagttagatctgtataagaaaatgcaggccggagaagaagtcacagaactgcgcaggaaatacactgagttacagcttgaggcggcaaagcgaggaatactcagttcaggaagggggagaggaattcattcccggggccgaggagccgtacacggacggggcagaggccgcggcagaggacgaggtgtgccaggccacgccgtagttgatcaccggcctagagcgctagaaatttctgccttcaccgagagtgaccgcgaggatctcctgccacactttgctcaatatggcgagatagaagactgccagattgatgacagtagcttgcacgccgtgatcacctttaaaaccagagctgaagcggaagcggccgctgtccatggtgcgcgctttaaggggcaggacttaaagttagcttggaacaagcccgtgacaaacataagtgcggtagaaactgaggaggttgagccagacgaggaggagttccaggaggagtctctggtcgacgacagtctccttcaggacgatgatgaggaagaggaggacaacgagagccgatcctggcggaggtag

SEQ ID NO: 50730 - DNA, 807 bp, Artificial Sequence
  Description of Artificial Sequence: Synthetic coding sequence
atggccgccgccctgggcgccagcggcggcgccggcgccggcgacgacgatttcgaccagttcgataagcctggggcagagcggtcctggaggagacgggccgctgacgaggactgggatagcgagctggaagatgaccttctgggagaggacctgctgtctggcaagaagaaccagtccgatctgtcagacgaggagctgaatgatgacctgctccagagcgacaacgaagatgaggaaaattttagttcccaaggggtgacaataagtctcaatgcaaccagcggcatggttacttcttttgagttaagcgataacactaatgatcagtcgggcgaacaagaatcagagtacgagcaggaacagggtgaagatgagctggtataccataagtccgacggctccgagctttacacgcaagagtaccctgaggagggtcagtacgagggccatgaagctgaacttacagaggaccaaatcgagtatgtagaggagccagaggaagagcaactctacacggacgaggtcctggatatcgaaataaacgagcctctcgacgaattcactggcggtatggagacgctggagctgcaaaaggatattaaagaagagagtgacgaggaggaagaagatgatgaggagagcggtaggctgcgcttcaaaacggaacggaaggagggaaccatcatcaggctcagcgacgtgacacgtgagagacggaatattcccgagactctaggcaacttcttcgcatgtcttccttcctctttcactctgatcagtacgagcagcattgtattgctctag

SEQ ID NO: 50731 - DNA, 321 bp, Artificial Sequence
  Description of Artificial Sequence: Synthetic coding sequence
atgcacggccggggccggggcgtggccggccccatgggccggggcagactcatgcccaacaagcagaacttacgcgtagtcgagtgtaaaccacaaccttgcgtcgttagcgtcgaaggattgtcaagctctaccacagacgcgcagctcaagtccttgctcatgtctgtgggacccatccagtcgctgcaaatgctacctcagcagagaaaagccatcgcaaagttcaaagagcccgcccacgcgcttgccttccagcagaagttccaccgacacatgatagacctgtcccacatcaacgtggccctgatagtggagtag

SEQ ID NO: 50732 - DNA, 3513 bp, Artificial Sequence
  Description of Artificial Sequence: Synthetic coding sequence
atggccgccgccctgggcgccagcggcggcgccggcgccggcgacgatgatttcgatcagttcgataaacctggagccgaacgcagctggcgtcgaagagcggccgatgaggactgggatagtgaactcgaagacgatctcctcggcgaagatttgctgtcgggaaagaaaaatcagtccgatctgagcgacgaggagctaaatgatgaccttcttcagtccgataatgaagacgaggaaaatttcagttcacagggtgttacaattagcttgaacgcaacaagtggcatggtgacctcgtttgaactgtcagacaataccaacgaccaatccggtgaacaagagtcggagtacgaacaggaacagggcgaagatgagctggtgtatcataagtcagatgggagtgagctgtacacgcaggagtacccggaggagggtcagtacgaaggacatgaggcggaattgacagaagatcagatcgagtacgtggaggagccagaggaggaacagctttataccgacgaggtcctggacatcgaaattaacgagcccctggacgaattcacaggagggatggagacactcgaactccagaaagatatcaaggaagaatcagacgaggaggaagaagatgatgaggagtcaggaaggctacggtttaagactgagcgtaaagaaggcactatcattcgtttatccgacgtgacaagagagcgccgaaatatcccggagacactggagttgtcggccgaggcgaaggccgcattactggagttcgaggaaagagagaggcagcacaaacagggccgatacagctcgcggcgaggagggcgcaggggtggccccttaatgtgtcgtggcgtcggcgatcagagacgagagagtacagagaggggccggatgaaagatcaccgccccgcactgttacctacccagcctccagtcgtgccccaggctccgcccccaccaccacctccccctcaacagcagccgatacgatccctcttccaaccacagcctctccagccattgcttcctgtacagcacccacaccaccccagtcctccccagggcatgcacatgcccccccaactggagaccccaaggatgatgatgactccacctcccgtgaccccgcagcagccgaagaacatccacataaacccacacttcaagggtactgttgttacgcccgtacaggtccccctgttgcccgtaccatcacagccccgcccggccgtgggcccccagcggttcccgggacctcctgagttcccccagcatactcccggaccagttccaaattcattctctcagcccccacgcctccctctgcaggatcagtggagagcccctccccctccccaggacagggaccctttcttcctgggcgtctcgggcgaaccacgcttccccagccacctcttcctggaacagagaagcccaccgcccccaccgcctccccctactctgctaaattctagccacccggtaccaactcagagtccactgccttttacccagcctggccctgcatttaaccagcagggacagcagcctgtgttcccccgcgagagacccgtccggccagcacttcagccccctggaccggtaggtatcctgcatttttcccagcctggctctgcgacaacccggcccttcatcccaccaagacagcctttcttaccgggcccgggacaaccttttctgcctactcacacccaacccaacttgcagggtcctctgcaccctccactgccgcctccccatcaacctcagccgcagcaaccacagcagcagcccccaccacaacatcaacctcctcatcagccccctcaccaaccaccaccacagcaccagcctcctccccaacatccgcctcaacaccctcctcagcaccagcaccaccaccatcatcaccatctgagcgtgccccctccgccacttatgccaatgagccagccgcagtttagaccacacgtccagaccgcacagccgcaggcctcttcgagtaggatgcagtgtccacaaagacagggactaagacacaatacgacatcccaaaacgttagcaagcgacctatgcaacaaatgcagccaacagctcctaggaatagcaaccttcgtgagcttccaattgcacccagtcatgtgatagagatgagttcctcccgctgcagtgcaactccatccgcccaggttaagcctattgtctcagcatcccccccttctcgggcggtcgccggtagcagaagcagccagggcaagaccgaagtaaaggtcaaaccggcctctccggtggcacaaccaaaagaagaagctaagactgaaaccgagtttccagacgaggacgaggagactcgcctatataggctcaaaattgaggagcagaagcgccttagagaggagatactgaagcagaaagagctgagacggcagcagcaggccggcgcacggaagaaagagcttttagaaagactggcgcaacagcagcagcagctgtacgctccacctccacccgccgaacaagaagaacaggccctgtccccatctcccacaaatggcaatcccttgctaccctttccaggcgcgcaagtgcgacagaatgtgaaaaatcgtctcctcgtcaagaaccaggacgtgagcatttccaatgtgcagccgaaaacctccaactttgtaccaagctccgccaatatgcagtaccagggacagcagatgaaggccctgaagcatctcaggcaaacccgcactgtcccccaaagtcagacccagccattgcataaggtgctgccgattaaaccagccgacgtggaggaaccagcggtcccgcagacccctcgggttgctagcatacaaggacgcccccaggacactaagcccggggtgaaaaggaccgtaacccatcggactaactcaggcggaggcgacggacctcacatctcatctaaggtcagagtgatcaagctgagtgggggtggaggggagagcgacggctttttccacccagaagggcagccacagcgactgccccagccaccagaagtcgggcctcagccagctagaaaagtaacactgactcggggaggtctgcagcaacctcctcatctccctgcgggcccacacgcccattcccccgtgccaccaggcatcaagtccattcagggcattcacccggcaaaaaaggcgatcatgcacgggagaggtagaggggtggccgggccaatggggcggggacgactcatgcccaacaagcagaatctgagggttgttgaatgtaagcctcagccatgcgtcgtttccgtggagggcctgtcttcctcaaccactgatgcccaactcaagtccttgctaatgtctgtcgggcctatccagagcctgcagatgttaccacagcagcgtaaagccattgccaagtttaaagagccagcgcatgctcttgcattccagcaaaagttccatagacatatgatcgacctgtcgcatattaacgtggccctcatcgtagagtag

SEQ ID NO: 50733 - DNA, 87 bp, Artificial Sequence
  Description of Artificial Sequence: Synthetic coding sequence
atgcacggccggggccggggcgtggccggccccatgggccggggccgcctcatgcccaacaaacagaacttgcgcgtggtcgaatag

SEQ ID NO: 50734 - DNA, 1278 bp, Artificial Sequence
  Description of Artificial Sequence: Synthetic coding sequence
atgagcaagcggaagcggaagcggagcgtgcaggagggcgagaaccctgacgacggcgtcagaggttcccctccagaggactatagactaggacaagtcgctagtagcttgttccgcggagagcaccacagccggggtggaacaggacgactggccagcctgttttcttccctggaaccacaaattcaaccggtgtatgtgccagtgcccaaacagacgatcaaaaagactaagcggaacgaggaggaagagtccacgagtcagattgagaggccactttctcaggaaccagcaaaaaaagtcaaagctaagaagaaacacacaaacgctgaaaaaaaacttgctgaccgcgagtcggcgctggcatctgccgaccttgaggaggagatccaccagaaacagggtcagaaacgaaagaattcccagcctggcgtgaaagtagcagatagaaaaattttggatgataccgaggacactgttgtgtcccaaagaaaaaaaatccagatcaatcaggaagaagagcggctcaagaacgagaggacggtcttcgtcggaaacctgcccgtgacttgtaataaaaagaagctgaagtcatttttcaaggaatatgggcagattgaatcagtgcggtttcgctctctcattcctgcggaaggaactctatccaaaaaactagcggcaattaagcggaaaattcatccggatcagaaaaacatcaacgcgtacgtggtgtttaaggaggagagtgccgcaacacaagcactgaagcgcaacggcgcccagattgcggatggattcaggattcgggttgatctggcatcagagaccagctctcgggataagaggtcagtatttgtcggcaacctgccttacaaagttgaagaaagtgccattgaaaaacattttctggactgtggctcaattatggcggtgcggatagtaagagacaagatgaccggaatcgggaaggggttcggctatgtgctgtttgagaatacagactctgtgcatcttgccctcaagctgaataatagcgaactgatggggagaaaactcagagttatgcgtagtgtgaataaggaaaaattcaagcagcagaactctaaccctcgtctcaagaacgttagtaagccaaagcagggtcttaatttcacttcaaaaactgctgaaggacaccccaagtccctcttcataggagagaaagccgttttattaaaaaccaagaaaaagggccaaaagaagtcagggaggcctaaaaagcagcggaagcagaaatag

SEQ ID NO: 50735 - DNA, 936 bp, Artificial Sequence
  Description of Artificial Sequence: Synthetic coding sequence
atgaagcgggtgaacagctgcgtgaagagcgacgagcacgtgctggaggaactggagaccgagggcgagaggcagcttaagtctctgctgcagcaccagttggacacttctgtgtccatcgaggagtgcatgtctaaaaaggagtcgttcgccccgggcaccatgtataagccatttgggaaagaagctgctggaacaatgaccttgtcacagttccaaactttgcatgagaaggatcaggagacagcttctctgagggagctgggcttgaatgagaccgaaatcctcatttggaagtcccacgtcagcggggagaagaagacaaagctccgggccacacccgaggcaatccagaaccgcctccaggacatcgaagaacggatatcagaaaggcaaaggattctctgcctgcctcagcgtttcgctaagtccaaacagctgaccaggagggaaatggaaatcgaaaagtcactgtttcagggggctgacaggcatagctttctgaaagctctctactatcaggcttaccacaaaaagaccagcgcagataaatacatgacgagtatgaagagaaaaatcaagctgggcacaaaagacgaacctcagaaaaagaataagggagacccgatgaataacctcgagtcattttaccaggaaatgattatgaagaagagactggaggagttccagctcatgcggggtctgacctcattcccacgggaagattttcaaaatctgtcctacgaaggcacaaccagcgtgctcggcgctaagtggcaaaagcggacgggccgaaccagcacgttctcaattctcctggtgtcactgctctccgagacggtgttcacatccagcgctatgtacgggatcccacacctcttaaccatgtctcttaagtttagcactcgaatcggaaagttgtcattcaccccttag

SEQ ID NO: 50736 - DNA, 1242 bp, Artificial Sequence
  Description of Artificial Sequence: Synthetic coding sequence
atgaagcgggtgaacagctgcgtgaagagcgacgagcacgtgctggaggagttggaaactgaaggagagagacaactaaaatctctattgcagcaccagttggacacctcggtatcaattgaggagtgcatgagcaaaaaagaatcttttgctcccggcactatgtacaagccattcggaaaggaagcagctggaacaatgaccctatcacagttccaaaccctccacgaaaaggatcaagaaacagcatcactgcgggagctcggtctgaatgagacagaaattttaatctggaaatcccacgtgagcggggagaagaagaccaagttgcgcgcaacccccgaggctatacagaatcgtctgcaggatatcgaagaacgcataagtgagagacagagaatcctttgcctgccacagcgcttcgctaagagcaaacagctgactcggcgagagatggagattgagaagtcactgtttcaaggcgctgatcgacacagcttcctaaaggcactgtattatcaggacgagcctcagaaaaagaataagggagaccctatgaacaacctcgagtctttctaccaggagatgatcatgaagaaacgcctcgaagaatttcagctgatgcgaggagagccctttgctagtcacagtcttgtgagcgccacctctgtcggggacagcgggactgcggagagcccctccctgctgcaagacaaaggaaagcaggccgcccagggcaaaggaccttctcttcatgttgccaacgtgattgatttcagcccagagcagtgttggacgggaccaaaaaagcttacacaacccatcgaatttgtgcccgaggatgaaatccagcgtaacagactttccgaggaagaaattcgcaagatccccatgttctcctcatataatccgggcgagccgaacaaggtgctctatcttaaaaacttgtcgccccgcgtcaccgagagagatctggtctccttatttgctcgattccaggaaaaaaagggtccaccaatccaatttagaatgatgacagggcgaatgaggggccaagccttcatcactttccctaacaaggaaattgcctggcaggcgcttcacctggttaatggctacaaattgcacgggaagatccttgtcatcgagtttgggaaaaataagaagcagagaagtaacctgcaggccacctcccttatatcctgtgccaccggcagcactactgaaatctcaggcagttag

SEQ ID NO: 50737 - DNA, 618 bp, Artificial Sequence
  Description of Artificial Sequence: Synthetic coding sequence
atgaagcgggtgaacagctgcgtgaagagcgacgagcacgtgctggaggagttggaaacagagggagaaagacagctcaagtctttgctccagcaccaattggatacctccgtgtcaatcgaagagtgcatgtctaagaaggagtcttttgcccctggtacaatgtacaagcctttcgggaaagaagcggcaggcaccatgaccctgtctcagtttcagactctccacgagaaagaccaggagacagccagcctgcgcgagctggggctgaacgagactgaaatcctgatatggaaatcgcacgtatccggggaaaaaaaaaccaagctgcgggcgacgccagaagcaattcaaaaccggctgcaggatatcgaggagcggattagtgaacgtcaacgcatcctgtgtctcccacagagatttgcaaaatctaaacagctaacacgtcgagagatggagatagagaagagcctgtttcaaggcgcagacagacactcctttctgaaagctctctattaccaggcttaccacaaaaaaacaagtgccgataaatacatgacctctatgaagaggaaaatcaaacttggaacaaagggcattatccctaaccccccttag

SEQ ID NO: 50738 - DNA, 1218 bp, Artificial Sequence
  Description of Artificial Sequence: Synthetic coding sequence
atgaagcgggtgaacagctgcgtgaagagcgacgagcacgtgctggaggagttggagacagaaggcgaacggcaactgaagtctcttctgcagcaccaacttgacacatctgtgtctatcgaagagtgtatgtccaaaaaagaatccttcgcccctggtactatgtataaacccttcggtaaggaggccgcagggactatgactctaagtcagtttcagacgctgcacgaaaaagaccaggagactgcctcgcttcgagaactgggcctcaacgaaaccgaaattctgatttggaagtctcacgtttccggcgagaaaaaaaccaagttgcgggccacgcctgaggcaattcagaatcgcctgcaggacatagaggaaagaatttccgaacgtcaaaggattctctgtttgccccagcgattcgcaaagagtaagcagctcactcggcgtgagatggagattgaaaagtcgctgtttcaaggcgcggaccgtcacagctttctgaaggctttgtattaccaggatgagccccagaagaaaaataagggggacccaatgaataatctcgaaagcttctatcaggaaatgatcatgaagaagcgcctggaagagttccagctgatgagaggggagcccttcgcctctcacagtttagtttcagcgaccagcgtcggagactcaggtacggctgaatcaccaagtctgctgcaggataaagggaagcaggcagcacagggaaagggccccagtctccatgtcgcaaacgtgattgatttttcgcccgagcagtgctggacaggaccgaaaaaactgacccagcccattgaatttgttcctgaggacgagattcagcggaaccggctgtctgaggaggaaatacgcaaaattcctatgttctcctcctacaaccccggtgaaccgaataaggtgctgtatctgaagaacctgtcccccagagtgactgagcgggacctggtgagcctcttcgcaagatttcaagaaaaaaaaggaccacccatccaatttcgaatgatgacaggccggatgcgcgggcaggccttcatcacgtttcctaataaggaaattgcctggcaggcacttcacctcgtcaacgggtataagctgcacggtaagatactggtgatcgaattcgggaaaaacaagaaacaacgcagcaatctccaggccacgtccttaattagttgcgctaccggctag

SEQ ID NO: 50739 - DNA, 612 bp, Artificial Sequence
  Description of Artificial Sequence: Synthetic coding sequence
tgagtgaacagctgcgtgaagagcgacgagcacgtgctggaggagctggagactgagggcgaaagacagcttaaatccttgttgcagcaccagttagatacttccgtctctattgaagagtgcatgagcaaaaaagagtcctttgcccctggcactatgtacaagccctttgggaaggaagccgctggcacaatgacactcagccagttccagaccctccacgagaaggaccaggaaaccgcatcgctgcgcgaactcgggctcaatgaaactgagatcctgatctggaaaagccacgtgagtggcgagaaaaaaaccaaactgcgagcgactcctgaggcaatccagaatcggctgcaagacatagaggagcgtatttcagaacgccagagaattctatgtctgccccagcggtttgccaaatcgaaacagctaactaggcgggagatggaaattgagaaatccctgttccagggagcggatcgacactcttttctgaaggctctttattatcaggcttatcacaagaagacatccgccgacaaatacatgacatccatgaagaggaagataaagttgggaaccaagggaataattcccgaagagccatag

SEQ ID NO: 50740 - DNA, 3159 bp, Artificial Sequence
  Description of Artificial Sequence: Synthetic coding sequence
atgatgcaggccaccgccgtggtggagaccgccagcggcaagggctaccatagcaacggcggaaatctgcagaaagacaaaccttcaaatcctaaaaaggagaatctccttctcagctcgaacgggtgtgatgaagttaagctgaccttccccgacgacgactggaattcgagtacactcgaacaacgggccaataataaagaaatctccaacattgataaaatggacctgcttgagccatttttcagcgtgtcccaggatacaaatactgaaagcacgcagtttcaatccagcgagctggaggactccaccgactacgcttttctaaacaaaacatactccatcccgtactccgaatctaagctgaagaaggagagtctcactcctctctcttccgaactagatcccgaggtgcagaagaaggaagaagtcttttttaatatcctcgaacaccaggacaagactgttgggctagagcgtatttacaacataagtgacgccaattatcgcgagtccgcagaggatacccagaagcatgacacagatgaagactcccagcaagaataccacagcgccgaggagcaagaatatatttcaaaccatctctctttcgaccagacaaaggcgctggacattagcaaccccgaggtggtagagttgggaaactcagggtacgaggtgaaatgtgcaagcaacgtcgaggacaaccgggtcaactccggctcagggtctatcatctccttcgactcgctggacgtttatggacaggaggagtccctacacgtaagcaaattccaaaattctgtcatgcttcgggagtaccacgatctcaagcacgaaaaatacaaagagcaggagaccaactccatgtaccataccgtgttcgacggtagtgtgctgcgcagtaactccccagggaaccaagaatctcagagtaaatcagggtctctgtctccccaaaaagttcttaagatgaagatttatacagagaatatgaaatcccaaatcaacgaaggaaaagacttttgtgggaacaaaatcgtggagaataaaatacttctgcacctggaaaatcccagcacacttccccaagataaagctcttgagacgctgctacagccatgcaaggactgtcaaactagctggactagcgtgttcgacgacagtattatcagcgcttgcggttactacgaatcccttcagaatactgccgacagtgccctagacttcagcgctatgctccctaagattgccgtgagagacaaccaggccatcgaggacaacacatccctgaaggtcgcccacagcagtactacaaaaaaaacatgcttccataatattggagagatgtgtacaaaatccctgaccgatgcggcgagctgtacagtgacaatcaaccaaaccgtggatgtgagcacagacttcagggcgtgcttcacaaccagtcgcgccacgtccgcccggccttctgtggtgtcaacatcaagcaatacagaaataactatgatgaataagaagagaccagatgagtggcagaacgagaaacaaaaatctgtggcttgtagtacagattggagctactcagaggactgcatagacacccagatggccattaccaaaggcagtggtaagagcctgtctgtcgactcactgaagcccaacggaaattttttaaacaaggactttctggaactgcgtaaggcttgcggaatcaccgacttgaagaaacatcccgagcgagaatttcagctgttcaaagataccgagaaagatctgcctagcatgtgttgccaaaagataatgcagcgagccattaaggctgagctccatctgctaaacgtacactaccagatgtgccgacggcactgttgcgacatctacaaactggttatggaaaatcgagagggactcaacatgaacctttccagcaacagcgctaaaaaagaacttggatctgctctgttaagcttgctcggggatctcaaggtacgatacgtgacacttaaggagaagattcacaaaggaatccctctcgaggaactcccaccactgtcccttgagtctaagctcttaagtacattttcgacttttgcctctcggttgatgaagaaggaaacacatgtgtttagcgaagccgatgccgaacaggataaccaaagggcacatgatgttgacgttagcagcaacctaaagaaaacactgtctcagatgtccttaagttccgataactctcatgccacacaaaatatatcgcccaaaaaagatgacttcaaaaatggggatattaatgctgatttttcccagctgaagctgggagacaaggattgccgccattaccaggaaacctctgaagattggagtgatgccaaagagtctctcaccggcgttgatgtgagtggtacacagggaaatcaggtggagcaggacacttggaacttggatctgactggcgaaatgaaaaatgtggagccgtctcagagggataaaggctatttgattcacgtgggcgggctgtgcccatctgtatccgaagctgatttacggtcacatttccagaagtaccaggtgagcgagattagcatctacgattcaactaattataggtacgcatctctggccttcactaaaaactccgatgcaaagatcgcagtgaaggagatgaatggcatcgagattaatggcaagtctgtgaatgtttggcctgttaagattctgggtgagtacacctcgccactgtcctccaagaacggaaatagaatttcatccaacaatctagaaaaatccaccaataagcagatacactcagaattctctataagccgtctcccgcgaactaggccacgacagctgggatccgagcaggacagcgaggtgtttccaagcgaccagggagtcaagaagaactgtaagcagattgagtccgccaaattactacccgacacaccagttcaatttattccccctaatactctcaatctccggagcttcacaaagatcatcaagaggctagctgaactgcaccccgaggtgtcacgcgatcatataattaacgccctccaggaggttcggatccgccataaaggttttctgaatggcctgtcaattaccacgatcgtcgaaatgacctcttcgctgttaaagaactcggcctcttcttag

SEQ ID NO: 50741 - DNA, 3159 bp, Artificial Sequence
  Description of Artificial Sequence: Synthetic coding sequence
atgatgcaggccaccgccgtggtggagaccgccagcggcaagggctatcacagtaatggcggaaacctgcaaaaagacaagccttcaaatcctaaaaaggagaacctcctgttgagctctaatggttgtgacgaagtcaagctcactttccccgacgatgattggaactcttcgaccctagagcagcgagccaataacaaggagataagtaacatagacaagatggacctgctggagcccttcttctcagtcagtcaggatacaaacaccgagtccacacagttccaatccagcgagcttgaagattccactgactacgccttcctgaacaagacctattcaattccgtacagtgagtctaagttaaagaaagaatcactaacacctctctctagcgaactggaccctgaagtgcagaaaaaagaggaggtgttttttaatattctagaacaccaggataaaaccgtgggactggaacgaatctataatatcagcgatgccaattacagggaatctgctgaggatactcagaagcatgatacagatgaagacagccagcaagagtaccacagcgccgaggagcaggaatacatctcaaaccatctgtcttttgaccagacaaaggctttggatatcagcaatcctgaggtggttgagttaggtaacagcggctacgaagtcaaatgtgcttccaatgtcgaggataacagggtgaatagcgggtccgggtctatcatatctttcgactcactggacgtgtacggtcaggaagaaagcctccacgtcagcaagtttcagaattcagttatgttgcgcgagtatcacgacctaaagcacgagaaatacaaagaacaggaaacgaactcaatgtatcacactgtcttcgacgggagcgtgctgagaagtaactcgccaggcaatcaggagagccaatctaaatccgggtctttgagcccacagaaagtgctgaagatgaagatctatacagagaacatgaaaagtcagatcaacgaggggaaggacttttgcggcaacaaaattgtagaaaacaaaattctgcttcatctcgaaaatccatccaccctgccccaggacaaagccctcgagactcttctgcagccttgcaaggactgtcaaaccagttggactagcgtgttcgacgattctatcatctcagcatgtggatattacgagagcctccagaacacagccgacagtgccctcgatttcagcgccatgctcccaaagattgcagtccgtgacaatcaggcaatcgaagataatacctccctgaaggtcgctcacagttccacaaccaagaagacctgctttcataatataggcgagatgtgtactaagtcacttacggacgccgccagctgcaccgttacgataaatcagacagtagatgtgagcactgatttcagagcttgcttcacaacaagtagggctacctctgcccggccctctgttgtcagtacctcttctaatactgaaataacaatgatgaacaagaaacgccccgatgagtggcagaatgaaaaacagaagtcagtggcatgcagtaccgattggtcttattcagaagattgtatcgacacacaaatggcgatcacaaagggctccggcaaatccttgtccgtggatagcctgaagccaaatgggaattttttgaataaagattttctggagctccggaaagcctgcggaatcaccgatcttaagaagcatccagaaagggagtttcaactgtttaaggataccgagaaggatctacccagcatgtgctgccaaaaaattatgcaaagagcaattaaagccgagctgcacttgttgaacgtgcactaccagatgtgtcgtcggcactgctgcgacatttataagctggtgatggagaatcgagaaggcctcaacatgaacctgtccagcaatagcgccaagaaggaattagggagtgctctcctgtccctgctaggggatctcaaggttagatacgttacacttaaggaaaaaattcataagggtatccccctggaggaactgccaccgctctctctcgaatccaaactgttgagcacctttagcacttttgcgtcccgtctgatgaaaaaagagacgcacgttttcagcgaggcggatgcagaacaggataatcagcgagcacacgatgtggatgtcagctcaaatctgaagaagactctctcccaaatgtcactctcatctgataattctcacgccactcagaatattagtcctaagaaggatgattttaagaacggcgatataaacgccgatttttcacagctgaaattgggtgataaggattgcaggcactatcaagagacctcagaggattggagcgatgcaaaagaatccttgaccggcgtggacgtgtccggcactcagggcaatcaggtggagcaggatacttggaatctcgatcttaccggagaaatgaagaacgttgaaccttcacagagggataagggttatctgatacacgttggaggtctttgtcccagtgtaagtgaagcagatctccgctctcattttcagaagtaccaggtctccgagatcagtatctatgatagcaccaactatcggtacgctagccttgcattcacaaagaactccgacgccaaaatagcggtgaaagaaatgaatgggattgagatcaacgggaagagcgtgaatgtttggcccgtgaagatcctcggcgagtacacaagccccctcagcagtaagaacggcaaccgcatttcgagcaataatcttgaaaagtccaccaataaacagattcattccgagttttccataagcagactgcctaggaccaggcccaggcagcttggaagcgaacaggactctgaagtctttcccagcgaccagggggtcaaaaaaaactgcaagcagatagagtccgccaagctactcccggatactccggtccagtttattccaccaaacactctgaatctccgttcatttactaagatcattaagaggctggcggagcttcatccagaagtcagtagagaccatatcatcaatgccctgcaggaggtacgtatcaggcataaaggtttcctcaatggccttagcatcaccaccatcgtcgaaatgaccagcagcctgctgaagaactccgcttcgtcttag

SEQ ID NO: 50742 - DNA, 1602 bp, Artificial Sequence
  Description of Artificial Sequence: Synthetic coding sequence
atgaacgaggagaacatcgacggcaccaacggctgcagcaaggtgagaacggggatccaaaacgaagcggcactgctcgccctgatggaaaaaaccgggtataacatggtccaggagaacggtcagcgcaagttcggcggcccaccgccaggttgggaaggtccccctccaccgagaggatgtgaggtgtttgtggggaaaatccctcgtgacatgtatgaggacgagttggtacctgtcttcgaaagagccgggaaaatttatgaattcaggctgatgatggagttctcgggagagaatcggggttacgccttcgtaatgtatactaccaaagaggaagctcagttggcgattcggattctgaataattatgaaatccggcccggaaagttcatcggcgtgtgcgtgagtctggataactgccgcctctttatcggagccattcctaaggagaagaagaaggaagagattcttgacgagatgaaaaaggtcacagagggggtcgtcgacgttatagtgtacccttccgcaacagacaaaacgaagaaccgagggtttgcattcgtggaatatgagtcccaccgggccgccgccatggcccgtcgtaagctgattcctggcacattccagctgtggggtcacaccattcaggtcgactgggccgatcctgagaaggaagtcgatgaggagacgatgcagcgcgttaaagtcctgtatgtgcgaaatctgatgatcagcaccacagaggagacaattaaggccgagtttaacaaatttaaaccaggtgctgtcgaaagggtcaaaaagctgcgagattacgcttttgtccatttctttaacagggaggacgctgttgcagcaatgtcggtcatgaacgggaagtgtattgacggagcatcaatagaagtcaccttggccaaaccagtgaataaggagaacacttggcgtcagcatctgaatgggcagatctccccgaattcggagaatctgatcgtgtttgcaaacaaggaggagtcccatcccaagaccctgggtaaactacctactttgcctgcccggctgaatggacagcactcacccagtcctccagaggttgaaaggtgtacttatcccttttaccctggtacaaaactcacccctatctccatgtacagcctgaagtctaatcatttcaattccgccgtcatgcacttggattactattgtaataaaaataattgggctcccccggagtattacctgtactccaccaccagccaggatggcaaagtgttactcgtgtacaaaatcgtgattccagccatcgcgaatgggagtcagtcgtacttcatgccagataagttgtgtacaactttggaggatgccaaggagctggcggcccaattcactctattgcacttggattataactttcaccgatccagtatcaactcattgtcccccgtgagcgctaccctatctagcggcacaccctcagttctcccatacacttcacggccttactcctatccaggctacccactgtcgcccaccatcagtcttgcaaatggatcccacgtcggtcaaagactgtgcatttccaatcaagccagttttttttag

SEQ ID NO: 50743 - DNA, 1104 bp, Artificial Sequence
  Description of Artificial Sequence: Synthetic coding sequence
atggccagcagcggcggcgagctgggcagcctgttcgaccaccacgtccagcgggcggtatgtgataccagggctaaatatcgcgaaggacggagaccaagagctgtgaaagtgtacactattaacctggagtctcagtacctgttgatacaaggtgtacccgcggtgggggtgatgaaggagctggtggagaggttcgcactgtacggggccatagagcagtacaacgccctggacgaatatcccgcggaggactttacagaggtatacttaattaagtttatgaatctgcagagtgcccgaacagcaaagaggaagatggacgagcagtccttttttggcggcctgctccatgtatgttatgctccagaatttgagactgttgaagagacacgcaaaaagttgcaaatgcgtaaggcctacgtggtcaagacaaccgagaataaggaccactacgttaccaagaaaaaactggtcaccgagcataaggatactgaagatttccggcaggactttcactccgaaatgtccggtttttgtaaagcagcactgaacaccagcgccggcaacagcaacccgtatttgccctactcttgtgaactgcctctatgctacttctccagtaagtgtatgtgttctagcggaggacctgtggatcgggctcccgattcttcaaaggatggccgtaaccaccataaaaccatgggacactacaaccataatgactcactgaggaaaacacagataaacagcctgaagaatagtgtcgcctgcccaggggcgcagaaggctatcacaagtagcgaagccgttgaccgctttatgcctcgcacaactcagctgcaagaacggaagcgcagaagagaagacgatcgtaagctaggcacattcctccagaccaacccgaccggcaacgaaataatgattggacccctgttaccagacattagtaaagtagatatgcacgacgactccctaaacaccactgcgaatctgatacgtcacaaactgaaagaagtcatcagcagcgtgccaaaacctcccgaggataaaccagaagacgtgcataccagtcacccgcttaagcagcgccggcggatctag

SEQ ID NO: 50744 - DNA, 1083 bp, Artificial Sequence
  Description of Artificial Sequence: Synthetic coding sequence
atggccagcagcggcggcgagctgggcagcctgttcgaccaccacgtccaaagagcagtgtgtgatactcgtgccaagtatcgggagggcaggaggccacgggctgtaaaagtttataccatcaacctggaatctcaatatctgctcatccagggagtcccagccgtgggggttatgaaggagctggtggaacggtttgcactctacggagccattgagcaatacaatgctcttgatgaatatccggctgaagactttaccgaagtctacctcattaagttcatgaatctccaatcagccaggacagccaaacgcaaaatggacgagcagagctttttcggggggcttctgcatgtgtgttacgctcccgagttcgagaccgtggaggaaacccgaaagaagctgcagatgcgaaaagcttatgttgtgaaaacaactgagaataaggatcattacgtaacgaaaaagaagttggttacggagcataaggacaccgaggactttaggcaggatttccatagcgagatgagtgggttctgcaaagccgcactgaacacgagtgctggaaactccaacccatacctgccttatagctgcgagttgcctctgtgttacttcagcagcaagtgtatgtgttcatctggagggcctgtagatagggcccccgacagcagcaaggatggcagaaaccaccacaagacgatgggccattataatcataatgactctctgcggaaaacacaaatcaactccctcaagaactcggttgcctgcccaggtgctcagaaagccatcacgagctccgaggcagtcgatcgatttatgccccggaccacccagctgcaggagagaaagcgtcgccgcgaggacgatagaaaactggggaccttcttacagaccaacccaactggtaacgagatcatgattggaccactccttcccgacatcagtaaggttgatatgcacgacgattccttaaacacaaccgctaatttaatccgtcacaaactaaaagaagtgtttcacctgtgccaaagtctccagcgcaccagtcaaaaaatgtatatccaggttattcactag

SEQ ID NO: 50745 - DNA, 381 bp, Artificial Sequence
  Description of Artificial Sequence: Synthetic coding sequence
ggcaagatggccagcagcggcggcgagctgggcagcctgttcgaccaccacgttcagcgtgcggtgtgcgatactcgggcgaaataccgggaagggaggcggccgcgtgcagtcaaggtctataccattaacttggaaagtcagtacctcctgatccagggggtgccagccgttggcgtaatgaaagagctggttgagaggttcgccttatatggtgccatagagcagtacaacgccctcgatgagtatcccgcagaagacttcactgaagtgtatctgatcaagtttatgaacttgcagtcagctaggacagcgaagcgcaaaatggacgagcagtctttcttttggattgcttcatgtgtgctgtgctccagaatttag

SEQ ID NO: 50746 - DNA, 969 bp, Artificial Sequence
  Description of Artificial Sequence: Synthetic coding sequence
atgaaccccctgaccaaggtgaagctgatcaacgagctgaacgagcgtgaagtgcagttgggcgttgcagacaaagtatcatggcattctgaatataaggactccgcctggatattccttggcggcctgccttatgagcttacagagggtgacatcatatgcgtgttttctcagtacggtgaaatcgtaaatatcaatctggttcgtgacaagaaaacaggcaagtcaaagggtttttgttttctgtgttatgaagatcagcggagcacaattttagcggttgacaacttcaacggcataaaaattaagggccgaaccatacgcgtggatcatgtgtcgaactaccgagcccccaaagatagtgaagaaatcgatgacgtaactcgacaactgcaggagaagggctgcggagcccgcaccccctctcctagcttgtcagagagctccgaggatgagaagcctacgaagaagcacaagaaagataaaaaggagaagaagaaaaagaagaaagagaaggagaaggcagaccgggaggtgcaggcggagcagcccagctcatcaagcccacggaggaagacggtgaaagaaaaggatgacacaggtcctaagaaacactcctcgaaaaatagtgagcgagctcagaagtccgaacctcgggaagggcaaaaactcccaaagagcagaacagcgtattccggtggtgccgaggatttggagagggagctcaagaaggagaagccaaagcacgagcataaatccagcagccggagggaagctcgagaggagaaaacaagaatcagggacaggggccggtcttccgacgcccactcatcctggtacaacgggcgttccgaaggacggagctaccgctctcggtccagatcgcgggataagagccatcgccacaaaagggcccggagatcgagggagcgggagtcgtcaaatccatcagatcgctggcggcactag

SEQ ID NO: 50747 - DNA, 177 bp, Artificial Sequence
  Description of Artificial Sequence: Synthetic coding sequence
atgaaccccctgaccaaggtgaagctgatcaacgagctgaacgagcgcgaggtccaactgggcgtggctgacaaggttagctggcatagtgagtacaaggactcagcatggattttcctggggggactcccatatgagcttacagaaggcgatataatttgtgtgtttagccagtag

SEQ ID NO: 50748 - DNA, 828 bp, Artificial Sequence
  Description of Artificial Sequence: Synthetic coding sequence
atgaaccccctgaccaaggtgaagctgatcaacgagctgaacgagagggaggtgcaactgggggtcgcagataaggtgagttggcatagtgagtacaaagactccgcctggatctttcttggagggctgccgtacgagttaaccgaaggtgacattatctgcgtattttcccaatacggtgaaatagtgaacatcaacttggtgcgcgacaaaaaaaccgggaaatctaagggcttctgctttctgtgttacgaggaccagcgctccaccattttagctgtggataatttcaacggcatcaagattaagggtaggacaattagggttgaccacgtttccaattacagagcccccaaggatagtgaagaaatcgatgacgttaccaggcagctgcaagaaaaggggtgcggagcgagaaccccatcgccaagcctatccgagtcttctgaagatgaaaagcccacaaagaaacataagaaagataaaaaagagaaaaaaaagaagaaaaaggaaaaggagaaagcagaccgagaggttcaggcagagcaaccttcaagctcctctccccgcagaaagacagttaaggaaaaggacgacaccggccctaaaaaacacagcagcaagaattctgaaagggcacagaaaagtgagccccgcgaaggtcagaagctgccaaaatccaggacagcctactctgggggggccgaagatcttgagcgagagttgaaaaaggagaagcctaaacacgagcacaagtcatcaagcagaagagaagcacgtgaagagaagacaaggattagggatcgaggcctcaggtgcactttttag

SEQ ID NO: 50749 - DNA, 3204 bp, Artificial Sequence
  Description of Artificial Sequence: Synthetic coding sequence
atgatggaggccgaccggcccgagaagctgttcatcggcggcctgaatctgaagaccgatgagaaagcgcttaaggcagaatttggcaagtatgggcacattatcaaagtgttccttatgaaggaccggaaaaccaataagtcgcggggattcgcattcgtaaccttcgagagtcccgctgacgcaaaagccgcagcccgggacatgaacggaaagtatttggacggcaaggctattatggttgcccagactatcaagcctgcattcaaatccagtagatgggtgcctcccacaccgggttctgggagtcggtccagatttagccaccgcactcgcgggggaggcagcagcccgcagagacctccttcacagggccgccctgatgacgggcgaggctatgcgggctattttgacctttggccttatagagcccccatgcctcgtaagcgaggacctcctcccagacattgggcctcaccgccgcacaaacgcgctacccctagttctctcgcacatagtgtgggatgcggcatgcggggcaaggctcccaccgtctccgggcaagacggctactccggactccagcccaggagatgggccggacctccgcacaagcgggccgtgccgagaagcagcttggctagaatcggaggatccggaatgcccgggaaggcgcccgctgtttggggccaggacgggtatagcggccctcgggtcagggagccccttcccccctgtagggatcccggggacttcgtgcctgcgctaagagattactcccgacgctattacggccacagttctgtgccggactataggcccctgaggggtgacggtaaccagaatggttacagagggagagaccacgagtacacggatcaccctagtaagggttcctaccgagagccgctgaagtcatacggtggaccctgtggcgccgcccccgtgtggggcaccccgcccagttacgggggtgggtgcaggtacgaggaatatcagggtaactcacccgacgcttgttccgaagggcggagctccgaggccttgcccgtcgtactgccagatgcttacagtcgtgaccatagcccaaaggcttactccggcgggaggagctcctcaagtaatgggtactctagatctgaccggtacggcgaggaggggtgctacgaagaatataggggtaggagtcccgacgctcatagcggaggacgcaactcaagcagtaacagctatggccagtcgcatcattacggcggcgaaggccgttacgaggaatacagaggcaggagccatgaagcccgttcaggaggacgaagtaccgacgcccactcccggggccgcagcgacgatgcttactccggaggccatgactccagttcttggagcgactgttgcggcgggggcgggcggtacgaagaatatcaaggtaggagtttggatgccaactctggcggctgctctcctgaggcctatagcggcgggcacgacaatagcagttggtcggaccgttacggagttggaggccattatgaagagaatcggggccattccctggatgcaaatagcggagggaggtctcccgatacccacagcggaggtcattcttcatcttctaattcctacggtcagagtcacaggtatggaggcgaaggacggtatgagtaccggggacgatctcacgatgctcacagtggcggctgctctgccgatgcgtacagcggagggcatgacagctctagtcaaagcaataggtacggaggcggagggtgctatgaagagtaccggggaaggagccttgatgctaattccggggggcgtagccccaatgcctacagtggagggcacgacagctccagctggagccatagatacggtgggggaggaaggtacgaggagtaccgtggacgctctctggatgccaatagtggcggtcgatctccagatgcttattcggggggccatgactctagcggacaatcaaattgttatggtggagggggacgctacgaagaataccgaggaagactcctcgacgctaattccgggggacgatctccggatgcttactccggcggccacgattcttctagtcagtcaaatagatacggtggggggggtcggtatgaagagtatcgtggccactcgctggatgccaactccggtggtcgctcccccgacacttatagccgtggccacgatagcagtagccagtccgatcactatgggggggggggaaggtctctcgatgctaactcaagtggaaggttgccagacgcatatagcgggggccatgattcctcctcgaggtcacaccgctatgggggcgggggtaggtacgaagagtatcgtggacggagcctggatgctaattccggtggtcgaagtccaaacgcttacagtggggggcacaattcgtctagccgaaatgacccttgccgcgggggggggcggtatgaggaaaacagaggtcatagtctggacgccaactccggtggccacagccctaacgcctattccgggggacgagacagtagttcaaattcgtatgataggtcgcacaggtatggcggcggtggccactacgaggagtacagaggccgatctcatgacacccattctcgggggcgctcgcctgacgctcactccggggatcactatacagaggcttactctagagggagggactccttcagcaactcgtacggtaggagcgaccactacggaaggggcgggtgttatgaggagtatcaggggagatcaccaaatgcctatggagggggccggggcctgaactcatccaataattcccacgggagaagccatagatacggtggaggtggcagatacgaagaatataggggtccctcccccgatgcccactctggaggccgggactcctcaatcaaatcctatggcctttctgacaggtatgggggcggcgggcactacgaagagtaccaggggagccttccagatgcgtattctggggatcacgaccggtcaagcaattcctatggaaggtccgaccgttactcacgcgggcgtgatcgtgttggtaggccggacaggggactgcccctcccgatggagactggtagcccacctctccacgacagctactcaagatccggctgtagggtcccccgggggggagggagacaagggggccgcttcgaaaggggagaggggcggagtaggtattag

SEQ ID NO: 50750 - DNA, 1491 bp, Artificial Sequence
  Description of Artificial Sequence: Synthetic coding sequence
atggtggaggccgaccaccccggcaagctgttcatcggcggcctgaacagagaaacaaatgagaaaatgctcaaagccgttttcgggaaacacggccctatctcagaggttcttctgatcaaggacaggacctccaaatccaggggtttcgccttcatcacttttgaaaatccagccgacgcaaagaacgccgctaaggacatgaacggcaagagcctccacggtaaagcaattaaggtcgagcaggccaaaaaaccctctttccagagcggagggaggcgccgtcctcccgccagttctcggaaccggtcgccgagtgggtccctgcggagcgcccggggttcacgcggggggacgcgtggttggctgccatctcaggagggccacctagacgacggcggctacacacccgaccttaagatgagctacagcaggggactgattcccgtcaaacgcggacccagttcccggagtggtggccctcctcctaagaagtcagctccgagcgccgtcgcccggagcaactcctggatgggcagtcagggccctatgtcccagcggagagagaactacggagtgccccctcgacgtgctaccatctcctcctggcgaaatgatcgaatgtcgacaaggcacgacgggtatgccaccaatgacgggaaccatccgtcgtgccaggaaacccgcgactatgcccccccttcccgtgggtacgcttacagggataatggtcacagcaaccgggacgagcattcttcccgtggctatcgtaatcacagaagctctagggagactcgcgattatgcccccccaagcagggggcacgcataccgcgactatggacactccaggcgagacgaaagctatagtaggggttatcgcaacaggcggtcaagccgggaaactcgcgaatatgccccccccagtcgcggtcacggctatagggattatggtcacagccgaagacacgaatcttattctagggggtatcgcaatcaccccagttcccgagaaacccgcgattacgccccccctcacagggactatgcataccgggactatggccatagttcgtgggacgagcacagctctcgtggctactcctaccatgacggatacggagaggccctgggcagggaccactcagagcatctgagcggatctagctatagagacgcccttcagcggtacgggacgtcccatggcgcaccaccagccaggggaccacgaatgtcctatggtggatccacctgccatgcttattcaaacactcgcgaccgctatggaagaagctgggagtcttacagttcttgcggagactttcattactgcgatcgggagcacgtgtgtcggaaagatcagcgtaatcccccctctctgggaagggtgctccctgatccgagagaggcttacggctcatcaagttacgtggcgagcattgttgacggtggcgaaagccgatctgaaaaaggagattcaagtcgatattag

SEQ ID NO: 50751 - DNA, 1491 bp, Artificial Sequence
  Description of Artificial Sequence: Synthetic coding sequence
atggtggaggccgaccaccccggcaagctgttcatcggcggcctgaatagggaaactaacgaaaaaatgctgaaggctgtgtttgggaagcatggccctatttcagaggtgctgctcattaaggatcgcacttcaaagagcagagggtttgcgttcatcacctttgaaaatcccgccgacgccaagaatgcggcaaaagacatgaacggaaaatctttgcatggcaaggccataaaggtcgagcaagccaagaaaccctcattccagtcaggcggaagaaggaggccccccgcatcctctaggaatcggtcaccaagcggatccctgaggagcgcccggggctcaagggggggaacgagagggtggttgccgagccaggaagggcacctggatgacggagggtatacacccgatctgaagatgagctattcaagaggcctgatccctgtcaagcgaggccccagcagcaggtcggggggaccaccccccaaaaagtcagccccaagtgcggtggcacgatccaactcctggatggggtcacagggacccatgagtcagagaagggagaactatggggttcccccccgccgggccactatatcatcttggagaaacgatagaatgtccactcgccacgacggctacgccacaaatgacggtaatcatccctcgtgccaagagaccagggattacgcccctccatcccggggatacgcttaccgggacaatgggcactctaaccgcgatgaacattcaagtaggggctacaggaatcatcggagctctcgcgagaccagggattacgcaccaccctcccgcggccatgcgtatagagactacggtcattcacgtcgagacgaatcttatagtagggggtatagaaaccgtcggtctagccgcgaaaccagagaatacgctccgccaagtcggggtcacgggtacagggactacggacactcaagaagacacgagagctatagcaggggatatcggaatcatccctcaagccgggaaacccgagactacgctcccccacatagggactatgcctaccgcgactatggccattcaagttgggacgagcatagttccagaggctattcttaccatgacgggtacggggaggcattgggaagggaccattctgagcacttatctggaagctcctatagggatgctctgcaaagatatggcacctcccatggcgcccccccagcaagaggccctcggatgagctacggcgggtccacctgccatgcctactcgaacactcgcgaccgctacggccgatcatgggagagttactcaagttgcggagacttccattactgcgatcgagagcatgtatgtcgaaaagaccaacgcaacccaccctccctgggcagagtactgccagacccgagggaggcctgcggtagctctagctacgtagctagtatcgtcgatggaggggagtctcgatcagagaaaggcgatagcagtcgctattag

SEQ ID NO: 50752 - DNA, 1491 bp, Artificial Sequence
  Description of Artificial Sequence: Synthetic coding sequence
atggtggaggccgaccaccccggcaagctgttcatcggcggcctgaatcgggaaaccaacgagaagatgctgaaggccgtctttgggaaacacgggccaatctccgaagtcctgctgattaaggaccgaacaagtaagtccaggggattcgcgttcattacctttgagaaccctgctgatgccaagaacgcagcaaaagacatgaatggaaaaagtctgcatggcaaggctatcaaggtcgagcaagccaagaagccgtcttttcagtcaggaggccggcgaagacccccagcatcatctcggaacaggtcccctagtggcagcctgagatcagccagggggtcacggggagggactaggggctggctgcccagtcaggaagggcatctggatgacggtggatatacgccggaccttaagatgtcctatagtaggggcctgatacccgtgaaacgtggcccttcttccaggagcggagggcctcctcctaagaagtcagccccaagtgcggtagcccgtagcaatagttggatggggagccagggcccaatgagtcagcggcgcgaaaattacggtgtgcctcccaggagagccactatcagctcatggaggaatgatagaatgagcactcggcatgatgggtatgctacaaatgatggcaaccaccccagctgccaggaaacgagagattatgctccaccatcaaggggctacgcctacagagacaatggtcactccaaccgagatgaacattcatctcgtggatacaggaaccatcggagctcccgcgaaactagggactacgcgccgcccagtagaggtcatgcctatcgcgactacgggcattcccggcgcgacgaaagctacagcagagggtatcggaataggagatccagcagagaaacaagggagtacgctccgccttccagaggacacggctatagagactatggccactcaaggcgccatgagtcttactcaaggggatacaggaaccacccctcctctcgagaaactcgggactatgccccaccccatagggattatgcttacagagactacggacacagctcttgggacgaacactcttccaggggttactcatatcatgacggttatggcgaggccttgggccgagaccattccgaacatctaagcggctcgagctatagggacgccctgcagcgttacggaacttctcacggggctccccccgcccgagggccgaggatgtcctacgggggatctacatgtcatgcatattccaatactcgcgatcgctatggtcgctcttgggagtcatattcgtcctgcggtgacttccattactgtgaccgggaacacgtgtgccgcaaagatcagcgaaaccccccatccttaggacgggtgctgccagacccgagggaggcctgtgggagcagttcctatgtggctagcattgtggatggtggcgagagccgctccgagaagggggactcttccaggtattag

SEQ ID NO: 50753 - DNA, 1380 bp, Artificial Sequence
  Description of Artificial Sequence: Synthetic coding sequence
atggtggaggccgaccaccccggcaagctgttcatcggcggcctgaatcgagaaaccaacgaaaagatgcttaaggccgtcttcggcaaacacggcccaatctcagaagttttattgatcaaagaccggaccagcaaatcccgaggattcgcctttataacttttgaaaaccctgccgacgctaaaaatgctgcaaaggatatgaacggtaaatctcttcacggcaaggccattaaagttgaacaggccaaaaagccaagcttccagtcaggtggtcggcgcagacctcccgccagcagcaggaatagaagtccttccggctctctccgttctgctagaggaagcaggggtggcacgcgcggctggttgccaagccaggagggccacctagatgacgggggatacactccggacttgaaaatgagttacagtcgagggctgattccagtcaagcgtggccccagttctcgctcaggcgggccaccacctaaaaagtcggcaccatctgccgttgcgaggtcgaacagttggatgggaagtcaaggcccgatgagtcagagaagggaaaattacggggttccccctagaagagcaaccatatcttcttggagaaatgatagaatgtctacacggcatgacggatacgcaactaatgatggcaaccatcctagctgtcaggagactagggactatgcaccacccagcagaggctacgcatatagggacaatggccacagcaaccgggacgaacacagctcccgcggctaccgcaaccataggagttccagagagacacgagattacgcaccaccctctagaggacatgcgtatagggactacggccacagtcggcgagatgagagctatagcaggggttatcgcaaccggcggagttctagggaaactagagaatacgcccctccgagtcggggccacgggtaccgcgactatggccattcaaggagacacgagagctacagccgaggctacagttatcacgatggttacggtgaggccctaggtagagaccattcagagcatctgagcggaagttcatatcgggatgccctgcagcgctatggcacatcgcatggagctcctccagcccgggggccccggatgagttatggaggctcaacctgccacgcttattcgaatacccgcgaccgctatggcaggtcatgggagagctatagctcttgtggtgactttcactactgtgatagagagcacgtttgtcggaaagatcagcggaaccccccaagcctaggccgggtgcttcctgacccacgcgaggcctgtggaagctcctcatatgtggcctccatcgtggacggaggggagtcacgttcagaaaagggcgacagcagtcgctactag

SEQ ID NO: 50754 - DNA, 1380 bp, Artificial Sequence
  Description of Artificial Sequence: Synthetic coding sequence
atggtggaggccgaccaccccggcaagctgttcatcggcggcctgaaccgcgagacaaatgagaaaatgttaaaggcagtcttcggcaaacacgggcccattagtgaggtgctgctgatcaaagatcggacctctaagtctcggggctttgcatttataacattcgagaaccccgcagacgctaaaaatgctgctaaagatatgaacgggaagagccttcatggtaaggccattaaggttgaacaagccaagaaaccgtcattccaatctggggggcggcggcgccctcccgcatcctctcgcaaccgatctccatccgggagcttgagatctgccaggggatcccgtggcggcacacgcggttggttgccgtctcaggagggccatctggatgatggggggtacacacccgaccttaagatgtcctacagccgcggcttaatccccgtgaagcgtggcccaagcagccgtagcggcgggcccccccccaagaaatctgctccaagcgccgtcgcccgatctaactcttggatgggtagtcagggtcctatgtcccagagaagggagaattacggcgtcccaccccggcgggctaccatcagcagctggagaaatgatcggatgtccacccgccatgacggatacgccaccaatgatgggaatcatccatcatgccaagagaccagggattacgctccacccagccgcgggtatgcctaccgggataatgggcactctaaccgagatgagcatagctctcgcggatatagaaaccatcgtagctcacgagagacaagggactatgcaccgccttcaagggggcatgcgtatagggactatggtcactcacgacgggatgaaagctattcgaggggctaccgcaataggcgatcttcccgggagacacgggaatatgcccctccaagtagaggccatggctacagggactacgggcattcacggaggcatgaatcttattcaagaggctatagttaccacgacggctatggagaggccctgggcagggaccacagtgagcacctgtcaggctcatcataccgtgatgccctccaaaggtatggcactgctcacggtgctccaccagcaagagggcctagaatgagttacggtgggtccacttgccatgcatacagtaatacccgggaccggtacgggagaagctgggagtcatactcatcgtgcggagatttccactactgcgatagggaacacgtgtgcagaaaagatcagagaaatcctccgtccttgggcagagtgctgcctgacccgcgtgaagcctgcgggtctagctcctacgtggccagtattgttgacggcggagaatcaaggagcgaaaagggtgattcatcccgctattag

SEQ ID NO: 50755 - DNA, 1491 bp, Artificial Sequence
  Description of Artificial Sequence: Synthetic coding sequence
atggtggaggccgaccaccccggcaagctgttcatcggcggcctgaaccgggagactaatgaaaagatgctcaaagccgtattcggcaagcacgggccaatttctgaagtccttttgattaaggaccgcacctccaagtcgagaggcttcgccttcatcacattcgaaaaccctgccgacgctaagaatgctgcgaaggacatgaacggaaagtctcttcacggaaaagctattaaagtagaacaggctaagaagccaagctttcagtctggaggccgacggaggccaccggcctcatcccgtaacaggtctccctctggaagtttacggtcagctcggggcagtcgggggggaacaaggggatggctaccgtctcaggagggccacttggacgacggaggctatactcctgacctgaaaatgtcctattccaggggactgattcccgtcaagaggggcccctcctccagatccggcgggcctccccccaagaaatcggcaccgtcggccgtcgcaagaagcaattcctggatggggagccagggaccaatgtcccagaggcgggagaactatggtgtgcccccacggagagctaccatcagctcttggaggaacgataggatgagtaccaggcatgacggttatgcaacgaatgatgggaaccacccgtcttgccaggaaacacgagactacgcaccgccttccagaggctacgcctatagagataacggacactctaaccgggacgaacacagctcaagaggctatcgcaatcatcgatcatccagggaaactcgtgactacgctcctccttcaagaggccacgcctaccgggactacggccactccagacgtgatgaatcctatagccgtgggtatagaaataggcgatcctctcgagagacccgtgaatacgctcccccatcaagggggcatggatacagagactacggacatagccggagacacgaatcatatagtcgaggctatcgcaaccacccctcatcccgcgaaacccgtgactatgcccccccacatcgggactacgcttaccgcgattacggtcactcgtcctgggacgaacacagcagtcgtggatactcctaccacgatggctacggcgaggccctaggtagagatcattcagagcacctgagcgggagttcatatcgagatgcgcttcagagatatggcacagcacatggagcccctcctgcccgcggccccagaatgagttacggaggcagcacctgccatgcctacagcaacacaagagacaggtatggaagatcatgggaatcgtacagctcatgtggcgacttccattattgtgaccgggagcacgtgtgtaggaaagatcaacggaatccaccctccttggggagagtgctgcccgaccccagggaagcttgtgggtcatcctcttacgtcgcttcaatcgtggatgggggtgagagtagaagtgagaaaggagactcatctcgctattag

SEQ ID NO: 50756 - DNA, 1491 bp, Artificial Sequence
  Description of Artificial Sequence: Synthetic coding sequence
atggtggaggccgaccaccccggcaagctgttcatcggcggcctgaaccgcgagacaaacgagaaaatgctcaaggccgtgtttggaaagcacggccctatttctgaggtcctcctgattaaagatagaacatccaagtcgcgcgggtttgcctttatcacttttgagaatcccgctgacgccaagaatgctgccaaggatatgaatggaaagtctctgcacggtaaggctattaaggtcgaacaggccaaaaaacctagcttccagtccggcggacgaagacggccaccagcctcttctcggaacagaagcccatcaggatcactgcgctcagcacgtgggagccgtggaggcaccagaggttggctcccttcccaagagggacatctggatgatggaggttacacacccgatctgaagatgagctactcaagagggttgattcccgttaagaggggtcccagttcccggtcgggggggcctccccctaagaagtccgccccaagcgctgtcgcaagatcaaactcatggatgggctcacaggggcctatgagccagcgccgagaaaactatggcgtgcctccgcgcagagccaccatttcatcttggcggaacgaccgcatgagtaccaggcatgatggctatgctaccaacgatggaaaccatcccagctgtcaggagactagggattatgctcccccctcaagagggtacgcataccgggataatggacattccaacagagatgaacactcatctagaggctaccgcaaccaccggagctcccgggagactcgcgattacgctcccccatcccggggccatgcctatagggactatggccattcaagaagggatgagagctacagccgaggttaccgaaataggcgctctagccgcgagacccgcgaatatgctcctccttccagagggcacggctaccgggactacgggcattccaggcgccatgagtcctactctcgtgggtatcggaatcatccctcatctcgggaaaccagggattacgcgcctccacacagagattatgcgtatagggactatggacactccagttgggacgagcatagctcacgcgggtactcctatcacgatggatatggagaggccctgggcagggaccacagcgaacacctgtcaggttcctcttaccgggatgcacttcagaggtatgggaccagccacggggcaccgccagcccgtggacccagaatgagttatggaggctcaacctgtcatgcttattccaacacacgcgaccgatacggccggtcttgggagtcatactccagttgcggcgatttccattactgtgatagagagcacgtttgtagaaaggaccagcgtaacccacctagtttgggtagggtgctgccagaccccagagaggcatgcggctcaagttcatatgttgcgagtatcgtggatggaggcgagtccagaagcgagaagggggacagttctcgctattag

SEQ ID NO: 50757 - DNA, 630 bp, Artificial Sequence
  Description of Artificial Sequence: Synthetic coding sequence
atgagcaacctgaagcccgacggcgagcacggcggcagcaccggcacgggtagcggagctgggagcggcggtgcactggaggaggaggttcgcactctctttgtgtccggtttgcccgttgacataaagcctcgggagctgtacttactgttccggcctttcaagggatacgaggggagcctgatcaaactcactgcacgccaaccagtgggctttgtaatattcgactcgcgtgccggcgcagaggccgccaaaaacgctctcaacggcatccgatttgaccccgagaaccctcagacactgcgcttggagtttgcgaaagcgaacaccaagatggctaagagcaaactgatggctacacccaatccctcaaacgttcaccccgccctgggcgcacacttcattgctagagacccatacgatctgatgggagctgcactgattcccgcctcccctgaggcttgggcaccgtacccactatacacaactgaactgacgcccgcaatctctcatgctgccttcacttatcccaccgccacagcagcagcagctgccctccacgcccaggtccgctggtacccaagctcagatacaactcagcaggggtggaaatacaggcaattctgttag

SEQ ID NO: 50758 - DNA, 1731 bp, Artificial Sequence
  Description of Artificial Sequence: Synthetic coding sequence
atggacgtgcggttctaccccgccgccgccggcgaccccgccagcctagacttcgcacagtgcctgggttactatggttacagtaagtttggtaacaacaacaactacatgaatatggccgaggctaacaacgcatttttcgctgcctcagagcagacatttcataccccatcgctgggagacgaggaatttgagatccccccaatcacccccccacccgagtctgatccggctctcggtatgcccgatgtcctattgccatttcaggccttgtccgatcccttgccatctcaaggcagtgagtttaccccccagttccctccacagtcccttgatttgccctctatcacaatcagtcgtaatttagtggagcaggacggagttctacattcctccgggcttcacatggatcaatcacatacgcaagtgtcacaataccgacaggatccatctctcattatgagatccattgttcacatgaccgacgctgcgcgcagtggtgtgatgccacctgcccagctgaccacaattaaccagagtcagctatccgcccagcttggactgaatctcggcggagcctcaatgccgcatacttctccaagtcctccagcctccaaaagcgctactccaagcccctcctcctctataaatgaagaggacgcagacgaggccaaccgcgccataggcgaaaagcgagctgctcctgattccggaaaaaaacccaaaactcctaagaaaaaaaagaaaaaggatcccaacgagccgcagaaaccagtgagcgcctacgctctcttctttcgcgacacccaggcggccatcaaaggtcaaaaccccaatgcaacatttggcgaggtgtcgaagatagtggcctctatgtgggattccctgggggaagagcagaagcaagtgtataagcggaaaactgaagcagccaagaaggagtatctgaaagccctcgcagcttaccgggcctcactggtttctaaagcagcagccgagtcagccgaggcacagactattagatcggtccaacaaaccctggctagcactaatttgacgtcctccttgttgctaaacacccccctgtctcagcatggtactgtgagcgccagcccacagactctccagcagtccctgccacgcagtattgcgccaaaaccccttactatgagactgccaatgaatcagatcgttacttcggtaaccattgcagccaatatgccctcgaacattggggctccactgatcagctccatgggtaccaccatggttggcagtgcaccttccacccaggtttccccatcagttcagacccagcagcatcagatgcagctgcagcaacagcagcagcagcagcaacagcaaatgcagcagatgcagcagcagcagctgcagcagcaccaaatgcatcaacagatccagcagcaaatgcagcaacagcattttcagcatcatatgcagcagcacctgcagcagcaacagcaacacctgcaacagcagatcaaccaacaacagctgcagcagcagctgcagcagcggttgcagctgcagcaactgcagcatatgcagcaccagtcacagccatctcctagacagcattcccccgtggcctctcagatcacaagccccatccccgcaattggttcaccgcaaccggccagtcagcaacatcagtcacagatacaatctcagacacagactcaggttctgtcacaggtctctatattttag

SEQ ID NO: 50759 - DNA, 1023 bp, Artificial Sequence
  Description of Artificial Sequence: Synthetic coding sequence
atggccgcccccctgctgcacacccggctgcccggcgacgccgccgcctcacctagcgccgttaagatgctgggtgcatccaggaccggcatctcaaacatgcgggccctcgaaaatgactttttcaatagtccaccccgtaagacagtccagtttggaggaacggtgactgaggttctactaaagtataagaccggcgagaccaatgacttcgagctgctgaagaaccagctgttggaccctgatattaaagacgaccagatcatcaattggctcctggaatttcggagcagcatcatgtacctgacaaaagactttgagcaattgatatcaataattttgcgtttgccatggttgaacaggtcccaaaccgtagtggaggagtacctggcattcctgggcaatctagtgagtgctcagaccgttttcctcaggccctgtctgtctatgattgcttctcatttcgtacctcccagagttataatcaaggagggtgacgtcgacgtctcagactcagacgatgaggatgacaacctacccgccaacttcgataccagtcagtccctggccaacaactctaaaatctgcaccatcgaatgctacgtgcacaacctgctgcgcataagcgtttatttcccaacccttcgccacgaaattttggaattgattattgagaagctgctgaaactggacgtgaatgcctctaggcagggaatcgaggacgctgaggagaccgccaatcagacctgtggtggaactgatagcacagaggggttatgcaacatgggatttgctgaggctttcctggaaccactctggaagaaacttcaagatccaagcaaccctgccatcatccggcaagcggcaggtaattacatcggttctttcctcgcgcgggccaaatttatcccactcatgattcgcgagcagcgccatagcgctatgctccttagcatggatcactttacccagccggcaaagctctgttcaacaccacttttcctggataccagtagtttctag

SEQ ID NO: 50760 - DNA, 1461 bp, Artificial Sequence
  Description of Artificial Sequence: Synthetic coding sequence
atggccgcccccctgctgcacacccggctgcccggcgacgccgccgctagtccaagcgcagttaagatgctcggcgcctctcgcacagggatcagcaatatgagggctctcgagaatgacttcttcaactcaccgccaaggaagactgtgcagttcggagggaccgttacagaggttctcctaaagtataagacaggagaaaccaatgactttgaattgctgaaaaaccaattgctggacccagacattaaacggttgccatggctcaatcgatctcagactgtggtggaggagtacctggcctttctcgggaacctggtatccgcccagactgtttttctcaggccatgtttgtccatgatcgcctcccatttcgtccccccacgcgtgatcatcaaagagggagacgtggacgtttcagacagcgatgatgaggacgacaacctgcctgcaaattttgatacttctcagtcacttgccaacaattccaagatatgcaccattgagtgctatgttcacaatctcctgcgaataagcgtctacttccctacgctcagacacgaaattcttgaactgattatagagaagctgctgaagttagatgtcaatgcatcaagacagggcattgaggacgccgaggagactgcaaaccaaacgtgcggaggtactgactcaactgaaggcctgtgtaatatggtttcatccctgctaatgaaagtagaaatgaaattcatcatcatcaaaggctggaagcagctggtattgctgatattcggttttgccgaggccttcctagaaccactttggaaaaagctccaggatccatcaaaccctgcaatcatccgccaagccgcgggcaactacatcggctccttcctggccagggccaagttcattccactaataacagttaaatcctgtctggatttgctggtgaattggctgcatatttacctgaacaaccaggatagcggtaccaaggctttttgcgatgtggcactgcatggccctttttacagcgcctgtcaggctgttttctacacatttgtctttcgccacaagcagctgttatccggcaatttaaaagagggtctacagtatctgcagagtctaaactttgaatggatcgtgatgagccaactgaacccactgaagatctgcctaccatccgtggtcaattttttcgcggctattaccaataaataccaattggttttctgttacaccatcatcgagcgcaacaacaggcagatgctgcctgttattaggtcaacaacagggggcgacagcgtgcagacatgtaccaacccactcgacacatttttcccctttgacccatgcgttctaaaaaggtctaaaaaattcatcgatcctatctaccaggtctgggaagatatgtcggccgaagagttgcaggaatttaagaaacccatgaagaaactgttctggcggataatgtag

SEQ ID NO: 50761 - DNA, 939 bp, Artificial Sequence
  Description of Artificial Sequence: Synthetic coding sequence
atggagcccggcagcgtggagaacctgagcatcgtgtaccggagccgcgacttcctagtcgtgaacaaacattgggacgtccggatagattcaaaagcctggcgggagacgctgactttgcagaagcagttgcggtacaggttcccagaactggccgaccctgacacgtgttacggttttcgcttttgtcatcaattggattttagcacttctggcgcactgtgcgtggccctgaataaggcagccgcaggtagcgcctaccgctgttttaaggaaaggagggttactaaggcatacttggctctactccggggtcatatccaagagtctcgcgtgaccatatcacacgcaattggacggaatagcaccgaggggcgtgctcacactatgtgtatagagggctctcagggatgtgagaacccaaagccctctttaactgatctagtcgtgttggagcatggactgtatgcaggagatccggtgtctaaagtactgctgaagcctctgaccgggagaacccaccagctcagggtgcactgctctgcgctagggcaccccgtggttggggatctgacctatggtgaggtttccggcagagaagaccgtccgttccgaatgatgttgcacgctttttatttgcggatccccaccgatacggagtgcgtggaggtgtgtacgcccgatcctttccttcccagcctggacgcttgctggagtccacacactctgctgcagagcctggatcagctcgttcaggcgctccgggccaccccagatcccgatccagaggatcggggaccacggcctggcagcccttctgctctcctacctggcccagggcgacccccgcctccaccaaccaagcctcccgaaaccgaagcacaacgcggcccgtgcctgcagtggctgtccgagtggaccttggaacctgattcatag

SEQ ID NO: 50762 - DNA, 1638 bp, Artificial Sequence
  Description of Artificial Sequence: Synthetic coding sequence
atgtggctggaccggcggggctggctgcgggtgctgggccactggcgatacgacctgcggagaccttcctttacacgcacgtggtccggcgacaaaggccctatggccgaaaccgtttccacgcaggtagggaccgagggtggactccgtgccagccaccagcaaaatggcgacgccggaggcgacgcaaaggtggaattatctcctggccctcctaagccagccgggcgtgaggtagaaccagctcctgtggggggtgagcacccttccgcagcggcccccggccctggcaaacacaagaaacggaggggggcaaccagggagcgggttgtgcctccacccaagaaaaggaggactggggtgtctttcggagatgaacacttcgctgagacatcatactatttcgaaggagggcttcgaaaggtccgaccttattattttgacttcagaacatactgcaaaggaagatgggtgggacacagtctacttcacgtgttttcaactgagtttcgcgctcaacctctggcctattatgaggcagcagttcgtgcagggcgtctgcagctcaacgagaagccagtacaggacctgaatattgttttgaaagacaatgatttcttacgcaataccgtgcaccggcatgagcctcctgtcacagctgagcctattcgcctcctggctgagaatgaagacgtggtggtagtggataagccatctagtattccagtgcacccttgcggtcgcttccgccataatacagtgatctttatcctgggtaaggaacaccaattgaaggagctgcacccgttgcatcggttagataggctcacaagcggggtgttaatgtttgctaagacagcagccgtgtcagagcggatacacgaacaagtgcgggatcggcaacttgagaaagagtacgtctgccgcgttgagggcgagtttccaaccgaggaagttacctgcaaggagcctatcttggtggtgagctataaggtgggggtatgtagagtcgacccccgcgggaagccatgtgagaccgtgttccagaggttgagttacaatggccagtcctctgtcgtccgctgcaggcccctgactggtcggacccaccagatccgcgtgcatctccagtttctggggcaccctattcttaacgaccctatttacaattctgtggcctggggcccgtcccggggccgtgggggctatattccaaaaacaaacgaggaacttcttcgcgatctggtggccgagcatcaggccaaacagtcgctagacgtgctggatttgtgtgagggggatctctcacccgggttaaccgactcaaccgcgccttccagcgagctgggaaaggacgacctggaagaactggctgccgccgcacagaaaatggaggaagtcgcagaagctgcgccacaggagctcgacaccatcgctttggctagtgagaaggccgttgagacagatgtcatgaatcaggagacagacccgctgtgcgcagaatgtcggttggtgaggcaggacccattgccacaggatctcgtgatgtttctgcatgcactccgctacaagggccccggtttcgaatacttcagtcccatgcccgcctgggctcaagacgactggcagaaggattag

SEQ ID NO: 50763 - DNA, 1575 bp, Artificial Sequence
  Description of Artificial Sequence: Synthetic coding sequence
atgtggctggaccggcggggctggctgcgggtgctgggccactggaggtacgacttaaggagaccatcttttacaaggacctggtcaggagacaaaggacccatggccgagactgtctccacccaagtagggaccgagggcggcctccgcgcctctcaccaacagaacggggacgctggaggtgatgccaaggttgaattgagccctggaccacccaaacccgccgggcgcgaggtggaacctgcaccggtggctcgcgaacgagtcgtccccccacctaaaaagcggcgtactggagtctcgtttggcgacgagcattttgccgaaaccagctactactttgagggaggactacggaaagtcaggccttactatttcgacttcagaacttattgtaagggacgctgggtgggccactccctgctgcacgtcttttccactgagttcagggctcagcctctggcttattatgaagccgccgtgagggcaggcaggctacagttgaatgagaagcccgtgcaggacctgaacatagttctcaaggacaacgatttcctacggaacacagtccacagacatgagccccccgtgacagctgaacctattagactcctggcagagaacgaggacgtggtcgtggtggataagccttcatcaatccctgttcacccatgcggtcgatttcgccacaatacggtgatttttatcttaggcaaggaacaccagctcaaggagctgcaccccctgcacaggttggaccgactgacgagcggcgtacttatgtttgcgaagaccgccgcagtcagtgaacggattcatgaacaagtgcgtgatcggcagctggagaaggaatatgtgtgtcgtgtcgagggagagttccctactgaagaagtgacctgcaaagaaccaattctggttgtttcatataaggtaggagtttgccgcgtagatccacgtggaaaaccctgtgagaccgtctttcaacgtctctcttacaatggccagtcctctgttgtcaggtgcagaccactcacagggcgcacacaccagatccgcgtgcacctgcaatttttgggtcaccccatcctgaacgatcccatctataatagtgttgcctggggaccgtcgcgcggaagaggcggctatatccccaagacgaatgaggagcttctgcgggatttggttgccgaacaccaggccaaacaatccctagatgtcctagacctctgtgagggagacctctcgcccgggctcacggactctaccgccccaagtagcgaactgggaaaggatgatctcgaagaactggccgctgccgcccagaagatggaggaggtcgctgaagcggctccacaggagttagatacaatcgcgttggctagcgaaaaggccgtcgagactgacgtaatgaatcaagagactgatcctctctgcgccgagtgcaggctggtgcgacaggaccctctgccacaggacctcgtgatgttcctgcatgccctccgctataaggggcctggctttgaatatttttcaccaatgccagcgtgggctcaagatgactggcagaaggactag

SEQ ID NO: 50764 - DNA, 1056 bp, Artificial Sequence
  Description of Artificial Sequence: Synthetic coding sequence
atgcgggccgtgctggcccgggagatggacggccggcgggtgctggggagattttggagcggatggcgtcgcgggctgggcgttcgtccagtgcccgaggacgctggatttggtaccgaggcccgtcaccagagacaacctagagggtcgtgccagcggtccggacccctgggagatcagccctttgcgggactactaccaaaaaatctctcccgtgaggagttggttgacgctctacgggccgccgttgttgatcgtaagggccctctcgtgaccctgaacaaaccacaggggttacccgtcacggggaaacccggcgagttaacattattttctgtccttcccgagctgtcgcagtctctcgggcttagggaacaggaactgcaggtcgtgcgggcgtccggtaaggaatcctctgggttagtgttactgagcagttgtcctcagactgcctcccgcctgcagaaatactttacccatgccagacgtgcccagcgtcccaccgcaacttattgtgcagtcacagatggaataccagctgccagcgaaggcaaaatccaggcagccctgaaattggagcacattgatggagtgaatctcactgttcctgttaaggcaccatcccggaaggatatcttagagggagtgaaaaagaccctgtctcactttcgagtggtggcaaccggctccggttgcgccttagtgcagttacaaccattaactgttttctcatcccagctgcaggtgcacatggtcctgcagctgtgtcccgtccttggagaccatatgtacagtgccagggtggggacggttctgggccagcggttcctgttacccgctgaaaataataagccgcagaggcaagtcctggatgaagccttactccgtagactgcatcttaccccaagccaggcagctcagctgcccctgcacctgcaccttcaccgcctcctgctacccggcacaagggcccgggacaccccagtcgagttgctggcaccacttcctccctattttagtcgcaccctgcagtgccttgggctgcgcttgcagtag

SEQ ID NO: 50765 - DNA, 1011 bp, Artificial Sequence
  Description of Artificial Sequence: Synthetic coding sequence
atgcgggccgtgctggcccgggagatggacggccggcgggtgctgggccgattctggagcggttggcgtagggggctcggcgtgagacctgttcctgaagacgctggcttcgggacagaagcccgccatcagaggcaacctcgggggtcatgtcagagaagtggcccgctgggcgaccaaccatttgctgggcttctgccgaaaaacctttcgcgcgaagaactggtggacgcacttcgcgccgccgtggtcgatagaaaggggaaacctggcgagttaacactgttctccgtgttacctgaactctcacagtcacttgggctgagagagcaagaactgcaagtggtgcgggcctcaggcaaggaaagctccggcctggtcctgctgtcctcttgtccccaaaccgcttctcgactgcagaaatattttacacatgcacgccgggcacagaggcctactgctacctattgtgctgtcacagacgggatacccgccgcctccgaaggaaagattcaggccgctttgaaacttgaacatattgatggcgtgaatctgaccgtaccggttaaagctcctagccgaaaggatattctggagggagtgaaaaagacactatcccatttcagagtggtcgccacgggttcagggtgcgcactggtgcagctgcagcctttgacagtcttcagttctcaactgcaggtacacatggtgctgcagctgtgccccgtgctgggcgatcacatgtattccgccagagtggggaccgtgcttggacagcggtttctgctgcccgccgaaaataataaacctcaacggcaggtcctcgatgaagccttacttaggcgcttacacttgaccccctctcaggcggctcagctgcctctacatctgcatcttcacagattactccttcctggcacccgtgctagagacaccccagtggaactgctggctccactgcccccctatttctctagaaccctgcagtgcctaggcctccgcctgcagtag

SEQ ID NO: 50766 - DNA, 864 bp, Artificial Sequence
  Description of Artificial Sequence: Synthetic coding sequence
atggccaccgtgatggccgccaccgccgccgagcgggccgtgctggaggaggagtttcggtggctattgcacgacgaggttcatgcagttcttaagcaactgcaggatattctcaaggaagccagtctaagatttacgctaccagggtccggcacagagggaccggcaaagcaggagaatttcatcctaggcagttgcggaactgatcaggtgaaaggtgtgttgactctgcaaggggatgctttatcacaggctgatgtgaatctaaagatgccccggaataatcagctcttacacttcgccttccgggaggataagcaatggaaactgcaacaaattcaggacgcacggaatcatgtgagccaggccatctatctgttaacctccagggaccagagctatcagtttaagaccggggccgaggtgttgaaattaatggacgcagttatgctgcagctgacacgagcccgaaacaggcttaccaccccagccaccctcacactgcctgagattgctgcaagcggccttacacgaatgttcgccccagcgctgccttctgatctgctcgtcaatgtttacatcaacctgaacaagctttgtctcactgtttatcagctgcatgctttgcagcccaatagtactaagaacttcagacccgccgggggagccgttctccactcccccggggcgatgtttgaatggggcagccagcgactcgaggtatcccacgttcataaggtggagtgcgtgattccttggcttaacgacgctctggtgtatttcaccgtaagcctgcaactttgccagcaacttaaagacaagattagcgtctttagtagttactggtcatacaggcctttctag

SEQ ID NO: 50767 - DNA, 6681 bp, Artificial Sequence
  Description of Artificial Sequence: Synthetic coding sequence
atggtgctggccggcctgatccggaagctgggccaccagctggccgaaataagggagcgcgctctcaaaagcattttgtgtaagatcgagcacaatctgatatgttacgcagacctgatccaggagcgtcagctgtttctgcacctgctggagtggtttaattttccctccgttccaatgaaggaggaggtgctgaaccttctgtctcggcttgttaagtatcccccagcagtccagcacttggttgatgtgggcgcagtcgagtttcttagcaagctgaggagcaacgttgaaccaaacctccaggccgaaatcgatgggatcctggacggactgtttttgctgccctctgaggtgcccgccctgtcctccgcgtcttaccaaactaaccagaccgaactttccaagaatcccgagattctaacaggctattttccccaggacaagagtaactttcaacagatggaggtcccaccacggcccgtcgtgaaccaaacagtaaaatgcctgaaattcagcacgtttccgtggctgcctctcacgactactgatcggcacgttctttctagcaacgaatcctccctgagatcaagcaatcataccttaatatggaacacctgcgaacttctcaaagacgttataatgcaggatttccctgccgaaatattcctccagagacctaaaatcgtgcagagcctcctatctttgctgaagctcgcgtttggggatgggaaacaccggctcgctctgcaaagcgtgagttgcctgcagcagctctgcatgtatctgaggaacagactgaattttcaccgggatccaggttttttctctaataagcatgatactgtaagccaaaacagtagtctgtcctattgccacgaggcccgagggacacaccactcccagaatccttcgccaggctcaagcagccctaggccttcagtcgttggcaggaccggacagcggcccagaggcgacggccaggattgggacgccgcttcctcgtcagggtcctcctcacacgctcatgtcaattcacgcataagcgtgcatagccccttggatatgggtcacattgatttacctgagctcgaaaccgaggacactttggagctgcaattccagcaactatctttaccacagttttgcgtgtcaattctagaaagcgccgttcctctcttgagaacagggtccaggcaagtgatcattcgcgtattggagctgcttaccgaagacatgaccctcattggtgaggctatctctacggacatctgggatgactctagcctgttcggaatagacatgaaggagaagctcctgttagtactaggagctctcggcgagaccatgtgttatcacaagtcctcaataagcctggagcagccggaggtcatgctggtgcaccacaggatggccttcatttccattagcctgttcgctgtaagacttctccagacacttctcccagtggagaaggcttcagagttcctgtccgagcctatgtcaaccgcccttttcctgctctcccttgacatgcctataagtttagagtaccctaacatccacgaagcagtggtggcctaccttgagcagctgaacagtgaaaattacagcatttacaagcgaactgcagaagccgtgtacagtatcgaatgcacctgcaacttcctctcagatattggtaaggagggagagaaaaacctgcttgagctagtagaacttgctgaccaggcgcttcggtcattctcctatcatcagcactttccccttatcaaagagataatcagtatttgcagtaaaatttggaagtccgcacaagctagtcctttgctgcagggcgagtctcaaaaggtgctgctccacatgctgtcacatcctctgccacgagtgaaagcagaaacctatcactgttgcctggagatcacgaaagagtgtttaggagtgcataatgtgaccaagccagtgagcagtctctgtaacggaattcatttccttctccatccaaaggtactttacgaaattagcgtgtttggtattcaggagccagagtcagaggtgaacactgccgccaaggccatcctactctacctgctgcagggtaggctgatgatgacagcactgacatggaacaagttcatagagtccctgtgccccgtgattccgatcctgcaggggtatgctgataccgaggaccccttaggaaattgcatcctattgctctctaaggcctcatccgataccgaagaaatgttgccctgcacgacgcgactgaaatcaatgttgcggctgctactggtcaaaaaaccatccgtgaggagtctcgctctgaaactgctagcatttcacctaacaagtgaggagggcgctgataccaagcggccactgatcgacgctcgggtgcttagtagggttactgatctgttcatcggtaagaaacccattgaattgcggctggacgaccggagagagcttgtcatcaagctggaaactgttgagaaggtttacgaaatttttacctctgacgacgtcgatttagtcctaagaaaatcggccgcagaacagctcgccgtgatcatgcaggacattaagatgcatgccgtggtgaaaaaattgtgcttaatcgacaaaatcattgagtacttaaacgagtgcgtgtcacaggacgggaaggttgtcgagtgcctggtccagccctgcctcaccctcctgcgcaaagtgttatgcggcgatcctgtaatgagagtgagcctgagtcaacagtcatccctgctcaccgttctcttccgcgtgtccctgatattccacgaggactgctctgtagtaacggaggttggagccctcttctgtttgctgttgttcgacgaggtaagtcgcatggatatgtggtctgtgaatccctcaaacaaaccttctctgccatctgtcttttccctgcctgtctcggttttcagaagatatcacctcccagttcatgtgattggccatcacgcggtcagcccatactccattgtgttgcccctctccgcagattgcctggccctcaagcccgtgtccgacatgctccggatcgcctggaacctgagctggtaccacggctcagataatctgctaaagcagatgaatagtgagacaaaaacacaagagattctggacgccctcaaattgagcacagaagatattcttactctgaagatcacacacatggcaagcggcctccaggattgtctccattccatcgttcaggctgccacccacagggaggtgagggcggccgtcaccagaatgtccttctatttactgaatgatagattatctctgaaggggtgcccggggccttgtggagtaacgttgaaatctctcgcttggcacaccgctctgaaccgatttctccaagtgctgcccgcatgcactgaagatgagaaattattgattgacattattcactttctgaacaaactgattaaggaacaaaggaagaattcctccctcgagttactgaattggattctggagctgcttctgagacattctgcaaaccccctgctcgatctcctggtcctcacggaaagtcaagcccgggaagaaactgatgacatacgcacagcagtaaggcagcagctccaaaaagaattaatcgcactctttgacaccctcttgcttaacttcatggaggtgacagacagaaagtgtagcgagctgctgtacgtcttccagacccagcttgcgctaaaattattacaatgcctgaaggttacagacgcccctcatttttatgggctccctagcctcgaaaggacactgcggggtatggcaaatctgaccgcctttcctgggtggtcaagtcactccccattgacgaaacctctcgatatatgcgtgaaatacctttccggactactggaagtaataacctctttctacgtggagagaggtggaaacgcaatgtcattcatgggcaaaggcgtgaccaaatcaacaatcctgtgtctgctccatctgtcccacgaaatgatggcacaagcggggagtctggagtggatgtctttgtggtttctgccactgggttctcactccgaggagcacattcctacccagcagggtctggcttggttgattcctctctgggtcgatcgagaccccgaggtgcggttcacaagccttggattaggcagtgccctcactacattagagactggatgcgtggccctcgccaatagctgtcagaatatatctggtggcctgtggggaacagtggtgaacatcttactggaccagagcgagtgctctatggtcaggcgagaggctgcttttatcctgcagaatctgctcgtaatccccatgcccactgaaatcatcaaagattacacctggcagggaccttgcgttcacgatgaggactctggactcagtctcataggcaaaccggccttacaggccctgctgtatcactgccacttctatgagcatctgaaccagatggtcaaacattgttacctgggaagatgcatgttcgatctgaacttttcagcattcgatagaaacagcgaatcaaatgacctgaacggcttggatgactccttcaaattctggagagccccttctcggaccagtcaggatagagacccttcatccctgtctacttctgagacaacggtcgcaccaagcttgggtagcactgaattccaacctctcgtgcaaagcacaacgttgctaccagaggccagtcacgatcagttcgtggcccaggggcaccaagagtctaccagcccccgccccccccatgatagcagtttgtcagctcctctccctaaactgtgtgtatttgtgactccgagcctcctttctgccatgtgctcccttcttgacaacctgctgacgatcgccccccgtgataccgctaaagccttccgacaggcccacctgattgagctgttatgtagcatcgctgacgcaaccctgattcagacttgtgtgcaggaacttcgggccctgctcccctcatctcccccggctgaacatactcaggcccaggtctcatttctgctcgagtatttgtccagcctgtcgcgcttgctgcaaagttgcctgctagtagagcccgatctcgtgatccaagacgaattggtcaagcccctgatcaccaatatcatcggaatcttgaccatttgtacaaaggacgtccttgataaggagctgatttctgctttctatcatacttggacacacttattcaacctcctcgcgatgttactgcgtaaagctggtgccattaccctgccatttgttaccgtggccctcgctaagcactggacggccgcgattgatatgttctgtacttgtgcaggactcagcgctacatgccctgcactgtataccgcttcactgcagtttctgagtgtgctgctcaccgaagaggcaaagggccacctgcaggctaaatccaaaacccacctttgctgctcacccacggttgccagtctgctggacgactctcaagagaaccaaaagtctctggaacaattatccgatgtcattctgcagtgctacgaagggaagagttcaaaggatatcctgaaacgcgtggctgcaaacgcactgatgtctctgctggccgtctcaagaagagcacaaaagcacgccctgaaagctaaccttatcgataactgtatggagcagatgaagcacatcaatgcacaactaaacctggactctttgcgacccggaaaggctgccctcaagaagaaagaagacggagtcatcaaagaactgtcaatagccatgcaactgctccgtaattgtttatatcagaatgaagaatgcaaagaggccgctctggaggcccatctggtgcctgtgcttcactcattgtggccgtggattctcatggacgacagcctgatgcaaatttctttgcagttgctctgtgtgtacaccgctaactttcctaacggctgtagctctctctgctggagctcctgcggtcagcaccctgtgcaagctacccatcggggcgccgttagtaacagccttatgttatgcatcttgaagctggcctctcagatgcccctggaaaataccactgtccagcagatggtttttatgttgctatcgaacctggccctctcccatgattgcaagggagtcattcagaaatctaactttctgcaaaatttcctctccctggccttgcccaaagggggcaataagcacctgtccaatttgacaatcctgtggctaaagttactgcttaacatcagctctggcgaggatggtcagcagatgatcctgcgattggatggctgcttagacctactgactgaaatgtccaaatacaagcacaagtcgagtccactcctccccctgttgatcttccacaatgtatgtttctcacctgccaataaaccaaaaatcctcgcgaatgaaaaagtaataaccgttctcgccgcatgtctggagtcagaaaaccagaatgctcagaggatcggggccgcggccctctgggctctgatttacaattatcagaaagccaaaacagctcttaaatcccccagcgtgaagcgacgcgtggatgaggcctacagcctggccaagaaaacgtttccaaattcagaagccaatccactgaatgcctactacttaaagtgcctggaaaatctggtgcagctgctcaattcttcttag

SEQ ID NO: 50768 - DNA, 4782 bp, Artificial Sequence
  Description of Artificial Sequence: Synthetic coding sequence
atggtgctggccggcctgatccggaagctgggccaccagctggccgaaatacgcgagagggctctcaagagcattttatgcaagatcgagcataacctgatttgctacgccgacttgattcaggaaagacagctgttcctgcacctcctcgaatggtttaactttccatctgtgcccatgaaagaggaagtgctaaatttattgagtaggctcgtaaagtacccccctgctgtgcagcatctggttgatgttggcgctgtggagtttttaagcaagctcagatccaacgttgagccgaatctgcaggcagagatcgacggcattctggatggtttgtttctcttaccaagcgaagtgcctgccctctcttctgcctcatatcagacaaaccagacagaactgtccaaaaatcccgaaatcctaacaggatattttccacaggataagtcgaacttccagcagatggaggttccacctcgtcctgttgtgaatcagacagtgaagtgcttgaagttttctacattcccctggctccctctgaccacgaccgatcgtcatgttctctctagcaatgaaagttccctgagaagctccaaccacaccctgatctggaacacctgcgaattgcttaaggacgtgatcatgcaggacttcccagccgagatcttcctgcagcgtcctaagattgtccagagcctactgtccctcttgaagctggccttcggcgacggaaagcatcggctggcccttcagtctgtatcttgcctgcagcagctgtgtatgtacctgcgaaatcggctaaactttcaccgggatccaggcttcttttccaacaaacatgacacagtaagccaaaacagctcgctgagctactgtcacgaggcgcgcggcacccaccactctcagaatcctagccccggttcctcctccccccgccctagtgtggtaggacggaccggccagaggccacggggcgacggccaggactgggacgcggcgtctagctctggaagtagcagccatgcccacgtgaactcccggatcagtgtccactcccccctggatatgggccatattgaccttccagaactggaaactgaggataccctggagctgcagtttcaacagctgtctctgccgcagttctgtgtgagcatcctagagtcagcagtgccacttctgagaaccgggtcaagacaggtcattatccgtgtcttggagctgctcaccgaggatatgacactcatcggtgaggctatttctaccgacatctgggacgattcaagcctctttgggatagacatgaaggagaaattgctcctggtgcttggggccctcggtgagacaatgtgctaccacaagagttctatttcccttgaacagcctgaggtgatgctcgtgcatcaccgcatggccttcatctctatctcactgtttgccgtccgactgctgcagaccttattgccagtggagaaagccagcgaattcctgagcgaaccaatgagcaccgcactgttcctgttgtctctcgatatgcccataagcttagagtaccccaacatccatgaagctgtggtcgcttatctcgagcagctgaattctgaaaactactccatctacaaaagaacagctgaagcagtgtactccatcgaatgtacatgcaacttcctgagtgacattgggaaggaaggcgagaagaacctgctcgagctggtcgaacttgcagatcaggcattgcgctccttcagttatcatcaacatttcccccttattaaggagatcatatctatctgctccaagatctggaagtctgctcaggcttctccattgctgcagggagaatcccaaaaggttctgctgcacatgctgagtcatcctctgcccagggtgaaagcagagacataccattgctgcctcgagatcactaaagagtgtctaggagtacataatgtgactaaacctgtttccagtctgtgcaatggaatacatttcctgctgcacccaaaggtactgtatgaaatttccgtcttcggcatccaggaacctgagtctgaggtgaacactgcggctaaggctatactgctatacctgcttcagggtcgactgatgatgacagcactgacctggaataagttcattgagagtttgtgccccgttattcccattctccagggctacgccgacactgaggaccctctgggaaattgtattctgttactgtccaaagcaagttccgacaccgaagagatgctcccctgcacgactcgcctgaaatccatgctgaggctgctgctcgtcaaaaagccgtcagtcaggtctctcgcgctgaagttgttagcctttcatcttacatctgaggaaggagctgacaccaagaggccattaatcgacgcccgggttctgagccgggtgacagacttgtttatcggcaagaaaccaatcgagctccgcctagacgacaggagagagctggtcattaagctggagaccgtggagaaggtgtacgaaatctttacatcagatgacgtggatttagtgttgcgtaagagcgctgcggagcagctcgcagttatcatgcaggacattaaaatgcatgctgtcgtcaaaaagctgtgcctcatcgataagattatcgaatatttgaacgagtgcgtaagtcaagatggtaaggtagtggagtgcctcgttcagccatgcttgacattactgagaaaagtcttgtgcggtgatcctgtcatgagagtgagtctcagtcagcagtcttcgctgctgacagtcctgttcagggtgtctttgatctttcacgaggactgttccgtcgttacagaggtgggtgctctgttttgcctgctgctgttcgatgaggttagcaggatggacatgtggtccgtcaacccatccaataaaccttcactgccctcagtgttttcactgcccgtctctgtcttccgcagatatcatctaccggtgcacgtaattggccatcatgcagtgtcaccatactcaattgtgctgccactgtcagctgactgtctggctcttaaacctgtgagcgatatgctgaggatcgcgtggaatttgtcttggtaccatggcagtgataacctgctaaagcaaatgaacagcgagacgaagacccaggaaatcctcgatgcactgaaactgagcacagaagacatcctgaccctgaaaataactcatatggcttctggattgcaagattgccttcactcaatagtgcaggccgcaacacaccgagaagttcgcgcagctgtcacacgcatgtcgttttacctgttaaacgacagactgagcctgaaagggtgccccgggccatgtggtgtaacgcttaagtctctcgcctggcatacggcactgaaccggtttctgcaggttctgccagcttgcacggaggatgagaagttgcttattgatataattcactttctcaataaactaatcaaggagcagaggaagaactcaagccttgaactgctgaattggatcttggagttgctgctgcggcattctgcaaacccactgcttgacctactggttctgaccgaatctcaggccagggaggagactgatgatatccgtacggccgtgcgtcagcaactgcagaaagaattgattgctctttttgacacactgctactcaatttcatggaagtcacagatcgcaagtgctccgagctcctttatgtgtttcagacacaattggccctgaaactacttcaatgtctgaaggtcactgacgcgccccatttctacgggctgccatctctggagaggaccctgcgagggatggccaacctgacagctttccctggttggtcctcccacagtccgttgaccaaacccctagatatatgtgtaaaatatctgtccggtcttttggaggtcattacttccttctatgtggaaaggggagggaatgcaatgtcctttatgggaaaaggtgtcacaaagtcaaccatcctctgtctcctccatctgtcacatgaaatgatggcccaggctggcagtctggagtggatgtcgctgtggtttcttcccttgggcagccattctgaagaacacatacccacacagcagggcttagcatggttaatccctttgtgggtggatcgagaccctgaggtgcgattcaccagcctggggctgggcagcgccctcacaactctggagactggctgcgtggctctcgctaacagctgccagaatatcagcggcggactgtggggtactgtggtgaacattttgctcgaccagtctgagtgcagcatggtgagaagggaagccgccttcatccttcagaacctccttgtcattcccatgcctacagagattattaaggactacacatggcagggaccttgtgttcacgacgaagactccggtctcagtctaatcggcaagcccgcactgcaggctctcctttatcattgtcacttttacgaacacctcaatcagatggtgaagcattgttatctaggacgctgtatgttcgaccttaatttctcagcctttgacaggaattctgaaagcaatgatctgaatgggttggacgactcatttaaattctggagggcacccagcaggacctcccaggatcgcgacccaagcagcctgagcaccagcgaaacaaccgttgccccttccttggggagtactgagtttcagccgctggtccagagcaccacactactgccggaggcatctcacgatcagtttgtggctcaaggaaacagacattttggcactaatattcagttttag

SEQ ID NO: 50769 - DNA, 2640 bp, Artificial Sequence
  Description of Artificial Sequence: Synthetic coding sequence
atggtgctggccggcctgatccggaagctgggccaccagctggccgagatccgggagagggccctcaaatctatcttatgtaagattgaacataacctgatttgctatgccgacctgattcaggaacgtcagctctttttacacctgcttgaatggtttaacttccccagtgtaccgatgaaggaggaggtcttgaacttgctgagccgattggtgaagtatcctcccgcggtacagcacctagtggatgtgggagcagtcgagttcctgtcgaaactgcggagtaatgtcgagcccaacctgcaagcagaaatcgatggcattctcgacgggctgttcctgctccctagtgaggtgccagccctcagttctgcaagctaccagactaaccagaccgaactctcaaagaatcctgaaatcctgacaggttacttcccgcaggacaaatccaatttccagcaaatggaagtaccaccccgcccagtcgtcaaccaaacggtgaaatgcctcaagtttagcacattcccttggctgcctctgaccaccacagataggcatgtcttatcctctaatgagagctcactcaggtcttctaatcacacactgatctggaacacatgcgaactgcttaaagacgtgattatgcaggactttcctgccgagatcttccttcagagacctaaaatcgtacagtccttgcttagtctgctcaagctcgcctttggcgacggtaaacaccggctcgctttacagtctgtgtcatgtctgcagcaactgtgtatgtacttgcgaaatagattaaattttcaccgcgaccctggctttttctcaaacaagcatgacactgtcagccagaactcatcattaagctactgtcatgaagctaggggtacccatcacagtcagaatccatctcccgggtcctcaagcccacgcccttccgtggttggacgcaccggtcagcgccctaggggagacgggcaggattgggacgcggcttcatccagtggctcttccagccacgcccacgtgaacagccggatcagcgttcacagcccactggatatgggccacattgacctgccagagttggagactgaggacacgctggaactgcaatttcagcagctgtcccttcctcaattctgtgtgtctattctggaaagcgctgtgccgctgctgcgtacgggcagccggcaggtgatcatcagggtcctggagctgctgacggaggatatgaccctgattggtgaggctatctcaactgacatatgggacgactcctcactctttggtatcgacatgaaggagaagctcctgcttgtgctaggcgccctgggcgagacaatgtgctatcataagtcctccatcagtctagaacagccagaagtcatgctggtgcaccaccgcatggcatttataagcatctctctgtttgcagtgaggctactccagactttactgccagtcgagaaggcaagtgaattcttgtccgagccgatgtctacggccctattcctgctgtctctggacatgcctatttcgcttgagtaccccaacatccacgaagctgtggttgcctatctggaacagctgaacagcgaaaactattcaatatataagaggaccgcggaagctgtgtattctatcgagtgcacgtgcaattttctgtcggacattggcaaagagggagagaaaaatttactggaattagtagaactggccgaccaagcccttcgcagcttttcctaccatcagcacttccctttaataaaggaaatcatatccatttgctcaaagatttggaaaagcgctcaggccagccccctcctccagggggagtcccaaaaggttctcctccacatgctcagccatccactccctcgagtgaaagctgagacataccactgctgcctggagatcaccaaagaatgcctgggtgtccacaacgtcactaaaccagtgtcttcattatgtaacgggatacactttcttctccatcctaaagtgctctacgagatcagcgtctttggtatccaggagccagagtccgaggtcaacacggctgcaaaggccatccttctgtatctattgcagggaaggttgatgatgacagccctgacttggaacaagttcattgagagcctctgccccgtgattcctatccttcaggggtacgccgacaccgaggaccctcttggcaactgcatactgctcctgagcaaggcatcaagcgataccgaagaaatgctgccatgtaccacaagattaaagagcatgttgaggttactactggtaaagaagccaagcgttcggagccttgccttgaaattactggccttccacctgacaagcgaggaaggagctgacacaaaacgccccttgatcgacgcccgggtgctctcacgggtgacagatttgtttattggcaagaaacctattgagctcagactcgacgaccgccgggagctcgtcatcaaactggagaccgtggagaaggtgtacgagatttttacttcagatgacgtggatctggtgctgcgtaagagtgcagctgaacaactggccgtgatcatgcaggggtgcagaatgttcgggacaactatgccgcacacgcttgaggagggcttcatgtggtag

SEQ ID NO: 50770 - DNA, 438 bp, Artificial Sequence
  Description of Artificial Sequence: Synthetic coding sequence
atggccgagagcctgcggagcccccggcggagcctgtacaagctggtgggctctccgccttggaaagaagcctttagacagcgctgcctggaacgaatgcgtaattctagggacagactattgaacagataccggcaggcaggctcttccggaccaggtaactcccaaaacagttttctggtacaggaagttatggaagaagaatggaacgctttgcagtcagttgagaactgccctgaggatttggcccagttagaggaattgatcgatatggcagttctcgaagaaatccagcaagagttaataaatcaagaacaaagcattatatctgaatacgaaaaatctctgcagtttgacgagaaatgtctgtctattatgctggccgaatgggaggcaaatcccctgatttgtcccgtctgcaccaatttgctctcctag

SEQ ID NO: 50771 - DNA, 519 bp, Artificial Sequence
  Description of Artificial Sequence: Synthetic coding sequence
atggccgagagcctgcggagcccccggcggagcctgtacaagctggtcggttcaccgccttggaaagaggcattcaggcagcgatgccttgagcgcatgcgaaacagccgggacaggctgctcaatcggtaccgtcaggccggcagtagcggacctggtaacagtcagaactcttttctcgtgcaggaggtaatggaggaagagtggaatgcacttcagagtgtcgaaaattgtcctgaagacctggcccagcttgaggagctgatcgatatggcagttctggaagaaatacagcaggaactgataaaccaagaacagagcattatttctgagtatgagaaatcacttcagttcgacgaaaaatgcctctccatcatgttggccgagtgggaggctaaccctctgatttgcccagtgtgtaccaagtacaaccttaggatcacttccggagttgtcgtctgccagtgcgggttaagcatcccttcccacgcttgtgacacctgggcggtgatactgtag

SEQ ID NO: 50772 - DNA, 660 bp, Artificial Sequence
  Description of Artificial Sequence: Synthetic coding sequence
atggccgagagcctgcggagcccccggcggagcctgtacaagctggtgggctccccaccctggaaggaagctttccgccagcggtgtttagagcggatgcgcaatagtcgggataggctcctaaacaggtatcgacaggcaggcagctcaggaccgggtaattcccagaatagcttcctggtacaggaagttatggaagaggaatggaacgctttgcaatccgtggaaaattgtcctgaggaccttgctcagctggaagaactgattgatatggcagtcctcgaagagatccaacaagagctgattaatcaagagcaatcaattatttccgagtatgagaagagcctacagtttgacgagaaatgtctgtcaattatgctggccgagtgggaagccaacccattgatctgtccagtctgcactaaatacaatttacggatcaccagcggggtcgtcgtgtgtcagtgtgggctcagcattccctcccactcatccgagctgacggagcagaagctgcgtgcctgcctcgagggcagcatcaacgagcattcggcccactgtccacatacccccgagttctcagtaaccgggggaaccgaagagaagagcagcctgctcatgagctgcctcgcttgtgatacctgggctgttatcttgtag

SEQ ID NO: 50773 - DNA, 696 bp, Artificial Sequence
  Description of Artificial Sequence: Synthetic coding sequence
atggccgagagcctgcggagcccccggcggagcctgtacaagctggtgggctctcccccttggaaggaggctttcagacagaggtgcctggaacgcatgcgcaattctcgcgatagattgctgaaccgatacagacaggccgggagctctgggcccggtaatagtcagaattccttcctggtccaagaggtgatggaggaggaatggaacgcactacagtcggtggagaactgtcccgaagacctcgctcaactcgaagagttaatcgatatggccgtgcttgaggagattcagcaggagttgataaatcaagagcaaagcattatctccgaatatgagaagagcctgcagtttgacgagaaatgtctgagtataatgcttgcggaatgggaggccaacccgctcatttgtcctgtgtgtaccaagtacaacctgaggattacctcaggtgtggtcgtgtgccagtgcggactgtctatcccgtctcactccagcgagctcacagaacaaaaactgcgggcctgtctggagggttcaattaatgaacatagtgcgcattgtcctcacacccctgagttctcagtcaccgggggcacagaagagaagtcttctctgctgatgagttgtctggtgtctgtatcctgggatccgctttgcggtaaacgcgatctgtggttagtgctttttccaccctag

SEQ ID NO: 50774 - DNA, 321 bp, Artificial Sequence
  Description of Artificial Sequence: Synthetic coding sequence
atggccgagagcctgcggagcccccggcggagcctgtacaagctggtcggtagtcccccgtggaaggaagctttccggcagcggtgtcttgagagaatgcggaactcgcgcgatagactccttaatcgctatcgacaggccgggtcatctgggcctggcaattcacaaaacagctttcttgtccaggaagtgatggaggaggagtggaacgctctgcaaagtgtggagaactgccccgaggatctagcccagctggaggaactcatcgacatggctgtgctcgaggagatacagcaggagctgatcaaccaggggctgtag

SEQ ID NO: 50775 - DNA, 447 bp, Artificial Sequence
  Description of Artificial Sequence: Synthetic coding sequence
atggccgagagcctgcggagcccccggcggagcctgtacaagctggttggatcacctccatggaaggaagcattcaggcagaggtgcctcgagcggatgcgcaactctcgagacagactgctaaacaggtataggcaagctggaagcagcggtccaggcaattctcagaactcgttcttggtgcaagaagtcatggaggaggaatggaacgcccttcagtccgtggaaaattgccccgaagatttggcccagctcgaggaattgatcgatatggccgttctggaggaaatacagcaggaattgataaaccaagaacagagcatcatcagcgaatacgaaaaatccttgcagtttgatgagaaatgtcttagcatcatgctggcggagtgggaggcaaatcctttaatctgccctgtatgtactaagccagtcatccttggactatag

SEQ ID NO: 50776 - DNA, 321 bp, Artificial Sequence
  Description of Artificial Sequence: Synthetic coding sequence
atggccgagagcctgcggagcccccggcggagcctgtacaagctggttgggtctcccccctggaaggaagcatttcgtcagagatgtcttgagcgcatgagaaactctcgcgatcggctcctaaacaggtatcgacaggctggctcttcaggccctgggaattcccagaactcgttcctcgtccaggaggtgatggaggaagagtggaacgccctgcagtcagtggagaattgccctgaagacctcgcccagttagaagaactcattgacatggccgtactggaagagattcagcaggaactgataaaccaggtcttctag

SEQ ID NO: 50777 - DNA, 591 bp, Artificial Sequence
  Description of Artificial Sequence: Synthetic coding sequence
atggaggccgaggacgaggacgagaagtacctgcaggagtgcctgtctaaaagtgacagtctgcagaagcagatatcccagaaagagaaacaactggttcagctggaaacggatctgaaaatcgaaaaggagtggaggcagaccctacaggaggatctccaaaaggagaaagacgctctgagccatctgaggaatgaaacccagcagatcataagtctgaaaaaggagttccttaatcttcaggatgaaaatcagcagttgaagaagatctatcatgagcaggagcaagccctgcaggaactgggtaataaactgagcgaaagtaaactgaaaatcgaggacatcaaagaggcaaacaaagccctacagggattagtgtggctgaaggacaaagaagcgacccactgtaaactatgcgaaaaggagtttagcctttctaagcgtaagcatcactgcagaaactgcggggagattttctgtaatgcttgcagtgataatgaattacctctgccaagctctcccaagcctgtgcgggtgtgcgactcgtgccacgcattgctcatccagagatgttctagtaacctgccatag

SEQ ID NO: 50778 - DNA, 699 bp, Artificial Sequence
  Description of Artificial Sequence: Synthetic coding sequence
atggccaccaaggaccccaccgccgtggagcgggccaacctgctgaacatggcgaagctgagtatcaaggggttgatcgaaagcgcactttcattcggccgcacactcgattccgattatccacctcttcaacagttcttcgtcgtgatggaacactgtttgaaacatgggctgaaggtgaggaaatcattcctgagttataacaaaactatctggggccctcttgagctcgtggaaaagctctaccctgaggcagaagaaattggggcatccgtgcgggaccttccaggactgaaaacccccctcggccgcgcacgtgcatggctccgcctggctctgatgcaaaaaaagatggccgattatctgcgctgcctcattatccagagagacctactgtcggaattctacgagtaccatgcgctcatgatggaagaagaaggggctgtaatcgtggggctcctggtggggttgaatgtaatcgatgccaacttatgtgtgaaaggggaagaccttgactcacaggtaggagtgatcgacttctccatgtacttgaagaatgaggaggacattggaaataaggaacgctacgactttcataagcttttccacattctgggcttcctgtactcttcactgcagattattatcaggagcatctacctgcagtgcggattcattctgctcttcagccctctctag

SEQ ID NO: 50779 - DNA, 1926 bp, Artificial Sequence
  Description of Artificial Sequence: Synthetic coding sequence
atgaccttccaggtgtggggctggcggcgggaggacgccagccaggtgttggcatgggtgcctgatgctgaaggcggacggagaggtatgctgacacggaggagcctggctacgaaggatccaacagctgtggaacgagccaacctgctgaatatggcgaagctgtcgattaagggattgatcgagtccgccctgtcgttcggcaggactctggattccgactatccaccattgcaacagttcttcgtcgtaatggagcactgtttgaaacatggtctgaaagtgagaaagtctttcctcagttacaataaaactatctgggggccattagagctggtcgaaaagctgtatcccgaggccgaagaaataggagcatccgtcagagatctccccggactgaaaactcccctcggaagagcccgagcctggttgagactcgcactgatgcaaaagaaaatggccgattacctgcggtgcttgattatccagagagatctgctatctgagttctacgagtatcatgcactaatgatggaggaggagggtgccgtcatagtgggactcctcgtgggactcaacgtgatcgacgctaacctgtgtgtgaagggtgaagacctggactcacaggtgggcgtcatcgacttctctatgtatttgaagaacgaagaggacatcggcaacaaggagcgaaatgttcaaattgctgccatccttgaccagaaaaattatgtcgaggaactgaaccgtcagctgaacagcacggttagctctctccactctagggtcgactcactggaaaaaagcaacaccaaactgatagaagaacttgcgattgcaaagaacaatatcattaaactccaggaagaaaatcaccaactgaggtccgaaaacaagctgatcttgatgaaaacccagcagcacttagaggtgaccaaggtcgacgtagaaaccgagctgcagacctacaaacattcacgccaaggccttgacgagatgtacaatgaggcaagacgccagctcagagatgaatctcagctgaggcaggatgtggagaacgaactggcagtgcaggtctccatgaaacatgagattgagctggcgatgaagctgttggagaaggatattcacgagaagcaggatactcttattggcctccgccagcaactggaggaggtcaaggccatcaatatcgagatgtatcaaaagttgcagggttccgaggacggtctcaaagagaaaaacgaaataatcgccagactggaggagaagactaataagatcacagccgccatgaggcaattggagcagcgtttgcagcaagccgagaaggcgcagatggaagcagaggatgaagacgaaaagtacctgcaagagtgtctgtccaaaagtgacagcctgcaaaaacagatctcccaaaaggagaagcagctggtccagctggaaaccgacctcaagattgagaaggagtggcgacagacactccaggaagacttgcagaaggagaaggatgccttgagccacctccggaacgagacccagcagattatctcgctgaagaaggaatttctcaatctgcaagacgagaaccagcaactgaagaagatctatcatgaacaggaacaggccctgcaagaactcggcaacaagctatcagagtctaaacttaaaatagaagatattaaggaggctaacaaggccctgcagggcctggtttggctaaaggacaaagaggctacccattgtaagttatgtgagaaagaattctctctttccaagcgcaaacaccactgtcgaaattgcggagagattttttgtaatgcttgcagcgataacgaacttccactgccatctagtcccaagccagtcagggtctgtgattcttgccatgcattgctgattcagagatgttctagcaacttgccatag

SEQ ID NO: 50780 - DNA, 1212 bp, Artificial Sequence
  Description of Artificial Sequence: Synthetic coding sequence
atggccaccaaggaccccaccgccgtggagcgggccaacctgctgaacatggcaaagctgtcgatcaagggtctgatcgagtccgcattgtcctttgggcgcacactggactctgattatcctcccttacagcagttcttcgtcgttatggagcactgcctaaaacacggactgaaggtgagaaagagctttcttagttacaacaagaccatctggggcccactggagctcgtggagaagctctaccccgaggctgaggagattggcgccagcgtgagagatctcccgggacttaacgaattttacgagtatcatgctcttatgatggaggaagagggagcggtgatagttgggctcctagtaggcctcaatgtcatcgatgcaaacctttgcgtcaagggtgaagatttggattcacaggtgggcgtaatcgacttttcaatgtatctgaagaacgaagaggacataggtaacaaggagcgcaacgtccagattgcggcaatcctggatcaaaaaaactacgtcgaggaactgaaccgacaactcaattccactgtgagttccctgcattctcgggtggattccttggagaagtctaataccaagttgatagaggaactggctattgcaaagaataatatcatcaagctgcaggaagaaaaccaccagctgagaagcgaaaacaaattaatcctcatgaagacccagcagcacttggaagtgaccaaagtcgacgttgagacggagcttcagacctacaaacactcaaggcagggcctggatgaaatgtacaacgaggcacgcaggcaattacgggacgagtcccagctgcgacaagacgtggaaaatgagctcgctgtgcaggtgtcaatgaagcatgagattgaactggcaatgaagctgctggagaaggacattcacgaaaagcaagacactttaatcggattgagacaacagctggaagaggttaaagcaattaacatcgaaatgtaccagaaactgcagggaagtgaggacggacttaaggagaagaatgaaatcatagcaaggctagaagagaaaaccaacaagattaccgctgctatgcgccagctggagcagtcagataacgacctgcttacccagaccagaacaatagcgatgagcttggttaaatgcgcatcttccgacacccaagaccagtataaactcgttaaagatattagtttttag

SEQ ID NO: 50781 - DNA, 1140 bp, Artificial Sequence
  Description of Artificial Sequence: Synthetic coding sequence
atggtgcggaagagcttcctgagctacaacaagaccatctggggcccactggaattagtggaaaagctctatccagaagcagaggagattggcgcctccgtacgagatctgcccggcttgaaaacacccctgggaagagccagagcctggctcaggttggctctcatgcagaaaaaaatggccgattacctcagatgcctaatcatccaaagggacctgcttagcgaattctacgaatatcatgccctaatgatggaagaggagggcgcagtgattgtgggacttctagtcggcctgaatgtaatagatgccaatctgtgtgtgaagggcgaggatctcgactcccaggtcggtgtcatcgatttttctatgtacctgaagaatgaggaagacattggaaacaaagaacgaaacgtgcaaatagcagcaatcttggatcaaaagaactacgtggaagagctgaaccggcagctgaactctacggtcagctcacttcattctcgtgttgattcactggagaagagcaatactaagctcattgaagagctggcaatagctaaaaacaatattatcaaactacaggaggagaaccaccagctgcggtccgagaacaagctgatcttaatgaagactcagcagcacctagaagtgacgaaagttgacgtggaaaccgaattacagacctacaaacattcaaggcaggggctggatgagatgtacaacgaagcaagaagacaattgagagatgagagtcagttgagacaggacgtcgaaaatgaacttgccgtgcaggtctccatgaaacatgagatcgaactggctatgaagctgctggagaaagacatccatgagaaacaggatactctgattgggttgcggcagcagctcgaagaagtgaaagctatcaacatcgagatgtatcagaagctgcagggatccgaggacggcttaaaagaaaaaaatgaaatcattgctcgactcgaggagaaaaccaacaagattactgctgcaatgcgccagctggagcagagtgataatgacttgctgacacagacacggaccatagcaatgtctctggttaagtgcgcttcttcagatacacaggatcaatacaagctggtcaaggatatctcattttag

SEQ ID NO: 50782 - DNA, 2529 bp, Artificial Sequence
  Description of Artificial Sequence: Synthetic coding sequence
atgaagcggggccggctgcccagcagcagcgaggacagcgacgacaacggtagcttgagtacgacctggtcccagaatagccgcagtcagcaccgccgaagcagctgctccagacatgaggaccggaagccatctgaagttttccgtactgatttaattacagccatgaaactgcacgattcctatcaattaaaccccgatgaatattacgtcttagctgacccgtggcgccaggagtgggaaaaaggcgttcaggtgcccgtcagtcctggaaccattcctcagcctgtggctagggttgtgtctgaggaaaagtccctcatgtttataaggcccaagaagtacattgtgtcgagcggaagcgagccgccggagcttgggtatgttgatattagaaccttagctgactctgtgtgcaggtacgatctcaacgacatggatgccgcctggctcgaacttactaacgaagaatttaaagagatgggcatgcccgaactggacgagtacaccatggaacgggtgctggaggaattcgaacagcgctgctacgacaacatgaaccacgccatcgaaactgaagagggcctcggaattgaatacgatgaggacgtcgtttgtgatgtctgtcaatcccctgacggagaggacggcaacgaaatggtgttctgcgataagtgcaatatctgcgtccatcaggcgtgctatggcatcctgaaagtgccagaaggcagctggctttgcaggacctgtgccttgggtgtgcagcctaaatgccttctttgtcctaaaaagggcggtgccatgaagcctacccgatcagggacaaaatgggtccatgtgtcatgcgccttgtggattcccgaggtgagtatcggatcaccggagaagatggagcccattactaaagtttcccacattccctccagtcgttgggcgctggtgtgttcactctgcaatgaaaagtttggagcctcaatccaatgttctgtgaagaactgcagaacagctttccatgtcacgtgcgccttcgatcgcggactagagatgaagaccatccttgccgaaaatgacgaggtcaaattcaagtcctattgtccaaagcactcaagtcatcggaaaccggaagaaagcctaggtaagggagctgcccaagagaacggtgctccagagtgcagccctaggaatccactggaaccctttgccagcctagaacagaatcgggaggaagcccacagggtgagcgtccgaaaacagaagcttcagcagctggaggacgaattctacactttcgtgaatttactggatgtcgctagggcactgaggttacctgaagaagtggtagactttttgtaccagtactggaagcttaaacgtaaggtgaatttcaacaagccactgataacccctaagaaggatgaagaagataatctggcaaagagggaacaggacgttctattcaggcgactgcagttgtttacacatctccgacaggatctggagcgcgtacggaatctcacctacatggtcacccggagagaaaaaataaagcggtctgtgtgcaaggttcaggagcaaatctttaacttatatactaagctcctagaacaggaacgcgttagtggcgtcccatcttcttgtagctcgtcaagcttagagaacatgctgttattcaattctcccagtgttgggcctgatgccccaaagattgaagacctcaaatggcacagcgctttcttcaggaagcaaatgggcacgtcactcgtccacagtctgaaaaaaccccacaagagggatcccttgcagaactcccctggttcagaaggtaaaaccttgttaaaacagccagacctgtgtgggcggagggagggcatggtcgtccccgagagctttctcggactcgagaagacttttgctgaggcccgcttgatttccgctcagcagaaaaacggggttgtgatgcccgatcacggaaaacggcgcgacaaccggttccactgcgacctcatcaagggcgatctgaaggacaagtcatttaaacagtcccacaagcccctcagatctacagatgtatcacagcgccacttagacaatacccgcgccgccacctctcccggtgttggtcagtccgctcccggaacgcgaaaggaaattgtgccaaagtgtaacggaagcttgatcaaagtgaactataaccagactgctgtgaaagtacccacgactcccgcctcgcctgtgaagaactggggaggattcaggatccccaagaagggtgaacgacaacagcaaggagaggcccatgatggagcttgtcaccagcacagcgattatccctacctgggcctcgggagggtccctgctaaagagagagccaaatcgaaacttaagagcgataacgagaatgacggttatgtccctgatgttgagatgtctgacagtgaatctgaagcctctgaaaagaaatgcattcatacatcttccacaatctccaggcgaactgacatcattaggagatccattctggccagctag

SEQ ID NO: 50783 - DNA, 1521 bp, Artificial Sequence
  Description of Artificial Sequence: Synthetic coding sequence
atggccgagaccccccccccccccaccgccggcgccgagagctgcagcgaggaacctgctagaggtggcgagtggcgccccgaggagccaaggcgggctcctgccggcggcaccgacagagagggcgaggcaggccctccccccgcctcccctgctgggcagagcgagcccgattctccagtcgccgcgcctttctttctgttgtaccctggggacggaggtgctggctttggcgtccgtccacctccccagcagcagcgcagttggcgaacccctccaagtcctggcagccccttaccgttcttgcttctatcctatccctccgggggtggcggcagcagtggctccggaaagcatcaccctaattatctcatggcaaacgaacgcatgaacctgatgaacatggccaagctctccattaagggcctgatcgagtcagccctgaacctcggtagaacattggactcggattatgctcccctgcagcagttcttcgtggtcatggagcactgcctgaaacacggcctgaaggctaagaaaacatttttaggacaaaataagtctttttgggggcctctggagttggtggagaaactggtgcccgaagcagccgaaatcaccgccagcgtgaaggacttacctgggctgaagacccccgtgggcaggggtagagcctggctgcggctggctctgatgcagaagaaactctctgaatatatgaaggcactgatcaataaaaaggagctcttgtcagaattctacgagccaaacgcacttatgatggaggaggagggagccattattgcaggcctgttggtgggcctgaacgtcattgacgccaacttttgcatgaagggcgaggatctcgattcccaggtgggagtgatcgacttcagtatgtatcttaaagacggcaatagcagcaaggggactgaaggcgacggtcaaattaccgcgatcctcgatcaaaagaattacgtggaggaactgaatcgccacctgaatgccacagttaataatctgcaggcaaaggttgacgccctggaaaagagcaacacgaaactgaccgaggagctagctgttgccaacaaccggattattactctgcaggaggagatggagcgcgtgaaggaagaatccagctacatcctggagtccaaccgaaaaggccctaaacaggaccgtaccgccgaaggacaagctctcagtgaagccagaaagcacctcaaagaagaaacccagctgcggctggatgtcgagaaagagttggagatgcagatttctatgcgtcaggagatggagttggccatgaagatgctagagaaagatgtatgcgagaagcaggacgccctagtcagtcttaggcagcaacttgacgatttacgcgcgctcaagcacgaactagcctttaaactgcaatcatctgatttaggtgtgaagcagaagtcagagctgaatagccgactggaagaaaaaacgaaccaaatggccgccaccatcaagcagctggagcagcgttag

SEQ ID NO: 50784 - DNA, 297 bp, Artificial Sequence
  Description of Artificial Sequence: Synthetic coding sequence
atggccgagaccccccccccccccaccgccggcgccgagagctgctcagaggagccagctagagggggcgagtggcgcccagaggagcctcgaagggcacctgccgggggcaccgacagagaaggggaggcgggtccccctcccgcaagcccagccggccaatcagagccggatagcccagtcgctgcgcccttcttcttactctatcctggggacggcggggccggcttcggagtgcggccccccccacagcagcagcgctcttggaggacccctccctcacctgggtcaccctag

SEQ ID NO: 50785 - DNA, 1362 bp, Artificial Sequence
  Description of Artificial Sequence: Synthetic coding sequence
atggacggcgagtggctgtgcctgcgggagctggacgacatcagcctgaccccagacccagagccaacccacgaggacagctgggaggatctcaccgacttggtggagcaaatgagggatgacactgaggatccgaattatcttatggccaatgagcgcatgaatctgatgaacatggcgaagctgtccattaaagggttgattgaatcagcgctgaacctgggaagaacactagattcagactatgcacccctccagcagttttttgttgtgatggagcactgtctgaagcatgggttgaaagcaaagaagacctttctgggccaaaataagtccttttggggcccactcgaactggtggaaaagctggttcccgaagcagccgaaatcactgcgagtgtgaaggacctcccaggcttaaaaacgcccgttggccgtgggagggcttggctacgcctggccttgatgcaaaaaaaattgtcagagtacatgaaagccctgataaacaagaaggagctgctctctgagttctatgaacccaatgcccttatgatggaggaggaaggcgctataatcgccggactgctggtcggcctcaacgtgattgacgcaaacttctgcatgaagggcgaagatttggactctcaggtgggggtgatcgattttagtatgtaccttaaggatggcaattcgtcgaaaggaaccgaaggcgatgggcagattacagccattctggaccagaagaactacgtggaagagctaaaccgacatctgaatgccactgtcaataatttgcaggccaaagtcgatgctttagagaaatcaaataccaaactaaccgaggagctcgcagttgcaaataaccgcatcatcactctgcaggaagaaatggaacgcgtgaaggaagaatcctcctacattctagagtccaaccggaagggcccgaagcaggacagaaccgctgagggacaagctctctctgaagctagaaaacacctcaaagaagaaacgcagctccgtctggacgtggagaaagaactcgagatgcagatttcaatgcgccaagaaatggaactagctatgaaaatgttggaaaaagacgtatgtgagaaacaagatgccctggtgagcctgaggcagcagcttgacgatctccgcgctctaaagcacgagctagctttcaaactgcagagcagcgatctcggcgttaaacaaaagtcggaactgaattcaaggctagaggagaagaccaaccagatggccgcaaccatcaagcagctcgaacaaagtgagaaggacttggtaaaacaggctaaaaccctgaattcagctgcaaacaagctgatcccgaaacatcactag

SEQ ID NO: 50786 - DNA, 1863 bp, Artificial Sequence
  Description of Artificial Sequence: Synthetic coding sequence
atgagcgccctgaccccccccaccgacatgcccacccccaccaccgacaaaattacccaggccgctatggagaccatctatttatgcaagtttcgcgtcagcatggacggggaatggctttgcctgcgggaactggatgacatttcacttacgccagatcccgagccaactcacgaggatccaaactatctgatggctaatgagcgaatgaatttaatgaatatggccaaactgtcaatcaaaggcttgatcgagtctgctcttaaccttggacgcactctcgactctgattacgcaccgctccagcagttctttgtggttatggagcattgccttaaacatggactgaaggccaagaagacattcctcggccaaaacaagagtttctggggtcctctcgaactggtggaaaaactcgtgcctgaagccgccgaaataacagcgtccgttaaagacttacctggactgaaaactccagtgggacgtggacgggcctggttaaggttggcactgatgcagaaaaaactgtctgagtatatgaaggctctgattaacaagaaagaactgctctcagagttctacgaaccaaacgcacttatgatggaggaagaaggtgctatcatcgccgggttgttggtagggctgaacgtaatcgacgctaatttctgcatgaaaggagaggatctcgacagccaggtgggtgttatcgacttcagcatgtacctcaaggacggtaactcatctaaagggactgagggagacggtcagattactgcgatcctggatcagaagaattacgtcgaggaactgaaccgacatcttaacgccacagtaaacaatttacaggcaaaagtggatgcgctggaaaagagtaacacaaaactaactgaggagctggcagtcgcaaacaaccggattatcactcttcaggaggagatggaacgggtaaaggaagaatcaagctacattctcgagtccaaccggaaagggcctaagcaagaccgcacagccgaaggccaagctctcagtgaggctcgtaagcatttaaaagaggaaacgcaactgcgcctcgatgtagagaaagaacttgaaatgcagattagcatgcggcaggagatggagttagccatgaaaatgctggaaaaggatgtctgcgagaagcaggacgccctcgtctccctcaggcaacagctcgacgatctgcgggccctcaagcacgaattggcctttaagctccagagcagcgacctaggggtgaaacagaaatctgaattgaactcgcgactggaagagaagacaaaccagatggccgcaaccattaagcagttggagcagcggctaaggcaagccgagcggagccgtcaatccgctgaactggacaataggttgtttaagcaggattttggcgacaaaatcaattctttacagttagaagttgaggaattaactagacagagaaaccagcttgaattggagcttaagcaggagaaggagcggcgccttcaaaatgatcggtctatccctggccgcggctctcaaaagagtgaatccaaaatggacggaaaacataagatgcaggaggaaaatgtcaaattgaaaaagcccctagaggaaagccacagattgcaaccacatcccatggacgaacaagatcaattactgctgtctgaaaaaccacagctctgtcagttgtgtcaggaggacgggagcctgacaaagaatgtatgtaagaactgttccgggacattttgtgacgcatgttccactaatgagcttccactcccgtcatcgattaaactcgagagggtctgtaatccttgccataagcacctgatgaagcagtactcgacctcccctagctag

SEQ ID NO: 50787 - DNA, 1716 bp, Artificial Sequence
  Description of Artificial Sequence: Synthetic coding sequence
atggccgaggagggcgccatcctgaaggtgaccaaggacctgcgggcggccgtctctgccatcctgcagggatacggcgatggacagggcccagtaacagacacctcggcggagctgcacaggttgtgcggatgcttggagctactgcttcagtttgatcagaaagaacagaaaagttttttgggtccacgcaaagattattgggactttctctgcaccgctctccggcgtcagagaggtaacatggagcccatccattttgtgcggagccaggacaagcttaaaacaccgctggggaagggtcgggccttcatccgcttctgcctagctaggggtcagctggccgaagcccttcagctgtgtttacttaattccgagctgacaagagaatggtacggaccacgctcccccctgctatgtcccgagcgtcaggaggatatactggactcactttacgcgttaaatggggtggccttcgagctcgatctgcagcagcctgacctggacggggcgtggccaatgttcagcgagtctcgctgcagttcctccacccagacacagggccgcagacctcgtaagaataaggatgcacccaagaagatacccgcagcctacggtggccccgagaacgtgcaaatcgaggattcccatacaagccaggcgatttgcctgcaggacgcacctagcggccagcaactggcgggcctacccaggtcacagcagcaacgccatctgcccttctttctagagaagaagggcgaatcctcacgcaagcatcgctatccacagagcatgtgggaacctgaaggaaaagagctgcaattagaccaggaagaaagggccccatggatcgagatttttctcgggaacagcaccccttcgacacaggggcaaggcaagggagccatgggaacccagaaggaagttatcggcatggaagcagaggtcacaggtgtgctcctggtggctgagggccagcgaactacggaggggacgcacaaaaaggaagcagaatggagtcacgtgcagaggttactgatgccttctccaagaggagccgtcgagggggcagtctccggtagccggcagggctccggcgggtcgagtatcctgggggagccttgggtactccagggacatgcgaccaaagaggacagtaccgtggaaaaccctcaggtccagactgaggtgactctggttgctaggcgcgaagagcaagctgaggtgtcactccaagatgagattaagagcttgaggctgggtctccgcaaggccgaggaacaggctcagcgacaggaacagctgttgcgcgagcaggaaggcgagctgcaggccttgcgcgagcagttgagccggtgccaggaagagcgcgctgagctccaggctcagcttgagcagaaacagcaggaagcagaacgtcgggatgccatgtatcaagaggagctaggtggccaacgtgatctggttcaggcaatgaagcgccgtgtgctggagctgattcaggagaaggatcgactctggcagcgcctgcagcacctgtcctctatggcacccgagtgctgcgtcgcctgtagtaagatctttggacggttcagccgccgctacccatgccgtttgtgtgggggcctgctgtgtcacgcatgctcaatggactacaagaaaagggaccgatgctgccccccctgcgcgcagggcagagaagcgcaggttacctag

SEQ ID NO: 50788 - DNA, 1824 bp, Artificial Sequence
  Description of Artificial Sequence: Synthetic coding sequence
atggccgaggagggcgccatcctgaaggtgaccaaggacctgcgggccgcagtgtctgcaatccttcagggttatggagacggccaaggaccagtgactgatacctcagctgagcttcacaggctgtgcgggtgtctggaacttcttttacagtttgatcagaaggaacagaaatccttcctcggaccccgaaaggactactgggacttcctttgtacagcattgagacggcaacgtggcaacatggagcctatccactttgtcagatctcaggataagttgaaaacccctctggggaagggacgcgcattcatcagattctgcctggctcgtggtcagctggcagaagccttgcagttgtgtctcctgaatagcgaactgacacgcgaatggtacggtccccgcagcccactactgtgtccagagagacaggaagacatcctggattccctatacgcattaaacggagtggcttttgaacttgacctgcaacagcccgatctcgacggggcatggcctatgttctccgagtcccgctgctcgagttcaacacaaactcagggccggcggcccagaaagaataaggatgctccgaagaaagtcccgctgccttgtctgcactctgagctgccgttaccccatctgcttggcatccttaagatccctgcagcttatggtggccctgagaacgtccaaattgaggattcccatacgtctcaggccatatgcttgcaggacgcaccatccgggcagcagttggcagggctgccaaggagccaacaacagagacatctcccctttttcctggagaagaaaggcgagagcagtcgcaaacaccggtacccccagtctatgtgggagccagaaggaaaagagcttcagttagatcaggaagaacgtgcaccttggattgagattttcctggggaactccaccccatcgacccaaggccaaggtaagggggcaatgggaacacagaaggaggtcatcggtatggaggcagaagttacgggggttctgctggtagcagaggggcaacgaacaacagaaggcacccataaaaaagaggctgagtggtcacacgtgcagagactactcatgccttctccccgcggcgcagttgaaggcgccgtttcaggctccagacagggcagcgggggctctagcatacttggagagccctgggttctgcagggccacgcaacgaaggaggactccacagtcgagaacccacaggttcagactgaagtcaccttggttgccaggagagaagagcaggccgaggtatccctgcaggacgaaatcaagagcctgaggctgggcctgcgtaaggcagaggagcaggcccagcgtcaggaacagcttctcagagagcaagaaggcgagctgcaagcccttagagagcagctaagtcggtgccaggaggagagggcagagcttcaggcccaactggagcagaaacagcaggaggcagagagaagagacgccatgtaccaagaggaactggggggacagagggacctggtacaagccatgaaaagacgcgtgttagagcttattcaggagaaggatcgactctggcagaggttacagcatctgagttccatggctcctgagtgctgtgtggcctgtagtaagatttttggtaggttcagcaggcggtatccttgttctgctagaacctcactgggaagagaagagagcgagcctcccggtgaagccgcgatgtggcgctggagactgtggcgaggacgcgcatccggacaccccagtggggagggacgacccccagagaccaaccaaggacattccaccggcaggtag

SEQ ID NO: 50789 - DNA, 519 bp, Artificial Sequence
  Description of Artificial Sequence: Synthetic coding sequence
atggccgaggagggcgccatcctgaaggtgaccaaggacctgcgggccgcagtgagcgccatactgcagggctacggagatggtcaagggccggtgaccgatacgtctgccgagctccacagactttgtggttgtctggagcttctgttacagtttgaccaaaaagagcagaaatcgttcctcggtcctcggaaagactactgggatttcctgtgtactgctttgcgccgccaacgtggcaatatggagcccattcacttcgtgagatcacaggacaagggaatggtgtggactcccgaaccttccgcattaccacggactccacgcagacacccaggccttagcctatgtagtcaatgggggggactccgggtgggtcctcccgccgctaggcctggctggtccctggctcacgtgttacgggtaaccctcctgcagtttcatccaaatccaggcaaggagacacagaaaaagcagcgatgccctaaggaagatccatcacgaatctggagggcttag

SEQ ID NO: 50790 - DNA, 1842 bp, Artificial Sequence
  Description of Artificial Sequence: Synthetic coding sequence
atggccgccgtggaggccgccgccgagcccgtgaccgtggtggccgccgttggtccaaaagcaaaggatgaagaagaggaagaagaagaacccctgcctccatgcgaagcagtcaggtgggccccagttggagcagtcgccgaggccaggcctggggccaccgccttcctggaggaagctacagccgaagagccaggcgccgcgcccgggagccccccggattctccaggccgcactctgcgacgcctgagggctgagaggcgcaggctcgatagcgccctgctcgctttaagttcccactttgcacaggttcaattccgacttagacaggtcgtgagaggcgctccagcagaacaacaaagactattaagagagctggaagacttcgcgtttcggggctgtcctcacgtcctcggatatgaaggcccgggcgatccagcttcagatgagggggacggcctgccgggcgatcggccctggctgcgcggagaggaccaatcagagcaggaaaagcaggaacgactggaaacacagagagagaaacaaaaggagctaatactacagctgaagactcagctcgatgatctcgaaacttttgcataccaagaagggtcctacgatagtttgccccagagtgtagtactggaacgacagcgcgtgattatagatgagcttatcaagaagctggacatgaacttgaacgaggatatcagctccctctccaccgaggagctccgacagcgcgtcgacgctgctgtggctcaaatcgtgaatcccgctcgcgtgaaggagcagctagttgagcagctcaagacccagattagagacctggaaatgttcatcaatttcattcaggatgaagtgggatctccccttcagactggggggggacattgcgaatgcaaggctggcggaaagacaggaaatggatgttcccgaaccgggagctccagaacacctcccggcaacagtaagaccaaggccgaggatgtcaaaaaggtgcgggaaaccggactgcatcttatgcggagagcccttgcagtactgcagatttttgcagtgagccagtttggatgcgccactgggcagataccacccaccctttggcaacgcgtgcaggcagatcgtgattactcccccctgctgaaacgacttgaagttagcgtcgaccgcgttaaacagctcgccttgaggcagcagccccacgaccacgttattacctcagcaaacctgcaggacttgtctctgggcggcaaggacgagctcacgatggccgtcaggaaagaactcactgtagctgtcagagacctgctcgctcacgggctgtatgctagctcgccggggatgtccttggtcatggctccaatagcttgcctgcttcctgccttcagttcggctccagaggctatgcacccttgggagttatttgtcaagtactaccacgccaagaatggtcgggcctacgtggagagtcccgctaggaaactctcccaatcatttgctctcccagtaactgggggcaccgtggttacccccaaacagagtctgctcaccgccatccacatggttctgactgaacatgacccattcaagagaagcgcggattcagagctcaaggctctggtgtgcatggcccttaatgagcagaggctggtgtcttgggtcaatttaatttgtaaaagtggttctctgatcgagcctcactaccagccttggagttacatggctcacactgggttcgaatcagctctgaatctgctatctaggttatcctcactcaagtttagtctaccggtcgaccttgccgtccgtcaattgaagaatatcaaggatgcgttctag

SEQ ID NO: 50791 - DNA, 1422 bp, Artificial Sequence
  Description of Artificial Sequence: Synthetic coding sequence
atggccagccggagcctgggcggcctgagcggcatccggggcggcggtggaggcggcggaaaaaaaagcctctctgccaggaacgccgcagtggaaaggcggaacttgatcaccgtgtgcaggttcagtgtcaagaccctgattgatcgaagctgcttcgaaacaatagatgactccagcccggagtttaataacttcgcggcaatccttgagcagatcctgagccacagattgaaagaaatctcccagagctgtcggtggcttgcccacctccagatccccttacaggggcaagttacatggtttggctacgaatcccctcgttctttctgggactacatccgtgtcgcatgtagaaaggtgtctcagaattgtatctgttccatcgaaaatatggaaaatgtgtcttcttccagagccaagggacgagcctggattcgcgtggcgctgatggagaaacacctgagcgaatacatcagtaccgctctgcgagattttaaaaccacccgccgtttctacgaagacggggctattgtgctcggggaggaggccaacatgctggccggcatgctgctaggcctcaatgccatcgattttagtttctgtctcaagggggaaggcctcgatgggtcgtttccagccgtcattgattacaccccatacctgaagtatattcagtcctccgacagcatttcgtccgatgaggaagaactgagaactcttggctcatctggcagcgaatcatccactccagagaatgttggacctccattcctgatggatgaaaatagctggtttaacaaatgtaagagagtcaaacagaagtatcagctgacgctggagcaaaaaggctatttggaggagctgctgcgactcagagagaaccagctgtccgagagcgtcagccaaaacaagatcctgctgcagaggatagaagattccgatctggcacataaattagaaaaggagcagcttgaatacatcattgtggaacttcaggaccaactgacagtgcttaaaaacaatgatctccgaagccggcaagagctcacagcacatctcaccaaccagtggccctcgcctggcgccttggatgtcaacgctgttgccctggacacccttctgtaccgaaagcacaataaacagtggtatgaaaagagttatcagtctctcgaccagttgtcagccgaggtcagcctgtctcaaaccagcctagacccaggacagtcccaggagggtgatggcaagcaggataccctaaacgtgatgtcggagggaaaggaggatactccgtcacttctcggtctgtgcgggtccctgacatctgtcgcttcttataagagccttaccagcctcaagtcaaatgactacttagcctcccccaccaccgagatgacttctccaggactaaccccctcttag

SEQ ID NO: 50792 - DNA, 1371 bp, Artificial Sequence
  Description of Artificial Sequence: Synthetic coding sequence
atggccagccggagcctgggcggcctgagcggcatccggggcggcggaggaggaggaggcaaaaaaagcctgagcgccagaaacgccgctgttgagcgtcgtaacctaattaccgtatgccgattctccgtgaagacgctgattgaccggtcttgtttcgagactattgatgatagcagccccgagttcaataatttcgccgctattttagaacagattctctctcaccggctgaagggccaggtgacatggttcggttacgagagtccgagatccttctgggactatatccgcgttgcctgtaggaaggtttcccaaaattgcatttgcagtattgagaacatggaaaacgtgagttctagcagggctaaagggcgcgcttggatccgcgtggctttgatggaaaagcatctgagcgagtatatctccaccgcactccgtgacttcaagacgactaggcggttctatgaggacggcgcaatcgttctaggcgaggaggctaatatgcttgccggcatgctgttggggcttaacgcaattgattttagcttttgcttaaagggggaggggctcgacgggtccttccctgcagttatcgactacactccctatctgaaatacatacagagcagcgacagtatttcaagtgatgaggaagagctccggactcttggctctagcggctctgaatcttccactcctgagaatgtgggacctccattcctcatggacgagaatagctggtttaacaagtgcaagcgcgtgaaacaaaagtatcaacttactctggagcagaaggggtatctcgaggaactcctgcgactgagggagaatcagctgagcgaaagtgtttcccagaacaaaattctccttcagcggattgaggacagcgatcttgcccacaaactggagaaggaacagctggaatatattattgtggaactgcaggaccagttaactgtgcttaaaaacaatgacctgcgatcacggcaggagttgaccgcacatctgacgaaccaatggccctctcctggcgcactggatgtgaatgctgtagccctggatacgctgctttacagaaaacataacaagcagtggtacgagaagagttatcagtccctggaccaactgagtgcagaagtctcacttagccagacctccttggatcccggccagtcccaagaaggggacgggaaacaagatactctgaatgtgatgagtgaagggaaagaagatacaccgtccctcctgggcctctgcggctcactcacatcggtagcctcatacaaatcactgactagcctgaagagcaacgactatctggccagtcctaccaccgaaatgacatctccgggcctcaccccttcctag

SEQ ID NO: 50793 - DNA, 1224 bp, Artificial Sequence
  Description of Artificial Sequence: Synthetic coding sequence
atggccagccggagcctgggcggcctgagcggcatccggggcggcgggggcgggggagggaagaagtcacttagcgccaggaacgcggcagtggagcggagaaatctcattaccgtatgccgatttagtgtcaaaactcttatcgacaggtcatgctttgagaccatcgacgacagtagccccgaattcaataactttgcagccatcctggagcaaatattgagccatagattaaagggacaggtaacttggttcggctatgaaagccctcgtagcttttgggactatatccgcgtggcatgtcggaaggtaagtcagaattgcatctgtagcatcgaaaacatggaaaatgtctccagctctagggcgaaggggagagcgtggatcagggtggcattaatggagaaacaccttagcgaatatatatccacagccctgagagactttaaaacaacacggcgcttttacgaggatggtgccatcgtgcttggcgaagaggctaatatgctggccggcatgctcctcggcctcaacgccattgattttagcttctgcttaaagggagaaggtcttgacgggtccttcccagctgtgatcgactatacaccatatctcaagtacatccagtctagtgatagtatttcctctgatgaggaggagctcaggacgctcgggtcttctggctccgagtcctctacacccgaaaatgtggggcctccctttctgatggatgagaattcatggttcaacaaatgtaaaagagtgaaacaaaagtatcagctcaccctagagcagaagggctacctcgaagagttgttacgcctgagggaaaaccagctgagtgagagcgtttctcagaacaaaattctgctgcagaggatcgaggatagtgatttggcccacaaattagaaaaagagcagcttgagtatattatcgtggagctgcaggatcagctcaaatcttaccagtccctagaccaactgtcggctgaggtatccctcagccagacatcattggatcccggacagagccaggagggagacggcaagcaggacactctgaatgtgatgtccgaaggcaaagaggataccccaagtctactaggcttgtgcggcagcctgaccagtgtggcatcgtacaaatctctgacatcgctaaaatccaacgactatctcgctagcccgacaactgagatgacaagtcccgggctgacaccgagctag

SEQ ID NO: 50794 - DNA, 156 bp, Artificial Sequence
  Description of Artificial Sequence: Synthetic coding sequence
atggtgatgatcttcaccctggtgaccgccgtgcaggagaagctgaacgagattgtagatcagattaaaacgagacgcgaggaggaaaaaaagcagaaggaaaaagaagccgaagaggcagagaagcaactgtttcatggaacaccagtgacctag

SEQ ID NO: 50795 - DNA, 444 bp, Artificial Sequence
  Description of Artificial Sequence: Synthetic coding sequence
atggtgatgatcttcaccctggtgaccgccgtgcaggagaagctgaatgagattgtggaccaaatcaagacaagaagggaagaggaaaagaagcagaaggagaaggaggccgaggaagcagagaagcagttgttccatggaacccccgtaactatcgagaactttctgaattggaaggcgaaatttgatgcagagctcttagagattaagaaaaagcgcatgaaagaagaagaacaggccggcaagaacaaattatcagggaagcaactcttcgagacagatcacaacttagatacgtctgatatacaatttcttgaggatgccggcaataacgtcgaggtggatgaatcactctttcaagagatggatgacctcgagctggaggatgacgaagatgatcctgactacaaccctgccgaccctgagagcgattccgcggactag

SEQ ID NO: 50796 - DNA, 732 bp, Artificial Sequence
  Description of Artificial Sequence: Synthetic coding sequence
atgaccgactacggcgaggagcagcggaacgagctggaggccctggagtccatttatcctgactcattcacagtgctgtccgaaaaccccccatccttcaccataacggtgaccagcgaagccggggagaatgacgaaacggtgcagacaactttaaagtttacttactccgaaaagtacccagacgaggcaccgctatatgaaatttttagccaggaaaacctggaggacaatgatgtgtcagacattctgaaactgctggcattacaggctgaagaaaacctggggatggtgatgattttcacgttggtgaccgccgtccaggaaaaactgaacgaaatcgttgaccagattaaaactcgtagggaagaagaaaaaaaacagaaagagaaagaagcagaggaagccgagaagcagttatttcacggaacccctgtgaccattgaaaatttcctgaattggaaagcgaaatttgatgcagaacttctggagatcaagaagaaaagaatgaaagaggaagagcaggctggcaagaataagctaagcggaaagcagttgttcgagacggatcacaatctcgatacgtccgatatccagttcctggaggacgctgggaataatgtagaggtcgatgagagcctctttcaagaaatggacgatctcgagctggaggacgatgaagatgaccctgattacaacccagcggatccagaatccgatagcgccgactag

SEQ ID NO: 50797 - DNA, 204 bp, Artificial Sequence
  Description of Artificial Sequence: Synthetic coding sequence
atggtgatgatcttcaccctggtgaccgccgtgcaggagaagctgaacgaaattgtggaccagatcaaaacaagacgtgaagaagagaagaagcagaaggaaaaggaggccgaggaggcggagaagcagctgttccacggcactcccgtgacaattgagaattttctaaattggaaggctaaatttgacgctgagctcctgtag

SEQ ID NO: 50798 - DNA, 444 bp, Artificial Sequence
  Description of Artificial Sequence: Synthetic coding sequence
atggtgatgatcttcaccctggtgaccgccgtgcaggagaagctgaacgaaattgtggaccagatcaagaccaggagggaggaagaaaagaagcagaaggagaaagaggccgaagaggccgaaaaacagctgtttcacgggacccctgtaaccatcgagaactttctgaactggaaggctaagtttgacgccgaactactcgaaattaaaaagaagcggatgaaagaagaagaacaggccgggaaaaataagttgtcgggaaagcaactatttgaaaccgaccataatttggacaccagcgacattcagtttctcgaagatgcagggaacaacgtagaggtcgatgaaagcctcttccaagaaatggacgacctcgaacttgaggatgacgaggacgaccctgattacaaccccgctgaccccgagtctgacagcgccgactag

SEQ ID NO: 50799 - DNA, 219 bp, Artificial Sequence
  Description of Artificial Sequence: Synthetic coding sequence
atggtgatgatcttcaccctggtgaccgccgtgcaggagaagctgaacgagatcgtggatcagattaagacccgtcgcgaggaagaaaagaaacaaaaggaaaaagaagctgaagaagcagaaaaacagctctttcatgggactccggttaccattgaaaattttctcaattggaaggccaagtttgatgccgagctgcttgaaataaaaaagaaatag

SEQ ID NO: 50800 - DNA, 879 bp, Artificial Sequence
  Description of Artificial Sequence: Synthetic coding sequence
atgagcgccagcgtgaaggagagcctgcagctgcagctgctggagatggaaatgctgttttctatgtttcccaaccagggcgaagtcaaacttgaggacgtcaatgccctgacgaatatcaagcgctatctggaggggacccgggaggccctcccacccaagattgagttcgtcataacattgcagattgaggaacccaaagtgaagatcgacctgcaggtgaccatgccacactcttatccatacgtcgctcttcagctgtttggcagatcttcagagctggatcgtcatcagcagctactgctgaacaaggggcttacttcctacattggcacattcgatccgggtgaattatgtgtgtgcgctgctatacagtggctccaagataatagcgccagctatttccttaacaggaaattagtttacgagccgagcactcaggccaaacccgtgaaaaatacttttctgcgtatgtggatttattcacatcatatttaccaacaagatctgaggaagaagatactggatgttggtaaaaggttagatgtcaccgggttttgcatgactggtaaacccgggataatctgcgtcgagggattcaaggaacactgtgaagaattctggcatacaatacgatatcccaattggaaacatatcagctgtaagcatgccgagagtgtcgagactgaagggaatggtgaagacctccgcctctttcatagcttcgaagagctgctcctcgaagcccatggggattatggcctccgtaacgactatcatatgaacctgggccagttcttggagtttctgaagaaacacaaaagcgagcatgttttccagatcctcttcgggattgaatccaaatcctctgattcgtag

SEQ ID NO: 50801 - DNA, 717 bp, Artificial Sequence
  Description of Artificial Sequence: Synthetic coding sequence
atgctgtggtacctgaacctgttcgacttccacttcaaggtgaagatagacctacaggtcacgatgccacacagttacccttatgtggccctgcagctgtttggccgatctagtgaactagataggcaccagcagctacttctcaacaaaggcctgacctcctacatagggacttttgaccctggagaactgtgcgtttgcgctgctattcagtggctgcaagacaactctgcatcttacttcctgaacagaaaacttgtctacgagccttccacccaggcaaagcctgtgaagaacacatttctaagaatgtggatctactcccaccacatctatcagcaggacttgcggaagaagattcttgatgtcgggaaaaggctggacgtgaccggcttttgcatgacgggaaaacctggtataatctgcgtggaagggtttaaggaacactgcgaagagttctggcacacgatcagataccccaactggaaacacatatcctgcaagcacgcagaatcagtggaaaccgaaggcaatggcgaagacctgcggctcttccatagctttgaagagctcctgcttgaagctcacggcgactatggactccggaatgactaccatatgaacctgggacagttcctggagtttttaaagaaacacaaatctgagcacgtcttccagatactcttcgggattgaatccaagtcttcagatagctag

SEQ ID NO: 50802 - DNA, 960 bp, Artificial Sequence
  Description of Artificial Sequence: Synthetic coding sequence
atgaagatcgagctgagcatgcagccctggaaccccggctacagcagtgagggtgccaccgcccaagagacgtatacctgtccaaagatgattgaaatggagcaagctgaagcacagctggccgagctggatctgctagcgtccatgttccctggagaaaacgaacttattgtgaacgatcaattggctgtggcagagctcaaggactgtattgaaaaaaaaaccatggagggccgcagttctaaggtgtatttcacaatcaatatgaatctggatgtgtccgatgagaagatggccatgttcagcctggcatgtatcctgccctttaaataccctgccgtgcttcctgagattaccgtcagatcggttcttctgagtagatctcagcaaacacagctaaataccgacctgacagccttccttcaaaagcattgccacggtgacgtgtgtatcctgaacgcgacagagtgggttagggaacatgctagcggatacgtgtccagagatacatccagctcaccgacgaccgggagcacagtgcagtccgtagatcttatcttcactaggctgtggatctacagccaccacatttataataaatgtaagaggaaaaatattttagaatgggccaaggagttaagcctgtctggttttagtatgcccggcaagcctggagtcgtttgtgttgaaggtcctcagtccgcatgtgaggaattttggtcgaggctcaggaagctgaattggaaacggatacttatacggcatcgcgaggatattcccttcgacggcaccaacgacgaaactgagcgacagaggaaatttagtatctttgaggaaaaggtgttcagcgtgaatggagccagagggaaccacatggactttgggcagttgtaccagtttctaaacaccaaggggtgtggcgatgtgtttcaaatgttcttcggggtggagggtcagtag

SEQ ID NO: 50803 - DNA, 567 bp, Artificial Sequence
  Description of Artificial Sequence: Synthetic coding sequence
atgagcgccaacgaggaccaggagatggagctggaggccctgcggtccatttatgagggcgacgagagctttcgtgaactctcaccggtgtcttttcagtatagaatcggtgagaacggcgatccgaaagcctttctgatcgagatttcgtggactgaaacctatccgcagacaccccctattctgtctatgaacgcttttttcaacaataccatttccagtgccgtgaaacaaagtattcttgcgaaactgcaagaagcagtggaagctaatttaggaaccgcaatgacatacacactgttcgaatatgccaaggacaacaaagagcagtttatggaaaaccacaatccgatcaattctgccaccagcattagtaatattatctccatagagactcccaatactgcccccagttctaaaaaaaaagacaagaaagagcaactttcaaaggctcagaagaggaagttggcagacaaaactgatcacaaaggtgaactgcctcgggggtggaactgggtggatgtggtcaagcacttaagcaaaacaggtagcaaggatgacgagtag

SEQ ID NO: 50804 - DNA, 564 bp, Artificial Sequence
  Description of Artificial Sequence: Synthetic coding sequence
atgagcgccaacgaggaccaggagatggagctggaggccctgcggtccatctatgagggagatgagtctttccgcgaacttagtcccgtgagtttccagtataggattggtgaaaatggtgaccctaaagccttccttatcgagattagctggaccgaaacctatcctcaaacccccccaatcctttccatgaacgctttcttcaataacactatcagctccgccgtgaaacagtctattctagctaagctacaggaagccgtcgaggcaaacctggggacagccatgacctacactctgtttgagtatgccaaggacaataaagagcagttcatggagaaccacaatccaatcaactccgccaccagtatctccaatatcataagcatagaaactccgaataccgcgccatcctcgaaaaaaaaagacaaaaaagaacagttgtccaaggcccagaagaggaagctcgctgataagactgatcacaaaggagaactccccaggggatggaactgggtggacgtggtcaaactatccaagaccggctcgaaggacgacgaatag

SEQ ID NO: 50805 - DNA, 2988 bp, Artificial Sequence
  Description of Artificial Sequence: Synthetic coding sequence
atgagcagcctgccccggcgggccaaggtgcaggtgcaggacgtggtgctgaaggacgaattcagttccttcagcgagctgagctccgcaagtgaggaggatgataaggaagatagcgcttgggagccacaaaagaaagtacccaggagtcgcaaacagcccccccctaaggagtctaagcccaaacgcatgccccgcgttaagaagaacgcccctcagatctcagatggctcggaggttgtagtggtcaaagaagagttaaattcatcagtggcaattgcggacacagctttggaggaccgcaaaaataagctggatactgtccagacattgaaaactgccaaaacaaagcagaaatgtgcagcccaacctcacacggtccggaggactaagaaactcaaagtagaggaggagactagcaaagcctctaacctcgagggggaaagtaatagctccgaaaccccatctactagcacagtctggggaggcacctgtaaaaaggaggaaaatgacgacgatttcacatttggacagagcgccttgaagaagattaagaccgagacatacccgcagggacagcctgttaaattccccgccaatgccaacagcactaaggaagaggtggagatgaactgggacatggtccaggtgctctcagagcgcactaacatagaaccctgggtgtgcgcgaacatcataaggctctttaacgacgacaatacaatccctttcatcatcagatacagaaaagagcttataaacaatctggacgccgacagtctcagagaggtacagcagactctggaagagcttcgggcagtggccaaaaaagtacattcaactatacagaagataaagaaagaaggcaaaatgagcgagtgcttactgaaggccatgctgaactgcaaaacattcgaggagctggagcatgtctctgctccatacaaaaccggcagcaaggggacgaaggcccagagggctagacagttggggctggagggcgccgccagggccctgcttgagaagccgggcgagttatccttgctttcgtatatcagacctgacgtgaaggggctcagcacccttcaggacattgagataggcgtgcagcacatcctggcggatatgattgcaaaagataaagacactctggacttcatcagaaatctgtgtcagaagcggcacgtctgcattcagtcctccctagccaaggtctcaagcaagaaagtaaatgagaaagacgtcgacaagttcttgctgtaccagcacttttcatgcaacatccgaaatattcaccaccaccaaattttggccatcaatcgtggggagaaccttaaggtgctgaccgtaaaggtcaatataagcgacggtgtcaaggatgagttttgtcgttggtgtatccagaatcgttggcgcccacgctctttcgctcgccccgaactgatgaagatcctttacaactcactgaacgattctttcaagcgccttatctatcccctgttgtgccgcgagtttcgagcaaagttgaccagcgacgccgagaaggagagtgtgatgatgttcggcaggaacctgagacagttgttgctgactagccccgttcctggaaggacactgatgggggttgatcccggctacaaacatggctgcaaattggccatcatctccccaacctcacagatcctgcatacagacgtcgtatacctccactgcggacagggatttagagaagccgaaaagatcaagactctccttctcaatttcaactgtagcaccgtggtgatcgggaatgggactgcctgcagagagacggaagcatacttcgctgatctcatcatgaaaaattatttcgctccattggatgtggtgtattgcatagttagtgaggccggagcctcgatctactcggtgtccccagaggcaaataaagaaatgcccgggctagatccaaatttgcgctccgctgtgtcgattgccagaagagtccaggacccactggccgaattggtcaagatcgagcctaaacacattggagtggggatgtatcagcatgacgtgagccagaccctccttaaggctactcttgactctgtcgtggaagaatgcgtgtcctttgtaggggtcgatatcaacatatgcagtgaagtacttctgagacatatcgctgggttgaacgccaatcgggccaaaaacatcattgagtggcgggagaaaaatggcccattcatcaatcgggaacagctaaagaaggtgaaaggcctgggacctaaatcttttcagcagtgcgctggattcattcgcattaatcaggattatatccggaccttctgctctcaacaaactgaaaccagtggacagatacagggtgtggctgttacttcttccgccgatgttgaggtaaccaacgaaaaacaaggcaagaaaaaaagcaagaccgcagtgaatgttctcctgaagccaaaccctctggatcaaacctgtatccatcccgagtcgtacgatattgctatgcggttcctctcttcgattggaggaacgttgtacgaagtgggcaagccagaaatgcagcagaagataaattccttcctcgagaaagagggcatggagaagatagctgaacggctgcagacaaccgttcataccctgcaggtaatcatcgacggcctatcccagcctgaatcattcgattttcgcactgattttgacaaacccgattttaagagatcaatcgtctgcttggaggacttacagatcgggactgtgctgaccggtaaggtcgaaaatgctacattgttcggcattttcgtcgacattggcgtcggcaaatcaggacttatccctataagaaacgtgactgaggcaaagctgtctaaaaccaagaagaggcgcagtctcgggttggggccgggggagcgtgtcgaagttcaagtgctgaacatcgatataccacgttcaagaattacactcgacctgatccgcgttctctag

SEQ ID NO: 50806 - DNA, 1545 bp, Artificial Sequence
  Description of Artificial Sequence: Synthetic coding sequence
atgaagatcctgtacaacagcctgaacgacagcttcaagcggctgatttaccctctgctgtgtcgagagtttcgcgctaagctgacatctgacgctgagaaagagagcgtgatgatgtttggcaggaacttgcggcagttgctgctgacaagccctgtgccaggccggaccctgatgggtgtcgatccaggttacaagcatggatgcaagctcgcaatcatctctccaacatcacaaattctccacacagatgttgtgtatctgcactgtgggcagggattcagagaggccgaaaaaatcaagacacttttgctaaatttcaattgcagcaccgtggtcattgggaacgggactgcgtgtcgggagacagaggcctacttcgctgacttgataatgaaaaattattttgcacctttagacgtcgtgtactgcatagtgagcgaggccggggcttcaatctattcggtgtcccccgaggccaataaggaaatgcctggactggatcctaacctgcgcagcgcagttagtatcgctcgaagagttcaggaccctttggcagagttagttaaaatagagcctaaacacatcggtgttggcatgtaccaacacgatgtgagtcagacgttactgaaagctactctggatagtgttgttgaggagtgcgtatcattcgtgggggtcgatatcaacatctgttcggaagtcttgctgcggcacatcgccggcctgaatgcaaatcgggctaaaaatattatcgagtggcgggaaaagaatggacctttcataaatcgggaacagctgaaaaaggtcaaaggattaggccccaaatccttccagcagtgcgcagggtttatccgcataaaccaagactacatacgaaccttttgttcccaacagacagagactagcggacaaattcagggggtggcagtcacatccagtgccgacgtcgaggtcaccaatgagaagcagggtaaaaagaagtccaagaccgcagtcaacgtacttctgaaacccaatcctctggaccagacctgtatccatcccgaatcctatgacatcgctatgaggttccttagtagcatcgggggtactttgtacgaagtcggcaagccagaaatgcagcagaaaatcaactcctttctggagaaagaagggatggagaagatcgctgagcggctacagacaactgttcacactttacaagtcattatagacggcctatcccagcccgagtcattcgattttaggaccgacttcgacaagcctgatttcaagaggagcatcgtttgcctggaagacctgcaaatcggcacggtgctgaccgggaaagtggagaatgctaccttgtttggaatttttgtggatatcggggtggggaaaagcggactcattccaattcgtaacgttaccgaggcaaaactgtcaaagactaaaaagcgcaggagtctagggttgggtcccggtgagagagtggaagtccaagtgttaaacatcgacattcctcgtagccggataacgcttgacctgattagagtgctgtag

SEQ ID NO: 50807 - DNA, 306 bp, Artificial Sequence
  Description of Artificial Sequence: Synthetic coding sequence
atgaacatccccctgggcgagaaggtgatgctggacatcgtggccatgtttcggcagtattctggggacgatggccggatggacatgcccggtctagtgaatttaatgaaagagaactttcccaacttcctttccggctgcgaaaaatcagacatggattatctgagtaacgccctggagaaaaaggacgacaacaaggataagaaggtcaattacagtgagtttctgtcattactgggagacattacgatcgatcaccacaaaataatgcacggggttgccccctgctctggagggtctcagtag

SEQ ID NO: 50808 - DNA, 306 bp, Artificial Sequence
  Description of Artificial Sequence: Synthetic coding sequence
atgaacatccccctgggcgagaaggtgatgctggacatcgtggccatgtttagacagtatagcggagacgacggaaggatggacatgcctggactggtaaacctcatgaaggaaaactttccaaatttccttagtggctgtgagaaatcggatatggactatttgtctaacgctttggagaaaaaagacgacaataaagataagaaagtgaactacagcgagtttctgagcctgctaggagatatcactatagaccatcacaaaattatgcatggagtggcaccatgttctggcggaagccagtag

SEQ ID NO: 50809 - DNA, 339 bp, Artificial Sequence
  Description of Artificial Sequence: Synthetic coding sequence
atgctgcccagcagcggcttcctgaaggccaagatgaacatccccctgggcgagaaagtcatgttggacatcgtggctatgttcaggcagtactccggggatgatggccgcatggacatgccgggcctagtaaacctaatgaaggagaactttcctaactttctgtctggctgtgagaagtcagacatggattacttatccaacgccctagaaaaaaaggatgacaataaggacaaaaaagtcaattacagtgagttcttgtccctcctgggtgacataaccatcgatcatcacaaaatcatgcatggagtggctccctgctccggtgggagccaatag

SEQ ID NO: 50810 - DNA, 2715 bp, Artificial Sequence
  Description of Artificial Sequence: Synthetic coding sequence
atgcaggccagccccctgcagaccagccagcccaccccccccgaggagcttcatgccgccgcctatgtttttactaacgacgggcagcagatgcgaagcgatgaggtcaaccttgtggctaccggccaccagtccaaaaagaagcattcccgaaaaagcaaaagacattcaagctctaagcgtagaaagagcatgagcagctggctggacaagcaagaggacgcggcggtgacccactccatttgtgaagagcgaattaacaatggacaaccagtggccgacaatgttttaagcactgcccctccgtggcctgatgcgaccatcgcccataatatccgcgaagagcggatggaaaatggtcagagcagaactgacaaggtgttaagtaccgcccccccccaactggtacatatggcagccgccgggatcccatccatgtccactcgggacctgcattctacggtcacccacaatatccgggaagagagaatggaaaacggacagccacagcctgataatgttctcagcaccggaccaacggggctcatcaatatggcagccactccaattcctgccatgtccgcacgcgatctgtatgcaacagtaacgcataacgtctgtgagcagaagatggaaaacgtgcagccagccccagacaatgtgctcctgaccctacgtccgcgtagaattaatatgacagacacaggaatcagtccaatgagcactcgggacccatacgccactatcacgtacaacgtgccagaagagaagatggagaagggtcagccgcaacctgataacattctgagcaccgcctcaacaggccttataaatgtcgctggcgcaggaacgccagctatttcaaccaatggcctttacagtactgttcctcacaacgtgtgcgaggagaaaatggaaaacgatcagccgcagcccaataatgtccttagcacagtccagccggttattatctacctgaccgccaccggcatcccaggaatgaataccagggaccagtacgccaccataacccataacgtctgcgaagagagggtggtaaacaaccagcccctgccctctaacgctttatctacagtcctgccggggttggcttacttggccaccgccgacatgcccgcgatgagtactcgcgaccagcatgccacaataattcataaccttcgggaagagaaaaaagataattcccagcctacaccggataacgttctctccgctgttacccccgaattaatcaacttagctggggcagggattccacccatgagcaccagggaccagtatgccactgttaaccaccatgtccacgaggcccggatggagaatggacaacgcaaacaggataacgtgttgagtaacgtcctgtccgggctgattaacatggctggggcctcaatcccagctatgagcagtagagatctgtatgctaccattacacatagcgtgagggaagagaagatggagtctgggaagcctcagacagacaaggtaatctcgaatgatgccccccaactcggccacatggcagccggggggatccccagtatgtcaaccaaggacctgtatgccacagtgacacagaacgtgcacgaagaacgtatggaaaacaatcagcctcaaccgtcatacgatctctcaacagtgttaccaggacttacctaccttacagtggctggaatcccggctatgagcactcgtgaccaatacgccaccgtgacccacaacgtgcatgaggagaagatcaaaaacggccaggccgccagcgataatgtgttctcaaccgtgcccccagcatttattaacatggcagctaccggcgtaagctcaatgtccacccgagatcagtacgcggcggttactcacaatattcgggaggagaaaataaataacagccagcctgctccagggaacatcctgtctaccgcaccgccatggctgcgtcacatggcagcagctggtatttcctcaaccattactcgcgatctttatgttactgccacccactccgttcacgaggagaaaatgactaacgggcagcaggctccagacaatagccttagcaccgtgcctccaggctgcataaatctgtcaggggccggaatctcttgtagatccacccgcgatctgtatgccacagtaatccacgacattcaggaggaggagatggaaaacgatcagaccccgccggacggcttcctgtccaattccgactctccagaacttatcaacatgacagggcactgcatgcctcccaacgcgctcgactcttttagccacgatttcacttcactgtctaaagacgagctactgtataagcccgactcaaacgaatttgcggtggggactaaaaattattctgtttccgctggagaccctccagtgacagtgatgtccctggtggaaacagtgccaaacacaccacagattagtccagctatggctaagaagattaacgatgatataaagtatcagttgatgaaggaggtgaggaggttcggtcagaattatgagcggatcttcatccttctcgaagaggtgcaggggagcatgaaggtgaaaaggcagtttgtggagttcacaatcaaagaagctgcaagattcaagaaagtggtgcttatacagcagttggagaaggcactgaaagagatcgactctcattgccaccttcgtaaggtcaaacacatgcgcaagagatag

SEQ ID NO: 50811 - DNA, 2715 bp, Artificial Sequence
  Description of Artificial Sequence: Synthetic coding sequence
atgcaggccagccccctgcagaccagccagcccaccccccccgaggagctgcacgccgcggcctatgtgttcaccaatgatggccaacaaatgaggtccgatgaggtgaacctggtcgcgactgggcatcaatcaaagaagaagcacagtcgtaagagtaaaagacattcctctagcaagcggcggaaatctatgtcctcatggctcgacaagcaagaagacgcggctgtgacacatagtatctgtgaggaacgcattaataatggccagccagtggcggacaatgtgttgagtactgctccaccctggcctgatgccactattgcccacaatattcgtgaggagaggatggaaaatggacagtcaaggaccgataaagtccttagcaccgccccaccacaactcgtacacatggctgccgccggaattccctctatgagtacaagggatctgcatagcactgtgacccataatatccgagaggaacggatggagaacggccagccacaacccgacaacgttctgagcacaggtcccaccgggctgatcaacatggctgccacccccattcctgcaatgagcgcgcgagatctttatgctactgtgactcacaatgtgtgcgaacagaaaatggaaaacgttcagcccgcccccgataatgttctgctgacgcttcggccaagaaggataaatatgacggacacaggaatcagccccatgtccacgcgagacccctatgctacaatcacttataatgtccctgaggaaaagatggagaaggggcagcctcagcccgacaatatcttgagtactgcctccacaggcctgattaacgttgccggggctgggactccagccataagcactaatggtctgtattccacagtaccccataacgtgtgcgaggagaaaatggagaacgaccaaccccagcccaataatgttctgtccacagtgcagcccgtgattatatatctgactgccacaggcatccccggcatgaacacacgcgaccagtacgccaccatcacacataatgtatgtgaggagcgtgtcgtcaacaaccagcctctcccgagcaatgccctgagtaccgtcctgcctggcctcgcatatctcgccacggccgacatgccggcaatgagcacccgagaccaacacgctacgatcatccacaatctgcgggaggagaagaaagacaatagccagcctactcctgacaacgtcctgtccgcagttacccccgagttaattaacctggctggggccggtatccccccgatgagcacccgcgatcagtatgccactgtcaaccaccacgtgcatgaagcccggatggaaaatggccagcgcaaacaagacaatgtcctcagcaacgttctctctggcctcataaacatggcaggagctagtattcctgccatgtcatccagggacctgtatgctactattactcattctgtaagagaggaaaagatggaaagtgggaaacctcagacagacaaggtgatatccaacgacgcccctcagctgggacacatggccgctggcggaatcccatccatgagtaccaaggatctgtacgcaacagtcacgcagaacgtgcacgaagagcgcatggagaacaatcaacctcagccaagttatgatttatccactgtgctacctgggctgacatacctgactgttgctggaatcccagccatgagcactagggaccagtatgcaaccgtgacgcacaatgtgcacgaggaaaaaattaaaaatggacaagctgcttctgataacgttttttcgacggtaccacctgctttcatcaacatggcagccaccggggtgagttctatgtccacccgtgaccagtacgccgctgtgactcacaatatacgagaggagaaaatcaacaatagccaacctgctcctggaaacatcctttctacggcccctccctggctgcgccatatggctgccgccgggatatcgtcgacaattacccgcgacctgtacgttaccgcaactcatagtgtgcacgaggagaagatgaccaatgggcagcaggcccccgacaatagtctgagcacagtgccacccggctgcattaacctgtctggagcggggatctcgtgccgcagtacccgagatctctatgcaaccgtcatacacgacatccaggaggaggagatggaaaatgaccagaccccacccgacgggttcctgtcaaattctgattccccagagcttatcaacatgaccggacattgcatgcccccaaacgccctggattccttttctcatgactttactagcttgagtaaagatgagctgctttacaagccagattccaacgagttcgccgtgggtaccaaaaattacagcgtctcagccggagatccccccgttaccgttatgagccttgtagagaccgtgccaaatactccccaaatttctccagccatggccaaaaaaatcaacgatgatataaagtaccagctgatgaaagaggtgaggagatttgggcagaactacgaacggatcttcattttgctcgaggaggtgcaaggttctatgaaagtcaaaaggcagttcgtagagttcaccattaaggaagcagccagatttaagaaggttgtgctgattcagcagttagagaaagccctcaaggaaatagactctcactgccacctccgcaaggtgaaacacatgcggaagaggtag

SEQ ID NO: 50812 - DNA, 2715 bp, Artificial Sequence
  Description of Artificial Sequence: Synthetic coding sequence
atgcaggccagccccctgcagaccagccagcccaccccccccgaggaactgcatgcagccgcgtacgtgttcacaaacgacggacagcagatgcgcagcgacgaggtcaacctggttgccaccggccaccagtctaagaagaagcacagccggaaatcaaagcggcacagttcttcaaaacgacggaaaagcatgagcagttggctggataagcaggaggacgcggccgtaactcatagtatttgcgaggagcggattaataatggccagccagtggcggacaacgtgctgagtaccgccccaccttggcctgacgctacaatagcccacaacatacgggaggaaagaatggagaacgggcaatcgcgcacggacaaagtgctctctacagctccaccgcagctggtgcatatggctgccgctgggatcccctctatgtccacgagagacctccattcaaccgtcactcacaatattagggaggaaaggatggaaaacggccagccccaacccgataacgtgctctccacgggtccaaccgggctgattaatatggctgccaccccaatcccggcaatgagtgcccgcgacctctacgctacagtgactcacaacgtctgcgaacaaaagatggagaatgtgcagcctgctccggacaacgtcctcctgaccctccgcccacggcgcatcaatatgactgataccggcatttcacctatgtctacacgcgacccgtacgcaacgatcacgtacaacgttccagaggagaaaatggaaaaggggcaaccccagccagataatattctgtctacagcgagcaccggcttaattaacgtggctggggcgggcacgcccgctatttctacaaacggcctttactccactgttccgcacaacgtgtgcgaggagaaaatggagaacgaccagcctcagccaaacaacgttctgtctacagtgcaaccagttattatctatctaacagcaacgggaattccaggtatgaatacccgagatcaatacgccaccattacccacaacgtgtgtgaggagagagtggtcaacaatcaacccctgccatccaacgctctgtctaccgtgttgccggggctggcttatctggctacagcagacatgccggccatgagtactcgcgatcaacatgctacaatcattcataatctcagggaggagaagaaggataactcccaaccaacccctgataatgttctgtcggccgtgaccccagaactgattaaccttgcgggtgccgggatacctcccatgtctacccgggaccagtatgccactgttaaccaccatgtacatgaggcgaggatggagaatggtcagagaaaacaggataatgtcttatcgaacgtgctttccgggctgattaatatggccggagcctctatccctgccatgtcatcacgagatctgtatgccaccatcacacattccgtaagggaggagaagatggagtcaggcaagccgcagacagacaaagtgatctccaacgatgccccccagctgggccatatggccgccggtggaattccatcaatgtctactaaggacttgtacgcaacagttacccagaacgtgcacgaagagagaatggaaaataatcaaccccaaccctcttacgacttatccaccgtgttgcccggcttgacatatcttaccgtagccggaattcccgcaatgtccacgagagatcaatatgcaaccgtgacacataacgtccatgaagagaaaatcaagaacgggcaggctgcgtccgataacgtgttcagcactgtgccacccgcttttatcaacatggccgccaccggcgtgtcatccatgtccacacgggaccaatacgccgctgttactcacaatatcagggaagagaaaataaataacagccagccggctcctggtaacatcctatccaccgcaccaccctggctccggcatatggccgctgccggtatcagcagcactatcacacgggacctttatgtaacggccacgcacagcgtacatgaagaaaaaatgaccaatggacagcaggccccggacaacagcctgagtactgttccacccggctgcattaatttatcaggcgcaggcatttcctgtcggtcaactcgcgatctctacgcaactgttatacacgacatccaggaggaggaaatggagaatgatcaaactccaccagacgggttccttagcaatagcgattctcctgagttgatcaacatgacaggccactgtatgcccccaaatgcactggacagcttcagccacgatttcacatccctgagcaaggatgaattgctgtataagcccgatagcaacgagttcgctgtcggaaccaagaactactccgtgtcagccggagaccctcccgtgaccgtcatgtcactggtggagacggtaccgaataccccacagatctcacctgcaatggctaaaaaaattaacgatgacatcaagtaccagctgatgaaagaagtcagaaggtttggccaaaactacgaacgtattttcatattacttgaggaagtccagggatcaatgaaagtgaagaggcagtttgtggagtttaccatcaaagaggctgctcgatttaaaaaggtggtgttgatccaacagttagaaaaagccctgaaggaaatcgatagccactgccatttacggaaagtgaaacacatgagaaagcgatag

SEQ ID NO: 50813 - DNA, 1587 bp, Artificial Sequence
  Description of Artificial Sequence: Synthetic coding sequence
atgcaggccagccccctgcagaccagccagcccaccccccccgaggagttgcacgctgcagcttacgtgtttactaacgatggccagcagatgaggtcagacgaggtgaaccttgtggccacgggtcaccagagtaaaaaaaagcattcaagaaaatccaagagacattccagttctaaaaggcgaaagtccatgtcaagctggctggacaagcaggaggatgccgccgttacccactcaatctgcgaggagcggatcaataacgggcagcccgtggcagataatgttctgagcacagcaccaccctggccagacgctacgatagcgcacaacatccgagaagagcgtatggaaaacggacagtcccggaccgacaaagtgctgtcaaccgcgcctcctcagctcgtgcacatggctgccgctggcattccgagcatgtcaacaagagatctgcacgccaccgtgacccagaacgtgcacgaagaaagaatggagaataatcagcctcagccatcctacgacctctcaacagtcctgcccggactgacgtatctaaccgtcgcaggtattccagcaatgagcacccgagaccagtatgcaaccgtgacccataacgttcacgaagaaaaaataaagaacggacaggccgctagcgacaacgtgtttagtacggtacctcccgccttcatcaacatggctgccacaggtgtgagctccatgagcacgcgcgatcagtacgcggctgtgactcacaatattagagaagaaaagatcaacaatagtcagccagccccaggcaacattctcagcacggcccctccatggctcagacatatggccgccgccggaatcagcagcaccatcactcgcgatttatacgtcactgccacccattctgtccacgaggaaaaaatgacgaacgggcagcaggcccctgataattctctgtccaccgtcccccccgggtgcatcaacttgtcaggtgccggcatttcttgtaggagcacgcgcgacctttacgccactgtgatccatgacattcaggaggaggagatggaaaatgaccagacaccccccgatggatttcttagtaacagcgactctcctgagctgattaatatgactgggcactgtatgccaccaaacgcattggatagtttcagccacgattttacatctctcagcaaagacgagctcctatataaacctgattctaacgagttcgccgtggggaccaaaaattacagcgtctctgcaggcgacccacctgttacagtcatgtccctggtggagacagtcccaaacaccccccagatctctccagccatggcaaaaaagatcaacgacgacattaaataccagctgatgaaagaggtcagacgctttggacaaaactatgagcgtatattcatcctgctggaggaggtccaaggcagcatgaaagtgaagcgacagtttgtggagttcaccataaaggaggctgcccgctttaagaaggtggtgctcattcagcagctcgaaaaggccctcaaagagatcgatagtcactgccacctgaggaaggttaagcatatgaggaagagatag

SEQ ID NO: 50814 - DNA, 2715 bp, Artificial Sequence
  Description of Artificial Sequence: Synthetic coding sequence
atgcaggccagccccctgcagaccagccagcccaccccccccgaggagctacatgccgccgcttatgtgtttacgaatgacggtcaacagatgagaagcgatgaggtgaacctcgtggccacgggacaccagtctaagaagaaacactcccgtaaaagcaagcgccatagcagttccaagcggcgcaagtctatgagtagctggctggacaagcaggaggacgctgcagttacacattctatctgtgaagagagaatcaataatggtcagcccgtggctgataatgttctctcaactgcacccccttggcccgacgcaacaatcgcacacaatatccgcgaggagcgaatggaaaacgggcagtccagaactgacaaggtcctctcgactgctccacctcagctggttcacatggccgcagctggcatcccttctatgtctacacgcgatttgcattcaaccgtgacccacaacattcgagaggaacggatggaaaacggtcagcctcagcctgataacgtgctaagcactggcccgacaggcttaattaatatggcagccacaccaattcctgctatgagcgctcgtgatctctacgcaactgtcacacataacgtctgcgaacagaagatggagaacgtgcaacctgcccccgacaatgtactgctgactctgcgcccaaggcgcattaatatgactgataccggaataagccctatgtcaaccagagatccttacgcaaccataacctacaacgtccccgaagagaagatggagaagggccaaccccagcctgacaatatactctctaccgccagtacaggacttattaacgtggctggagctgggacacctgctatttctaccaacggcctgtatagtaccgtgccgcataacgtatgtgaagaaaaaatggaaaacgaccaaccccagcccaataacgttctctctaccgtacagcccgttataatctatttaactgcgaccggaatacctggaatgaatactcgtgatcagtacgccactataacacataatgtatgcgaggaaagagttgtgaataaccagcctctgccatccaacgctctatctactgtcctgcccggcctggcttatctcgccactgcagacatgcccgcaatgagcacacgtgatcagcatgcaaccattattcacaatctgagagaggaaaagaaagataatagtcagcccacgcccgacaacgtgttatccgcagtcactccggaattgattaaccttgctggcgccggcataccaccaatgtcaaccagagaccagtatgcgaccgttaaccatcacgtgcatgaagcaaggatggagaatgggcagcgcaagcaagacaacgttttatcaaacgtgctttctggcctcatcaacatggctggcgcttctattcctgcaatgagctcccgcgatctgtacgctacaatcactcactcagtcagagaggagaagatggagtcaggcaaacctcagactgataaggtgatctcgaatgacgctccacaacttggacatatggccgcaggaggcattccgtccatgagtaccaaggacctctatgcaactgttacccagaacgtacacgaggagagaatggaaaacaatcagcctcaaccgagctacgatcttagtaccgttctgccagggctaacgtacctgacagtagccggtatcccagcgatgtcaacacgagatcaatatgctaccgtcacacacaatgtgcatgaggagaagatcaagaacggccaggcagcttccgataacgttttttcgacagtgccaccagcctttataaatatggcggccaccggggtttcttccatgtccactcgagaccagtacgcagccgtgactcataatattagagaagaaaagattaacaattcccagccagcacctggcaatattctctcaactgccccgccatggctgagacacatggccgccgctgggattagctccactataacacgagacctctacgtgaccgctactcatagcgtgcatgaggagaaaatgaccaatgggcaacaagccccagacaactctctgtccacagtcccgcccggctgtataaacctttcaggtgctggtatctcctgtagatccacacgagacctgtatgccactgtcatccatgacatccaggaggaagagatggaaaatgatcagactccaccagatggcttcctctcaaattcagacagcccagaactgatcaacatgaccggtcattgcatgccacccaacgcacttgactctttcagccatgacttcactagcctttcaaaggatgagctgctctataaacctgatagtaatgaatttgccgtcggcactaagaattactcagtcagtgcgggagaccctcccgtgaccgtaatgagcttggttgagacagtgccaaacactccccagatttcgccagccatggcaaaaaagataaatgacgacatcaaataccagcttatgaaggaggtgcgtcgcttcggccaaaattatgagaggatatttatactgctggaagaggtgcagggatcgatgaaagtgaagcgccagtttgttgaattcaccatcaaagaagctgcccgttttaagaaagtggtgctgattcagcagctggagaaagccctcaaggagatcgactctcactgccatcttcgaaaggttaagcatatgaggaagcgctag

SEQ ID NO: 50815 - DNA, 225 bp, Artificial Sequence
  Description of Artificial Sequence: Synthetic coding sequence
cggggcagccggggccggcaccactggagcggcggcgccgccgtgtcatctggctacccatccaatattgagaaaaaggaataccaggaacaaagcgtgctttcttgctgctctgagaggaaggatgccaatccaaagtctgtggtgtgtagtttctttatgcaagaacagtgtacgaagggggaaaagcaagccgtcgtgattagcgattttggcgagagctag

SEQ ID NO: 50816 - DNA, 2385 bp, Artificial Sequence
  Description of Artificial Sequence: Synthetic coding sequence
atggaggccgtgagccgggtgttccccgccctggccggccaggcccctgaggaacagggcgagattattaaagtgaaggtgaaggaagaagatcacacatgggatcaggagagtgcattaaggcgcaatttaagttacacgcgcgaattgtcccgccaacgcttccgccagttctgctatcaagagacaccaggccccagggaggcactgagtcagcttagagagctatgccgtcagtggctcaatcccgaaattcacaccaaagaacaaattctggaattgttagttctggagcagttcttgactatcctgcctgaagagttacaatcttgggttagagagcataacccagagtcaggcgaagaggtggtgacgctgcttgaagacttggagcgtgagctggatgaacctaggcagcaagtgtcccagggcacatatggccaggaggtcagcatggaagaaatgatacctctggattccgcaaaagagtcgttaggtacacagttgcagagtatggaagatcgtatggaatgtgaatcaccagaacctcatcctctccaggacaatggatcattcctctggttttccatgatgtcccaatcgatggggggtgacaacctttctagtctcgatacaaatgaagcagagatcgagccagagaacatgcgtgagaagttcttcagaagcctggccagacttctcgagaataaaagtaacaatacgaaaattttttcaaaggccaaatactgccaactgataaaagaggtaaaagaagccaaggccaaggctaaaaaagagtctgtggattaccggaggttggcgagattcgatgttatcttagtgcaggggaatgagaagcttatcgaggccgtaaatggcgagaccgacaaaatccgctactacctgcatagcgaggacctattcgacatcctgcacaatacccacctcagtatcgggcacggcggaaggaccagaatggagaaggagctccaggctaagtataaaaatataacgaaagaggttattatgctatatcttacactgtgcaagccttgtcagcagaagaacagtaaactaaaaaaggtgctgacgagtaagtccattaaggaagtgtcaagtcgatgtcaggtcgacctgattgatatgcagctgaacccggatggggagtaccgtttcatactccattatcaggatctttgcaccaaacttacattcctgaggagtttaaagtcaaaacgcccaaccgaggtggctcatgccttgttggacatttttaccatcatcggagcaccatcggtcctacaaagcgacaacggcagggaattttcctcccaagtagtatccgagctgtccaacatctggcccgaactcaaaatcgtgcatggtaaatcacagacatgtcagtcccaatcaagtgccgagcagactgaagatatccgcaagcgcattttttcctggatgcagactaacaacagtagtcactggaccgaatttctgtggttcatccaaatgtctcagaatcaaccttatcaccgcagtatgcaacagacaccatgcgaatccgcattttccagcgaggcaaaacttgggcttagccattcacagctcaccgaggagctcgttgcttccctccacaccgagaacgagctggaccaggccgacaaagagctggagaacaccctccgggcacagtatgaagaaaacatcgagactggcaccgatagttctgacatcgaggaaaatctatccgtcactccgaaagttgccgaaaagtcaccccctgaaagcagattacgattcctctcctgcgtcgtatgtgagaaagaatgtacaggtgtcaacagctgcatcagttgcgacggaaacatacatgccatatgcggcgtacccagtcagcacggaacagagggctgtgggaggcagataacctgctcactgtgttacgaaacaagcaccatgaagcgtaagcacgacgagatccagagaagcctgcctgttaagccaagcaaaatgttgaaacccagcggaactccgttctcaccagataaggtgggcgattggatggctaagcaggcaagtctagatttcttcgttaagaaaagacacgcctttagcgagcactcaagctcaaataagagaaatgtgaacaatcggtcgtatcccgaagaagggaagacaaagcgagttcatgcgtctttcaccagaaaatacgacccatcatatattgagttcggtttcgtagctgtgatcgacggggaagttcttaagccacaatgcatcatttgtggggatgtgctggccaacgaggcaatgaaaccatcaaagctcaaacggcacctatatagcaaacacaaagagatttcatcacagccaaaggagttttag

SEQ ID NO: 50817 - DNA, 1737 bp, Artificial Sequence
  Description of Artificial Sequence: Synthetic coding sequence
atgaacatcagcgtggacctggagaccaactacgccgagctggtgttagatgtcgggcgggtgacgctcggggaaaatagtcggaagaaaatgaaagactgtaaactgcgcaaaaagcaaaatgaaagtgttagtcgcgccatgtgcgcactgctcaattctggcggaggggtgatcaaggccgagattgagaatgaggattactcctacacaaaagacggcataggcctggacctggaaaattctttctctaatatccttctgtttgtacccgaatacttggattttatgcaaaacggcaattacttcctgattttcgtgaagtcttggtcccttaacactagcggccttcggatcactacactgagctccaatctttacaagagggatattacaagcgctaaggtcatgaatgccaccgctgcgctggagtttctgaaggacatgaaaaagacaagggggcgactgtaccttaggccagaactgctcgccaaaagaccctgtgttgatattcaggaggagaataatatgaaggctttggcaggagtgtttttcgaccgcacggaacttgatagaaaggagaagctcacatttaccgagtctactcacgttgaaatcaaaaacttttccactgagaaattgcttcaaaggatcaaggaaattcttccccagtacgtgagtgcattcgccaataccgatggaggctatctcttcatcggcctgaatgaagacaaagaaataatcggcttcaaagcagaaatgtccgacttggacgatctggagagggagattgaaaagtctatcagaaagatgcccgtgcaccacttttgcatggagaaaaagaagattaactattcgtgcaaatttctaggcgtgtatgacaaaggatcattgtgtggctacgtatgcgcactgagggtagagcgcttctgctgcgccgtattcgccaaagagcccgacagttggcatgttaaagataacagggtgatgcaactcacacggaaagagtggatccagtttatggtggaggctgagcctaaatttagtagtagctacgaggaagtgatcagccagattaacacttctctcccagccccacattcttggcctctcttggaatggcagcggcaacgacaccactgccccgggctgtcagggagaatcacctacacccccgagaatttatgccggaagttgttcctccagcatgagggactgaaacagcttatctgcgaggaaatggattctgtccgaaaagggtccctgatcttctcacggagctggagcgttgacctcggacttcaggagaaccacaaagtgctttgcgatgccctcctcatctcccaggatagccccccagtactgtacacattccatatggtgcaggacgaggagttcaaggggtacagcactcagacagcgttgacccttaagcagaaactcgccaagatcggcggatacacaaaaaaagtgtgcgttatgacaaagatcttttacctgtcaccagaggggatgactagctgccaatacgacctgcgcagtcaagtcatttatccagagagctactactttactcggcgcaagtacctgcttaaggccctttttaaggctctgaaacggctgaagagcttgcgagaccagttcagcttcgccgagaacctctatcagattataggtattgattgtttccagaaaaatgacaagaagatgttcaagtcttgcagaaggctgacatag

SEQ ID NO: 50818 - DNA, 1737 bp, Artificial Sequence
  Description of Artificial Sequence: Synthetic coding sequence
atgaacatcagcgtggacctggagaccaactacgccgagctggtgctggacgttggcagagtaacactgggggagaattccaggaagaaaatgaaagactgcaagcttcgcaaaaaacagaatgaaagcgtctccagggccatgtgcgctctgctgaactctggtggaggagtgattaaggctgagatcgagaatgaagattacagttacacgaaggatggaatcggtcttgacctggagaattcatttagtaacatcttactctttgtgccagagtatttagacttcatgcagaatggtaattatttccttatcttcgtgaaaagttggtcgctgaacacttcaggacttagaattacgacactcagcagtaacctctataaacgagacattacttccgcaaaagtaatgaacgcgaccgccgctttagagttcttgaaagatatgaagaagactcgcggcaggttgtatctgaggcctgaacttctggccaaaagaccctgcgtagatattcaggaggaaaacaacatgaaagcccttgctggcgtgttttttgaccggaccgagttggatcgaaaagaaaagctcaccttcaccgaatcgacgcatgtggagatcaaaaatttcagcaccgagaagctgttacagcggatcaaagagattctgcctcagtacgtgtctgcatttgctaataccgacgggggctacttattcatcggcctcaacgaagacaaagagattattgggtttaaagctgaaatgtccgacctggacgacttagagcgtgaaattgaaaaaagcattcggaaaatgcctgtccaccatttttgcatggagaaaaagaagattaattattcctgcaaatttctgggagtctacgacaagggaagcctgtgtggttatgtttgtgctctaagagtggagaggttctgttgtgcagtttttgcaaaggaaccggacagttggcacgttaaagacaatagggtgatgcagctgacgcggaaagagtggattcagttcatggtcgaggctgagccaaaattttcttcatcatacgaagaagttatctcacagataaatacttctctgcctgctcctcatagctggcctcttttggagtggcagcgtcagagacaccactgcccgggcctttctgggcgaattacgtataccccagagaacctgtgtaggaagctgtttttgcagcacgagggcctaaagcagctcatctgcgaggagatggattccgtgagaaaggggtcacttatctttagtagatcctggtccgtggaccttggactacaagagaatcacaaagtcctgtgtgatgcattattgataagtcaggactcgccacccgtgctgtacacatttcacatggtgcaggatgaggagttcaaggggtactccacccagactgccctgaccttgaaacagaaacttgcaaagatcggcggctatacaaaaaaggtgtgtgtgatgacaaaaatcttttatttatcaccggagggcatgacctcttgccaatatgatcttagatctcaggtcatttacccagagagctactatttcacaagaaggaaatatttgctgaaagctttgtttaaggctctcaagcggttgaagtcactccgggaccagttttcttttgccgagaacttatatcagatcatcggaattgactgctttcagaagaacgataaaaagatgttcaaatcctgtcgccgcctgacctag

SEQ ID NO: 50819 - DNA, 48 bp, Artificial Sequence; identical to SEQ ID NO: 24521
  Description of Artificial Sequence: Synthetic coding sequence

SEQ ID NO: 50820 - DNA, 210 bp, Artificial Sequence
  Description of Artificial Sequence: Synthetic coding sequence
atgaacatcagcgtggacctggagaccaactacgccgagctggtgctcgacgttggtcgggttactctcggggagaattcacgcaagaagatgaaagactgcaagttgaggaagaagcaaaacgaatccgtgagccgagccatgtgcgcacttttaaactcaggaggcggcgttatcaaggcagaaattgaaaacgaagattactcgtag

SEQ ID NO: 50821 - DNA, 387 bp, Artificial Sequence
  Description of Artificial Sequence: Synthetic coding sequence
atgaacatcagcgtggacctggagaccaactacgccgagctggtgttagacgttggtcgtgttacactcggggaaaacagccggaagaagatgaaggattgtaaactcaggaagaagcagaatgaaagtgtctccagagcaatgtgcgcacttcttaacagcgggggcggggtcattaaagccgagatcgagaacgaagattactcctacactaaggacgggatcggcctagacctggagaatagcttctctaacatacttctgtttgtgccagaatacttggattttatgcagaatgggaattatttcctcatctttgtgaagtcttggagtctgaacacctctggccttcgcatcacaaccctgagctcaaatctgtataaatag

SEQ ID NO: 50822 - DNA, 1737 bp, Artificial Sequence
  Description of Artificial Sequence: Synthetic coding sequence
atgaacatcagcgtggacctggagaccaactacgccgagctggtgctcgacgtcggcagagtgactctcggagaaaatagccggaagaagatgaaagattgcaagctgcgcaagaagcagaacgagtcagttagcagagctatgtgcgccttgctcaattccggcggcggcgtgatcaaggcagagatcgagaacgaggattacagttacactaaagatggaatcggcctggatctggagaacagcttcagtaatattctgctctttgtaccagagtacctcgacttcatgcagaacggaaattacttcctcatctttgtcaagtcatggtctctgaacacaagcggactgcgcatcaccactttaagcagcaacctatataagagagacataacaagcgcaaaagtgatgaatgccactgctgctctggagttcctgaaagacatgaaaaaaaccagagggagactatatctccggcccgagctgctggcgaagcgtccctgtgtcgatatccaggaggaaaacaacatgaaggccctggccggagtcttctttgatcgcaccgaattggatcggaaagaaaaacttacgttcacagagagtactcacgtagagatcaagaacttttcgacagagaaattgctgcagcgcattaaagagatattgccccaatacgtgtcggcgtttgctaatacagacggaggttacctgtttattgggttgaacgaggataaggagattataggctttaaggctgaaatgtccgatctggatgaccttgagcgcgagatcgagaagtctatacggaaaatgccagtgcatcacttctgtatggaaaaaaaaaagattaattattcctgtaaattcctgggcgtgtacgacaaggggagcttgtgcggttatgtgtgcgccctccgggtggagcgcttctgttgcgccgtgtttgcaaaagagccggacagttggcacgttaaagacaacagggttatgcaattgactaggaaggagtggatccaattcatggttgaggccgagccgaagttcagcagtagctacgaagaagtgatttcccagatcaacactagtctccccgcacctcacagttggccactgctggagtggcagcgccagaggcatcactgccctggattgtctggtagaattacttatacaccagagaacctctgccgcaagctgttcctgcagcatgaggggttaaaacagttgatttgcgaagagatggactccgttcgtaaggggagccttatcttctcgcgatcttggtctgtagacctgggcttgcaagagaatcataaggtattatgtgacgcacttctcatctctcaggactctccccccgttttgtacactttccacatggtacaggatgaagaattcaaaggctattctacacagacggccctcactctcaagcagaagctggcaaaaatcgggggatacacaaaaaaagtttgtgttatgactaagatattttaccttagtccggagggaatgacgtcctgccagtacgatctgcgatcccaggtcatttatccagagagttactacttcactagacggaagtacctgttaaaagccctatttaaagccctgaagcgcctgaaatcactgagggaccagttctcattcgccgagaatctgtaccaaatcataggcatagactgctttcagaagaacgataaaaaaatgttcaagtcttgcagaaggctgacttag

SEQ ID NO: 50823 - DNA, 1854 bp, Artificial Sequence
  Description of Artificial Sequence: Synthetic coding sequence
atggccatgaagatcatggagaagatccggaacgtgttccactgcgaagcacaccggatcctttacatctgcgagagccagttcctccgaaactttatcaggaaggagtttctgaggggaaatgggctcgctgcaggcaaaatgaatatcagcattgatttagacactaattatgcagagctggtactcaacgtaggcagggtcacactcggcgaaaacaaccggaagaaaatgaaggactgccagctgcgtaagcagcagaacgagaacgtgagccgggcggtctgcgctctgctgaattccggcggcggggttataaaagccgaggtggagaataagggatactcatacaaaaaggacggcatcggccttgacctggaaaacagctttagcaacatgctgcccttcgtgcccaacttcctcgatttcatgcagaatggcaactacttccatatatttgtcaagtcctggtcattggaaacaagcggaccacagatagcaacactgagcagcagtctttacaaacgagacgtcacctcagctaaggtaatgaatgcctcagcggctttggagttccttaaagatatggaaaaaaccgggggccgcgcatatttaaggcccgaatttcctgcgaagcgggcctgcgtggacgtgcaggaggagtccaacatggaggctttggctgcagatttcttcaatcggactgaactgggctataaagaaaagctgacctttacagaatccacccacgtggaaatcaagaatttttctacggagaaacttctgcaaaggattacagaaatcttacctcagtatgttagcgcctttgccaatacggacggcggctacctctttgtggggctgaacgaagacaaagaagtgatcgggttcaaagccgagaaatcctacctgacaaagttagaggaagtgaccaaaaactccattggcaaactgcctgtccaccacttctgcgtagagaaaggtactattaattatttatgcaaattcctgggtgtgtacgacaagggccgcttgtgtggctatgtctacgccttacgtgtggaacggttttgctgtgcagtgttcgccaagaaaccggacagctggcatgtgaaggacaatagagtaaaacaacttactgagaaggaatggatacagttcatggtagatagcgagccagtctgcgaggagctgccatcccctgcttcaacatccagcccagtgagccagtcgtatcccctgcgtgagtacatcaatttcaagattcagcctctgaggtatcacttgcctggcctctctgagaagattacttgcgccccaaagactttttgcagaaacctgttcagtcaacatgagggtctgaaacagcttatatgtgaagaaatgggctcggtcaataaaggatccctgatcttttccaggtcttggtccttggacttaggcctccaggagaaccacaaagtcctgtgtgatgcacttctcatttcacaagacaagccacctgtgttgtacacatttcacatggttcaagatgaggagttcaaagactactccacgcagaccgcccaaacactgaagcaaaaactcgccaaaataggaggatacactaagaaagtttgcgtcatgacaaagatattctatctctctcctgaggggaagaccagctgtcagtatgatctgaacagtcaagtgatttatcccgaatcttactattggaccacagcacagaccatgaaggatctcgaaaaagccctatcaaacatcttaccaaaagagaaccagatcttcctctttgtttgtctgtttaggttctgccttttcgtctgctggtttgtctgtttctttcttagatag

SEQ ID NO: 50824 - DNA, 1860 bp, Artificial Sequence
  Description of Artificial Sequence: Synthetic coding sequence
atgcagctgagcgagggcctggccgcccacacccggcgggccggcaagtggaagaggacccaggtcccactactgggagaagaatgtgcggatatggacctggccagaaaagagttcctgcgcgggaatggactggccgccggaaagatgaacatttcgatcgaccttgacaccaattacgccgagctcgtgcttaatgtgggtcgcgtgacgcttggtgaaaataatagaaaaaaaatgaaagactgccaactcagaaagcagcagaacgagaatgtcagtagagccgtgtgtgcactccttaactctggcgggggcgtcataaaggccgaggtggaaaataaagggtacagttataaaaaggatgggattggattggatttggaaaactcattctccaatatgctgccatttgttccaaacttccttgattttatgcagaacggaaactacttccatatctttgtgaagtcttggtccctggaaacatctggccctcagattgcaacgctgagtagctcattgtacaaacgagacgttacatcagcgaaagttatgaacgcctctgcagcgctggagttcctgaaagatatggagaagactggtggtcgcgcctaccttcggccagaattccctgccaaacgagcatgtgttgacgtacaagaggagtccaatatggaggcactcgccgcggacttttttaaccggacagagctcggttataaggagaagctaacctttacggaatccacccatgtggagattaaaaacttctctacagagaagttacttcagagaatcaccgaaatcctgcctcagtatgtgtctgccttcgccaacaccgatggcgggtacctcttcgtcgggttaaacgaggataaggaggttataggtttcaaggcggagaaatcatacctgaccaagctggaagaggtgactaaaaattctatcggtaagctgcctgtacatcacttttgtgtggaaaagggtacaattaattacctctgcaaatttctcggcgtgtacgataagggccgtctatgtggatacgtctacgcactgcgggtggagcggttttgttgtgcagtgttcgcaaagaaacctgatagttggcatgtaaaggataatcgtgtgaagcagttaacggagaaagagtggatccagtttatggtcgatagcgaaccagtttgcgaagagttaccttctccagcgagcacatcttctccagtttctcagtcctatccgctacgggagtacattaactttaaaatacaacccctgcgataccatctacctggtttgtccgaaaagattacatgcgctccaaagactttttgtagaaatctgttcagccagcatgagggcctgaagcagcttatttgtgaggaaatgggcagcgtgaataaggggagtctcatattctctagatcatggtccctcgacttagggctgcaagagaaccacaaagtgctctgtgacgccttgttgatctcccaggacaagcccccagtcctgtatactttccacatggtgcaggatgaagaatttaaagactacagcacgcagaccgcccagactctgaaacagaagttagccaagatcgggggttatacaaaaaaagtctgtgtgatgaccaaaatattctatctcagcccagagggcaaaaccagctgccagtatgatctgaattcccaagtcatttacccagaatcttactattggaccacggcccagacaatgaaagacctcgagaaagcgctctcaaacatcctgcctaaggagaatcagatttttctcttcgtgtgtctgtttagattttgtctgttcgtctgctggtttgtgtgcttttttctacgttag

SEQ ID NO: 50825 - DNA, 2694 bp, Artificial Sequence
  Description of Artificial Sequence: Synthetic coding sequence
atggaggccaaccactgcagcctgggcgtgtaccccagctaccccgacctggtcatcgatgtgggcgaagttaccctgggggaggaaaaccgcaagaagctccagaagacccaacgagaccaagagcgagcaagggtcatcagggctgcatgtgccctgctgaactctggaggaggggttattcagatggaaatggcgaacagggatgagcgccccaccgagatgggcctggatctggaagagtccctgcgcaaacttattcagtacccatatctgcaggcattcttcgagaccaaacagcatggtagatgcttttatattttcgtaaagagctggtccggcgacccctttctgaaggatggaagctttaatagccgaatctgttctctctcctcatccctttactgcagatcgggaacctctgtcctgcacatgaactccaggcaggcctttgattttctgaaaaccaaagaacggcagagcaagtataatctcattaacgaggggagcccgccctctaaaattatgaaggcagtttaccagaatatctccgagtccaatccagcctacgaggtgtttcaaacagatacaatagagtatggggagatattatctttcccagaatcaccatccatcgaatttaagcaattctccaccaaacacattcaacagtatgtagagaacattatccccgaatacatttcggcctttgcaaatacagagggcggctacctgttcatcggcgtggacgataagagccggaaggtgctgggttgtgccaaggaacaggtggatccagatagtctaaagaacgtgatagcacgggctatctctaaattacctatcgttcacttctgtagttctaagccccgcgtcgaatactcaaccaagatagtagaggtgttttgtgggaaagaactatacggatacctgtgtgttataaaagtgaaggctttctgttgtgtcgtgtttagcgaagcccctaagagttggatggtaagggaaaagtacatacgccccctgaccaccgaagagtgggtagaaaagatgatggatgcggacccagaatttcctccagacttcgctgaagccttcgaatctcagctgtccttatcagactctccctccctgtgccgaccagtctactcaaagaagggtctggaacataaggccgaccttcagcagcatctctttccagtcccccctgggcatctcgagtgcacacctgagagcctgtggaaggaacttagtcttcagcacgaagggttaaaagagctcatccataaacagatgaggccttttagccagggaatcgtgatcctgtcacgtagctgggccgtagatctgaacttacaagaaaaacccggagtcatttgtgatgccctcctgatcgcacaaaattcgacacctatcctttacacgatactgcgagagcaagacgccgaaggacaggattattgcacccgcaccgccttcaccctaaaacaaaaacttgttaacatggggggttataccggaaaggtctgcgtgcgggcaaaagttttatgtttaagtcctgagtcgtccgctgaggctttggaagctgcggtgtctccgatggactatccagcatcctactccctcgcaggcacgcagcatatggaagcccttctgcagtccttggtgatagtattactgggattccggagtttgttatcagatcaattgggatgcgaggtactcaaccttctgactgcccagcagtacgagatattctcaaggtctcttaggaagaacagggagctgtttgtccacgggctgcctggcagcggcaagacaataatggccatgaaaataatggagaaaatccgaaatgtgtttcactgcgaagcacatagaatcttgtatgtctgcgagaaccaaccactgagaaactttatcagcgaccgtaacatctgccgcgctgaaacccgggaaacattcctccgcgagaagtttgagcatatccaacatattgttattgacgaggcccagaattttagaaccgaagacggggactggtatcggaaggccaaaacaattacccagcgtgagaaagactgcccaggtgtgttatggatcttcctagactacttccagacatcccacctgggccactctggtttgccccctctcagcgcccagtaccctagagaagagttgacacgggtcgtgcgcaacgccgatgaaattgccgagtatatccagcaggaaatgcaactaattatagaaaatccaccgatcaacatcccccatgggtatctggcaattctgtcggaggcaaaatgggtcccaggcgttcccggaaacaccaagataattaaaaattttacgctggagcagatcgtgacttatgtcgccgatacgtgcagatgtttctttgaaagagggtactctccaaaggatgtggccgtgttggttagcaccgtgacagaggtcgagcaataccagtctaagctcctcaaagcgatgcggaagaagatggtggtgcaactgagtgatgcctgcgacatgttaggagtgcacatcgttcttgattcagtgcgacggtttagcgggctcgagagaagtatcgtcttcggcattcaccctcgcacggcagatcctgcaatccttcccaacatcctgatctgcttagcctcaagggctaagcagcatctttatatctttttgtag

SEQ ID NO: 50826 - DNA, 1740 bp, Artificial Sequence
  Description of Artificial Sequence: Synthetic coding sequence
atggaggccaaccactgcagcctggcccccaagagctggatggtgcgtgagaaatacattaggcccttgactacggaggagtgggtggagaaaatgatggatgcagatccagagtttccgcccgactttgcggaggctttcgagtcacagttgtctctcagcgactctcccagtctctgccgccccgtgtattccaaaaagggcctggaacacaaggcagacctgcaacagcacttgtttccagtcccccccgggcacctcgagtgtacgccagaaagcctctggaaggagctgtccctgcagcatgaaggtctcaaagagctgattcataagcagatgcggcctttctcccagggtattgtgattttgagtcgaagttgggccgtggatctgaaccttcaagagaagcctggggtgatctgcgacgcgctcctaatcgcccaaaactcaactcctattttgtatactatcctgagggaacaggatgccgagggccaggattactgtaccagaactgctttcaccttgaagcaaaaactcgtgaatatgggggggtatacgggcaaggtctgcgtcagggctaaagttctctgtctgagccccgaatcctctgctgaggccctggaagctgcagtatcaccaatggattatccggccagttatagcctggcaggcacacagcatatggaagctctcctgcagtctcttgtgatagtgctgctggggtttcggtcactgctgagcgatcaactaggatgcgaagtgttgaatctactgacagcgcagcagtacgagatcttttcccggtcactgcgcaagaatagggagctgtttgtgcatggacttcccggctctggaaaaacgattatggctatgaagattatggagaaaattcgtaacgtgtttcattgcgaggcgcaccgtatcctgtatgtgtgtgaaaatcaacctttgaggaactttattagcgacaggaatatctgcagagccgagacaagagagacctttctaagagaaaaatttgagcatatccagcacatcgtgatcgatgaggcccagaattttcggactgaggacggcgactggtatcgtaaagccaagaccatcacacagcgcgaaaaagactgcccaggcgtactgtggattttcctcgattacttccagacttctcatctgggacacagcggcctgccacctctgtccgctcaatatccgagagaagaactcacccgggtagtcaggaatgccgatgagatcgctgagtacatccagcaggagatgcagctgatcatagaaaacccccctatcaatattccacatggataccttgctatactgagtgaggccaaatgggtacctggggtgcctggcaatacaaaaatcattaagaacttcactctggaacagatcgtgacttacgtcgcggacacatgccgatgtttctttgaaaggggttacagtcctaaagatgtggcggtactggtgtcgacggttacagaggtagagcagtaccagagtaaactgctaaaagccatgcgcaagaaaatggtggtacagctttctgacgcttgcgatatgcttggtgtgcatattgttttagactctgtgaggagattctctggattggagagaagcattgtgtttgggatacacccccggaccgccgaccccgccatcctccccaacattctgatatgccttgcgagccgcgcgaagcaacacctctatattttcctgtag

SEQ ID NO: 50827 - DNA, 321 bp, Artificial Sequence
  Description of Artificial Sequence: Synthetic coding sequence
atggaggccaaccactgcagcctgggcgtgtaccccagctaccccgacctagtgatcgacgtgggggaggtcacactcggagaagagaatagaaaaaaactgcagaagacacaaagagatcaggaacgggcacgagtgattcgcgctgcttgcgccctcctgaatagtggcggaggagtgattcaaatggaaatggccaacagagacgagcggcccactgagatgggcctagacttggaagaaagcctccgaaagctgatccagtacccatacctgcaggcgttcttcgaaaccaagcagcatggacgctgtttttactag

SEQ ID NO: 50828 - DNA, 2694 bp, Artificial Sequence
  Description of Artificial Sequence: Synthetic coding sequence
atggaggccaaccactgcagcctgggcgtgtaccccagctaccccgatcttgtcatcgatgtcggagaggtcaccttgggggaggagaacaggaaaaaactgcagaagactcagcgagaccaggaacgggcacgggtcatcagagccgcctgtgctctgctgaacagcgggggaggagtgatccagatggaaatggctaatagagacgagagaccaaccgaaatgggtttggacctagaggaatctttaaggaaattgattcagtatccctacttgcaggcgttcttcgagacgaagcagcatgggcgttgcttctacatatttgtgaaatcatggtcaggggatccttttctgaaggacggtagtttcaactcacggatttgcagccttagctcctcgctctactgtaggagtggcacctccgtattgcacatgaacagccgtcaggcattcgatttcctgaagaccaaagaacgtcaaagcaagtataatctcatcaacgaggggagtccaccatccaagatcatgaaggccgtctatcagaacatctctgagtcaaacccagcatatgaagtcttccagacggacacgatcgagtacggagagattctgtccttcccagagtctcccagcattgaattcaagcagttttctaccaaacacatccagcagtacgtagaaaatattattcctgagtatatcagcgccttcgcgaataccgagggtggatatctgttcataggtgtcgacgataagtctaggaaggtactggggtgtgcaaaagaacaggtcgacccagattccctgaagaacgtgatcgctagagctattagtaagttgcctatcgtgcacttctgttccagtaaacctagggttgaatattctacgaagatcgtggaggttttttgcgggaaagagctgtatggatacttgtgtgtgatcaaggtcaaggcattctgttgcgtagtcttttctgaagcacccaagagctggatggtgagagaaaagtacattaggcccttaactaccgaagagtgggtcgaaaagatgatggatgctgacccagaatttccccctgacttcgccgaggcatttgaaagtcaactgagtctcagtgactctcccagcctgtgcaggccagtctactccaaaaaaggacttgaacacaaggccgatttgcagcaacatctttttcccgttcctcctggacatcttgagtgcactcctgagagcctatggaaagaactgtctctacagcacgaaggtctgaaggaacttatccataagcagatgcggccatttagtcagggcatcgtgattttgtctaggagctgggcagtcgacctcaatctccaggagaaaccaggtgtgatctgcgacgctctactcatcgcacagaattctacccccatcctctacaccattttgagggagcaggatgctgagggccaagattattgcaccaggactgctttcacgctaaagcagaaattggtcaacatgggagggtacaccggcaaggtgtgcgtgcgggcaaaagtgttatgtttaagcccagagagttcagccgaagccctggaggccgcagtgtccccaatggactatcctgcttcttactcactagccggtacgcagcacatggaagcgctgctccagtctcttgtcatcgttttgttaggcttcagaagcctgcttagcgaccagctcggttgtgaggtgttaaacctgttgacagcccagcagtacgagatcttctccagatcactaaggaagaatagggagctgttcgtccatgggctcccaggatcaggaaaaaccatcatggcaatgaagatcatggaaaagattcgaaatgtgttccactgtgaagcccatcgcattctctatgtgtgtgaaaaccagccacttcgcaactttatcagcgaccgcaacatctgccgagccgaaaccagggaaaccttcctgagggagaagttcgagcacatacaacacatcgttatcgacgaggcccagaatttccggaccgaggacggcgattggtataggaaagcgaaaacgatcacacagagagagaaggactgtccaggcgtactgtggatcttcctcgactactttcagacaagtcacttagggcactccggtctgccgccactgtctgcacagtacccacgagaggaactcaccagggtggtgcgcaatgcagacgagattgctgagtacattcaacaggagatgcaacttattattgaaaatccccccatcaacattccacatggctacttagccatcctgtctgaggctaagtgggtaccaggcgtgccgggaaatactaagattataaaaaatttcacactcgaacaaattgtaacctacgttgcagatacctgtaggtgtttcttcgaacgcggttactcccccaaagacgttgccgtgctcgtgtctactgtgaccgaggtggagcagtatcagtctaagctgttgaaagctatgcgaaagaaaatggtcgtgcagttatctgatgcctgcgatatgttgggcgtgcacatcgttctcgatagcgtgagacggttctcagggctcgaacgcagcatcgtcttcggtatacacccaagaacagcggacccagccatcctgcccaatatcctcatctgtctcgcttccagggctaaacaacacctctacatatttctgtag

SEQ ID NO: 50829 - DNA, 1740 bp, Artificial Sequence
  Description of Artificial Sequence: Synthetic coding sequence
atggaggccaaccactgcagcctggcccccaagagctggatggtgcgggaaaaatacattcgtcccctgacaaccgaggaatgggtggaaaagatgatggatgccgacccagagttccctccagatttcgcggaggcattcgaaagccagctgtccttgtctgacagccctagtttatgtaggcctgtctactcaaagaagggcctggaacacaaggccgatctgcagcagcacctcttcccggttcctcccggacatctggaatgcacacccgagtctctgtggaaggagctgtcgctccagcatgaagggctgaaggaactgatccataaacaaatgagacctttctcccagggtatagtgatactgagccggagctgggcagtagatcttaacctgcaagagaagcctggcgttatttgtgatgcactgctgattgcacaaaacagcactcctatcctctataccatccttagggagcaagacgccgaagggcaggattactgtacacgcactgcttttacactcaaacagaaactggttaacatggggggatacacgggcaaggtttgcgttagagcaaaggtactctgtctatcccccgaatctagtgcagaggccctggaggctgctgtgtcccctatggactacccagcctcatacagccttgccgggacccaacacatggaagcactgcttcagtccttggtcattgtgttgcttggtttcaggagccttttatccgatcagctcggatgtgaggtcttgaatctccttaccgcccaacagtatgaaatattcagtcggagtctcaggaagaaccgcgaactgttcgttcatggactgcccggcagcggcaaaaccatcatggcaatgaagattatggagaagattcggaatgtgttccactgcgaggcacaccgaatcctctatgtctgtgaaaaccagccactccgcaacttcatcagtgacaggaacatttgtcgggcggaaacaagagagacttttttaagggagaagtttgagcatattcagcatatcgtcatcgatgaagctcagaactttaggaccgaagatggggattggtacaggaaagccaaaactattacacagagggaaaaggattgccccggggtgctgtggatttttctagactatttccaaacatcccacctaggacacagtggtcttccccctctttcagcccagtatccccgtgaagagcttacgcgcgtcgtccgtaacgctgacgagatcgccgaatatattcaacaggagatgcagttaattatcgaaaacccccccataaatatcccccacggatatctggccatactgagtgaggcaaagtgggtccccggagtgcctggaaacacaaagataatcaaaaacttcacactagagcaaatcgtgacctacgttgccgatacatgcagatgcttttttgagcggggttactctccaaaggacgtggccgttctagtcagtactgtgactgaggtggagcagtatcagtctaagctcctgaaagctatgcgaaagaagatggttgtgcagctgtcagacgcatgtgatatgttaggcgtgcacatcgtgttggattccgtgcggaggttttcaggcctcgaacgctctatagttttcgggatccatccccgtaccgccgatccagcaatactccccaatattctgatttgcctggcctcaagagccaaacagcacctgtatattttcctgtag

SEQ ID NO: 50830 - DNA, 2694 bp, Artificial Sequence
  Description of Artificial Sequence: Synthetic coding sequence
atggaggccaaccactgcagcctgggcgtgtaccccagctaccccgacttagtcattgacgtgggagaggtgacactgggcgaggaaaatcggaagaagctgcaaaaaacacagcgcgaccaggaaagagcgcgagtcattcgggcggcgtgtgcgttactgaattctggcggcggcgtgatacagatggagatggccaacagggatgagaggcccacagagatgggtctggatctggaggagtctcttaggaaactgattcagtacccatacctgcaggcctttttcgaaaccaaacagcatggaagatgtttctacatctttgtgaagagttggtctggcgaccccttcctgaaggatggatcctttaactctcgcatttgcagccttagcagttctctctactgcagatccggcacttcagttcttcatatgaactcccgccaggctttcgactttctcaagaccaaggagaggcagagtaagtacaatctaatcaacgaaggaagcccgccttcgaaaatcatgaaagcagtttatcaaaacatttctgagtcgaaccccgcgtacgaagtttttcagacagatactattgaatacggggaaatccttagcttccccgaatcaccttcaattgagtttaagcagttcagcacaaagcatatccagcagtatgtcgagaacattattcccgagtacatatctgcattcgctaatacagaggggggctatctgttcattggtgtggacgacaagagtcgtaaagtgctggggtgtgcaaaagaacaggtggatcccgactccctgaaaaacgttatcgcgcgtgcaatctccaagttgcccattgtgcatttctgctcttctaagcctagagtggaatacagcaccaagatcgtggaggtcttttgcggcaaggaactgtatggttacctgtgcgtcatcaaagttaaggctttctgctgcgtagttttctctgaggcacctaagagctggatggtcagagagaaatatatccgcccactgaccacagaggagtgggtggagaaaatgatggacgccgatcccgagtttcctcccgattttgctgaggccttcgaatctcagctcagcctgtccgatagtcccagcctgtgccgcccagtctacagcaagaagggcctcgagcacaaggccgacctccagcagcacctgtttccagttccaccgggacaccttgagtgtacccccgaatcactgtggaaggagctgtcacttcagcatgaagggctaaaagaattgatccataagcaaatgagaccttttagtcaaggcattgttatccttagtcgatcctgggctgtcgatctcaaccttcaggaaaagcctggcgtgatctgtgacgccctgctgatagctcaaaactcaactccaatcctctacacgattctgagagagcaggacgcagaggggcaggactattgcacccgtaccgcattcaccctcaaacagaaactcgtgaacatgggagggtacacaggcaaggtctgcgtgcgcgcgaaggtcctctgtctgtcacccgagagctccgctgaggcattggaggcggctgtcagccccatggattaccctgcttcttactccttggctggcacccaacacatggaggctctccttcagagcttagtcattgtgctgctgggttttagaagtctgctcagcgaccagcttggatgcgaggtgttaaacttactgaccgctcagcagtatgagattttttcgcgaagcctacgcaagaatagagagctctttgtccatggcttgccaggttcagggaaaacgattatggcaatgaaaattatggagaaaatacgaaatgtgttccattgtgaagcacatcgaattctatacgtatgcgaaaaccagcctctgcgcaacttcatatctgacaggaatatctgccgcgcagagacacgagagaccttcctacgagagaaattcgaacacattcaacacattgttattgacgaagcccaaaacttcagaaccgaggatggagactggtatcggaaggctaagacgattactcaacgagaaaaggattgtccaggggtgctttggatcttcttagattacttccagacaagccatcttgggcactcagggctgccccccctcagcgcccaataccctcgagaggaactcacgcgcgtggtccggaatgcggacgagatagcagaatacattcagcaggagatgcagctgatcatcgaaaacccaccaatcaatatcccacatgggtatctggcaatcctctctgaggcaaagtgggtgcctggagtgcctgggaatacgaagattatcaagaacttcacactggaacagatcgtaacatatgtggccgacacctgtagatgtttttttgagcggggatactcgcctaaagatgtagcagtgctagtctcaactgtcacagaagtggaacagtaccagagcaaactactgaaggcaatgaggaagaaaatggtcgtacagctctccgatgcgtgcgatatgctgggtgtgcatattgttctggactccgtccggagattttccgggctcgaacggagtattgtgttcgggattcacccacgaaccgcagatcctgccatactgcccaacattctcatctgtctggcctcgagggcaaaacaacatttatatatcttcctatag

SEQ ID NO: 50831 - DNA, 2739 bp, Artificial Sequence
  Description of Artificial Sequence: Synthetic coding sequence
atggagagcctgaagaccgacaccgagatgccctaccccgaggtgattgtcgacgtaggtcgcgtcatctttggagaagaaaatcgcaagaagatgactaactcttgcctgaagcgttctgagaattcccgtataatcagggcaatctgcgccctgctcaacagcggcgggggtgtgattaaagcagagatagacgataagacatactcctatcaatgtcatggcctgggacaggacctcgaaacttccttccagaaactgttgccatccggaagccagaaatacttagactacatgcagcagggacataacctactcattttcgtgaaaagctggtcacccgatgttttctccctgccgctgaggatttgctccctgagatccaacctgtaccgacgtgacgtgaccagtgcaatcaatctctccgcatcatccgcactggagctgctgagagaaaagggttttagagcacaaagaggacggcctagagtgaagaagctgcacccccagcaggtgttaaatagatgtatccaggaagaagaggacatgagaatactggcttccgaattcttcaagaaagataagctcatgtacaaagaaaagttaaatttcaccgagagcactcatgtggaattcaaaagattcaccaccaagaaagttattcccagaatcaaagaaatgctgcctcactacgtgagcgcttttgcaaacacacaggggggctatgtcctgatcggagtcgacgacaaaagcaaggaggttgtaggctgtaaatgggaaaaagttaatcctgatctgctgaagaaagagatcgagaactgcatcgaaaagttgcctacctttcacttttgctgcgagaaacctaaagtgaatttcacgacaaaaatactaaacgtgtatcagaaggatgttctggacgggtacgtttgtgtgattcaggttgaaccattttgttgtgtggtgttcgcagaggctccagactcttggattatgaaggataactctgtcactcggcttacagccgagcagtgggtcgtcatgatgctggatacacaatctgcccccccgtctctggtcaccgactacaactcttgcctcattagcagcgcatcttccgcccgaaaatcaccagggtaccctattaaagttcacaagttcaaggaagctcttcaacgccacttgtttcccgttacgcaagaggaagtgcagttcaaacccgagagcctctgcaagaaattattctcagaccacaaagagcttgaaggactgatgaagactctgatacacccttgctctcagggcattgtcatttttagccgcagctgggctggcgatgtaggctttagaaaggaacagaacgtcctgtgcgacgccctgctcatcgccgtgaattccccagtggtgttatataccatcttgattgaccctaactggccaggtgggctggaatacgcaaggaatacggcccaccagctgaaacagaaattgcagaccgttggtggttataccgggaaagtgtgtatcattcctagattaattcacctgagctccacacagtctcgtcctggggagatcccgctccgatacccacgcagttaccgcctggcagacgaagaagagatggaggatcttctgcaggcacttgtggtagtgagtctcagttcacggagcttgctctcggatcaaatgggctgtgaatttttcaatctcctgatcatggaacagagtcagctgcttagcgagagtctccagaaaacccgggagctgttcatctattgctttcctggtgtccggaagactgctctagccattaagattatggagaagatcaaggacctgttccactgcaaacccaaagaaattctgtatgtgtgtgaatctgactcattgaaagacttcgtcactcaacagaccacatgtcaggctgtgacccgcaaaacgtttatgcagggggagtttctaaaaataaaacacatcgtgatggacgaaactgaaaatttctgttctaaatacggcaactggtatatgaaggctaagaatattacccatcctaaggccaagggcaccggaagtgagaacctgcatcatgggatcctgtggctgttcctcgatccctttcagatccatcacgccgacgtaaacggcttgccccctcccagcgcccagttcccgaggaagactatcacctctggcatccactgcgcgctagagattgcaaaggtgatgaaggaggagatgaagcgcatcaaggaaaatcccccaagcaacatgtcccccgacacccttgccctcttcagcgaaaccgcatatgaggaagctacatgcgcccaggcactccccggagtgtgtgagactaaaactaatcttacaaccgagcagatcgccaactacgtggcccgcaagtgccactcgctctttcagtgcggttatctaccaaaggatatagctatcctctgtagaagaggggaagatcggggtcgataccggctagctctcctcaaggcgatggagctgatagagactcaccggcccagtgaggtggtcttctctcccgccaccggagtgtgggggagccacatcgtcctcgatagcatccagcagttctcaggattggagcgcaccgttgtgtttgggttgagccctgaatgtgaccagtcggaggagtttcataaactgtgctttgccagccgcgccatcaagcacctgtatctgctgtacgaaaaacgcgcagcgtactag

SEQ ID NO: 50832 - DNA, 2676 bp, Artificial Sequence
  Description of Artificial Sequence: Synthetic coding sequence
atgagcctgcggatcgacgtggacaccaacttccccgagtgcgtggtggacgccggcaaagtcaccctgggcacgcaacagcgtcaggagatggacccccgcctgcgggagaaacagaacgagattatcctacgggcagtctgtgccctgttgaactccggaggaggcataattaaggccgaaatagaaaacaaggggtataactacgagaggcatggggtgggtctggatgtgcctcctatcttccgcagtcaccttgataaaatgcagaaggaaaatcatttcctgatctttgtgaaatcttggaacacagaggctggagtgcccctcgctacactctgtagcaacctttaccacagggagcggacttccacagatgtcatggactctcaggaagcattggcctttctcaagtgtaggactcagacacctaccaacattaatgtgtctaatagtctgggtccccaggccgctcaggggagtgtccagtacgagggcaatatcaacgtgagtgccgccgctctgttcgaccgaaagagactccagtacctagaaaaattaaatctgccagagagcacccacgtcgagttcgtcatgtttagtacagacgtgagtcactgcgtgaaggacagattgcctaagtgcgtgtccgcctttgcaaatacagaaggcggttatgtcttctttggcgtgcatgatgagacgtgccaggtcattggatgcgagaaagaaaaaatagacctcacttcactccgggcttcaattgacggctgcatcaaaaaactgcctgtgcatcacttttgcacgcagcgtcccgaaattaaatatgtccttaatttccttgaggtccacgacaagggagctctgaggggctatgtttgtgctatcaaagtcgagaagttttgttgtgctgtgtttgccaaggtgcccagtagctggcaagtaaaagacaatagggttcgacaattgccaactagagaatggaccgcatggatgatggaggcagacccagacctgtcccgctgtccagaaatggtgcttcagctcagtctttcctcggccacgcctagatctaagcctgtctgtattcacaaaaattcggagtgcctgaaggagcagcagaagcgctatttcccagtattttctgatagggtggtctacaccccagaatctctctataaggaattgttctctcagcacaaaggcctacgggacctgattaacacagaaatgaggccattctcccaggggattctcatcttttcacaatcttgggctgttgatctggggctgcaagagaagcagggggtcatttgcgacgctctcctaatctcacaaaataacacgccaatcctctacacaatcttttcaaagtgggatgcaggctgcaaaggttactcgatgatcgtggcctactccctcaagcaaaagctggtgaacaagggcggttacacaggaagactgtgtataactccccttgtgtgcgtgctcaactccgacaggaaggcccaaagcgtttacagctcatatctgcagatctacccagagtcctataatttcatgacgccacagcatatggaggcattactccagtctctggtgattgtcttgctgggctttaagtcatttctctcagaagagttaggctctgaagttctcaatttgttgaccaataagcagtacgagcttctctccaaaaacctgcggaaaacacgagaactgttcgtgcatggacttccaggtagcggaaaaaccatcctcgccttgcgcattatggagaagatccggaatgtatttcattgtgaaccagccaacatcctgtatatttgtgaaaatcaacccctgaagaagctggtttccttctccaagaagaacatttgccagcctgtgacccggaagacgtttatgaagaacaacttcgagcatatccaacatatcatcatcgatgatgcccagaactttcgcacagaagatggggattggtacggaaaagccaagtttattacacaaactgccagggatggcccaggcgtactgtggattttcctggactatttccagacctatcacttaagctgctctggcctacccccacctagcgaccagtatcccagggaggagatcaaccgggtggtgcgcaacgccggacccatcgctaactatctgcagcaggtcatgcaggaagcccgtcagaatcctcccccaaatttgcccccaggcagtctggtgatgttatacgaacctaagtgggcacagggcgtgcccggaaacctcgaaatcatcgaagatctgaatctagaggaaatcctaatctatgttgccaataaatgtcgctttcttctgaggaacgggtatagccctaaagatatagccgtgctgtttacaaaggcttcagaagtagaaaagtataaggacaggctgctgacagcaatgagaaagagaaagctcagtcagttgcacgaggagtccgacttattgttgcagattggagacgcctctgacgtcctcactgatcacatcgtcttagactcagtttgcaggttttccggcttagaacgaaatatagttttcggcatcaatcccggcgttgccccccccgccggggcctacaacctgttgctgtgcctggcctcccgtgccaaacgacacctttatatcttgaaggcctcagtgtag

SEQ ID NO: 50833 - DNA, 1170 bp, Artificial Sequence
  Description of Artificial Sequence: Synthetic coding sequence
atgagcctgcggatcgacgtggacaccaacttccccgagtgcgtggtcgacgccggcaaggtgacactcggtactcagcagcggcaagagatggatccccgtctgagagagaagcaaaacgagattattctgagagcagtctgcgccctgttaaactccggtggcggcattatcaaagccgaaattgaaaacaaaggctacaactacgaacgacatggggtaggcctggacgttccccccattttccggagtcatttagacaaaatgcagaaagagaaccactttctgatctttgttaagtcctggaacactgaggcaggtgtaccgttagcgacgttgtgctccaatttgtaccatagagagaggacatcaacggatgttatggactcacaggaggccctggcgttcctcaagtgccggacgcagaccccaacaaatatcaatgtatcaaactctttgggacctcaggcggcacagggatctgtccagtacgagggcaacattaacgtctcagctgccgcacttttcgatcggaaacggctacaatacctggagaagctgaatctcccagaatctacccacgttgaatttgtcatgttttccactgacgtttcacactgtgtgaaagatcggttgccgaagtgcgtctccgccttcgccaacacagaaggtgggtacgttttcttcggtgttcacgacgaaacctgccaggttatcgggtgcgagaaagaaaagattgatctgacatctctaagagcttccattgacggatgtattaagaagttacctgtgcaccatttctgtactcaacggcccgagatcaagtatgttttgaattttctggaggttcacgacaagggagccttgaggggatacgtctgcgccatcaaggtggagaaattctgttgtgccgttttcgcaaaagtaccgtcgtcctggcaggtgaaggataatagagtccgtcagttacccacacgggaatggaccgcgtggatgatggaggcagaccccgatctgagcagatgcccggagatggtgctgcagctctcactatctagcgcaacgcccaggagtaaacccgtttgcatccacaaaaactcagagtgcctgaaagagcaacaaaaacgctattttcccgtgagcgccagaaaaaccagcgctagccagtag

SEQ ID NO: 50834 - DNA, 1224 bp, Artificial Sequence
  Description of Artificial Sequence: Synthetic coding sequence
atgacccccatgaagcggagcgtgcagacccaggtgagcgagcccttcatggaatcttggggagaggagtccttacccgaacttccggcggaacagtcgctgacggagtatagcgacttagaggaggcacccagtgcacacaccctctatgtaggccaccttaatcctcagttttccgtgccggtactggcttgtctcctcagagacacacttgagcgcctggagatgcctgtcgctcgcgaacatattgaggtggttcggagaccccggaaggcttatgcattggtgcaggtaacagttcaccgcgacaccctggcatccctgccctggagactccagaccgctcttgaggagcaccttattctcaaggagctggcggcccgcggtaaagatctgctcctgagcgaggcccagggacctttttcccatcgcgaggagaaagaagaggaagaagaagactcgggcctgtcccctggcccttctcctggaagcggggtgcctctgcctacttggcccacccatactctaccagatcgaccccaagcgcaacaattgcagagctgccaaggccggccctccggagtctgcagcgacagcgcaattgtgcaccagcagattgtcggcaaggatcaattgtttcaaggagcgttccttggatccgagacccgaaatatggaatttaagcggggaagtggcgagtacctttcccttgcattcaaacaccatgtgcgtagatatgtgtgcgcctttctcaactctgagggaggttcacttcttgttggcgtggaggacagtggcctcgtgcaaggcatcagatgcagccaccgcgacgaggatcgggcacggctcctggtggactccattctccaaggctttaaaccacagattttcccggacgcgtataccctgacttttattcccgtgatctccacctcggagacatcagtgcctctaaaggtcataagactcaccgtccacacaccaaaagcccagtcgcagccccagttgtatcagacagaccagggtgaggttttcctgcggagggatggaagcatccaggggcccctctctgctagtgcaatccaggagtggtgcagacaacggtggttagtggagctgggtaaactcgaagagaagatgaaagcgttgatgatggagaaagagcagctccagcagcagctccagcagcatggccctgtgtcttgcacatgttgcgtactctag

SEQ ID NO: 50835 - DNA, 1224 bp, Artificial Sequence
  Description of Artificial Sequence: Synthetic coding sequence
atgacccccatgaagcggagcgtgcagacccaggtgagcgagccctttatggagtcctggggtgaggagtcacttcctgagttgccagctgaacagagcttgacagaatatagcgatctggaagaggcaccatcagctcacaccctgtacgtagggcacctgaatccgcagttcagcgtacccgtcctggcatgcttgctgagagatacacttgagagactggagatgcccgtcgcacgggaacacatagaggtagttcggcggccgaggaaggcgtatgccctcgtgcaggtgaccgtgcatcgggacaccctggcctcgttaccgtggaggctccagaccgctctcgaggaacacttgattttgaaggagcttgctgcgcggggcaaggatctgctactcagcgaggcccagggcccattctcccacagagaagaaaaagaggaggaagaagaggacagtgggctttcgcctggtccgagccccggctcaggggtgcccctccccacctggccgactcatacactacctgacagaccgcaggcacagcagctccaaagctgtcaggggcgcccatctggcgtgtgctcagattccgccattgtccaccaacagatagtggggaaggaccaactttttcagggggctttcctgggatctgagacgcgaaatatggagttcaagcgtggatccggagaatacctctcactggcgtttaagcatcatgttagacgatacgtttgcgcttttctgaatagcgagggaggatcattgttagtgggggtcgaagatagcggactggtgcagggaatccgatgtagccaccgcgatgaagacagggctagattgctggtggactccattctacagggatttaaaccccagattttccccgatgcttacactctcactttcattcctgtcattagcacatcggagacatccgtgcccttaaaagttattcgactcacagtacatacccctaaggcgcagagccagccccaattataccagaccgaccagggggaggtttttcttcggcgagatgggagcattcaggggccgctcagcgcctcggctattcaggagtggtgtcgccagagatggctcgtggaattggggaagttggaggagaaaatgaaagcacttatgatggagaaggagcaacttcagcagcagttgcaacagcatggccccgtcagctgcacatgctgtgtgctatag

SEQ ID NO: 50836 - DNA, 1047 bp, Artificial Sequence
  Description of Artificial Sequence: Synthetic coding sequence
atgacccccatgaagcggagcgtgcagacccaggtgagcgagcccttcatggaaagttggggggaagagtcactccctgaactcccagctgaacaaagcctcacggaatattccgatctggaggaagctccatccgcacacactctctatgtaggccacctcaatccacagttcagcgttccagtactggcgtgcctcctgcgagataccctggagaggttggaaatgcccgtagcgcgggaacacatcgaagtagtgcgcaggccaaggaaggcctacgccctcgtccaggttacagtccatagagatacactcgctagtttaccctggcgtctgcagaccgcactcgaggagcacctgatccttaaggagctggccgcaagggggaaagacctgcttctctccgaagcccagggcccattttcacaccgagagcagatcgtcggaaaggatcagctctttcaaggcgccttcttaggctctgagacacgcaatatggagttcaagcggggatccggtgagtacttatcccttgcctttaagcatcacgtgaggcggtatgtctgcgcttttcttaattctgaaggtgggtctttattagtgggagtggaagattccggactggttcaaggaattcggtgtagccatcgagatgaggaccgcgctcggcttcttgtggacagcatcctgcaggggtttaagcctcagatctttcccgacgcttataccctgacattcattcctgtgataagtacaagtgagaccagcgtgcccctgaaggtcattcgcctgaccgtccatacccccaaggcccagagccagcctcaactgtatcagaccgaccaaggggaggtctttctccgccgggatgggtccattcagggtccactgagcgcttccgctattcaagaatggtgcagacagaggtggctcgtggagctcgggaaactcgaagagaagatgaaggctctcatgatggaaaaggagcagctgcagcaacagttacaacagcacggcccagtctcctgcacttgttgtgtgctgtag

SEQ ID NO: 50837 - DNA, 1080 bp, Artificial Sequence
  Description of Artificial Sequence: Synthetic coding sequence
atgacccccatgaagcggagcgtgcagacccaggtgagcgagccctttatggagtcctggggggaggaatcgttgcctgagttgccggcggaacagtcgctgactgaatacagcgatctcgaggaagccccaagcgcacacaccctttacgtgggacacctgaacccccagttcagcgttcctgtgctcgcttgcctgttaagggataccctggagcggctcgaaatgcctgtggcccgtgagcacatcgaggtggttcgacgccctagaaaagcctacgcattggtgcaggtcactgttcaccgggacaccctcgcttctctgccttggcgcctgcagacagcgctcgaggagcatctgattctgaaagagctggcagccagaggcaaagatctattattaagcgaggcccaagggcctttctcccacagggaggaaaaggaagaggaagaggaagatagcggactctcacctggtccgtctcctggttcaggggtccccctgccgacctggcctacccacacccttccggaccgcccccaggcccaacaactgcagtcctgccagggaagaccaagcggggtctgttctgactccgcgatcgtgcatcaacaaatagtgggcaaggaccagttatttcagggcgcatttcttggctccgagacgagaaacatggagttcaaaagggggagtggagagtatctttctcttgcctttaaacatcacgtccgcagatatgtgtgcgctttcctaaattctgagggggggagcttgctggtgggcgtggaggacagcgggctggttcaggggattagatgctcacaccgagacgaggatcgggctcgactgctggtagatagcattctccaggggttcaagccacaaatcttccctgatgcgtacacactgacattcatacccgtgatctcaaccagtgagacctccgtgcccctcaaacgctggctcgtagagctggggaaactagaggagaagatgaaggcactaatgatggaaaaggaacagctgcagcaacagttgcagcagcacgggcccgtgagctgcacatgttgtgtgctctag

SEQ ID NO: 50838 - DNA, 1080 bp, Artificial Sequence
  Description of Artificial Sequence: Synthetic coding sequence
atgacccccatgaagcggagcgtgcagacccaggtgagcgagccctttatggaaagctggggggaagaatccctgccagaacttcccgctgagcaaagtctgacagagtattcggacctggaggaagctccatccgctcacaccttgtacgtcggacacctcaacccgcaattcagtgttcccgtgctggcttgtctgcttagggatacactcgagaggcttgaaatgcccgtggcccgcgagcacattgaagtggtgcgcaggccaaggaaggcgtacgccttggtacaggtgactgtccaccgcgacacactagcctccttaccttggaggctccaaaccgctctggaagagcatcttatcctgaaggagttggccgcgcggggaaaggatctcctgctctcagaagcacaaggccctttttctcatagggaagagaaagaagaggaagaggaagattctgggctgtctcccggaccaagtcccgggagcggtgtgccgctgcccacctggcccacccacactctacccgataggccccaagctcagcagcttcagagttgccagggcaggccgagcggcgtgtgctcggattccgccatcgtgcaccagcagatagtgggtaaggatcaattatttcaaggggccttcctcggttccgagactcgtaacatggaattcaagagaggttccggcgagtacctgtctctggcctttaaacaccacgtccggaggtatgtgtgcgcctttctcaactctgagggaggatccctgctggtgggcgtagaagatagtgggctggtgcagggaatccgatgtagtcatcgagatgaggacagagcccgactgctggtggatagcatattgcaaggattcaagcctcaaatcttcccagatgcttacaccctcacgttcatcccagtcatcagtacctctgaaaccagcgtgcctttgaagaggtggctggttgagctagggaagctagaagaaaaaatgaaagcactcatgatggaaaaggagcagctgcaacagcaactgcaacaacatgggccagtaagctgtacctgttgcgtgctgtag

SEQ ID NO: 50839 - DNA, 1224 bp, Artificial Sequence
  Description of Artificial Sequence: Synthetic coding sequence
atgacccccatgaagcggagcgtgcagacccaggtgagcgagcccttcatggaatcctggggggaagagtctctgcccgagctgcctgcagaacagtccctcacggaatatagcgacctggaggaggctcccagtgcacacacactatatgtaggccacctcaacccccagtttagcgtgcccgttctggcttgtcttttacgcgataccctcgagcggcttgagatgccggtcgcacgagagcatattgaggtggtgcgcagaccccggaaggcttatgccctggtccaggtcacagtacaccgggacactctggcctctttgccttggagactgcaaacggccctagaagaacacctgattttaaaggagctggccgctagggggaaggatctgctcctaagcgaagctcagggcccgttctctcatagagaggaaaaagaggaagaggaagaggatagcgggctgtctccaggcccaagcccgggatccggtgtgccactgccaacgtggccaacccacactctccctgataggccgcaggcacaacagcttcagagttgccagggtcgcccatccggtgtatgctcagattccgcaatcgtacaccagcagatagttggcaaagatcagctgtttcagggcgcattcttaggatctgagacacgtaatatggagttcaagaggggatccggtgagtatctctccctggctttcaaacaccacgtccgccggtacgtgtgtgcgtttctcaactcagagggggggagcctgctggtgggagtggaggactcaggtctggttcaggggatccggtgctcacatcgtgacgaagatagagcccggctgttagtggactctatcctccagggattcaaacctcaaattttccctgatgcttacacactcacgtttatcccagtaatctccacctctgagacctcagttcctctgaaggtgattcggctcactgtgcacaccccaaaggcgcagtcacagccacaactctaccagacagatcaaggggaggtgtttctgcggagagacggaagcattcagggccctctgtcagcctcagcaatacaggagtggtgccggcagagatggctggtcgaactgggcaagcttgaagaaaaaatgaaggccctgatgatggagaaggagcagctgcagcagcaactgcagcagcacgggcccgtgagctgtacatgttgtgtgttatag

SEQ ID NO: 50840 - DNA, 1920 bp, Artificial Sequence
  Description of Artificial Sequence: Synthetic coding sequence
atgagcgccagcggcgtgctgagcttcacccagcagggctgggagcaagtgctcgcaaaagttaaaagggccgttgtttacctggatgccgcgtgcgctgaaagcctgcattggggctgcggctctactagactgctcgaggctgtcggcggccccgactgccatttacgcgaatttgaacccgatgcaattggcgggggggctaaacaacccaaggctgtcttcgttcttagctgcttactaaagggcaggacagtggagatactgcgcgacatcatttgcaggtcccacttccagtactgtgtagttgtaacaaccgtgtctcatgcagtgcacctgactgctaaccatgttccagcggctgcggccgccgagatggaaggtcaacagcctgtgtttgaacagttggaagaaaaactatgtgagtggatgggcaacatgaactacaccgcagaggttttccacgtccccctgctgttggctcccgtggcccctcattttgccctgaccccggctttcgctagccttttcccgctattaccacaggatgttcatctgctgaacagtgcccggccagataagagaaaactgggctctctgggtgacgtggacagcactactctgaccccagagctgcttctgcagattcggtgcctggtgagcggcctgtcttctctgtgcgaacacctgggagtaagagaggagtgcttcgcagttggctctctgtctcaagtgatcgcagccgatctcgccaattatgcaccagccaagaaccggaagaagaccgccgcgggtcgggccagcgttgtctttgttgatcgcaccctggatctcaccggggctgtgggtcaccacggcgacaacttggtggaaaagatcatctccgctctcccccagctcccaggccacaccaacgatgtgatggtgaatatgatcgcacttactgcgctccatacagaggaagaaaactacaatgtggtcgccccaggctgcctttcccagtcctctgataccacagcaaaggccctgtgggaagccctgctgaacacaaaacacaaggaagcagttatggaggtccgacggcacctggtggaagccgcttcgagggagaatctgcccataaagatgtcaatgggccgtgtgacccccggtcaattgatgtcgtacatccagctgtttaaaaataatctcaaagcccttatgaaccactgtggactcctgcagttgggactggccactgctcagacgttaaaacatccgcaaactgctaaatgggacaactttctcgcctttgaacgcctgctgctacagtccatcggcgagtcagcaatgagcgtggttctgaaccagctgcttccaatgatcaagccagtgacccagcggacgaacgaagattacagcccggaggaattgcttatcttgctgatctatatttacagcgtgaccggagagctaactgtggacaaagacctttgtgaggccgaggaaaaagttaagaaggcgctggcccaagtgttttgcgaggaatcgggattatctccccttttacagaagattacggattgggattcttccataaatctgacattccacaagtcaaagatcgctgtcgacgaactgtttacctctctgagggacatcgcaggggctcgaagtctccttaagcaattcaagtccgtctatgttccgggaaaccatacacaccaggtcagtaggcctcaccccagtgattatcccctcttaattctctttgtggtaggtggagttaccgtaagcgaggtgaagatggttaaagacctggtggccagcctgaagccaggcacacaagtcatcgtcctgagcacgagactgctgaaaccactgaacatacccgaactcctctttgcaaccgaccgactccacccagatctggggttttag

SEQ ID NO: 50841 - DNA, 2055 bp, Artificial Sequence
  Description of Artificial Sequence: Synthetic coding sequence
atgagcgccagcggcgtgctgagcttcacccagcagggctgggagcaggttctggcaaaggtaaaacgggctgtggtgtacctagatgccgcctgcgctgagtccctgcactggggatgtggcagcacccggctattggaggctgtgggggggcccgattgccatctgcgagagtttgaacccgatgctattggaggaggcgctaaacagccaaaggccgtgttcgtgctatcttgtttactgaaaggtcgcacggtggagatcctgagagacattatttgccgcagccattttcagtactgtgtggttgtaaccaccgtgtcccacgctgtccacttgaccgcaaatcatgtgccggccgcagccgccgccgaaatggaggggcagcagcccgtgtttgagcaactggaagagaaactgtgcgagtggatgggcaacatgaactacaccgctgaggtgtttcacgttcctctccttctcgcccccgtggctccgcattttgccctcaccccggcctttgcttcactgttcccccttttgccacaagatgtgcacctactgaatagcgcacgtccggacaagagaaagttagggtctcttggagatgtcgactccacaacccttacacctgagcttctgctccaaatcaggtgtctagtgtctggcttgtctagtttgtgtgagcacctcggggtgagagaggagtgttttgctgtggggtcccttagtcaagtgatcgccgctgacctagccaattacgctccagccaagaaccgtaagaagaccgcagccggccgtgctagtgttgtgtttgtagatcgaacactcgatttaacaggcgcagtcgggcaccatggagataatctcgtggagaaaattatctctgctctacctcaactgcccgggcatacgaatgacgtgatggtcaatatgatcgccctgaccgcccttcacaccgaggaggagaattacaacgtggtcgcgccggggtgtctgagtcaaagttctgacaccaccgcgaaggcactgtgggaagcccttctgaatacaaagcataaagaagcagtgatggaggtcaggcgacacctggtcgaggccgctagcagggagaacttacccatcaagatgtctatgggaagggtcactcctggacaactcatgagttacatccagctgtttaaaaacaacctgaaagcgctcatgaaccattgcgggctactgcagctgggtcttgctacggcccagaccctcaaacacccacagactgccaagtgggacaattttctggctttcgaaaggctgcttttgcagtccatcggcgagtcggctatgtcagtggtgctgaaccagctgttacccatgatcaagcctgtaactcagcgtacaaatgaagattacagtccagaagagctgctgattctgctaatctacatttacagcgtaaccggagaactcaccgtggacaaggacttgtgcgaagcggaggaaaaggtcaagaaagccttggctcaggttttctgcgaggaaagcgggctaagccctctccttcagaagataaccgactgggacagctcaattaaccttactttccacaagtccaagatcgcagtggatgaactctttactagtctgagggacatcgcgggcgccagaagtcttcttaaacagtttaagagcgtgtatgtgccagggaaccacactcatcaggcctcctacaagccacttctgaaacaagtagtggaggaaattttccatcccgagaggccagactcagtcgatattgagcacatgtctagtggattaacagatcttctgaagacagggtttagtatgtttatgaaggtttccaggcctcacccaagcgactatccactcttgatcctcttcgttgtgggcggcgtgaccgtaagcgaggtgaagatggtcaaagacctggtagccagcctgaaaccaggcacacaggtgattgtgctgagtacaaggctgctaaagcctctcaacatcccagaactactgttcgccacagacaggctgcaccccgatttaggattctag

SEQ ID NO: 50842 - DNA, 777 bp, Artificial Sequence
  Description of Artificial Sequence: Synthetic coding sequence
atgcagatcagcggcgccgtggcccccgccccccccagcagcggccttggttttggacctccgaccagtctggcctctgccagcggatcgtttcctaacagcggcttatatggctcatatccacaggggcaggcaccccctctctcccaggctcaaggccacccaggcatccagactcctcaaaggtctgcaccatcccaggccagctccttcaccccacccgctagcggggggccgaggctgccttcgatgacaggcccacttctaccagggcagtcttttggtgggcctagcgtcagccagcctaaccacgtttcaagtccccctcaggccctgcctccagggacgcaaatgacaggacccctgggcccgctgccgccaatgcatagtccacagcagccaggttatcagcctcagcagaatggaagtttcggtccagctcggggacctcagtccaattacggtggcccttacccggctgccccaacatttggctctcaacctggtccgcctcaaccgcttccaccaaaacggcttgatcccgacgccatcccttcacctgcttcaccctatgttgtcgatcatggcgagtcaggacccttgcgctgcaacagatgcaaggcttacatgtgcccctttatgcagtttatcgagggcgggcgaagattccaatgttgtttctgcagctgtataaacgatggacgcgtggggcagaagtcccagcaaagtgcactggcgctgtctcctacaataagatgtagcactagtattatgtag

SEQ ID NO: 50843 - DNA, 1278 bp, Artificial Sequence
  Description of Artificial Sequence: Synthetic coding sequence
atggccagcagcagccccgacagcccctgcagctgcgactgcttcgtgagcgtgccccccgcctcagccatccctgccgtcattttcgctaagaactcagaccgaccccgagatgaagtgcaggaagtcgttttcgttcccgcaggaacgcataccccaggctcgagattgcaatgtacatacattgaagtcgagcaggtgtcaaagacccatgcagtgatcctgtcacgcccatcctggctctggggagcggaaatgggtgcgaacgagcatggagtatgcattgggaacgaagctgtgtggacaaaagagccagtgggcgagggagaagccctgctgggaatggatcttctgagacttgctttagaacgctcctcatccgcacaagaggccttgcatgtcatcactggtctccttgaacactacggccagggaggcaattgccttgaggacgccgccccattctcatatcactccacctttcttctggctgaccgcacagaagcatgggtgctggaaactgccggcagactctgggctgcacagcggatacaggagggagctcgcaacatcagcaaccagctctctatcggaaccgatatctccgctcagcatccagaactccgcacacacgctcaagccaaaggatggtgggatgggcagggagcttttgatttcgcccagatcttcagtctgacccagcagccagtccgaatggaggcagcgaaggctagatttcaggcaggccgagagctactgcggcagagacaaggggggatcacggcggaggtgatgatgggcatactgagggataaggaaagtggcatatgcatggatagcggaggctttcgtactacagcctccatggtgtctgtgctgccgcaggatcctacccaaccgtgtgtgcactttctgacggccactcccgacccatctagaagtgtcttcaagcctttcatcttcggcatgggcgtggcccaagctcctcaggtcttaagcccaactttcggcgctcaagatcccgtacgcacattacctagatttcagacacaggtcgataggcgacacaccctatacaggggacaccaggccgcgctgggattgatggagagggatcaggaccgcggccaacagctgcaacagaagcagcaggatttggaacaggaaggacttgaagccacacagggtttgctagcgggagagtgggctccgcccctgtgggaactgggctctctgtttcaagctttcgtcaaaagggaatctcaggcctatgcctag

SEQ ID NO: 50844 - DNA, 1137 bp, Artificial Sequence
  Description of Artificial Sequence: Synthetic coding sequence
atggccagcagcagccccgacagcccctgcagctgcgactgcttcgtatcagtccctcctgcctccgcaattccggccgtgattttcgccaagaacagcgatcggccaagagacgaggtgcaggaggtcgtctttgtgccagctggcactcatacccccggtagtcgactgcaatgtacttacatcgaggtcgaacaggtgtcaaaaacgcatgcagtcatcctctctcggccctcatggctgtggggagccgaaatgggagccaatgagcatggcgtgtgcataggcaatgaagccgtgtggacaaaggaacccgtgggggaaggcgaggcactgctcgggatggaccttctccgtcttgcgttggaacgcagttcctccgcacaggaagccctgcatgttattaccggcttgctcgagcattacggtcaggggggtaactgtctcgaagacgccgcccctttttcctatcatagtactttcctgcttgccgatcggactgaagcttgggtgctggagacggcgggtaggctgtgggctgctcaaagaattcaggagggcgcgaggaacatttctaatcagctctctataggaacagacatctcggcgcagcatcctgaacttcggacacatgcccaagccaaggggtggtgggacggacaaggcgcctttgactttgcgcagatttttagcctgacccagcagccagtgagaatggaggccgctaaggctcggttccaggccgggcgagagcttctccgtcagaggcaaggagggatcacagcagaggtcatgatgggcatcctgcgcgacaaggagtctggcatctgtatggacagcggaggcttccgcacaacggcttccatggtatctgtgcttccccaggaccccacacaaccctgtgtccacttcctcactgccacaccagacccctcgaggtctgtatttaaaccttttatattcggcatgggggttgctcaagctccacaagtcctgagcccaacattcggagcccaagatccagtgagaacacttccaaggttccaaacccaggtggatagacgccataccctgtaccgcggccaccaggctgcattaggactcatggaaagagatcaagtgtccccccgggagtag

SEQ ID NO: 50845 - DNA, 1275 bp, Artificial Sequence
  Description of Artificial Sequence: Synthetic coding sequence
atggagcccttcagctgcgacaccttcgtggccctgccccccgccaccgtggataaccgaattattttcggcaagaattcggataggttgtatgacgaggtgcaggaggtagtttacttcccggccgtggtacatgacaacctcggtgagcgtttaaagtgcacctatattgagattgatcaggtcccagaaacttatgcagtggttcttagcagacccgcctggctatggggcgcagagatgggcgcaaatgagcatggggtctgcataggtaatgaggctgtctgggggagagaggaggtgtgcgacgaggaagccctgttgggcatggacttggtgcgcttagggttagagcgggctgacaccgccgagaaagcgcttaatgtgatcgttgatttactcgagaaatatggccagggtggtaactgcacagaaggacgcatggtgttctcttatcataatagtttcctaatcgccgatcgaaacgaggcttggatcctcgagaccgctggtaaatactgggctgctgagaaagtgcaagagggtgtgcgcaacatcagcaatcagctgtccattacaactaaaatagcgagggagcaccctgacatgcgtaattatgccaagaggaaggggtggtgggacggcaagaaggaattcgattttgctgccgcctattcttatttggacacggccaagatgatgacttcatctggcagatattgtgaagggtacaagctcctgaataagcacaaaggcaacattacctttgagaccatgatggagatcttacgggataaaccgagcgggataaacatggagggagaatttttaaccacagcatccatggtttcgattctcccccaagatagctctcttccatgcatccacttcttcaccggtactccagaccccgagcgcagtgtgtttaagccttttatctttgtccctcacattagccaacttcttgatacaagttcccccacattcgagcttgaagacctggtgaaaaaaaagtctcatttcaaacccgaccgcagacaccctctttaccaaaagcaccagcaggccctcgaggtagtgaacaacaacgaagagaaagcgaaaataatgctggataatatgagaaagctcgaaaaggaactattccgggagatggaatccatccttcagaacaagcaccttgatgtggagaagatcgtgaacctgtttccccagtgtacgaaagacgaaatccagatctaccaaagcaacttgtcggtgaaggtgtccagttag

SEQ ID NO: 50846 - DNA, 342 bp, Artificial Sequence
  Description of Artificial Sequence: Synthetic coding sequence
atggagcccttcagctgcgacaccttcgtggccctgccccccgccaccgtcgataatcgcattatctttggtaagaattcagatcggctgtacgacgaggttcaggaggtagtgtacttcccagctgtggttcatgacaacttaggcgagcgtctgaaatgtacgtacatcgagatagaccaagtgccagagacatacgccgttgtactgtcaagacccgcctggttatggggggccgagatgggagccaatgaacatggggtttgcatcgggaacgaagcagtttggggacgggaggaggtgtgtgacgaagaagctctgttaggaatggatttagtctag

SEQ ID NO: 50847 - DNA, 408 bp, Artificial Sequence
  Description of Artificial Sequence: Synthetic coding sequence
atggagcccttcagctgcgacaccttcgtggccctgccccccgccacagttgacaataggatcatcttcggtaaaaattcggaccgcttatacgacgaggtgcaggaagtcgtgtactttccggccgttgtgcacgacaatctgggggagagattaaagtgtacctacattgagattgatcaggtgcccgaaacatatgctgtggttttgagtaggcccgcctggctttggggggccgagatgggagccaatgaacacggggtgtgcatcgggaatgaggccgtgtggggcagagaggaagtgtgcgacgaagaggcgcttctcgggatggatctggtacggctcggtctcgagcgggctgacacagctgagaaggctttaaacgtgatcgttgatctgctcgaatag

SEQ ID NO: 50848 - DNA, 33 bp, Artificial Sequence; identical to SEQ ID NO: 24550
  Description of Artificial Sequence: Synthetic coding sequence

SEQ ID NO: 50849 - DNA, 651 bp, Artificial Sequence
  Description of Artificial Sequence: Synthetic coding sequence
atggagcccttcagctgcgacaccttcgtggccctgccccccgccacagtggacaatagaatcatatttggcaagaactcagaccgtctatatgacgaagttcaggaagttgtctatttccccgcagtggttcatgacaacctcggggagagactcaagtgcacctacattgagatcgaccaagtgcctgaaacatacgcggtcgtcctgagccggccagcgtggttatggggggccgagatgggggcgaatgagcacggcgtctgtattggtaacgaggcagtttgggggcgggaagaagtgtgtgacgaggaggctctactggggatggacctcgtgcgtcttggactggagcgggcggatacggcggagaaggcacttaatgtgatcgtcgacttgctagagaagtatggccagggagggaactgcaccgaaggccgcatggtgttcagttaccataatagttttttaatagcggaccgtaatgaggcttggatcctggagacagctgggaagtattgggctgcagagaaggtgcaggaaggcgtgaggaacatcagcaaccagctgtccatcacaaccaagatcgcacgcgaacatccagacatgagaaattatgctaagaggaagggctggtgggacggtaaatag

SEQ ID NO: 50850 - DNA, 630 bp, Artificial Sequence
  Description of Artificial Sequence: Synthetic coding sequence
atggagcccttcagctgcgacaccttcgtggccctgccccccgccacagtggacaaccgtatcatttttggcaaaaactctgatcgcctgtacgatgaggttcaggaggtggtgtattttcccgccgtggttcatgacaatttgggagagcggctgaagtgtacgtacatcgaaatagatcaggtgcccgaaacgtacgccgtagtgctgagcaggccagcctggctctggggagcagagatgggagcgaacgaacacggagtatgcatcggcaatgaggcagtctggggcagggaagaggtgtgtgacgaagaggcactgctgggcatggacctcgttaggctcgggctcgagcgagctgacacagcggaaaaggcactcaatgttattgtcgacctgctcgaaaagtatggacagggggggaattgcactgaaggacgtatggtgttctcatatcacaattcctttctgattgccgacaggaacgaggcttggatattggagacagcgggtaaatactgggcagccgaaaaagtgcaagagggagttagaaacatctcaaaccaactgagtattactaccaagatagcgcgggaacatcccgatatgcgcaactacgcaaaacggtag

SEQ ID NO: 50851 - DNA, 1254 bp, Artificial Sequence
  Description of Artificial Sequence: Synthetic coding sequence
atgccccccctggccaccccccccagcgtgcacctgagcctgcgggtggcggggcgacctgatcggctctacgacgaggttcaggaagtggtctattttcccgctgttgtccatgataatttgggggaaagactgaagtgtacatatattgagatcgaccaggtgcccgaaacctacgctgtagtgttgagccggcccgcttggttgtggggcgcagagatgggcgctaacgagcacggggtgtgcatcggaaatgaggcggtgtggggtcgcgaagaggtgtgcgacgaagaagctctcctgggcatggaccttgtgagacttggtttggaaagggccgataccgctgagaaagcccttaacgtcatagtggacttgctagaaaagtatggtcaagggggcaattgcacagaaggaagaatggtcttcagctaccataatagcttccttattgcagaccggaatgaggcttggatcctggagaccgctggcaaatattgggcagcagagaaagtgcaggagggggtccggaatattagtaaccagctgagcatcaccaccaaaattgcgcgggagcatccggatatgagaaattatgcgaaacgaaagggctggtgggacggcaaaaaggaattcgactttgcggcagcctatagctacttagataccgccaaaatgatgacaagtagtggacgatattgtgaaggatataagctgttaaacaaacataaagggaacatcacatttgagacgatgatggagatattgcgagataaacccagtggaataaatatggaaggcgagtttctcaccacggctagtatggtatcgatcctgccccaagattccagcctgccttgcatccatttctttacagggacacctgacccagaacgtagcgtcttcaagccctttatcttcgtcccgcatatatcacagttgctcgacaccagtagtcctacatttgagttagaagatttagtgaagaagaagtcccactttaagccagataggaggcatccactatatcagaagcaccagcaggcactcgaagtcgtgaacaataatgaagagaaggcaaagattatgctcgacaacatgaggaaactggaaaaggagctattccgggagatggaatcaattttacagaataagcacctagatgtcgagaaaatcgtgaacttattcccacagtgcactaaggacgagatccaaatctaccagtctaacctatctgtcaaagtttcctcgtag

SEQ ID NO: 50852 - DNA, 3171 bp, Artificial Sequence
  Description of Artificial Sequence: Synthetic coding sequence
atggaccgggcccccaccgagcagaacgtgaagctgagcgccgaggtggagccgtttattccacagaagaaaagccccgacacctttatgatcccgatggcactgcctaatgataacggaagtgtctccggggtcgagcccacgcccattccgagctatctcatcacctgctacccttttgtgcaggagaatcaaagcaaccgtcaatttccgctttacaataacgacatccgctggcagcaacctaacccaaatccaactggcccttattttgcctatcccatcatctccgcccagccgcccgtctccaccgaatacacatactaccagctgatgccagctccctgtgcacaggtcatgggattctaccacccgtttcccacgccctactccaacactttccaggcagccaatactgttaacgccattaccaccgagtgcacagagcggccctctcagctgggccaggtgtttcccctctccagccatcgcagcaggaattccaaccgcgggtccgtagtacctaagcagcagttactgcagcagcacattaagagtaaacgacctcttgtgaagaacgtggctacacagaaggaaaccaacgcggccggccctgatagtcggtcaaaaattgtgttgcttgtggatgcttctcagcaaaccgactttccctccgatattgcaaacaagtccctgtctgaaaccactgctacaatgttatggaagagcaaaggaaggaggcgtcgcgcatctcaccctaccgcagaaagcagctccgagcaaggcgccagcgaggcggatatagactccgatagcgggtattgttcaccaaaacattccaacaaccagcccgctgccggggccctacggaatcccgattcaggtactatgaatcacgtggagtcctccatgtgcgctggcggggtgaattggtccaacgtgacgtgtcaggccacacagaaaaaaccatggatggagaaaaaccagactttctcccgagggggtaggcagaccgaacagcggaacaattctcaggacgaagatggttttcaggaattgaatgagaatggaaatgctaaagacgagaatatccaacagaaactctcttcaaaggtgttggatgatttgccagagaatagtccaattaacatcgtgcagacacccattcccatcacaacatccgtacccaaacgcgccaagtcacagaaaaagaaggccctggccgccgccttagcaactgcacaggaatacagcgaaatcagtatggagcagaagaagctacaggaggccctatccaaggcggccgggaagaaaaataaaacaccagtccagctggacctcggggatatgttggctgcgctggagaaacagcaacaggctatgaaggcccgtcagatcacaaacactcggccccttagctatacagttgtcactgcagccagttttcacacaaaggacagtacaaatagaaaacctctgacgaaatctcagccctgtctgacttcgttcaattcggtggacattgcaagtagcaaggcaaagaagggaaaagaaaaagagattgcaaaactaaaaaggcctacggccctgaaaaaagtgatcctcaaagaaagggaagagaaaaaaggccggctcaccgtggaccacaatctgttggggtccgaggaacctacagagatgcacctcgatttcattgatgatctgccccaggaaatcgtttcccaagaagacaccggcctgtccatgccgtccgatacctccctgtcacctgccagccagaatagcccgtactgcatgacacccgtgagccagggctcccctgcttcctctgggatcgggtcaccaatggcctcttccacaattacgaagattcacagcaaaaggttccgcgagtactgtaaccaagtgctgtgtaaggagattgacgagtgcgtcacccttctgctgcaggagttagtgtcctttcaggagcgaatctatcagaaagaccctgtgagggccaaggcacgtaggagacttgtcatggggctgcgggaagtcactaagcacatgaagcttaacaaaattaaatgtgtgatcatctcccctaattgcgagaagatccaaagcaaaggcggcttggacgaagccctatataatgtgattgcaatggccagagaacaggaaatccctttcgttttcgcactggggagaaaggcacttggcagatgcgtcaacaaactcgtgccggtgtcagtggtgggaatattcaactatttcggcgccgagagcctcttcaataaattagtagaacttactgaggaagcccgcaaagcttacaaagacatggtcgctgctatggaacaagagcaagcggaagaggccctcaaaaacgtgaagaaggtgccccaccacatgggacattcacgtaacccttccgcggcttctgcaatatccttttgcagtgtgatttctgaacctatcagcgaggttaatgagaaagagtatgaaaccaactggcggaacatggtggaaacctccgatggacttgaggcctcagagaacgagaaggaggtctcttgcaagcattcaaccagtgaaaaaccgagtaagttaccctttgacacaccgcctataggcaaacagcctagcctggtcgcgaccggatccactacatcggccactagtgctggaaaatcgacggcgagcgataaagaagaggtgaaaccggacgacctcgaatgggcgagccagcaaagtaccgagaccggatccttggatggcagttgcagagacctgttgaatagctctattacatccacaaccagcactctggtgcccggaatgttagaggaagaagaggatgaggatgaggaagaggaggaagactatacccacgagcctatcagcgtggaagtccagctcaatagcaggatcgaatcctgggtttccgagactcagagaaccatggaaactctccaactggggaaaacgcttaacggctctgaggaagacaatgtagagcaaagcggggaggaggaggccgaagccccggaagtcctcgaaccagggatggatagcgaagcatggacggccgaccaacaggccagccctggacagcaaaagtcctcgaactgcagcagtctgaataaggagcattcagactccaactacaccacccagactacctag

SEQ ID NO: 50853 - DNA, 3306 bp, Artificial Sequence
  Description of Artificial Sequence: Synthetic coding sequence
atggaccgggcccccaccgagcagaacgtgaagctgagcgccgaggtggagcctttcatcccccaaaaaaaaagtccagatacctttatgattcctatggcactccctaatgataatggctctgtctcaggggtcgagccaacgccaatcccatcatatttgattacctgttatccgttcgtccaggagaatcagagtaacagacagttccccctttataataatgacattcgatggcagcagcctaaccctaaccctacaggaccgtatttcgcttacccgatcatcagcgcacaaccgcccgtgtctaccgagtatacttactatcaactcatgcctgccccatgtgctcaggtcatgggtttttatcatccctttccaacgccgtattctaacaccttccaggccgccaacaccgttaacgcaatcaccacggagtgcaccgagaggccttctcagctgggccaggtgtttcccctgtcatcccaccgatcaaggaatagcaatagagggtccgttgtccccaagcaacaactgttgcagcagcacatcaaaagtaagcgcccgcttgttaaaaacgtggcaacacagaaggaaacaaacgctgccgggccggactcaaggtccaaaattgttctgttggttgacgcttctcagcagaccgactttcccagcgatatcgctaacaagtcactgagtgagacaacagccactatgctctggaagtcaaaggggcgaagacgaagagccagtcaccctaccgccgagtcttctagcgaacagggcgcttccgaagctgatattgatagcgactctggctactgttcacccaagcacagcaataaccaacccgccgctggagctctgagaaatcccgatagtgggacgatgaaccatgttgagtcctcgatgtgtgctggaggcgtgaattggagtaatgtgacctgtcaggcaacccagaaaaagccctggatggaaaagaaccagactttttcccgcggcggccgccagacagagcagaggaataacagccaagtgggctttcgctgtcgaggccactccaccagttccgaacgcaggcaaaatttgcagaaaaggccagacaataagcatttaagtagttcacagagtcatcgcagtgacccaaactcagagtcactgtacttcgaggacgaggacggatttcaggagctgaacgaaaatgggaacgccaaagatgaaaacatccagcagaagctgagttccaaagtgcttgacgacctcccggaaaatagtcccattaatatcgtgcaaacacctattccgattaccacctcggttcctaaaagagccaagtctcaaaagaagaaagccctcgccgcagccctggccaccgcacaggagtattctgagatttcgatggagcagaagaaactgcaggaggcattgagcaaggctgcaggcaaaaagaacaagacccctgtgcaacttgatctcggggacatgctggccgctctcgagaaacagcagcaggctatgaaggcacgacagatcactaacacacggcccctgtcatatactgtagtcacggccgcaagctttcacacaaaggactcaactaacaggaaacccctaacaaagtctcaaccctgtctcacttccttcaacagcgttgatatcgcatctagcaaagcgaagaaaggcaaagagaaggaaatcgctaaattaaaaaggcctaccgctcttaagaaagtgattctaaaggaacgagaggagaagaaaggcaggttgaccgttgatcataatctgcttggcagcgaagaaccaaccgagatgcacctcgattttatcgacgatctacctcaggagatcgtgtcccaggaggatacaggcctgtctatgcctagcgacacttctctgagtccggcctcccagaatagcccctactgcatgaccccagtttcacaaggctctccagcaagctcagggatcggctcccctatggcctcttcgacaattaccaagattcactcaaaaagattccgggagtactgcaaccaagttttgtgtaaggaaatcgacgaatgtgttactctgctattgcaagaattggtgagttttcaggagaggatctatcagaaagatccggtccgggccaaagctcggcggcgactggtcatgggattgagagaagtcacaaaacacatgaaattaaataagattaaatgcgttattattagccctaactgcgaaaagatccagtccaaaggcggactggatgaggcgctatataacgtgatagcaatggcccgggagcaggaaattccgtttgtatttgcacttggccgaaaagctttgggtcgctgcgtaaacaagctggtacccgtctctgttgtgggaatctttaattacttcggcgccgaatccctgtttaataagctcgtggagttaacggaggaggcaagaaaggcttacaaggatatggtcgctgctatggagcaagagcaggcagaagaggccctgaaaaatgttaagaaggtaccccatcatatgggccatagtcgaaatccatcggcagctagcgcaatatccttttgctctgtgatctcggaaccgattagcgaagtgaatgaaaaagagtacgagacgaattggcgaaatatggtggaaacaagcgatgggctcgaagcatcagaaaatgagaaggaagtgagttgcaagcattcaacttcagaaaagccgtccaagctgccatttgatacccctcctatcggcaagcagccttcgctggtggcaactggatcaaccacgtctgcaacgtccgccggtaaatctacagcatctgataaggaagaggtgaaaccagatgacctcgagtgggcaagtcaacagtccacagagacaggttcactcgacggatcatgccgggatctcctaaacagcagcataaccagcaccacctccacactcgtgcccggaatgttagaggaggaggaagatgaggacgaggaagaagaagaggattatacacacgaacccataagtgtggaggtgcagctgaactcacgcatcgaatcctgggtgtccgaaacacaacggactatggaaacactacagctgggtaaaaccttgaatggctcagaagaggacaatgtggagcaaagtggagaggaagaggcagaagcccccgaggtgctggaacccggcatggatagcgaagcgtggacggcagaccagcaggcttcaccggggcaacagaagagcagtaactgcagctcactgaacaaagagcattccgatagcaattacactacacaaacgacctag

SEQ ID NO: 50854 - DNA, 288 bp, Artificial Sequence
  Description of Artificial Sequence: Synthetic coding sequence
atgaagggcagccgggccctgctgctggtggccctgaccctgttctgcatatgccgtatggctacgggggaggataatgacgagttctttatggattttctgcaaaccctgctggtaggcacccccgaggagttatacgaaggtactctgggtaagtataacgtcaacgaggatgcaaaagctgctatgaccgaattgaagagttgcagggacggcctgcagccaatgcacaaggcagaactggttaagttattggtccaggtgctgggaagccaggatggtgcatag

SEQ ID NO: 50855 - DNA, 543 bp, Artificial Sequence
  Description of Artificial Sequence: Synthetic coding sequence
atggccagcgagcggcccgagcccgaggtggaggaggccggccaggtattcctactgatgaaaaaggattacagaatatcacgaaatgtgcggctggcttggttcctatctcatcttcatcagaccgtccaggccacaccacaggaaatgctcctgcagtccgagcaggaacttgaggttctcagcgtgttgcctcctggctggcaacccgacgagcccgtggtccctagaccgttcctgctcgttccctcaactagagtcactttcctggcctggcagtacaggtttgtgatcgagctggacctgtccccatccactggtattgttgatgatagcactggggaaattctgttcgatgaagtattccatgcgttgagtcggtgcctaggcggactgctgcggccgtttcgcgtgcctgggtcctgcatagattttcagccagagatttatgtgaccatacaggcgtattcatcaataataggcttacaaagccatcagaggcagggctttaccatgctggccagactgccgagcaacttctag

SEQ ID NO: 50856 - DNA, 507 bp, Artificial Sequence
  Description of Artificial Sequence: Synthetic coding sequence
atggccagcgagcggcccgagcccgaggtggaggaggccggccaggtattcctgctgatgaagaaggattatcggatctcgcggaacgtgaggctggcctggtttctcagccaccttcatcagaccgtccaggcgacgccacaagagatgttgctgcagagcgagcaggaactggaagtcctgtcggttctcccacccggctggcaacctgacgagcctgttgtgccccgtccctttctattagtcccttccaccagggtgacgttcttagcatggcagtacagatttgtgattgagttggatttatccccatctaccggtattgtagacgatagtactggagagatactatttgatgaagttttccacgcactgagtaggtgtctcggaggcctgttgaggccgttccgggtacccgggtcatgcattgattttcagccagagatttacgtcaccatccaggcatactcctctatcatagggctgcaaagtcatcagatgatctag

SEQ ID NO: 50857 - DNA, 7602 bp, Artificial Sequence
  Description of Artificial Sequence: Synthetic coding sequence
atggtgctggagctgcccatccagaacgagccccccggccaggccgcagccgaagagaagcacacatgcgtggtccagtacatcctgtttccaccccactccacatccactaaggattcctttagcacagacgatgacaacgatgttgaagtggaggccctggaaggagatagcgagctaaacctcgtaaccgaagtgtgggttgagcctcagtacggtagggtgggacctggacctgggatctggaagcatcttcaggatctgacatactccgagatacctcaggccctgcaccctcgtgatgcggcctgcatcgggtctatgttaagctttgaatacttgattcagctgtgtcagagtaaggagtggggcccgctgccccctgaaccccgagtgtccgatggactcgaccagggcggtgacacatgcgtccacgagataccatttcactttgacctgatggggctgttaccccagtgccagcaactgcagatgttttttctcctgctggcccggggtgccgaagggccgttgctgggagtccacggcatcccaaaagagcaagcggtcgggagcactcaggccacaggtgattcagcgtttaccagcctatcggtgggactgcccgagactttgaaaccccttatttctgcccagcctccacagtggcgctgttatgctcgccttgtcaatccccaacatgtcttcctgactttcctgccagcaaccttttccgacgtgcagagactggccgcctgcggactggaaggccctcctcaggaagagaccaaaccaaagtttggtgactggtccggtgccccaagcttaaaagatctgggtggcaccggcatcaaagcgacgaagtctcacgtgcccgtgcttagcgttaccctggcatccgataatgctcagaaccagggggaactaagtcctcctttcaggcgagacctgcaggcatatgcagggagacaggcatctcagacagaatcagctgatggtccgcgtacacgctgcccagtttacatctactcatgcagcctggaagcacttagagagcagatggtgggcatgcagccaccacaagcgcctcgcgacctgatcttccggacccagtttctagatcatccctctccatcgagtgcgtggatggaaccccgttataaggaagcagccaaccactgcgctttactgcaggagcatgctcagcggtgttacgtacgcgggcttttcagatctctgcaacaggcgcagtctgtaacatcccaggatctactgacagccgtggacgcatgtgaggaacttcttcaagagatcgacattacacccttcctcctcgccctctgtggccacacctggggtttgccgcacgccccgccctcccccggcccattgtccccaggaccattttcctccagcatggaggagggtgctgaaccacgtgaaagagccattctcgccagcgagagtagcattgaaaccgaagatctgtctgaacctgagtttcagtctaccagggtcccgggaatccccgatccgggaccagaaatctccctgacagatgtatgccagctccgaggtgaagcccacggcgccctccattcagttattcaggagaagttcctcgagatctcccggctgcattttcgcaccgtgcccagcaacccccattacttcttttattgcccacctagctcccggagagaagatgaggggcctagagataccgtggatcggaagataagcgacctcgagttttctgaggcagaactgatgggcgaggagggtgatacgtcggcttgctgtgtggtgacagaatccgatccagaattggaggtggaatacagggaatctcgtgagagcgatctcggtccagccggcctcgactctgccagcctgagcgacgtcgatacagtcaaccccgatgaagattccttttctatccttggcggggattcacccacgggaccagagagttttctgcacgacctgcctcccctcttcctgcaccttacatgttctgtacggctgaggggacagcattcctctgtgccagtgtgctcactccccacttgtctcggacaggtgctttctagcctagaaggtccaccagtaggagggcgggttcccctaagggatttatcggtaaccctcgatgtcttcatgctcactctgccactggaagtggagttacccacagcatctgatccacaacatcatcggtctacttcagaatcttccgcatcattcccccgctcacccggacaaccttccagcctccggtccgacgacggcttgggccctcccctgcctcctcccgaggaagagcgccatccaggactaagcaatctggccaccccacaccggctggccattgagactactatgaatgaaatcaggtggctcctcgaggacgagatggtcggtgcactccggcgcggcggaatcccccaaagtccagccctacatagagccgctgcccatatccacagctcccccggaagatctacatgtttgcgacaaacgctcccactgtctttcgtctttggtcctgaacgcagcctgacacagtttaaggaggagttccgtcgcttgcacctgcctgggcatgtcctgctcgaagaccctgactctgggttttttttcgttgccgcaggacagcagcccggcggcagccacggagaaccctccagcgccgcatgggcatggcactcccatgaggatcgcgccgagggcattgagggcgaaactctcacggccagtcctcaggcacctggatcacctgaagactccgaaggcgtgcccctcatcagcctgcctcgtgtgccacagggcggcagccaacctggcccctcccgaggcctttctcttatgagctctcaagggagtgtggatagcgatcacttgggctatgatggcggatcttctggttctgactctgaaggcccgaacgacactctgggtgaaaaagcccctttcactctccggacaccgccgggacccgcacccccccagccctcactttctgggcttcccggaccttgcttgccagacttttggctcattgtgagggttctgcaggatagggtggaggtctacgcccacgctcggagtctcattagggaagacggaggccctggcacggagtgccgtcacctgcagcagttgctggttcggagagtcggagaaatctgtcgggaagtaaaccagaggctcctgctgcaggacctccacgactcccacgtctgcaattcgctgctggtcgccgagagcgaagaggatctgtggcgcagtgaaactccttttcatagccggcaacgcgccccattgccctctgatgattatgcagccgacgaatcctgcgctccacggggatacctggccgcaaccatgcagtttgttcctggccatttcagttgtgatgttgtatggggaaccgtaattagggtacattccagactgaaaatgggaccctcaatgggcgtgagcagagcaatccaggctcttcgctcggtattgaacgcattcagcgtggtgaatcgcaagaacatgtttgtgtatcaggagcgggcgactaaagccgtatactatttgcgtcttctggaaacctcttgtagcgaccggccatggaaaggggacgctctgccaccttcccttgcactgtccagatctcaagaaccaatctatagcgaagaagcatcagggccaagaagccctctggacatggtcagctcacgctcttccgatgcagcaagacccgttggacaggtggataggcatatccagttacttgttcacggcgtaggccaagcgggtccggagatcactgacgagctcgtacgcgtgctttgtagacgcctggatgaggcgaccctagacgtgatcaccgtgatgctggttcgcaactgcaagttgaccccagccgatgtcgagttcattcagcctcccggaagccttcccagtgaggttctgcacctcgccctgccaacctcttgcagaccctggctgcccgccctcgcatggtacctgcgacagaatctgctcatatttctgcacagcccaaagtacaccgattccaactcacgaaaccactttcagcatcctctcccgcctcagggtgggctgcccgacctcgacatatacctctacaataagcccgggggccagggaacaggaggtaaaggcgtggcctgcatcacattggccttcgtggacgaggggggggctccgctgtcattggctctgtggcctcccagttctcctgggccacccgatcccctccgcgaggaggagttcgagcagcttacccaagtgattcgctgccctgtagtggttgactccagcagtgctcagaacggcgccccacgattacgtctcgacgtctgggagaagggcaatatctccatagtgcagctggaagaaaagttgcgcggtgctgcgagacaggccctggcagatgccatcatcgaactgcaattgctgcctgcaagtttgtgtactgaagacactcccacgggaagcctgcggaacgggtctctggagacgaaatcctccgcaggacgggcgtccaccttccctcccgcaccagtgccaggtgaaccagtcactcccccttctaaggcaggtcggaggtcattctgggacatgctttctaaaactgaatgtggcgatttgggttctcctaaaacaacagatgacatcgtgttggaccgtcctgaggatacaagaggccggcgccggcataagaccgagtccgtcaggacgccaggcggcgccgagcgcgctccaggatccgattccggcgcacagcggcagaaacgacgaactacacagctggaggaaggcgaagtcggcactttgcatcctgtctttgctcgcgtcgcccagcgttggatggaatttatggttcagatcggctgcgctagtgttagtaggtcctccgcacatatggtgtctcgcttcttgttgccaagtattctgagtgagttcacagcccttgtaacaagcatggcaggcgacacgtccgtgaggatattcgagcagcacctcggctctgaaccagagattttcggaccttgtagcccagggcaacttgggccctcccctcggccagcagctgagcgtcatcttctcttgctgggtcggaactttctgcagtggagacgccctacacaacaggctgccaaggccatgcaacgcttcgaaccgggtggtgatggctccagcggcagaaatgcaccgcgccagcgtttacttcttcttgaagtagtcgataagaaactgcagctattgacgtacaattgggctcccgacctcggggccgcactcggccgggctttagtgaggctagtgcagtggcagaacgcacgggctcatcttatcttctgtctgttatcacagaagctgggactgtttcaccattatggtcaactggactttccagtcagggatgagaaggaaccaaatccgtttcttcttcccaccatggaagtggaaactctgattcgctcagcctcgcccccactgagcagggaacagggcaggctgtcgggcagctctagggggggggggccactcccgctggacaccttcccatttgacgaagcattacgcgacatcaccgcagcccgccccagctcggttttaggaccagtaccaaggccccccgacccagttacataccatggtcaacagtttctggaaataaagatggcagagaggcgggaactggagagacaaatgaaaatggagaatcttttcgtaacgtggcagcagagaagcacacctgccaccatgcccatcagcgccggggagttggaaacgctgaaacagtcaagccgcctcgtgcactattgtgccaccgctatgctgtttgaccccgctgcttggttgcatgggccccctgagactagtgggccccccgacggtcagcgcaggcaccgccccgaatcaggaagcggctcccgcgaagcccctacctcctgtgagtccctcgacgtatctccaccgggagcccgtgaggaaccctggttaaaggagctgtccctcgcctttctgcagcaatacgtgcagtatctgcagagcatcgggtttgtacttgtaccactcaggcccccgagcccagctcgaagcacatcccggcctcgcgccatggcaattctgggcacggagggaagaggctccttttcatgtccaaagactaagactgacggatccccaaaatcgacctcttctccggtgacaacatatcacttacagagggccctgccaggcggtatcattctgatggaactggcttttcagggttgctatttctgcgttaagcagttcgctctggagtgctcacgcattcctatgggacaggcagtcaacagccagctcagtatgttgtttacggaagaatgcgacaaagttcgggacctgatgcatgtgcatagtttttcctatgatttccatttacgcctggtgcaccagcatgtgttgggagctcatctcgtgctgagacacgggtaccacctcacaacttttcttcgtcatttccttgctcatcatccggacggaccccattttggacgaaaccacatataccaggggactctcgaactgccgacacccctgattgccgcccatcagctgtacaactacgtagccgaccatgcctcatcataccacatgaagcctttaaggatggcaagaccaggcggccctgagcacaatgagtacgcactggtgagtgcctggcacagtagcggctcgtatctcgattccgagggccttcgacaccaggatgattttgacgtaagtcttctggtgtgccactgcgcggctcccttcgaagagcagggcgaggcagagcgacacgtgctgcgactgcagttttttgtggtattgacatcccagcgcgagctgttcccacgcttgacggccgacatgcggagattccgaaagcccccgcgcctgcctcccgaaccagaggcacccggctcttccgccggcagccccggcgaggcctcaggcttaattttggcccccggacctgcaccgctctttccgccgctggcagcagaagttggaatggctcgcgcccgactagcccagttggtccgtctggccggtggacactgcaggcgagatacactctggaaaagactgtttttgttagagccccctggacccgatcgcttaaggcttgggggccgtttagccctagctgaacttgaggagctgctggaggccgtccacgcaaagagtatcggcgatatcgaccctcagctggattgctttctgagcatgaccgtgtcctggtaccagagcctgatcaaggtgttgttgtcacgattcccgcaaagctgccggcattttcagtcccctgacctcggaacacagtatcttgtggtgcttaaccagaagttcacggattgctttgtgttggtctttttggactcgcacctgggaaaaacttccctaacagtggtgtttcgcgaaccatttcccgtgcagccccaggactctgaatccccgccagcccagctcgtctctacctaccaccaccttgagtccgtgatcaacaccgcttgttttacactgtggacccgtctgttgtag

SEQ ID NO: 50858 - DNA, 537 bp, Artificial Sequence
  Description of Artificial Sequence: Synthetic coding sequence
atggccagcgagcggcccgagcccgaggtggaggaggccggccaggtttttctcttaatgaagaaggattaccgcatatcaaggaacgtccgattagcttggtttttatcacatctgcaccagaccgtgcaggctactcctcaggaaatgctgagcgagcaggagctggaggtgctgtccgtgttaccgcccgggtggcagcccgacgagcctgtggtgcccaggccgtttctcctcgtaccctcaacaagggtcacctttctagcatggcagtaccgcttcgtaattgaactggacctgtcgcctagcactggaattgtggacgatagtaccggcgagatcctgttcgacgaggtgttccatgccttgtcccgatgcctggggggcctcctcagaccattcagggtgcccggaagctgcatcgattttcaacctgaaatttatgtgaccatccaggcatactcaagtatcattggcctccagagtcaccagcggcagggatttactatgcttgcacgcctgccatccaacttctag

SEQ ID NO: 50859 - DNA, 10128 bp, Artificial Sequence
  Description of Artificial Sequence: Synthetic coding sequence
atggccagcgagcggcccgagcccgaggtggaggaggccggccaggtgttcttgctgatgaagaaagactacagaattagccgcaatgtgaggctggcctggtttctaagccacctacaccaaacagtccaggccacgccacaggagatgctgttgcagagcgaacaggagttagaggtactgtccgtgctgcctccaggttggcagcctgatgaaccagttgtgcccagaccatttttattagtcccaagtacccgggtaacatttctggcatggcagtacagatttgtcattgaactggatttgtctccatcaacaggtattgtggatgactccactggggagatcctgttcgacgaagtgttccatgccctgagtcggtgtctggggggtctgctgagacctttcagagtgccaggatcttgcatcgatttccagcctgagatctatgtgaccatacaggcctactcctcaattattggattgcagtctcatcaagttttggtgcagggttgcttgctggacccttcacagagagaggtttttcttcagcaaatttacgagcaattatgcctgttcgaagataaggtcgcaaccatgcttcagcagcagtatgatccccagtcccaagcagaggatcagagccccgattctggggatctgctgggcaggaaggttggggtctcaatggtgacagccgacctcggactcgttagcatgatacggcaaggtatattggcactgcaactgttgccaagtaatagcagcgccggcatcattgttattaccgatggcgtaacatcggttccagatgttgctgtgtgcgaaactttgttaaatcagctgagaagcggcaccgtggcctgtagtttcgtgcaagtggggggagtgtatagctacgactgttcgtttggccacgttcctaacgtggagctcatgaagtttattgctatggcaacctttggaagctacctgtccacatgccctgaacccgaaccaggaaacctgggcctcaccgtctaccatagagcatttctcctttattcctttctgaggagtggcgaggcgctcaatcctgagtactattgtgggtcccagcaccggcttttcaatgagcacctggtatccgctagctcgaatccggcgctggctttgcgcaggaaaaagcacacagaaaaggaggtccctgcagatctggtgagcactgtgagtgtgcggctgcgtgagggttactccgtgcgggaggtgaccctggcgaaaggaggctcccaattggaggtcaagttggttctgctatggaaacacaatatgcggatcgaatacgtcgctatggctccctggcctctggaacctgagggaccccgggtgacacgtgtcgaggtcacgatggaaggaggatacgatatcctgcatgatgtcagctgtgcccttcgacagccgattcgatctctatatcgcactcatgttatcaggcggttctggaataccctgcagtccattaatcagactgatcagatgctggctcacctacagagcttctcaagtgtgccagagcacttcactttgccagacagcacaaaaagtggcgtccccctattttacatcccaccgggctcaaccaccccagttctgtccctccagccatccggttcagattcttctcacgcccagttcgctgcctattggaaacccgtcttatccatggatgccaatagctggcagcggtggctgcacatgcatcggctcgttctgattctggaacatgacaccccaatccctaaacacctgcacacgcctggatccaatgggaggtatagcaccattcagtgccggatatctcatagctctctaacctctctgctgcgggactggtccagcttcgtactggtagaagggtattcatatgtgaagctcctgagctcggctcccgaccagcccccgaattctttttatatggtgcgaattattagcaaggccccctgcatggtgctgaggctggggttccctataggcacgcctgcgcccgcccgacataagatcgtcagtgggttgagagaagagattctgagacttcggttcccccaccgcgtgcagtcaaaagaacccaccccaaaagtcaagaggaaaggattaggcggcgcgggtggcggttcatcgccatctaagagccctcccgtgcttggccctcagcaggctttgtcagatcgcccatgcctcgtggtgctccataagcccctggacaagctgctgattcgctacgagaagttgcctctggattaccgcgccccatttctgcttacattggagccgccagggccactgcctttagtgagtggacgttccgcttcttccagtctagcctcgctgagcagatatctctatcatcagcggtggctctggagcgttcccagtggcctggctcctgctctgccgctcagcgctatcgcccaactactgagtattttaacagaagtgcggttaagtgaaggcttccacttcgcctgtagcggtgagggcatcataaatatggtccttgagctcccgattcaaaatgagccaccgggacaggcagcagcagaggaaaagcacacttgcgtcgttcaatacatccttttcccccctcactctacttctactaaagactctttcagcacagacgatgacaatgatgtcgaggtggaggctttagagggggatagcgaattaaatttggtcacagaagtatgggtcgaaccgcagtatggccgcgtcgggccgggccctggaatctggaagcatctccaggacctgacctactccgagattcctcaagccctgcatccccgtgacgccgcctgcattggaagcatgctcagtttcgaatacctaatccagctctgccagtcaaaagagtggggcccattaccgcccgagcctagggtgagcgatgggctggatcaggggggagatacttgtgtccacgagattcctttccatttcgacctcatggggctcctgcctcagtgtcaacagctccagatgttcttcctcctgttagccaggggggctgaagggcccttactcggagtgcacggtatacccaaggaacaagccgtcgggtcaacccaggctacaggcgacagcgcctttacttcactgagtgtaggtctgccagagaccctcaagccactaatctccgcacaaccgccgcagtggaggtgttacgcccggctggttaaccctcaacacgtttttctcacatttctgcccgcaacgttctctgacgtgcaaaggttagccgcctgcggcctggagggcccaccacaggaggaaactaaacccaagttcggggattggtcaggcgcgccctcgctgaaggacctcgggggcaccgggatcaaggcaaccaaaagccacgtccctgtactgtccgttactctggcgagtgacaatgcgcagaaccagggggagctatctccgccattcagacgggacctacaggcctatgcaggacgccaggcttcccagacagaatccgccgacggacctcgtacccgttgtcctgtctacatctacagctgctcactggaggccctgcgagaacagatggtaggaatgcagccacctcaggctccccgtgacctgatcttccgcacgcaattcttggatcacccatcaccttcctccgcctggatggaaccacgctacaaagaggctgccaatcattgcgcgctcctgcaggaacacgcccagagatgctatgtgcgaggtctgtttagatccttgcagcaggcgcagtccgttacttcccaggatctactaacagctgtggatgcttgtgaggagctgctgcaagagatcgatatcactccgttcctgctggctctgtgcggccacacgtggggcttgccccacgcacctcccagcccagggccactttcacctgggccgttctcctcttcaatggaggagggagccgaaccacgcgagagggcaatccttgcatcagaatcttcaatagaaacagaggatctgtccgagcccgaattccaaagcacacgggtgcctgggatccctgatcccggtccagagatctccctaaccgacgtgtgtcaactgcgaggagaggctcacggagccctgcatagcgtaatacaggaaaagttcttggaaatctctcgattgcattttaggaccgtgccttccaacccccactattttttctattgccctccctcatcacggcgcgaggacgaaggcccacgcgacacggtagatagaaaaatttcagacctggaattcagtgaagccgaactgatgggcgaggaaggcgacacatccgcatgttgtgtggtgaccgagagcgatcccgaactggaagtggagtatagagaatcacgagagtcagacctgggcccagccggactggattcagcctctctgtctgacgtggatactgttaatcccgacgaggactcattctctatactcggaggggactcacccacggggcccgaatcgttcctgcacgatctgccgcctctgtttctacaccttacatgttcggtgagattgcggggacaacactcaagcgttcctgtgtgttccctgcctacttgtctgggccaggtgttgtccagcttggagggaccgcctgttggaggcagagtgccgttgcgcgacctttctgtcacactggatgtcttcatgcttacactccccctggaggtggagctgcctacggcatcggacccacagcatcatagatccaccagcgagagctccgcaagtttccctcgctcacccgggcagccctcttcgctgaggagtgacgacggcctaggtccgcccctgccaccaccagaagaggagaggcatcctggcctgtccaatcttgctacccctcaccggttagctatcgagactacaatgaacgaaattaggtggttgctggaagacgaaatggtgggtgctttaaggcgcgggggtatccctcaatcaccagctctccatcgggctgccgcccacattcacagctctcctggaaggagcacatgtttgcgccagacccttccactctcttttgtgtttgggcccgaaaggtcccttacccagttcaaagaggagttccgacgcctgcatctacccggacacgtgctcttggaagaccctgattctggcttcttttttgttgccgcaggtcagcagccaggaggaagccacggcgaaccatcaagtgccgcttgggcgtggcactctcacgaggatcgcgccgagggcattgaaggagaaacgctgacggcctctccccaggcaccgggctccccggaggattccgaaggggtgcctctgatctctctgcctcgagttccccagggcggctctcaaccggggcctagcaggggcctgtcactgatgtcatcacagggctccgtcgacagtgatcacctgggatacgacgggggctccagtggctcagacagcgagggccctaacgataccctcggcgagaaggctccatttactctcaggacccccccagggcctgcccctccacaaccttcactcagcggactgcctgggccctgcctgcccgatttctggctgatcgtgcgcgtgctgcaagaccgtgtggaggtctatgctcatgcacgaagcctcatccgcgaagacggaggaccaggaactgaatgccgtcacctgcagcagctgctagtgcggcgcgtgggcgaaatttgtagggaggttaatcagcggctcctgttacaagatcttcacgactcccatgtatgtaattctctgctggtggcagaatccgaggaggacctctggagatcagaaactcccttccattcccgtcaacgggccccattgcctagcgacgactacgctgcggacgaaagctgtgcccccagaggttatctggccgctacgatgcaatttgttcccggccactttagctgcgatgttgtgtggggtacagtgattcgagtccattctcgtctgaagatgggcccctccatgggcgtgtccagggctattcaggccctccgcagtgttctgaacgcgttttctgtagtgaatcggaagaacatgttcgtttaccaagagcgggccacaaaggccgtgtattatcttcgattgcttgaaacctcatgttccgaccggccatggaagggagatgcccttccccccagtttggcactttctcgctcgcaggagcccatttacagcgaggaagccagcggacctaggtcccccctggatatggtaagttctagatcctcagatgcagcacgaccagtcggacaggtcgatcgccacatacagctgttggtccacggagtcggtcaggccggccctgagattacggacgagctggtgagagtgctgtgcaggcgcttagacgaggcaacgcttgatgtaattactgtgatgctggtgaggaactgtaagctgacaccggccgacgtggaattcatacaacctccaggctctctgccgagcgaggtgttgcacctggccttgcccacctcctgtagaccgtggctcccagcactggcctggtacctcagacaaaatctcctgatcttcctgcattctcctaagtacacagatagcaattctcggaatcactttcagcacccgctgcctccacagggcgggctacctgatcttgatatatacctatataataagccaggcgggcaggggactggcgggaagggagtggcatgcatcaccttagcattcgtggatgaggggggagcccccttgagcctggcactctggcctccgtcgtcaccaggaccgccagaccccctcagagaagaggagtttgagcagctcacccaggttatccgttgccccgtggtagtggattcttccagcgcacagaatggcgctcctcggctcagactcgatgtgtgggaaaaggggaatatctctatagtccagctggaagagaaactccgcggcgccgcacgccaggcccttgccgacgctatcattgagctccagttgctccctgcttccctgtgtactgaagacacccccacgggatcactgcgcaacggatccctagagacaaaaagctctgccggcagagcctctacctttcccccagcccctgtgccgggcgaacctgtgacgccaccaagtaaggccgggaggcgcagcttttgggatatgctgagcaagacagaatgcggggacctcgggtctccaaaaacaactgatgatatagtgttggacagacctgaagatacgagaggacggaggcgccacaagaccgaatccgtgcgtactcctgggggtgcagaaagagcacccggcagcgacagcggggcacagcgccaaaaacgtcggacaactcaactggaagagggagaagtgggtactctgcaccccgtgttcgcccgggttgcccaaagatggatggagttcatggtgcaaatcggatgcgcttctgtgagccggagttctgcgcacatggtgtccaggtttctcctgccaagcatactctctgagtttactgccctcgtgacaagcatggctggcgacaccagtgtacgcattttcgagcagcacctggggtccgaacccgaaatctttggtccatgttcaccaggtcagttaggccctagcccccgaccagctgcagagcgacacctactgctgctcggccgtaacttcttgcagtggcgcaggcctacccagcaggccgccaaggctatgcagcgcttcgagcctggaggagacgggagctccggcagaaacgcgccccggcaacgtttgctgctcctcgaggtcgtggataagaaactgcagcttctcacctataactgggcgcccgatttaggtgctgccctgggccgcgcactggtacgactggtgcaatggcagaacgcccgggctcatttaatcttttgtctcctgagccagaagctgggtctgtttcaccattacggacagctggacttcccggttcgagacgaaaaagaacccaatcctttcctgctgccaaccatggaggtagagaccctcatcagatcagcgtctcctcctttgtcgagagaacaaggtcgccttagcggatcctccaggggagggggacctctcccactagacactttcccctttgatgaggcattgcgggatatcactgctgctcgcccaagcagcgttctcggcccagtccctaggccgcccgatcccgtgacatatcacggccagcagttcctcgagattaaaatggctgagagaagggaactcgagcgccaaatgaagatggagaatctgttcgtgacttggcagcaaagaagtaccccggctacaatgcctatctctgccggcgaattggagaccctaaaacagtccagtagactcgtccattattgtgccacagccatgttgttcgaccccgcagcctggttgcacgggccgccagaaactagtggacctcccgacggacagcggagacaccgcccggaaagtggatccggatcccgcgaggccccaacctcttgcgagtctctggacgtgagccctcctggggctagagaggaaccttggctcaaggaactgtcccttgcctttcttcagcagtatgtccaatatctccagtctattggttttgtgcttgtaccgttgcgccccccatctccagcaagatcaacaagtcggcctcgggctatggcaatcctgggaaccgagggccggggcagcttctcctgccccaagactaaaacggatgggtcaccaaagtccacttccagtcctgtgacgacctaccaccttcagagggccctgccaggtggtattattttgatggagctggctttccaggggtgctacttttgtgtaaaacagttcgctcttgaatgcagtagaattcccatgggccaggctgtgaactcccagcttagcatgctctttacagaagaatgtgataaggtccgggaccttatgcacgtgcattcattcagttacgatttccacctaagactggtgcatcaacacgtgctaggtgcccacctcgtgcttcggcatggatatcacctgactacatttctccgccatttccttgcccatcaccctgatggaccccacttcggccgtaatcacatttaccaggggacactggaactgccgacccctctcatcgcagcacaccagctctataattacgtcgccgaccacgcttcgtcttaccatatgaaaccactgcgcatggctagaccgggaggtcccgaacacaacgagtatgccctggtgtccgcttggcacagctccgggtcatacctggattccgaaggtttgcggcatcaagatgatttcgacgtttctctcctcgtctgccactgtgccgccccattcgaggagcagggtgaggctgaacgccacgtgttgcgcctgcaattcttcgtggtgctgacaagccaacgcgagctgtttcctcgcctgaccgccgatatgcggcggtttcggaaaccgccacgcctacccccagaacccgaagccccgggcagcagcgctggatccccaggagaggcatcagggttaatcttggcccccggcccagcgccgctttttccacccctggccgccgaagtgggcatggcaagagctagactggcccagcttgtgcgcctcgccggtggacactgccgccgcgataccctatggaagagactcttcttgctggagccaccaggccctgacagactgaggttaggtggcaggctggccctcgccgagctggaggagttgctggaggcagtgcacgccaagagcatcggtgacatcgaccctcagctcgactgcttcttatctatgactgtttcatggtatcagtctctgatcaaggtgctcctgagccggtttccccagagctgtaggcactttcagagtcctgatttaggcactcagtacctggtggtcctgaatcagaagtttaccgactgtttcgttttggtctttctggattcacacctgggcaaaacatctctcacggtggtattcagggagccatttccagtgcagccccaagattctgagagtcctccggcccaactcgtaagcacctaccatcatctggaaagcgtgattaatacagcctgcttcacactttggacacgcttgttgtag

SEQ ID NO: 50860 - DNA, 696 bp, Artificial Sequence
  Description of Artificial Sequence: Synthetic coding sequence
atggccggcatggtggacttccaggacgaggagcaggtgaagagcttcttggagaacatggaggttgagtgcaattaccattgttaccatgagaaggaccccgacgggtgttataggttggtggactatctggaggggatacggaaaaacttcgatgaggctgccaaagtgctgaagtttaactgtgaagagaaccagcatagtgacagttgctacaagttgggggcctactacgtgaccgggaaaggcggcttgacccaggatctgaaggcagctgcaaggtgcttcctgatggcctgcgaaaagcctgggaagaagagcatagcagcctgccataacgtaggtctcctcgcccatgatggacaagttaatgaggacggtcaacccgatcttgggaaagctcgcgattactacacacgcgcctgcgacggtggatacacgagtagttgcttcaatctcagcgccatgttcctgcagggcgcccccggcttccctaaggacatggacctcgcttgtaaatactccatgaaggcgtgcgaccttggtcacatctgggcatgcgccaatgcctcaagaatgtacaaactcggcgacggagtggataaagacgaagcgaaggctgaagtgctgaaaaaccgggcccagcagctccacaaggaacagcagaaaggcgtgcagccgctgaccttcggatag

SEQ ID NO: 50861 - DNA, 285 bp, Artificial Sequence
  Description of Artificial Sequence: Synthetic coding sequence
  Description of Combined DNA/RNA Molecule: Synthetic coding sequence
atggtgtacatcagcaacggccaggtgctggacagccggagccagagcccatggagactgtcactcattactgatttcttttgggggatcgctgaatttgtggtgctctttttcaaaactctgttgcagcaagacgtgaagaaaagaaggtcctatgggaattcctccgattccagatatgatgacggtaggggaccgccagggaatccccctcggcgtatgggaagaattaatcatctccgtggcccctcaccaccccctatggctggaggaugaggaagatag

SEQ ID NO: 50862 - DNA, 276 bp, Artificial Sequence
  Description of Artificial Sequence: Synthetic coding sequence
atggtgtacatcagcaacggccaggtgctggacagccggagccagagcccctggagattgagcttgataaccgactttttttggggcattgcagagttcgtggttctgttcttcaaaacactgctgcaacaagacgtgaaaaagcggagaagttatggcaatagcagcgatagtaggtatgatgatgggcggggcccaccaggcaacccccccagaaggatgggccgcatcaatcacctgagaggcccgtcaccaccccctatggccggcggttag

SEQ ID NO: 50863 - DNA, 438 bp, Artificial Sequence
  Description of Artificial Sequence: Synthetic coding sequence
  Description of Combined DNA/RNA Molecule: Synthetic coding sequence
atgagcctgctgctgccccccctggccctgctgctgctgctggccgctctcgtggcccctgcaaccgcggcgaccgcatataggccagactggaaccgcctcagcggtctcacccgggctcgtgttgaaacatgcgggggaugacaactgaaccgcctgaaagaagtgaaggcctttgtaacacaagatatacccttttaccataacctggtcatgaaacatctacccggcgccgaccctgagcttgtactgctgggaagacgctatgaggagttagaacggatccccctcagcgagatgacccgggaggagatcaacgccctggttcaggagttagggttctacaggaaggccgcccccgacgcacaggtcccacccgaatatgtctgggctccagctaagcctcctgaagaaacctcggatcatgcagacctttag

SEQ ID NO: 50864 - DNA, 438 bp, Artificial Sequence
  Description of Artificial Sequence: Synthetic coding sequence
  Description of Combined DNA/RNA Molecule: Synthetic coding sequence
atgagcctgctgctgccccccctggccctgctgctgctgctggccgcccttgttgctcccgcaactgccgcgacagcgtaccggccggactggaatagactgtccggcctcacccgtgcccgcgtggaaacgtgtggcggaugacaattgaatagattgaaggaggtcaaagcatttgtgacccaggacattcctttctatcacaacctcgtaatgaagcacctcccaggggctgaccccgagctggttttgctggggcgacgatacgaagagctggagcgtatcccgctgagcgagatgaccagagaagaaatcaacgcattggttcaggagctgggcttctatcgaaaagctgcccctgacgcccaagttccccccgagtacgtttgggcccctgcaaagccacccgaggagacatccgaccatgccgacttatag

SEQ ID NO: 50865 - DNA, 2010 bp, Artificial Sequence
  Description of Artificial Sequence: Synthetic coding sequence
  Description of Combined DNA/RNA Molecule: Synthetic coding sequence
atggccgtgtaccgggccgccctgggcgccagcctggccgccgccaggctcctccccctgggccggtgttctccgtcgcctgcaccaaggagtaccctgtctggcgccgctatggaaccagcccccagatggctggccggcctacgcttcgacaacagggccctccgtgccctcccagtggaggcacccccccccgggcctgagggtgcccccagcgcgcctcgtcctgtgcccggcgcttgctttaccagagttcaacctacacccttgcggcagccaaggcttgttgccctgagcgaacccgctttggcacttctggggcttggcgccccccccgcacgcgaagccgaagccgaggccgctctattcttcagtgggaatgccctgttgccaggggccgaaccggcagcgcactgctactgcggacaccagttcggacagtttgcgggacagctgggggacggggccgccatgtacctcggtgaggtttgcacagctacaggggagcgatgggaactgcaactaaagggagctgggcctaccccatttagtaggcaggccgatggaaggaaagtgctccggtcatccatacgggagtttttgtgttcagaagcgatgttccaccttggcgtacctacaacacgcgccggcgcttgtgtcacatccgagtccacggttgtcagggatgtcttttatgatggtaatcccaaatacgagcagtgtactgtagtattacgggtggctagcacttttattaggtttggcagctttgaaattttcaaaagtgcggatgagcatacaggaagagccggaccttcagtgggaagaaacgacatacgggtccagctgttggattatgtgatctctagtttctatccggagatacaggctgcacatgcatccgacagcgtgcagagaaatgctgccttcttccgtgaagtgacccggagaaccgcccgcatggtggccgaatggcagtgtgtaggcttctgccacggggtgctgaatacagacaatatgtccatcttagggctgaccatagattatggaccgttcggattcctcgaccggtacgatcccgatcacgtgtgcaacgcttctgacaacacaggccgctacgcctatagtaagcagcctgaggtatgccggtggaatttgagaaagctggccgaagctctacagcccgagctaccactggaattaggcgaggctatactggcagaggagttcgatgctgagtttcagcgccactatttgcagaagatgcgccgcaaactgggcctggtccaggtggaactggaggaggacggggcccttgtgtcaaagctactagaaaccatgcacttaaccggggccgatttcactaacactttctatttgctgtctagcttcccggtcgagttagaatcacccggtctggccgagtttctggctcgcctgatggaacagtgtgcatccttggaagagttacgcctggcttttcgcccacagatggatcctcggcaactgtctatgatgctgatgctcgcccagagcaacccgcagctgtttgcactgatggggactcgcgcaggcatagctagagagctggagcgggtggaacagcagtcccgattagagcaactgagtgccgccgaactgcagtctaggaaccaaggacactgggcggactggctgcaggcttacagggcccgtctcgacaaagacctcgagggggccggcgatgccgccgcttggcaggcagagcacgtgcgtgtgatgcatgctaataatcctaaatacgtccttcggaactacattgcgcagaatgccatcgaggctgccgagaggggcgatttctccgaggtcaggcgagtgttgaagctcctggagacgccctatcactgtgaggccggcgctgctacagacgcagaagctacggaagccgacggagccgatgggagacagcgttcctactctagcaaacccccattgtgggctgccgagctctgcgtgacaugaagctcatag

SEQ ID NO: 50866 - DNA, 588 bp, Artificial Sequence
  Description of Artificial Sequence: Synthetic coding sequence
  Description of Combined DNA/RNA Molecule: Synthetic coding sequence
atgcggctgctgctgctgctgctggtggccgccagcgccatggtgcgctccgaagcctccgccaatttgggcggagtccctagtaaaagacttaaaatgcaatacgccaccgggcctctcttaaagttccagatctgcgtgtccugaggttatagaagggtgttcgaagaatacatgcgggtgatctctcagagatatcctgacatacggattgagggtgaaaactatcttccccaaccgatctacagacacatcgcctcctttttaagcgtcttcaagctcgtgctgatcggcctgattatcgtgggaaaagatcctttcgcgttttttggaatgcaggcccctagcatatggcaatggggtcaggaaaataaggtatatgcctgcatgatggtgttttttctttccaatatgattgagaatcaatgtatgtcgaccggagcctttgagatcaccctcaatgatgtgccagtttggtctaaactggaaagcggtcatctgccctcaatgcagcagctcgtccagatcttggataatgagatgaaacttaatgttcacatggattctattccgcatcatagatcctag

SEQ ID NO: 50867 - DNA, 1041 bp, Artificial Sequence
  Description of Artificial Sequence: Synthetic coding sequence
  Description of Combined DNA/RNA Molecule: Synthetic coding sequence
atgaacaaccaggcccggacccccgcccccagcagcgcccggaccagcacatcagtcagggcctctactcctacgaggacgcctactcctctgcgaactcccacgccggtccgcacacggactcctattaggaccctgacgccagttcttacgcccagcccagccggtaccagtccactagttctgacaccagcacccgcacagatccctacgcttgtgccaacccctgccctggccaggatacctcgcctagttcctcctccagcccccgcctggattcccacccctgtccctactcccgtccccgtccgcaatccgacgcctgttccaaccccagccaggactctgactccaccagtccgggtccccgcacctgcacccgcccagctgttggcagggatcagggcggcactgcctgtgctagactcatacttagcgccagccttgccactggaccccccccctgaaccagcacctgaactaccccttctgcccgaggaggaccccgaacccgcaccgagcttaaaactcatccccagcgtgagttctgaagctggcccggcacctggccctctcccaactagaactcctttagctgctaacagtccaggaccaaccttggatttcacattcagggccgacccctcagccattggcctggcggacccccctataccctccccagtgccatctccaattttgggaaccattcccagtgctattagcctgcagaattgcacagaaacattcccatcgagttcagagaattttgcattggataagcgtgtgttgatcagggtgacgtattgtgggctgugatcttatagcctgagatacatcctgctgaagaagagtttggaacagcagttcccaaaccatctgctcttcgaggaagatagggctgcgcaggcaaccggtgaattcgaggtcttcgtgaatggccgattagtgcatagcaaaaagcggggagacgggttcgtgaacgaatcccgactgcagaaaatcgtttctgttatagacgaagagataaagaagagatag

SEQ ID NO: 50868 - DNA, 1041 bp, Artificial Sequence
  Description of Artificial Sequence: Synthetic coding sequence
atgaacaaccaggcccggacccccgcccccagcagcgcccggaccagtacttccgtgagggcaagcactcctacgcgcactccaacgccattgcgcactccgactccggtaagaactagaacccccataagaacactgacaccagtgctcaccccttctccagcaggaacatcaccactcgtgcttacacctgcgcctgcacagattccaaccctcgtgcccacgcccgctctcgcccggattcccaggttggtcccaccccccgctcctgcatggatccccactccagtgcccacacccgtgcccgtccggaatccgaccccagtcccaacacctgctcgaaccttaactccgccagtgcgcgtgcctgccccagcccccgcacagctcctggccggcattcgggccgctctccctgttctggattcctatctagcccccgcactgcctctggatccgcctcctgaaccagcacccgagctccctttgctcccagaagaggatccagagccagcgccaagtctgaagctcattcccagcgtttctagtgaggccggccctgctcccggtccgttgcctaccagaaccccactggccgccaactcgccaggtcccacattggacttcacctttagagctgacccaagtgcgataggtctggcagacccgcctatcccttcccccgtgccatcacccatcctgggaaccatccctagtgcgatcagccttcagaattgtaccgaaaccttcccttcttcgagcgaaaatttcgccttagataagcgcgtgcttattcgggtaacctattgcttcatacattcctactcccttaggtacatccttttaaagaagagtctggagcaacagttcccaaatcacctgctttttgaagaggatagagctgctcaggctactggggaatttgaggtatttgtcaacggcagacttgtgcattctaaaaagcggggggatgggttcgtgaatgagagcaggctacaaaaaatagtgagtgtaatcgatgaggagatcaagaaacggtag

SEQ ID NO: 50869 - DNA, 2250 bp, Artificial Sequence
  Description of Artificial Sequence: Synthetic coding sequence
atgggccgggccggcgccgccgccgtgatccccggcctggccctgctttgggcagttggcctaggatcggcggcccccagccctcctagattgcgattatcctttcaggagctgcaagcatggcacgggctacaaacgttctccctagagaggacctgctgttatcaggcgctgctcgtagacgaggagcgcggccggctgttcgttggtgccgaaaatcacgttgccagcttaaacctggacaacatatccaaaagagccaagaagcttgcgtggccagctcctgtggagtggcgagaggaatgtaactgggccggcaaggatattgggacagagtgcatgaactttgttaaactcctgcacgcctacaatagaacccatttactcgcttgtggaacaggggccttccaccccacatgtgccttcgtggaggttggacacagagctgaagaacccgtgttgcgactggatccgggccggattgaagacggcaaaggcaaatccccgtatgatcccagacaccgggctgctagcgtgttagtgggcgaggagctgtattctggggtagccgcagacctaatgggcagagacttcactattttccgctccttgggacagcgcccatctctacgcacagagccccatgacagccggtggctcaacgagccgaaatttgtgaaagtcttctggattcccgagtccgaaaatccagacgacgacaagatatattttttttttagggagaccgccgtggaggcggcacctgctctcgggcgactctctgtgagcagggtggggcagatctgtagaaacgatgtgggcggacagcgatccctagtgaataaatggaccacgttcctcaaagcgagactagtttgttccgttccgggagtggaaggagacacacatttcgatcaactgcaggatgtgtttctgctgtcctctcgggatcatcggacaccattactctatgccgtcttttcaacctccagctccatctttcaaggctccgctgtatgtgtatactctatgaacgatgtccgtagggcatttctgggcccattcgctcataaagaagggcctatgcaccaatgggtttcataccagggacgagtgccttacccacggcccgggatgtgcccctccaagacctttggcaccttctcttccacaaaggacttccctgacgatgtgattcaattcgctcgtaatcaccccctcatgtacaactcagtgttgcctacgggaggacgacctttattcctgcaggtcggcgctaactatacattcacgcagatcgccgctgacagagttgcagcggcagatggccactacgacgttctgtttataggcacggacgtcgggaccgtcctgaaagttatttcggtccctaaaggcagtcgaccctcagcagagggactgctcttggaggagctgcacgtttttgaagactccgccgccgttacttccatgcaaatcagtagcaagcgacaccagctctatgtagcgtcccgttccgctgttgcccagatcgccctccacaggtgcgccgctcatggccgcgtgtgcaccgagtgttgtctagccagagacccctattgcgcctgggacggggtcgcgtgcacgcggttccaaccatctgcaaagagaaggtttaggaggcaagacgttcgaaatggcgaccccagtacactctgctcaggggactcgagccgtcccgctctgttagagcataaggtatttggcgtggagggctctagcgctttcctcgagtgcgagcccagaagcctccaagcaagggttgaatggacattccaacgtgccggcgtcactgctcacacacaggtgctggcagaagagaggaccgagcggaccgcacggggactattgctcagaagactacgccgccgcgattccggcgtgtacctgtgcgccgccgtggagcaggggtttacccagcctctccgccgcctgtctctgcacgtgctgagcgccacgcaggccgagcggcttgcccgggcagaggaggccgcaccagcagctccccccggtccaaagctctggtatagggattttctccagctggtggagcccggcggcggcgggagcgcaaactcgttgcggatgtgtcgccctcagcccgctctacagagcctgccattagaatccaggagaaaggggcgaaaccgccggacgcatgctcccgaacctcgcgcggagcgcggcccccgctctgccacccactggtag

SEQ ID NO: 50870 - DNA, 444 bp, Artificial Sequence
  Description of Artificial Sequence: Synthetic coding sequence
atgggcggctgcatgcacagcacccaggacaagagcctgcacctggagggagacccaaatccctcagccgcacccacttctacatgcgcaccccggaaaatgcccaagcgcatatcaatctcaaagcagctcgcctcggttaaagcccttcggaagtgcagcgatctggagaaggcaattgcgactacggccttaatctttcgaaacagctccgactccgatggaaaactcgaaaaagcaattgccaaagatttactgcaaacacaatttcgtaacttcgctgaaggccaggaaacaaagccgaagtatagggaaatattgtcagagctggacgagcatacggagaacaagttggactttgaggacttcatgattctgttgctcagcattacagtcatgtcagatcttctgcagaacatccggaacgtcaagataatgaagtag

SEQ ID NO: 50871 - DNA, 279 bp, Artificial Sequence
  Description of Artificial Sequence: Synthetic coding sequence
atggagcagagcaaggtgctgatcaaggagggcggcgtgcagctgctcttaacaatcgtcgacacgccggggttcggagacgccgttgacaatagtaattgctggcagccagccatcaactatattgactccaagttcgaggactacctgaatgctgagagcagagtgaatcggtgtcagatgccaggcaatagagtgcagtgctgcctttattttatagctccatccggccacggatggcaaacgcgcaacatggattactgtgtggagtttcactag

SEQ ID NO: 50872 - DNA, 279 bp, Artificial Sequence
  Description of Artificial Sequence: Synthetic coding sequence
atggagcagagcaaggtgctgatcaaggagggcggcgtgcagctgctgctcactatagtggatacacccggtttcggcgatgctgtagataattcaaactgttggcaacctgctatcaattacatcgacagtaagttcgaagattacttgaatgctgagtccagggtgaatcgctgccagatgccaggtaacagagtgcagtgctgtctgtactttatagcacccagcggacatgggtggcagacgaggaacatggactactgtgtggagttccactag

SEQ ID NO: 50873 - DNA, 1269 bp, Artificial Sequence
  Description of Artificial Sequence: Synthetic coding sequence
atggagccccccgccagcaaggtgcccgaggtgcccaccgcccccgcaacagatgcggctcccaagcgggtggagatacaaatgcctaagccggccgaagcccccaccgctccctctccagcccagactctggaaaatagcgagcccgctccagtatctcagctccaaagtcgattggaacctaaaccccagcccccagtggccgaagccacaccacggtctcaagaggccacagaggcagctccatcgtgcgttggtgatatggccgatactccgagggatgctggacttaaacaggcacccgcttctcggaatgaaaaggcaccagtcgatttcggctacgttgggatcgacagcattttggagcaaatgcgacggaaggctatgaagcaggggtttgagtttaacataatggtggtcggccagagcggcttgggaaagtcaaccctgatcaacacactattcaagagcaagatttcccgcaagtcagtgcagcctacatccgaggagagaatccccaagaccattgaaatcaagtcaatcacccatgacatcgaggagaagggagtccggatgaagctgaccgtcatcgacacgccgggcttcggtgaccatattaacaacgagaattgttggcagcccatcatgaagttcatcaatgatcagtacgaaaagtatctccaagaagaagttaacatcaaccggaagaaaagaatccccgacacgcgggtgcactgctgtctctattttattccagccaccggtcactcacttagaccactagacatcgagtttatgaagcgtctgtcaaaggtagtcaatattgtacctgtcattgctaaggctgatacactgaccctcgaggaacgggtgcacttcaagcaacgcattacagcagatctgctgtccaacggcatagatgtctacccccagaaggaatttgacgaggactcagaagaccgcctggtgaatgaaaagtttcgtgagatgattccctttgctgtagtggggtcagaccatgaataccaagtcaacggaaagagaattctgggcaggaaaacaaagtggggaactatcgaagtggagaacactacccactgcgagtttgcatatttgagagatctcctgattcgtactcacatgcagaacatcaaggatatcacgagcagcattcattttgaggcctatcgggttaaacgtcttaatgaggggtcctctgccatggcgaacggcatggaggagaaagaaccagaggctcccgaaatgtag

SEQ ID NO: 50874 - DNA, 1269 bp, Artificial Sequence
  Description of Artificial Sequence: Synthetic coding sequence
atggagccccccgccagcaaggtgcccgaggtgcccaccgcccccgctacagatgctgcccctaagagagtagaaatccaaatgcctaaacccgccgaggctcccacagctccgtctcccgctcagacactggagaatagcgaacctgcccccgtctctcagctgcagtctcgcttggagcccaagccacagccaccggtcgcagaagcaactcctagaagccaggaagcaactgaggctgcaccatcctgtgtgggggacatggcagatacaccccgagacgcgggtctcaagcaggcaccggcaagtcgcaacgaaaaggccccagtcgacttcggctatgtgggaatagactccatcttggagcagatgcgccgtaaagcaatgaaacagggcttcgaatttaatataatggtggtcgggcaatctgggttaggaaagagtactctgattaacacactgttcaagtccaaaattagcaggaagagcgtgcagcccacatcagaggagcgaatcccaaagactattgaaatcaaatccatcacacacgacatagaagaaaagggagtgcgtatgaaacttaccgtcatagacactccaggcttcggagaccacatcaacaacgagaattgctggcagcctatcatgaaatttatcaatgatcagtacgagaagtatctgcaggaggaagttaacattaaccgtaagaagaggatccccgacacccgcgtacactgttgcctttatttcatccctgcaactggtcatagtctccggcctttggatatcgaatttatgaaaaggctgagcaaagtggttaatatcgtgcccgtgattgctaaagctgacactctgacgctggaggagcgggtgcacttcaaacagaggataaccgcggacctgctctctaacggaatcgatgtgtacccacagaaggaatttgacgaagacagcgaggacagattggtaaacgaaaagttccgagaaatgatcccgtttgcagtcgtcggctcagaccatgagtatcaggtcaacggaaagcgcattctaggaagaaaaacaaaatggggtacgatcgaggtcgaaaacacgacccattgtgaattcgcatacctgagagacctactgataagaactcacatgcaaaatatcaaagacataacaagctccattcactttgaagcttaccgcgtgaagcggctgaatgagggcagctccgccatggcaaacggcatggaagagaaggagcccgaagccccagagatgtag

SEQ ID NO: 50875 - DNA, 1008 bp, Artificial Sequence
  Description of Artificial Sequence: Synthetic coding sequence
atggccgacaccccccgggacgccggcctgaagcaggcccccgcctcacgtaatgagaaggcccctgtggacttcggctacgtcgggattgattctattctggagcagatgcggcggaaggccatgaaacagggttttgaatttaacataatggttgtaggccagagtggacttgggaaatctaccttaatcaacactctatttaaatctaagatttctcggaagagcgtccagccaacctcagaggagagaattccaaagactattgaaattaagagcattacacacgatatcgaggagaagggagtccgtatgaagcttaccgttattgataccccaggtttcggtgatcacataaataacgagaactgctggcagccgattatgaagttcattaatgatcaatacgaaaagtaccttcaagaggaagtcaacatcaatcggaaaaagagaattcctgatacacgagtgcattgctgcttatacttcattcctgccactggccattcactgagacctttagacattgagtttatgaaaagactcagcaaggtcgttaatatcgtccccgttatcgccaaagctgacactttaacactggaagagagagtccattttaagcagcgaataacagctgatttgctttctaatggcatcgacgtctacccacaaaaagaattcgatgaggacagtgaggataggctggtcaatgagaagtttagagagatgattccctttgctgtcgttggctctgaccacgagtaccaggtgaacggaaagcgaatattaggccgcaaaactaagtggggaacaatcgaagtggagaatacaactcactgtgaatttgcttacctgcgggacttattgattcggacccacatgcaaaatattaaggacattacctcgagcatacacttcgaggcctacagagttaaaagacttaacgagggcagttcagccatggccaatggcatggaggagaaagagcctgaagctcctgagatgtag

SEQ ID NO: 50876 - DNA, 1707 bp, Artificial Sequence
  Description of Artificial Sequence: Synthetic coding sequence
atggagcgggaccggatcagcgccctgaagcggagcttcgaggtggaggaagtcgaaacccccaattcaacgcccccgcggcgagtgcagacacctttgctgcgcgctaccgtggcaagctctacccagaaattccaggacctcggagtgaaaaacagcgagccatctgcacggcacgtcgactcacttagccagcgatcgccgaaagcatccctcaggcgggtcgagctctccggtccgaaggctgcagaacctgtgagtagacggaccgaacttagcatcgatataagctccaagcaggtagagaatgctggagctatcggcccctctaggttcggtctcaaacgcgccgaagtgcttggccataagacgccagagcccgcccccagacggacggagattaccattgtcaagcctcaggagtccgcacataggcggatggaacctcccgcctcaaaagtacccgaagtgcctaccgcaccagccacggacgccgcgcctaaaagagttgagatccagatgccgaaacccgcagaagcgccaaccgcaccctcccctgcgcagaccctggagaacagcgagccagcaccagtgtcacagttgcagtcacggttggaaccaaaaccacagcccccggttgccgaggccacaccgcgaagccaagaagccacggaagccgctccctcctgcgtcggcgacatggctgatacaccccgggatgccggtctgaaacaggcaccagcatcacggaacgaaaaggctccagtcgattttggctacgtgggtatcgacagcattctcgaacagatgcgcaggaaagccatgaaacagggattcgagttcaatataatggtggtgggccagtccggactcggcaagtccaccttgatcaacactctgtttaaatccaagatcagcagaaagagtgtacagccaacgtctgaagaacgtattccaaagacaattgagattaagagtatcacccatgatatcgaagagaagggggtgaggatgaagctgacggtgatcgatactccgggatttggggatcacattaacaatgaaaactgctggcagcctattatgaaattcatcaacgaccaatacgagaagtatctgcaggaagaggtgaacatcaatcgaaagaagagaatacctgacaccagggttcattgctgtttgtacttcatcccagcgactgggcactctctacggcctctggacattgaatttatgaagaggctatccaaggtggtaaacattgttcctgtgatcgcaaaagccgacaccctgactctagaggagcgcgtccacttcaaacaacgaataaccgccgacctgctttcaaatggaatcgatgtgtacccacagaaggaattcgatgaagattctgaagatcgcctcgtgaacgagaagtttagagaaatgattcccttcgccgtggttgggtcggaccatgaatatcaggtgaacggcaaaagaattctgggcaggaaaaccaagtggggaactattgaggtggagaatactacgcactgcgaatttgcttatcttcgggatttgctaatacgcacacacatgcaaaatattaaagatattacttccagtatccattttgaggcataccgggttaaaagattgaatgagggctcatcagccatggccaatgggatggaagagaaagagccggaggctcccgagatgtag

SEQ ID NO: 50877 - DNA, 1368 bp, Artificial Sequence
  Description of Artificial Sequence: Synthetic coding sequence
atgggcgcctgcctgggcgcctgcagcctgctgagctgcgccagctgcctgtgcggttcagccccctgtatcctgtgctcttgctgtcccgcctctcgaaatagcaccgtcagcagactcatattcacctttttcctgttcctcggcgtgctggtctctattatcatgttaagcccgggcgtcgaatcacagctctataagctgccttgggtgtgcgaggagggagcgggtattcctacagtcttgcaaggacacatcgattgtgggagcctgctgggctacagagcagtgtaccggatgtgctttgccactgcagccttcttcttcttcttcacacttctcatgctgtgtgtgtcatcttcgagggacccccgggccgcaatccagaatgggttctggttctttaagttcctgatcttggtgggccttacagtgggtgcattctacatacccgacgggtccttcaccaacatctggttttactttggagtagttggtagctttctttttatccttatccagctggtcttgctgatcgacttcgcacactcttggaaccagagatggctcggaaaagccgaggagtgcgactcccgtgcatggtacgcgggtctcttcttttttactcttctattttacctgctgtccattgcggccgtggccttgatgtttatgtactacaccgagcctagcgggtgtcacgagggcaaggtgtttatatccctgaatctcaccttctgtgtgtgtgtctcaatcgcagccgtgttgcctaaggttcaggacgctcagccaaactcagggcttctgcaagcctcggttattacattgtatacaatgttcgtgacttggtcagccctgtccagcattccagagcagaagtgcaatcctcacctcccaacacaattaggcaacgaaacagtggttgccggccccgagggatacgaaactcaatggtgggatgctcccagtattgtgggactgattattttcctcctctgtacattatttatcagtctgagatcttctgatcataggcaagtgaattctctcatgcagacggaggagtgtccaccaatgcttgacgcaacacagcagcagcaacaggtagcggcatgtgagggaagagcgttcgacaacgagcaggatggcgtcacctactcttactcctttttccatttctgtttggtccttgcctcccttcacgtcatgatgactttgaccaactggtacaaaccaggggaaacgcggaaaatgattagcacatggacagctgtgtgggtcaagatttgcgcctcatgggctggactgcttctgtatctgtggacgctggtcgcgccactccttctacgcaatagggacttttcttag

SEQ ID NO: 50878 - DNA, 294 bp, Artificial Sequence
  Description of Artificial Sequence: Synthetic coding sequence
atgaagggcatctgcagcgacgccatcctggtgctggccaccagcatgtggatggccttcgccatagatttccctcttccaatggcctcagaaagaggccagttagataagacaatcgttgaatgtttgaaaaacgttaacaagtgctggtttctctcctacattaaaccatcggagcccatttgcggaagtgatcaggtgacctattccagcgactgtcatttatgttccaagatcctgttcgaaggcctcaatattactaaactgtatgacggacagtgtgagaacagctag

SEQ ID NO: 50879 - DNA, 1794 bp, Artificial Sequence
  Description of Artificial Sequence: Synthetic coding sequence
atgagcagcaccgtgaacaacggcgccgccagcatgcagagcacccccgacgcagcaaacgggtttcctcagcctagtagttcgagcggtacctggcctcgggccgaggaggagctgcgcgctgccgaaccaggcctggtgaaaagggcccatcgcgagatcctcgaccatgaaaggaaaaggagagtggaattgaagtgcatggagctgcaggagatgatggaagaacagggctactcagaggaggagatcaggcagaaggtggggacctttaggcagatgctaatggaaaaggagggagtcttgacacgtgaggaccggcccggagggcacattgtggccgagaccccaagattaactgagggcgcggagcctggtttggagtatgcgcctttcgacgatgatgacgggcccgtggactgtgattgtcccgcttcatgttataggggacatcgaggctatagaaccaagcactggagttcctcatctgcaagtcccccgccaaagaagaagaaaaagaagaaaggcggccatagacggtcccgcaaaaagcgcaggctggagtcagagtgtagttgcggctcaagtagcccattacggaaaaaaaagaaatccgtcaagaaacaccgtcgcgaccgcagcgactctggatcgcgcagaaaaaggaggcatcggagcagatcttcaaagtgtaagagaaaggagaaaaacaaggagaagaaacggccccatacagaaagtcccggccggcggtctcataggcactcctcagggtcctctcattctccttcactttcctcccactacagcgactctagaagtccttcccgcctgagccccaaacaccgagacgagggccggaagaccggtagccagcgctcttccgggtccaggtcccctagcccttccggaggctctgggtggggatccccacagcgcaacggggggagcggtcaaaggtctggcgcccatggaggcaggccaggatccgctcattctcctcctgacaaaccttcatctccaagccctagggtccgtgataaagctgcagctgcagctcccacgcctcctgctcgtgggaaggaaagtccctctccacgctccgccccaagctcccagggaagaggcggtagggcagccggcggcgccgggcgcaggagaagacggcggcgacgcagacgcaggtcccggtcctctgcttcggcaccacggagacgcggcagaagacggcccaggcctgctccgccaagaggaagttcgcggagcctctcccgagctagatcctcttcggactccgggagtggtagaggcgcacctggccctggtccagagcccggcagcgagagaggccacgggggtcatggcaagagggctaaagaaagaccccccagagcacggccagcctcgacgtctccctcccctggcgcgcacggccggagaggggggcccgaaggcaaatctagcagccggtcccctggccctcatcccagaagctggagctctagtcgctcgccttctaaaagccgttcacgaagcgcggaaaaacgcccacatagtccgtcgaggtctccatctcccaaaaagccgctgtctcgagacaaagacggtgaagggagggctaggcattcagaggcagaggccactcgcgcacgcaggcggagcagatcatacagtcctattagaaaaaggagaagagatagtccatctttcatggaaccccggagaattacgtccgccgcttcagtgctatttcacacaacagggcccgctccgttgcctccacccgcggcttag

SEQ ID NO: 50880 - DNA, 1962 bp, Artificial Sequence
  Description of Artificial Sequence: Synthetic coding sequence
atgagcagcaccgtgaacaacggcgccgccagcatgcagagcacccccgacgccgcgaatggtttcccgcagccatctagcagttcaggaacttggcctagggccgaagaagagttgagggctgccgaaccaggactcgtgaagagagctcacagggaaatcttggaccacgagcggaagcggagggtcgagttgaagtgtatggagctgcaggaaatgatggaagaacaaggttacagcgaggaagaaattagacaaaaagtcggaacctttaggcagatgctgatggaaaaggagggtgtgctgacgagagaagacagacccgggggacatatcgttgctgaaaccccaaggctcacagagggggccgaacctgggctggagtatgcaccgttcgatgatgacgacggcccggtggactgcgactgcccagcctcttgctatcgcggccacagagggtatagaaccaaacattggagcagctcatcggcaagtcctccaccgaaaaaaaaaaaaaagaagaagggaggtcatcggcgctcccgtaaaaaaaggcgcctcgaatctgaatgctcatgcggatcttcttcaccacttcgtaagaaaaaaaagtctgtgaagaagcataggagagacaggagcgatagcggctctagacgcaagcgcaggcatcgcagcaggtctagcaaatgcaagcgcaaggaaaaaaataaggaaaagaagaggcctcatacggagagcccagggagacggtctcacaggcattcgagcggatcgagccacagtccctcgctgagttcacactactctgactctcggtcgccttcccgtctgtctcccaaacaccgggacgagggccgcaagacaggctcccaacggagtagtggatcgcgctcgccaagtccatctggcggtagtggttggggttctccacagcgcaacggaggcagtggccaaaggagcggcgcccatgggggtagacccgggagcgcacatagtccgcccgataagccaagttcacccagcccaagggtccgcgacaaagccgccgccgccgcacccactcctccagcgcggggcaaagagagcccctcccctcgctcagctccctcttctcaggggcggggggggcgggccgccggaggcgctggacgcaggagaagacgccgaagaagaagacgccggtctaggtcctctgccagcgcgcctcggcgacgcgggcgccggagaccccgacccgcgccaccccggggtagcagccggtctctatccagagcccgctccagcagcgactctgggtctggtagaggcgcccctggccccggacccgaacccggaagtgaacggggccacggtggccatgggaagagggccaaagaaagaccacccagggccaggcccgcctcaaccagtccctcccccggcgcacatggacggcgggggggaccggaaggaaaatcaagctccaggagccctggacctcatccccgcagctggtctagctcacgcagtccatctaagtcccgtagtcggtccgctgagaaaaggccgcatagccctagtcgatcaccatcaccgaagaagcctcttagccgggacaaggacggggaaggcagggcacgacacagcgaggcagaggctacccgtgcacggcgccggtctcgctcatactctccaattaggaaaaggcgcagggactcccctagtttcatggaacctcggaggatcacccggaggaggaagcgaccaataccctactacagaccatctcccagttcatcttccagctgtttatcttccgattactctacccgaagccacagccgtagcccatcgcctggccatagccacggttcctatagctcgaggtcccacgggacccggtcgcgaactcgcagtccatcccgtacccccagtcccagctaccatagccgatcgagttcagaatcaggtggattttag

SEQ ID NO: 50881 - DNA, 1794 bp, Artificial Sequence
  Description of Artificial Sequence: Synthetic coding sequence
atgagcagcaccgtgaacaacggcgccgccagcatgcagagcacccctgatgccgccaatggcttcccccaaccctcctctagttcaggaacctggccaagagccgaagaggaattgcgagccgcagaacccgggcttgtgaaaagagcccaccgagaaatactggaccacgagcgaaaacgcagggtggagctgaagtgtatggagcttcaagagatgatggaggagcaaggctatagtgaggaagagatcagacagaaagtcgggacctttagacagatgctcatggagaaagaaggagttctgacccgtgaggaccggccggggggccacatcgtggcggaaacgccaaggctgaccgagggcgcagaacccggtctggaatacgcacccttcgacgatgacgatggaccggtggactgcgattgcccggcaagttgttacagaggtcatcgaggctatcgaaccaagcactggagcagctcaagtgccagcccaccccccaagaagaagaaaaaaaaaaaaggcggccacagaagatctcgtaaaaaaaggagactggagtcagagtgttcgtgcggaagtagtagccctctgaggaagaaaaagaagagtgtcaagaaacaccggagagataggagcgacagcggctcccgccgaaagcgccgccaccgcagccgcagctcaaagtgtaagcgaaaggagaaaaataaagagaagaaacggccccatactgagtcgcctggcaggcggtctcacaggcactcatcaggttcctcccactcccccagtctcagttcccactattctgatagcagatctccatcacggttgtcccccaagcatagagacgagggccgaaaaaccggctcccagaggagctctgggtccaggtccccatcaccttcaggtgggtccggatggggctcacctcagcgtaatggcggttcaggccaaaggtccggagcccatggaggtcgcccaggcagtgctcattcccctcccgataaacccagttccccttctccccgtgttcgagataaagccgccgctgctgcaccgacacccccagcgcggggaaaagagtccccctcacccaggtccgctccttcatcccaagggcgtggcggaagggccgccggaggggccggaagaaggcgcagaaggaggcgacggcggcgtcgatccagatcaagcgccagcgccccaagacgacggggcaggcgccgcccacggccggcccccccacggggctcctcaagaagccttagtagagcacgctcctcctccgactccgggagtggccgcggggcacccggcccaggacctgagcccggctctgaacggggacacggaggtcacggaaaacgggccaaggaaaggccgcctagagcaagacccgccagtaccagcccgagtcctggggcacacggccgtcgcggcggccctgagggaaagtccagttctaggtcacctggaccgcaccctagatcatggtctagcagtcgcagtccttctaaatcaagatctcggagcgctgaaaaacggccacactccccgagccgttctccatccccgaaaaagcccctgtcaagggacaaggacggagaaggtcgagccaggcattcagaagctgaagcaacccgggctcggcggcggagccggtcttactcccccatccggaaacgtcggcgtgattctcctagcttcatggagcccagaagaatcacgagcgccgctagcgttctctttcacaccaccggacctgcacctttgccacctccagccgcctag

SEQ ID NO: 50882 - DNA, 1962 bp, Artificial Sequence
  Description of Artificial Sequence: Synthetic coding sequence
atgagcagcaccgtgaacaacggcgccgccagcatgcagagcacccccgatgctgctaacgggttccctcagccctctagctcatctggaacctggcccagagccgaagaggagctccgagcagctgagcctgggctggttaaaagggcacatcgcgaaattctagaccacgaacgcaagcggcgggtcgagttaaagtgtatggagctgcaggaaatgatggaagaacagggttattcggaagaagaaatccggcagaaggtcggcactttccgccagatgctgatggaaaaggagggggtgctaactagagaggacaggcccgggggccatattgttgcagaaacaccccggctcactgaaggcgctgagcctggtctcgagtacgcgcccttcgacgacgacgatggccctgttgactgtgactgcccagcttcctgctatcgcgggcatcggggctacaggactaagcactggagcagctcatccgctagtccccccccaaaaaaaaagaagaagaagaaaggcggccataggcgttcccggaagaaaaggagactggagagcgaatgttcctgtggctcaagcagccctcttcgaaagaaaaagaaaagcgtcaaaaaacatcggagggaccggtccgacagcggtagtcgccgtaagaggagacatcggtcaagaagctctaagtgtaaaaggaaagagaaaaataaggagaagaagcgaccacacaccgagtcccctggccggcgcagccacaggcatagctccggctcctcccattcaccttcactgtctagtcattactccgattctagatctccatctaggctcagtcctaagcacagggatgagggccgaaaaaccggcagtcagcggagctccgggtccaggagtccttcgccaagcggcggttccggatgggggagcccgcagcggaacggcgggagcggacagcgaagtggcgcacatgggggacggccaggctcagcgcattcacctcctgacaaaccctcctcaccatcgcctagggtgcgagacaaggccgcggctgccgccccgactccccccgcacggggtaaagaaagtccgtcccccaggtctgccccatcaagccaaggaagggggggaagggctgccggaggcgccggacgcagacgccggcgcaggagaagaagaagaagatccaggtcttcagccagcgctcctcgaaggcgggggcggcgcagacccaggcccgctccaccaagggggtcgtcacgatcactcagccgggcaaggagctctagtgatagcggctcgggcagaggtgccccagggccaggaccagagcccgggagcgaacgcggccacggtgggcacgggaagagggccaaggagagaccaccacgggcacgtccagcatccaccagccctagtccaggcgcacatggcaggaggggcggcccagaggggaaaagctcttcccggtcacccggacctcaccctcgctcctggtcgtcgtccaggtccccttctaaaagccgatcaagatccgccgagaaaaggccgcattcccccagtcggagtccatctcccaagaaaccgcttagccgtgataaggatggtgaaggccgggccagacactctgaggctgaagcaacccgcgccaggaggcgctctcgttcctattcacccatcagaaaacggcgccgggacagcccaagcttcatggagccaaggcgaattactcgtcgacggaaacggcccataccttattacaggccgagcccctcaagtagtagctcctgcttgagtagtgactacagcacaaggagccacagccgatcaccctcccccggtcatagccacgggagttacagcagtagatcacacggcactcggagccgcacccgcagtcctagtcgcacgccttctccatcctaccactctagatcctcttcggagtcagggggcttctag

SEQ ID NO: 50883 - DNA, 2148 bp, Artificial Sequence
  Description of Artificial Sequence: Synthetic coding sequence
atgagcagccccaagcggagcagcaagcccagcatgagcctggcccctagtggatcctctatgccaacagctgatcctaaaccaccggccagcttgaagtccactaaatccgctaccccaaatcggtccctggtgcctactaagccagctaccagccggaacagcgttatgagtccttcctccagcaagtccaccaagagcacgtctaccaagcgcgctcctagcaacagacccagctcacgaagtcgagtcagaagcaaggccaggaccccttcaagagtttccactgacactcggacctctaaggcttccaaggcatctgatgtgagatgccaccagcgtaggggcacccactcccgagggcggactcccggcagacgcggcagtcggagttcaaagaggagcccttcccgcgcctccactcccggccgcattcggactcacggtgcccgacctggaatggcctcgcgtgtcagaacccctactagtcagcagaaaggttcacgtgggaaaagctacggccgcccccgcactagcaacagggagaggtcagactcacaacctcgcaacctttccaaaaagagctatagaccccctggcggatcaggcattgggcgtagttctgagctggctgttacgccaagtacagcaaagtgccagacccccacaggaattccttcaaaagagaagtcggataatccctcacccagcagctccaggaaggtgaaaagctacgggcagatgattattcccagcagagaaaagtcgtactcccccaccgaaatgagctcccgtgtcaaaagttataatcaggcatctacaagaagccgacctcagtctcattctcaatctaggagccctcggagatccagatcgggaagccagaagcgaacccatagtagggtccgaagtcactcctggaagagaaatcacagccgggctaggagccgcacacgtaagggcatcttgtcacaaatgggcagacactcccaaagcaggtcccacagcaaaggcaaatcccaaaatcagtcccggacccccaggcggggcaggtcacataactggtcccgcaacccctccaaggaacgctcgcattctcactcgaggtctagctccaaagagagagatcaccgtggtagcagctcgccaagaaaagaatctggacgcagtcagagcgggagtccaaataagcagcgagatcactcccgctcccgaagccctaataaggcccgcgatcgttccagatctcgaagtccgtataaggcccgtgacagaagccgcagcagaagccccaacaaggcccgagattgttcaagatcacgaagtccctataaggctagggacagaagcaggtcacgttcgcctaataaggcacgcgaccatagtcggtccaggtcccctaataaggcccgcgatagaagtaggagccgaagcccatccaaggagcgcgatcactcccagctgggcagtccatccaaagagcgggaccatagacgtagccggtcgccctccaaggagcgacagtgtagacagagtagatcctcttctaaggagcgtgaccaccggaggtctcgaagcccctccaaggagaggcagaggaggcaatcaagaagtccgaacaaagaaagggatcggtcccagtccaggtcaccgtctgaggaacgcgagcacaggcaaagtcggtcaccaagcaaagagagagacagaaggcgctggcggagtcccagcaaagaaagggaacgccggcagtctagatctagttctgaagagcgagaccattcccgatcaagatcccccaacaagcaatctggctacagcaggccaagagcctcgtcaaaggaaaaggcccactcaaggtccaggacaccttccaaagaaggcaaccactcccaatcacggactagctcaaaagaatccgatccgagccagagcactgttcctcgctcccccgactggaaacgatcgccaacgaggacctcttctctgagtcaaaatcgcacgcccagtaagacaagctcacatagcccctcgacttttccctccggtggccagactctttcgcaggatgatagccaggcagacgccactaccagcaaggctaccctcccgggcgagaggtcttcctcttcatcatccaagctcgcatag

SEQ ID NO: 50884 - DNA, 2193 bp, Artificial Sequence
  Description of Artificial Sequence: Synthetic coding sequence
atgagcaccgtgaccagccggaccaccagccccttcgcccccaccatgtcatccccgaagcggtcgtctaagccttccatgagcctggctccgtccggctcttcaatgcccacagcagatcccaagcccccagcgagtctcaaatcaaccaagtcagcaacaccgaataggtctctggtgccgaccaagcctgctacatctcgcaactccgtgatgagcccctccagttccaaaagcacgaaaagcacctccacaaagagggctccctcaaatcgaccctcaagtcgctctcgggtgcgctccaaagccagaacaccctccagggtcagcaccgatactcgaacctcaaaggcttccaaagccagcgacgtcagatgtcaccagaggaggggtactcattctcggggtcgtacgccaggacgcaggggatcccggagttctaagagaagtcccagcagggcatctacccctggccggataagaactcacggagcaagacctggaatggctagccgagtgcgtactccaactagccaacagaaggggtcccgtggtaagtcctacggccgccctagaaccagtaatagagagaggagtgatagtcagccaagaaatctgtcaaaaaaatcttatagaccgccaggcggcagcggcattggcaggtcatcggaactggccgtcactccgtctaccgccaaatgccagacacccactgggattccctccaaggaaaaaagcgataacccttccccatctagctcaaggaaggtaaaatcctatggtcagatgatcatccctagcagagagaagtcttattcacccaccgagatgtctagtcgggtgaagtcttataatcaggcaagtactcggagcagaccccaatctcattcacagtcccgatcccctcgtcgaagtcgttctggctcgcagaagcgcacccactctcgtgtacgctcgcattcatggaagcgaaaccattcacgtgcaaggtcccgcacgcggaagggaattcttagtcaaatgggccgccactcacagtctcggtcccattcaaaagggaagtcacagaatcaaagtcgcacacccagacgaggcaggtcacacaactggagtcgcaatccatctaaggagcgttctcatagccattcaagaagctctagtaaggagcgggatcaccgaggaagctcctctccaaggaaggaatctggacgttcccagagcggttctcctaacaagcagcgcgaccattccagatcacgcagcccaaacaaagcccgcgatcgctcaagatcaaggagcccctataaagctcgtgaccggtccagaagtcggtctccaaataaggccagggattgctcgcggtcccggtctccatacaaggcgagagaccggtcgcgctctaggagtcctaacaaggccagagatcacagtagatcaagatcccccaacaaggctcgggacagatcacgtagcagaagtccatctaaagagcgcgaccacagccagcttggttctccttccaaggagcgagaccatcggagaagcaggtctccatccaaagaaagacagtgccggcagtcccgctcttcctctaaagaaagagatcatagacgatcccggagtccctccaaggagaggcagaggagacaaagtcggtcacccaataaggagcgggaccgatcgcagtcccggtcccctagcgaggagagagagcaccgacaaagtcggtcgccttccaaagaacgggacaggcgcaggtggaggtccccctcgaaggagagggagagacgtcagagtcgcagctcctcagaggaacgggatcacagcaggtcacgctctccaaataagcagtccgggtactcccgccctagggcgtcatctaaggaaaaggcacatagtcgcagtaggactccaagcaaggagggtaaccactctcagtcaagaacatcttccaaagaatctgaccccagccagtccaccgtgccccgatctcccgattggaaaaggtcaccaactcgaacatctagtctcagccagaacagaaccccttcgaagacgtctagtcatagcccatcaacatttccctccggcggccagacactaagccaggacgactctcaggcagacgctaccaccagcaaggcaactttgccaggtgagaggagctccagctcttcttcgaagctcgcctag

SEQ ID NO: 50885 - DNA, 1191 bp, Artificial Sequence
  Description of Artificial Sequence: Synthetic coding sequence
atgggcgccaacaccagccggaagccccccgtgttcgacgagaacgaggatgtgaacttcgaccacttcgaaatcctgcgcgcaatcggcaaaggatcctttggtaaagtgtgtatcgtccaaaaaaacgacacaaagaagatgtacgctatgaaatatatgaacaaacagaagtgtgttgaacgcaatgaggtccgaaacgtcttcaaggagctgcagattatgcagggcctggagcacccctttcttgttaacctgtggtactcattccaggatgaggaggacatgttcatggttgtggacctgttactcgggggtgatctccggtaccacctgcagcagaacgttcatttcaaagaggaaaccgtcaaattatttatttgtgagctcgtcatggccctcgattacctccaaaatcaacggatcatccatcgcgatatgaagccggacaacatccttctcgacgagcatggccacgtgcacatcaccgacttcaatatcgccgctatgttacctcgcgaaacacagatcactaccatggccggtacaaagccatatatggccccagaaatgttttccagcagaaaaggcgccgggtacagctttgctgtggattggtggtcattgggagtgaccgcgtatgaacttctaaggggtaggcgaccgtaccatatccgcagctcaacttcctctaaggaaatcgtccatacattcgagacaaccgtagtgacgtacccgtccgcatggagtcaggagatggtgagtctgcttaagaagctgctggagcccaaccctgatcagaggttctcacagctgagcgatgtgcagaattttccttatatgaatgatattaattgggacgcagtttttcaaaagaggctgatacccgggttcatccccaataaaggcaggctgaattgcgaccccactttcgaattagaggagatgatcctcgaatcaaagccactccataagaaaaagaaaagacttgcgaaaaaggagaaggacatgagaaagtgcgactcaagtcagacatgtctgcttcaggagcatcttgattctgttcagaaagagtttatcatcttcaaccgagaaaaagtcaaccgcgacttcaataaacgacagcccaatctcgcgctggagcagacgaaggaccctcagggggaggacggacagaacaataacctttag

SEQ ID NO: 50886 - DNA, 501 bp, Artificial Sequence
  Description of Artificial Sequence: Synthetic coding sequence
atgggcgccaacaccagccggaagccccccgtgttcgacgagaacgaagacgttaacttcgaccatttcgagattctgagagcaatcggtaaaggttccttcgggaaggtgtgtattgtgcagaaaaacgataccaagaaaatgtatgctatgaagtatatgaataagcaaaagtgcgttgagaggaatgaggtgcgcaatgtgttcaaggagctccaaatcatgcagggcttggagcatccttttcttgtgaatttgtggtatagcttccaggatgaggaggatatgtttatggttgtggatttgctgctcgggggcgatctgcggtaccacttgcagcagaatgtgcacttcaaggaggagaccgtcaaattgttcatttgcgaactcgtaatggcattggactatctccaaaaccagcgaattatccacagagatatgaagccagataacattctgctggatgagcacgtacagcaatataccttgaagtcccattag

SEQ ID NO: 50887 - DNA, 501 bp, Artificial Sequence
  Description of Artificial Sequence: Synthetic coding sequence
atgggcgccaacaccagccggaagccccccgtgttcgacgagaacgaagatgtcaactttgaccatttcgagatcctccgcgccatcggcaaggggagcttcggaaaagtgtgtatcgtgcagaagaatgatacaaaaaagatgtatgcgatgaaatatatgaataagcaaaaatgcgttgaaagaaatgaagtgagaaacgtgtttaaggagttacaaatcatgcaaggtttagagcatccttttctcgtcaatctgtggtactctttccaggatgaggaggacatgtttatggtcgtcgacctgctccttgggggggacctccgctatcacctgcagcagaatgtgcactttaaagaggagacggtgaagctgttcatttgcgaactggtgatggccttggattacctgcagaatcagcggattatccacagggacatgaagcctgacaatattctgctagacgagcacgatacatggctgtcatacaagagccattag

SEQ ID NO: 50888 - DNA, 1245 bp, Artificial Sequence
  Description of Artificial Sequence: Synthetic coding sequence
atgggcggcaaccacagccacaagccccccgtgttcgacgagaacgaggaagtcaattttgaccactttcaaattcttcgagccatcggcaaaggcagtttcgggaaggtgtgtatcgttcagaagcgggataccaaaaaaatgtacgctatgaaatacatgaataagcagaagtgtattgaaagggacgaggttaggaatgtattcagggagctgcaaattatgcagggactcgaacacccattccttgtcaacctatggtactcattccaagacgaggaagatatgttcatggtggtcgatcttctgttagggggcgatttgcggtatcatttacagcaaaacgtgcactttaccgaagggacggtaaagctctacatttgcgagctggctcttgctctcgagtacctgcagcggtatcacattatccaccgggacattaagcccgacaacatcctcttggacgaacacgggcacgtccacatcactgattttaacattgccactgtagtcaagggcgccgagcgagcctccagcatggctggaacaaaaccttatatggctcccgaagtattccaagtgtatatggatcgtggcccaggctactcctatcctgtggactggtggagcctggggattactgcgtatgaactgttacgcggctggcggccttatgaaattcacagcgtcactcctatcgacgagatcctcaatatgttcaaagtcgaaagggtgcactattcgtccacatggtgcaagggcatggtggccctgctaaggaaattattgacaaaggaccccgagtctcgcgtaagctctttacacgatatccaaagtgtaccctacctggccgacatgaactgggatgcggtgttcaagaaagcactgatgccaggttttgtccccaataagggcagactcaactgtgacccgactttcgagctcgaagagatgatcttggaatccaaacctttgcacaaaaagaaaaagagacttgccaagaatcgtagtcgtgacggtaccaaggactcttgcccactcaatgggcacttgcaacattgtcttgagacggtacgagaagaattcatcatcttcaacagagaaaagctacgtagacaacaggggcaggggtctcaactgctggataccgattctcgggggggtggccaagcccagtctaaattacaggacggctgcaataataacttactgactcatacctgcactaggggatgctcatcctag

SEQ ID NO: 50889 - DNA, 1104 bp, Artificial Sequence
  Description of Artificial Sequence: Synthetic coding sequence
atgtacgccatgaagtacatgaacaagcagaagtgcatcgagcgggacgaggttcggaacgttttccgagagttacagataatgcaaggacttgaacatcccttcttggtgaatttgtggtattctttccaggatgaagaagatatgtttatggttgtggatctgctgcttggaggagatctcagataccatctgcagcagaacgtccattttaccgagggtaccgtgaaactatacatatgcgaattggcattggcactcgagtatcttcagaggtaccatattatccacagggacatcaaaccagacaacattcttctcgacgaacacggacatgtgcacattacagatttcaacatcgctacagtggtgaagggggcagagagggcatcaagcatggccgggactaagccctacatggctcccgaggtcttccaagtctatatggatcggggacctggatattcttacccagtcgattggtggagcctcggaattaccgcctacgagctgctgcgcggctggcgcccatatgaaatccacagtgtaacccccatagatgaaattctgaacatgtttaaggttgagcgggtccattacagcagcacgtggtgcaagggtatggtggccttgcttagaaagctgctgactaaggatcccgagagccgggtgagttctctacatgatatccagtccgtaccctatctggctgatatgaattgggatgccgtatttaaaaaagctctgatgccagggtttgttcctaacaagggacgcttgaattgcgatccaaccttcgagctggaagaaatgatcttagaatccaagcctctccataaaaaaaaaaagcgattggcaaagaatcggagccgcgacggcacgaaggatagctgccctctgaacggtcatttacagcactgtctggaaactgtccgggaagagtttatcatttttaatagggaaaaattgaggcgccaacagggacagggcagccaactactggatactgacagccggggcggcggtcaggcccagtctaaactccaagatggatgcaacaataaccttctcacacatacttgcacaaggggctgctcgtcttag

SEQ ID NO: 50890 - DNA, 1461 bp, Artificial Sequence
  Description of Artificial Sequence: Synthetic coding sequence
atgcggagcggcgccgagcggcggggcagcagcgccgccgccagccctgggagtcccccacccggacgcgcaaggccagctggttccgacgcgccttctgcactacccccgcccgctgctggacagcctagagcacgggactcgggagacgttcggagccagccgcggcccctcttccagtggtctaagtggaaaaagaggatgggtagttccatgtccgctgctactgcgcggcggccagtgttcgacgataaagaggatgtcaacttcgaccattttcagatcctgagagccataggaaaggggtcctttggtaaggtctgtattgtccaaaaaagagacaccgaaaaaatgtacgccatgaagtacatgaacaagcaacaatgtatcgagagggacgaggtccggaatgtgttccgcgagttggagattttacaggaaatcgaacacgtcttcttggtgaacctgtggtactccttccaagatgaggaggacatgttcatggtcgttgatctgctgctggggggtgatttgcggtaccacctccaacaaaacgttcaatttagtgaagatactgtgcgcttgtacatttgtgagatggcactcgctttggactacctacggggtcaacacataatacatcgagacgtgaaacccgacaacatcttgctcgatgaaagagggcacgctcatctgactgacttcaatattgcaacaatcatcaaggatggagagagagccacagctttagcgggcacgaagccgtatatggctccagaaattttccattcatttgtcaacggaggtaccggatatagctttgaagtcgactggtggtctgtgggcgtgatggcatacgagttactgcggggatggcgaccctacgacatacacagctcaaacgccgtggaatctctggtgcagctattcagtaccgtctccgtgcagtacgtacccacctggtccaaggaaatggtggccctgctaagaaagctcctgactgtcaatccagaacatagactgtcctccctgcaggatgttcaagctgcacccgcattagccggggtgctgtgggaccacctgagcgagaaacgcgtcgagccaggtttcgtcccaaataaaggaaggttacactgcgatccaacattcgaactcgaggagatgattttggaatcgagacctctgcataagaagaaaaaacggctggcaaaaaacaaaagccgagataactccagagacagcagccagtctgaaaacgattaccttcaagattgtctggatgcaattcagcaggattttgttatattcaatcgagagaaactgaaacgctctcaggaccttcccagggaacccctgcctgcgcctgagagccgggatgcagccgaacccgtagaggacgaagctgaacgatccgcgctacccatgtgtggcccaatctgcccgagtgccggtagtggctag

SEQ ID NO: 50891 - DNA, 537 bp, Artificial Sequence
  Description of Artificial Sequence: Synthetic coding sequence
tgaggcctggagggcgtggtggtggacggccaggtggagaccgccagggtctggcggggggatcgtccgggcacagaaggcaaagaggaaagcggcatgctctccgctgtctggggtgctggcggaccaggagcaggaggggccgccagggggcagccttcacgcaaggaactgctgctcagacatcatctttggtccggcccacgttgcttgtccttccccctcggttctctgcccgccagcctcctcggccttcccggggccaccagtcacagatcttgtctgtctcccaatcttgccagcggtttagctgcgcggggcacacagacacaatcagttctgtttggtgaggttaggttgcctcttgatggcggggtgaggggcgccaggaaacgaagcctgctcagggcgcatccccgtacgggaatcttgccaggacggtgtggtatggtgtggaaggacaaaaagctccagccatccggttgccatgagaaagctgggggagtcttctgcggtcccagcagaggcggagtgtag

SEQ ID NO: 50892 - DNA, 834 bp, Artificial Sequence
  Description of Artificial Sequence: Synthetic coding sequence
cccttcttccgggcccggggcctggagggcgtggtggtggacggccaggttgaaacagcccgggtatggcggggggatcggccaggtacagaagggaaagaggaatccggcatgctttccgctgtatggggcgcaggaggtccgggagccggcggagctgcccgcggacagccatcccggaaagagctcttattgcgccatcacctgtggtccgggcctcgttgtttgtcattccccttgggaagcctgcccgccagtctgctaggccttcccggtgccacctctcataggagctgcctttcaccaaacttggcatccggactcgctgcccgtggtacgcagactcagtccgtgctttttggagaggtgcggttgcctctagatggcggcgtccgtggcgccaggaagcgaatgaatttcgatcatttccagattctcagagccatcggcaagggtagcttcgggaaagtgtctcctcgcgtgcctcggcgtccccaggcgagctgccgtacagccctgtgcccgcctggggtccattgtgccgaggctggccatggcgaagacgtgcggcatgaggtccacgaacaggccgctgtgcaccgggctcgcaggggaccccagcgactccccggtgccggggaccccgcaggcgatcgggcccgactccctggggagcccttggtgctgctgcccggacgcggaggtcacgtgcacgggcgggggcctgcgaccggccgaggcccggcgttgcctcccgccgccgagcgcgcggtgctacgaggacacggagaagctgtacatcttcgtgatgggacgggttctgggcttccatag

SEQ ID NO: 50893 - DNA, 1110 bp, Artificial Sequence
  Description of Artificial Sequence: Synthetic coding sequence
atgtacgccatgaagtacatgaacaagcagcagtgcatcgagcgggacgaggtccgcaatgtcttccgagagctggagattcttcaagagatcgagcacgtgttccttgtcaacctatggtactcttttcaagatgaagaagacatgtttatggtggtggacctcctcttgggtggggatctaagatatcatttacagcagaacgtgcaattttcagaggataccgttcgtctatatatttgcgagatggccctagccttggattacttgagaggccagcacatcatccaccgggatgtgaaaccggacaacatcctgctggatgaacggggccatgcgcacctgacagattttaacatcgccaccatcattaaagacggcgagagggctaccgccctggcagggacgaagccatacatggcccccgaaattttccactcttttgtgaacggaggcacagggtactctttcgaagttgactggtggtcagtaggggtaatggcgtacgagctgctccgcgggtggcgaccatacgacattcatagtagcaacgccgttgagtctttggttcagctgttctctacggtgtccgttcaatacgtgcctacctggagtaaggaaatggttgccttgttacggaagctgctaaccgtgaatcccgaacatagactctcatctttgcaggacgtccaggctgctcccgcgttggccggcgtgctgtgggaccatttatctgaaaagcgagtggaaccaggctttgtgcccaacaaagggaggctacattgtgaccctacctttgagttggaagagatgattctggagtcccgtccgctgcataaaaaaaagaaaagactagcgaagaacaagagcagggacaatagccgcgacagctctcagtccgagaacgattacctgcaggactgcctcgatgccatccagcaggatttcgttatatttaatagagaaaagttgaaacggagtcaggatctgcctcgcgaaccgcttccagcacccgagtcccgggacgcggccgagccggtggaagatgaggcagaacgctcggctctgccaatgtgtgggccgatctgtccgagcgctggatcagggtag

SEQ ID NO: 50894 - DNA, 1500 bp, Artificial Sequence
  Description of Artificial Sequence: Synthetic coding sequence
atgctgagcgccgtgtggggcgccggcggccccggcgccggcggcgcagcgcggggccagcccagccggaaagagttgctcttacgtcaccatctgtggagcgggcctagatgtctgagtttcccattaggatctctgcccgcatctcttctgggcttgccaggcgccacatcccaccggtcatgtttatcgcccaacttggcatctgggttagccgcccggggcacgcaaacccaatccgtattatttggtgaggttaggctgccactcgacggaggagtcaggggggcacggaaacggatgaactttgatcacttccagatcctccgcgcaatcggtaaggggagtttcggtaaggtgtgcattgtgcagaagagagacacggagaagatgtacgctatgaaatatatgaacaaacaacaatgcatcgaaagagacgaggttagaaatgtcttcagggaactggagatactgcaggaaatcgagcatgtattccttgtgaatctatggtactcctttcaggacgaggaagatatgtttatggtcgtggacctactgcttggcggagatctgcgataccatttgcaacagaacgtgcagttttcagaagataccgtccgcctctacatttgcgagatggccttagcattggattacctccggggtcagcacatcatccatagagacgtgaagccggataacattctgctggacgagcgtggtcatgcacatcttactgatttcaacattgctacaatcatcaaggatggggaacgggctaccgcactggcgggaaccaaaccatatatggcccctgagatatttcacagctttgtaaacgggggaacaggatactctttcgaagttgactggtggtcggtgggcgtgatggcatacgaactgctgagaggctggagaccatatgacatacactcttccaacgccgtcgaaagtctggtgcagctgttcagtactgtgtccgtgcagtatgtgcctacttggtccaaggagatggtcgcactgttgaggaagctgctgactgtgaatccggagcatcgtctttcctcactccaggacgtgcaggctgcaccagcactagctggcgtgctctgggaccatctcagcgagaaaagggtcgaacctggcttcgtccctaacaagggcagactccactgcgatcccactttcgagctagaagagatgatcctggaaagccgccccctgcataaaaagaaaaagcgcctcgcgaagaataagagtagggacaacagcagagactcaagccagtctgagaacgactacctgcaggactgtctggacgcaatccagcaggattttgtcatcttcaaccgcgagaaactgaaacgaagccaggaccttccccgcgaacccctcccagctcctgagtctagagacgctgcagagcctgtggaggatgaggctgagaggtcagccctccccatgtgcggtccgatttgcccgtcagctggaagtggctag

SEQ ID NO: 50895 - DNA, 411 bp, Artificial Sequence
  Description of Artificial Sequence: Synthetic coding sequence
tgagcccggggcctggagggcgtggtggtggacggccaggtggagacagcccgggtgtggcgcggcgatcgacctggaacagaaggcaaggaggagagcggaatgcttagcgccgtctggggagcaggtggccccggagccggaggggctgcaagggggcagccctctcggaaagagctattactcagacaccacctctggtctgggcccaggtgcctctcttttccacttgggtcactgccggccagtctgctgggtctaccgggtgccacttcccatcgttcttgcctgagtccgaaccttgcttccggtctcgctgcacggggtacacagacgcaatcagtgctgtttggcgaagtacgattgccattagatggcggggtcagaggggcacgcaaaagacgtagttag

SEQ ID NO: 50896 - DNA, 942 bp, Artificial Sequence
  Description of Artificial Sequence: Synthetic coding sequence
atgcccggcctgctgctgtgcgagcccaccgagctgtacaacatcttgaatcaggctacaaagctcagcagactgacagatccaaactacctctgcctgctcgatgtgcgaagtaagtgggagtatgatgaatcacatgtgatcaccgccctcagagtgaagaagaagaataatgagtacttgcttcccgaatccgttgatctggaatgcgtaaagtactgtgtggtgtacgataataacagctccacattggagatattgctaaaggatgacgacgatgactccgattctgacggggacggcaaggacctggtgcctcaggctgctattgagtacgggcgcatcctcacacggctaacacaccatccagtatacatactgaaaggaggatacgaacgattttccggaacttaccacttcttaaggacccaaaaaattatctggatgccacaggagctcgatgcctttcagccatatcctattgaaattgtacctgggaaggtatttgtcgggaattttagtcaggcatgcgatcccaaaatacagaaagatctgaagattaaagcacacgtcaatgtctctatggacaccggacctttctttgccggcgacgcagacaagttactgcacatcaggattgaagactcacccgaggctcagatacttccatttctgcgacacatgtgtcatttcattgagatacaccatcacttaggatctgtgatactcatcttcagcacccagggcatttcacgctcatgcgccgccattatcgcatatctgatgcattccaatgagcagacgctgcagagatcctgggcatatgtgaaaaaatgcaagaataatatgtgtccaaatagaggcctggtatcccagctgctcgaatgggagaaaaccatcttgggcgactcaataaccaacatcatggatcccttgtactag

SEQ ID NO: 50897 - DNA, 654 bp, Artificial Sequence
  Description of Artificial Sequence: Synthetic coding sequence
atgcccggcctgctgctgtgcgagcccaccgagctgtacaacatcttaaaccaagctactaagctgagtcgacttaccgaccccaattacttgtgccttctcgatgtgcgaagtaagtgggagtacgatgaatctcatgtaatcaccgctttgcgcgtaaaaaaagaactggatgccttccagccctatcctatagagatcgtgccagggaaggtgtttgtgggaaacttctctcaggcctgtgatcccaagatccagaaggatttgaagattaaagcccatgtaaacgtttcaatggatactgggcccttttttgcgggggacgccgataaactcctccacataaggatcgaggattccccggaggctcagatactccctttcctacggcatatgtgccattttattgaaatccaccatcatctcggatcggtgattctgatcttcagcacacagggaatcagcagatcatgtgcggccatcatcgcgtacctgatgcatagtaatgagcagactcttcagagatcatgggcatatgtgaaaaagtgtaagaacaatatgtgtccaaacaggggcctggtttcgcagcttctcgagtgggagaaaacaatcctgggagactcaatcactaacattatggaccctctgtactag

SEQ ID NO: 50898 - DNA, 942 bp, Artificial Sequence
  Description of Artificial Sequence: Synthetic coding sequence
atgcccggcctgctgctgtgcgagcccaccgagctgtacaacatcctgaatcaggccactaagctgagtcgtttaactgaccctaattatctctgcctgctcgatgtgcggtccaaatgggaatatgatgaatcacacgtcataaccgctttaagagttaagaagaaaaacaacgaatatctgctgcctgagagtgttgatttggaatgtgttaaatattgcgtcgtgtacgataacaattcctccacactcgaaatcttactcaaagatgatgatgatgacagcgactccgacggagacggaaaggacctcgtgccccaggccgccatcgagtatggaagaatcctgaccaggctgacccatcaccccgtgtatatattgaaaggcgggtacgaacgattctccgggacctatcattttttaaggacacagaagatcatttggatgccccaagagctggacgcctttcagccctacccaatcgaaatcgtcccaggtaaagtgttcgtgggcaatttttctcaggcctgcgatcccaagatccagaaagacctcaagattaaagcccacgtgaatgtctccatggacacggggcccttctttgcaggcgatgctgacaagcttctgcacatccgaattgaagattcaccggaggcacaaatcttgccttttctgcggcacatgtgtcatttcatcgagattcaccaccatctgggctccgtcatcctgatctttagtacacagggaatttctcggtcctgcgctgccattatcgcctacttaatgcattctaacgagcagactctccagagaagctgggcatatgtcaagaagtgcaaaaacaatatgtgccctaatagggggctggtctcccagttgctggaatgggaaaagacaatcctgggtgatagcatcactaacattatggaccccttatattag

SEQ ID NO: 50899 - DNA, 339 bp, Artificial Sequence
  Description of Artificial Sequence: Synthetic coding sequence
atgcccggcctgctgctgtgcgagcccaccgagctgtacaacatcctgaaccaggccactaagctctcaagactgactgacccaaattatctgtgcttactggatgtgaggagtaagtgggaatatgatgaatctcacgtgattaccgctcttagagttaaaaagaaaaacaacgaatatctccttcctgaatctgtggacttagaatgtgtgaagtactgcgtcgtgtacgacaataacagttcaaccctggaaatcttgcttaaggatgacgacgatgacagcgattccgatggcgatgggaagggcaccgggtgtatcagcgccattccgcactag

SEQ ID NO: 50900 - DNA, 957 bp, Artificial Sequence
  Description of Artificial Sequence: Synthetic coding sequence
atgcccggcctgctgctgtgcgagcccaccgagctgtacaacatccttaatcaagcgacaaaactcagcaggctaactgacccaaactacctctgcctgctcgacgtgagatccaagtgggagtacgatgaaagccatgtcattacagccttgcgcgtcaagaaaaaaaacaacgagtatctactgcctgagtccgtggacctggagtgcgttaagtactgcgtcgtttatgataacaatagcagcacccttgagattcttctgaaggacgatgacgatgattcagacagcgacggtgatgggaaggacttagtgccgcaggccgctattgagtacggacggatccttacccgcttgactcaccaccccgtttatatcttaaagggcggttacgagcgcttctccggcacctaccattttcttcggacccagaagatcatctggatgcctcaggagcttgatgcatttcagccatatccgatcgaaatcgtgcccggcaaagtattcgtgggaaacttttcccaggcgtgcgatcccaagattcaaaaagatctcaaaattaaagctcatgtcaatgtgtctatggataccggacctttctttgccggtgatgctgataagcttctgcacatccgaattgaggatagccccgaggcacaaattctgccttttctccgccacatgtgtcattttatagaagtgctgggactatgccaggaggttcagaaacagcatgtgagcaagtcaggcatcggagagccagcagctggtatgggcgaggattatccctggcgatttcaccacaagcaccatggcagcgctcttctgatcttcagcgaagcacataggcgggtcctgaagtcccttacatggggccactttgtagggggcggacctgagtgcgtgtatcccggcctgagcgggaggagaagacctttactgcctgagtcactctag

SEQ ID NO: 50901 - DNA, 942 bp, Artificial Sequence
  Description of Artificial Sequence: Synthetic coding sequence
atgcccggcctgctgctgtgcgagcccaccgagctgtacaacatcttgaatcaagcaactaagctctccagattgacggaccccaactacctctgcctgttggatgtccgctccaaatgggaatatgatgagtcccatgtcatcacagccctccgagtcaaaaaaaagaataatgaatacctgctgcctgaaagcgtcgacctagaatgtgtaaaatactgcgtagtttatgataacaactcgtctaccctggagatcctcctgaaagacgatgatgacgattcggactctgacggtgacgggaaagatctcgtgcctcaagctgccattgaatatggcagaatcctaacacgtctgacccatcacccggtctatatcttaaaaggcggatacgaacggttttcagggacataccacttccttcggacacagaaaattatctggatgccccaggagttagatgcgtttcagccgtatcctatcgagatcgtgccaggcaaggtattcgtcggcaacttctcccaggcatgcgaccctaaaatccagaaagacctgaagatcaaggcccacgtgaatgtgtctatggatactggtccgttcttcgctggggatgcggataagcttctgcatatccgaatcgaggactctcccgaggctcagatactgcctttcctgcggcacatgtgccacttcatagaaatacatcatcatcttgggtccgtgattcttattttctctacacaaggcatctcacgcagttgcgctgcaatcatcgcatacctgatgcactctaatgagcaaacattgcaacgatcctgggcctatgttaaaaagtgtaagaacaacatgtgtcccaacaggggcctggtgtcccaattactggagtgggagaaaactattctcggcgactctatcacaaacatcatggatcccctgtactag

SEQ ID NO: 50902 - DNA, 942 bp, Artificial Sequence
  Description of Artificial Sequence: Synthetic coding sequence
atgcccggcctgctgctgtgcgagcccaccgagctgtacaacatcttgaatcaagccaccaaactcagcaggcttacagaccctaactacctctgcctgctggatgtgcgctcaaaatgggagtacgacgaatcacatgtcatcaccgcccttcgcgtaaagaaaaagaataacgaatacttgctgccagaatctgtcgatctggagtgtgtcaaatattgcgtagtctacgataacaattcctccaccctcgaaattcttctaaaagacgacgacgatgacagcgattccgacggagacggcaaggatctggtgccacaagctgctattgaatacgggcggattttaactaggctgacacatcaccccgtgtatatcctcaaggggggttacgaacgattttccgggacctatcatttcttgcgcacgcaaaaaatcatctggatgccacaagagctcgatgcgttccaaccatatcccatcgaaatagttcctggtaaagtcttcgtggggaatttttcacaggcctgcgacccaaaaatccaaaaggacttaaagatcaaggctcatgtgaatgtgagcatggacaccggtcctttctttgctggagatgccgataaattattacacatcagaatcgaggactcgcccgaagctcagatattgccctttttacgccatatgtgccacttcatcgagattcaccatcacttgggttccgtgattctcatcttcagcacccaagggattagccgctcctgtgccgctataatcgcctatctcatgcactctaatgaacaaacactgcaacggtcatgggcttatgtaaagaagtgcaagaataacatgtgtccaaatcggggtttggtttcccagttactcgagtgggagaagactatccttggagattccataacaaatataatggacccgttgtactag

SEQ ID NO: 50903 - DNA, 1311 bp, Artificial Sequence
  Description of Artificial Sequence: Synthetic coding sequence
atgaccgccgtgtacatgaacggcggcggcctggtgaacccccactatgctcgatgggatcgtcgggatagtgtggaatcaggctgccagacagagagcagcaaggagggggaagaaggccagccacgccaactcacccccttcgagaagcttacgcaagacatgagccaggatgaaaaggtggtgagggaaattactctcggcaaacgaatcgggttttatcgaattcgaggcgaaatcgggtcagggaacttttcgcaagtgaaactgggaatccattcacttactaaagaaaaggtggccatcaagatactagacaaaacaaagctcgatcaaaagacgcagcgactgctctcacgagagatcagcagcatggaaaagctgcatcatccaaatataattaggctgtatgaggttgtggagaccctttctaagctccatttggtcatggaatacgctggaggcggcgagttgtttgggaaaatctctaccgaaggcaagctcagcgagccagagtcgaagctgatatttagccaaattgtcagcgctgttaagcacatgcatgaaaaccagatcatccatcgcgacttaaaggccgaaaacgttttctacaccagtaacacttgcgtgaaggtgggtgatttcggattctcgactgtaagcaagaagggcgagatgctaaatactttttgcggctccccaccctacgccgcaccggagctctttcgcgatgagcactatatcggcatctacgtcgacatatgggcgttgggcgtattgttgtatttcatggtgaccggtacaatgccttttcgcgccgagactgttgctaaactcaaaaaatcgattctggaggggacatattcagtccccccacatgtgtctgagccatgtcacagactcattcggggcgttctgcagcagatccccactgagaggtatggcatcgactgcatcatgaacgatgaatggatgcaaggcgtgccttatcctaccccactggaacccttccagcttgatcctaaacacctttcagagacgagcactctgaaagaagaggagaacgaagtcaaaagtacactcgaacatttaggaataactgaagaacatattagaaacaaccagggtcgggacgctcgctcatctattacaggcgtttatagaatcatacttcaccgtgttcagcgcaaaaaagcgctggagtccgttccagtcatgatgctccccgatccgaaagagcgggacctgaaaaaggggtctagagtctaccggggaattcgacacacctcaaaattctgcagcatcctttag

SEQ ID NO: 50904 - DNA, 1311 bp, Artificial Sequence
  Description of Artificial Sequence: Synthetic coding sequence
atgaccgccgtgtacatgaacggcggcggcctggtgaacccccactatgccagatgggataggcgtgatagtgtggagagtggttgccagaccgagtcatcaaaggagggagaggaaggccagccacgccagctcacgcccttcgagaagctgactcaggacatgtcacaagatgagaaagtggtgcgggaaattaccttgggaaaacgaatcggattctatcggatccgtggggaaatcggctcgggcaacttcagccaagtgaagctggggatccactcattgactaaggaaaaagtggccattaaaatcctggataagaccaagctggatcaaaagacgcagaggttactgtctagggagatcagttctatggagaaactccaccacccgaatataatcaggctctacgaagttgtggagactctatcaaaactccacttggtgatggaatacgctggaggcggcgaattgtttgggaagatatctactgaaggaaagctcagtgaaccagagtctaaattaatcttctctcagatcgtgtccgccgtgaagcatatgcacgaaaaccagataatacatcgtgacttaaaggccgagaatgtgttctacacttctaacacctgtgttaaggtaggcgactttggttttagcaccgtgagcaagaaaggtgagatgttgaacactttctgtggaagcccaccatatgctgcaccggaactgtttagggatgaacattatatcggcatctacgtcgatatctgggctctaggcgtgcttctttattttatggttactggcactatgccattcagagccgagaccgttgcaaaactaaagaagagtatcctcgaaggcacttattcagtacccccgcacgttagcgaaccatgccaccggctgatcaggggggttctccagcaaatcccaactgaaaggtatggaatcgactgtatcatgaatgacgagtggatgcagggggttccataccccacacccttggaaccctttcaactggacccaaagcatctgagcgagacatcaacactgaaagaggaggagaacgaggtgaagtctacactggaacacctggggataaccgaggagcatatccggaacaaccaaggcagagacgccagatcgagtatcacgggcgtgtaccgcatcatcctgcatcgggtccagcggaagaaggccctggagtccgtccccgtgatgatgctgccagatccaaaagagagggatttaaaaaagggctcccgcgtgtatcgcggtattcgtcatacgagtaagttctgctctatactgtag

SEQ ID NO: 50905 - DNA, 1140 bp, Artificial Sequence
  Description of Artificial Sequence: Synthetic coding sequence
atggagcagctgagcagcgccaacacccggttcgccctggacctgttcctcgccctgtctgagaataatccggctggcaacatctttatcagtccattttccatcagcagcgccatggccatggtgttcttaggaacccgcggaaacacagctgcacagctttcaaaaacattccactttaatactgtggaagaggtccacagtcgctttcagagcttaaatgccgatatcaataaacgaggtgctagctatatactgaaactggcaaacaggctgtatggagagaaaacatacaatttcctgcccgagtttcttgtatccacccagaaaacatatggagctgaccttgcctctgtcgatttccagcacgcctctgaagatgcaaggaagaccattaatcagtgggtgaaggggcagacggaagggaagattcctgagctcctcgcttcaggaatggtggacaatatgaccaagctcgttctggtgaatgctatttatttcaagggcaactggaaggacaaattcatgaaagaagcaacgactaacgcccctttcaggctgaataaaaaggatcgcaaaactgtgaagatgatgtatcagaaaaagaaattcgcctatggctacatcgaggacctaaagtgcagggtgctggagctcccatatcagggagaagagctttctatggtgattctgctgccggacgatattgaagatgaatcaacaggtctgaagaaaatcgaggaacagttaacactggaaaagctgcacgaatggactaaacccgagaacctggacttcatcgaggtcaatgtctcccttccacgcttcaagctggaagagtcctacactttaaattcagatctggcacgccttggagtccaagacttattcaactcttccaaagccgacctgtctgggatgtccggagccagagatatttttatctcaaagatagttcacaagagttttgtggaagtgaacgaggaaggaaccgaggctgccgctgccacagcagggatagccactttttgcatgctcatgcccgaggaaaactttacagccgaccacccctttctgtttttcatcaggcataactcaagtgggtcaattctgttccttgggaggttctcctctccatag

SEQ ID NO: 50906 - DNA, 687 bp, Artificial Sequence
  Description of Artificial Sequence: Synthetic coding sequence
atggtggacaacatgaccaagctggtgctggtgaacgccatctacttcaaaggcaactggaaggacaaattcatgaaagaggccaccaccaatgctccctttcggttgaataaaaaggatagaaagacggtgaaaatgatgtaccagaagaagaagtttgcctacggctacatcgaggatctcaaatgtagggtcctcgaactgccttatcagggcgaggagctctcaatggttatcctgttgccagatgatatagaagacgagtccaccggactgaaaaagattgaagaacagctgaccctcgaaaagctgcacgaatggactaagcccgaaaacctggatttcattgaagtgaacgtgtcgctgccaaggtttaaactggaagagagctacaccctgaattcagacctggcgcggctgggagtgcaggacttgtttaactcaagcaaggcagatctatccggcatgagcggcgccagggacatcttcatttcgaaaattgttcataagagttttgtggaagttaacgaggaagggacagaggccgccgctgccactgccggcatcgctactttttgcatgctaatgcctgaagagaactttacggcagaccacccgtttctattttttatccggcacaattccagtggatcgatcctctttcttggccgcttctcaagcccatag

SEQ ID NO: 50907 - DNA, 1026 bp, Artificial Sequence
  Description of Artificial Sequence: Synthetic coding sequence
atggccatggtgttcctgggcacccggggcaacaccgccgcccagttgagcaaaacttttcactttaacacggttgaggaagtgcactcaagattccagtcactcaatgccgacattaataaaaggggagccagttacatcctgaaactggccaatcggctgtacggtgagaaaacttacaacttcctgcccgaattccttgtctctacgcagaaaacttatggagccgacctcgcctccgtagactttcagcacgcaagcgaggacgctagaaagacaatcaatcagtgggtcaagggccagaccgagggcaaaatccctgagttgctggcctctggcatggtggataatatgacaaaactggtcctagtcaatgccatctacttcaagggaaattggaaggataaattcatgaaagaagcgaccacgaacgcaccatttaggcttaataagaaggatcgaaaaacagtgaagatgatgtatcaaaagaagaagttcgcatatggttatattgaggatctgaagtgcagggtgctggagctaccataccaaggtgaagagctttccatggtcatcctgttaccagacgacattgaagatgagtccacaggcttaaagaaaattgaggaacagctgactttagaaaaacttcacgaatggaccaaaccggaaaatttggactttatcgaggtgaacgtttcactgccccgattcaagctcgaggagtcttacactctgaacagtgatttagcccgtctgggagtgcaggatctcttcaacagcagcaaagcggatcttagcggcatgtccggagcacgggatattttcattagcaagatcgtgcataagtcgttcgtcgaggtgaacgaggaaggtactgaggctgcggctgcaacagctggcatagctaccttctgtatgctaatgccagaagaaaatttcacagctgatcatcccttcctattctttatccggcataattcgagtggctctatactctttctcggtagattctcctccccgtag

SEQ ID NO: 50908 - DNA, 654 bp, Artificial Sequence
  Description of Artificial Sequence: Synthetic coding sequence
atggtgctggtgaacgccatctacttcaagggccagtggcagaacaaattccaggtccgagagacagtaaagagccccttccagctttcagagggcaagaacgttactgttgaaatgatgtatcagattggcacttttaagcttgctttcgttaaagagccacagatgcaggttctagaactcccctacgtaaacaacaagctgtccatgatcatactgctgccggtgggcatcgcaaatctcaaacagatcgaaaaacaactcaactccgggactttccacgagtggacctccagcagcaacatgatggaacgagaagtcgaagtacacctgccacgctttaagttggagaccaaatatgaactgaattctcttctgaagtcgctcggcgtgaccgatttatttaaccaagttaaggcagacttgtcagggatgtccccaacgaagggcttgtacctatctaaagcgatccacaaatcatacctggatgtgagcgaggaaggcaccgaagcagccgcagccactggagactcgatagccgttaaaagtctgcccatgcgagctcaatttaaggctaaccatccatttctatttttcatcagacacacacatactaataccatcctattttgtggaaaattggcatccccctag

SEQ ID NO: 50909 - DNA, 573 bp, Artificial Sequence
  Description of Artificial Sequence: Synthetic coding sequence
atgggcagcctgagcaccgccaacgtggagttctgcctggacgtgttcaaggaactcaactcaaacaatatcggtgataacatttttttcagtagtcttagcttattgtatgccctgtcaatggtgctcctgggggccaggggggagactgaagaacagctagagaagatcgaaaagcagctgaattcaggaaccttccacgagtggacctcaagttctaatatgatggagcgtgaagtcgaagtacatctgcctcggtttaaacttgagaccaaatatgaattaaacagtttactgaagtcgctgggcgttacagacttattcaatcaagtcaaggccgacctcagtggcatgagccctactaagggactttacctgagtaaggcaatacacaaatcgtatcttgacgtttcggaagaggggacagaagccgccgctgctaccggggacagcattgccgtcaagtccttaccgatgcgggcccaattcaaggctaaccacccgttcctgttttttattcgtcatacacacacgaataccatccttttctgtggcaagcttgccagcccttag

SEQ ID NO: 50910 - DNA, 1179 bp, Artificial Sequence
  Description of Artificial Sequence: Synthetic coding sequence
atgggcagcctgagcaccgccaacgtggagttctgcctggacgtgtttaaggagctgaactctaataacatcggagacaatatttttttttcatccctctctttgttgtatgcgctgtctatggtgctgctcggcgcccgtggcgaaaccgaggagcaactggagaaagtcctccactttagccatacggtggattcactcaaaccaggctttaaagactcccctaagtgtagccaggcaggtcggattcacagcgagtttggggtcgaattcagccagatcaaccaacctgactctaattgtacgctatcaatcgccaatcggctctacggcaccaagaccatggctttccaccaacagtatcttagttgttccgagaagtggtatcaggcccgcttacagactgtggacttcgagcagtcaacagaggagacgcgcaagacaattaacgcctgggtggaaaacaagaccaacggcaaggtggctaacctcttcggcaagagcacgatcgatccctcgagtgtgatggttctggtgaacgcaatctacttcaaaggccaatggcagaacaagttccaagttagggaaacagtaaagtcccctttccaattatcagagggaaagaacgtgaccgttgagatgatgtatcaaatcggcacttttaagctggcatttgtgaaggagccccagatgcaagtcctcgagctgccctacgttaataataagcttagcatgatcattctgctgcctgtaggcatcgctaatttaaaacaaatcgaaaagcaattaaacagcggtacattccatgagtggacatctagcagcaatatgatggaacgggaagtggaggttcatctccctcgctttaagcttgaaacaaaatacgagttaaatagtttgctgaagtccctaggagtaacggatttgttcaatcaggttaaggcagatctgagcggcatgtcccccacaaaaggtctgtatctgtccaaggccatacataaaagttatctggacgtatccgaggagggtaccgaggccgcggctgctactggcgactccattgctgtcaagtctctgcctatgagggcgcaatttaaggccaatcacccgttcctattttttattagacacacacacactaatacaattctgttttgtggcaagctcgcctcgccatag

SEQ ID NO: 50911 - DNA, 1071 bp, Artificial Sequence
  Description of Artificial Sequence: Synthetic coding sequence
atgaccctggtgctgagcatgaaccggttctgcgagcccatcgtgtcggaaggcgcagccgaaattgctggataccagacactctgggaagcagacagctacggaggcccatctccccccggccccgcgcaggctcctctgcagggcgacaggggggcgggacctcctctcgcaggttcccactatcggggcatctccaatcctatcactacttctaagatcacatatttcaagaggaaatacgtggaggaggaggattttcaccccccattatcttcctgctctcataagacaatttcaattttcgaagagcgggcacacattttgtacatgagcctggagaagctgaagtttatcgacgaccccgaggtgtatcttaggcggtccgttctgatcaacaatcttatgaaacggatccatggggaaattatcatgcagaacaattggtgcttccctgcctgctccttcaacggcactagtgcacaagagtggttcatggcccaggactgtccatataggaagcgacctagaatggctaaggaggaatgtgagaagtttcatgcctgctgcttttatcaggaatgcggcggccactacctcaacctccccctgtccgtgaacgccaatgtcggctcagcctccactgcagcttcctctccatccgcctccagctctagctcctcctcttcgagtagtccaccgctaccactgccctcttgctcccgccaggtggactttgacgtggggagcgcaagtatttacaagtccgacggacagatccctgccaacgaaatcttcgtgacaaatgtaagaagtctgggagtgcaggaaaaagcgaaactgaatgatgaaaaagccaatgatgacacgaaccgggacggcggtcccctgtcccacgagcccgtgggcaacgatctggctttcgagtgcaaaggtcagttttacgattacttcgagactggctataatgaaagaaacaatgtgaatgaatcttggaagaaatcccttaggaaaaaagaggcaagcccccccagcaataaactctgttgcagcaaaggaagcaaaatttag

SEQ ID NO: 50912 - DNA, 447 bp, Artificial Sequence
  Description of Artificial Sequence: Synthetic coding sequence
atgcaggaggtgggcgtgggcctgtaccccagcatcagcctgctgaatcattcctgtgaccctaattgtagtatcgtgttcaatggaccgcatctgctcctcagggcggttagagatatcgaggtgggcgaggagctcactatatgttatctggacatgttaatgacatccgaggaacggagaaagcagctcagggaccaatactgctttgagtgcgactgcttccggtgccaaactcaggataaagatgcagatatgctgacgggcgacgagcaggtctggaaggaagtgcaagagtctctaaaaaagatcgaagaactcaaggcgcattggaagtgggagcaggttctggccatgtgtcaagccattatcagctctaactccgagaggctccccgacatcaacatctaccagcttaaggttctggattgcgctatggatgcatag

SEQ ID NO: 50913 - DNA, 396 bp, Artificial Sequence
  Description of Artificial Sequence: Synthetic coding sequence
atgcggtgcagccagtgccgggtggccaagtactgcagcgccaagtgccagaagaaagcgtggcctgaccacaagagagagtgcaagtgtctgaaaagttgtaaaccgcgctatccaccagattctgtgagactgctgggcagagtcgttttcaaattgatggacggggcaccgtccgaaagcgaaaagctgtattccttttacgatctggagtctaacatcaacaaacttacagaggacaaaaaggaaggcctcaggcagctagtgatgaccttccaacactttatgcgcgaagaaatccaggacgcttctcaactgcctcccgccttcgacctgttcgaggcgttcgccaaggtgatctgcaacagcttcactatctgcaacgccgaaatgtag

SEQ ID NO: 50914 - DNA, 225 bp, Artificial Sequence
  Description of Artificial Sequence: Synthetic coding sequence
atgcggtgcagccagtgccgggtggccaagtactgcagcgccaagtgtcagaagaaggcctggccagaccacaagagagagtgcaaatgccttaaatcttgcaagccacggtacccgcctgacagcgtccgcctactcgggcgagtcgttttcaagctcatggatggcgccccttcagaaagtgagaaactatactctttttacgatctggaatccaatatatag

SEQ ID NO: 50915 - DNA, 1110 bp, Artificial Sequence
  Description of Artificial Sequence: Synthetic coding sequence
atgcggtgcagccagtgccgggtggccaagtactgcagcgccaagtgccagaaaaaagcttggcccgaccacaaaagggagtgcaaatgtcttaagtcctgcaaaccgaggtatccccctgatagtgtacggttgttggggcgggtggtgtttaaactcatggacggggctcctagcgaatctgagaagttgtactcattctatgatctggagtctaatatcaacaagctgaccgaagataagaaagaagggctgcgccaacttgtgatgacgtttcagcacttcatgagggaagagatacaggacgccagtcagttacccccagctttcgacctattcgaggcattcgccaaagtgatttgtaattccttcacgatttgcaacgccgagatgcaagaggtgggcgtgggcttatatccaagcatatctctgttaaatcatagctgcgacccgaattgctcaatcgtctttaatggtccccaccttctcctgcgcgccgttcgggacatcgaggtcggggaagaattgacgatttgctatctggacatgttgatgacaagtgaggaacgccgcaaacagcttcgcgaccaatactgcttcgagtgcgactgcttccggtgccaaactcaggataaagacgccgacatgctcacaggagatgaacaagtctggaaagaagtccaagaatccctgaagaaaattgaggagctgaaagcacattggaaatgggaacaagttctcgctatgtgtcaggcaatcatcagctcaaatagtgagaggcttccggacataaacatctatcagctcaaggtgctcgactgtgccatggatgcttgtattaacctcggcctcttagaagaagcgctcttctatggaacccgtaccatggaaccatataggatattcttcccaggttcgcacccagttcgtggagtgcaagtcatgaaagttggtaagctccagttacatcaggggatgtttccccaagccatgaagaacttgcgactcgcttttgatattatgagagtgacccacgggcgagaacattctctgatcgaggatctgatcctgctgctggaggagtgtgatgctaacattagagcaagctag

SEQ ID NO: 50916 - DNA, 1110 bp, Artificial Sequence
  Description of Artificial Sequence: Synthetic coding sequence
atgcggtgcagccagtgccgggtggccaagtactgcagcgccaagtgccagaagaaagcttggcctgatcataagcgcgagtgcaagtgccttaagagctgtaaaccaaggtatccccctgactccgtgaggttgctcgggcgggttgtgtttaagttgatggacggagcgccaagtgaaagcgagaagctgtatagtttctatgatctggagtccaatataaacaagctgacggaggataagaaagaagggctaaggcagctagtaatgactttccagcactttatgcgcgaagagatccaggatgcgagtcagctgccaccagcattcgacctgtttgaagctttcgctaaagttatctgtaactcttttacaatttgtaacgctgagatgcaggaggtcggggtgggactatatcctagtatctcgctgcttaaccactcttgtgatccgaactgcagcatcgtttttaatggaccccacctgctgctcagagcagtgagagatatcgaagttggagaggaactgaccatatgctacctcgatatgctgatgacaagtgaagaacggcgtaagcaactgcgtgaccagtactgttttgagtgcgattgtttccggtgccagacacaggacaaagacgcggacatgctgactggggacgaacaggtttggaaggaagttcaagagtccttgaagaaaatagaagagctgaaggcccattggaagtgggagcaggtgctggctatgtgccaggccattatctcctcaaattcagagcggcttcccgacataaacatctaccagctcaaagttctcgattgtgcgatggacgcgtgcatcaacctcggactattggaggaggccctcttttatggcacccggactatggagccataccgtatattctttcctgggtctcaccccgtgagaggggtacaggtgatgaaggtgggtaagcttcagttacatcagggaatgttccctcaggcgatgaagaacttaagactcgctttcgatattatgagagtgacccatgggcgcgagcactctttaatcgaagatctgattctcctgcttgaagaatgtgacgccaacatccgcgccagctag

SEQ ID NO: 50917 - DNA, 777 bp, Artificial Sequence
  Description of Artificial Sequence: Synthetic coding sequence
atggaggaggaccgggacaaggtgatctgcaacagcttcaccatctgtaatgccgaaatgcaagaagtgggtgtcggcctgtacccatcaatctctctcctgaaccattcttgtgaccccaactgctccatcgtgtttaacggcccccacttattgttaagggcggtgagggatattgaggttggcgaggagctgacaatctgctacctcgatatgctgatgacaagtgaggaacgcagaaagcagctaagagatcagtactgtttcgagtgcgactgctttcgttgtcaaacacaagataaagacgctgatatgctgactggcgatgagcaggtgtggaaggaagtgcaggaatccctcaaaaaaatagaggagcttaaagcccattggaagtgggagcaagttttagccatgtgccaagcaatcatcagtagcaattctgaacgactccctgatataaatatttatcagcttaaagtgttggattgcgctatggatgcctgtattaacctaggcctgctagaggaggcactgttttacggtaccagaacaatggaaccctatagaatatttttccctggctcccaccccgtgcgcggggtccaggtaatgaaggtggggaaattgcagcttcaccaagggatgttcccacaggccatgaagaatcttcggctggcttttgatataatgcgcgtgacacacggccgcgaacacagcctgatcgaagatctgatattgctactagaggagtgtgacgctaacatcagggcgagttag

SEQ ID NO: 50918 - DNA, 2415 bp, Artificial Sequence
  Description of Artificial Sequence: Synthetic coding sequence
atggacctgcccgtggacgagtggaagagctacctgctgcagaagtgggctagcctccccaccagtgtgcaagtaaccatcagcaccgccgaaaccctcagagatattttcctccattcaagttctttgttgcagcctgaggatgagctgtttctcaaaagactctcaaaaggctaccttgttggcaaagacagtgacgcgcctctcttttacagagaggagggcaacaagaaattccaggaaaaggattataccggtgcagcagtgctttattcaaagggcgtgtctcacagtcgacccaataccgaggacatgagtttatgccacgccaaccggtcggcagccttattccacctgggtcaatacgagacctgcctgaaggacatcaatagagctcaaacacacggctatccggagagactccagcctaagatcatgctacgcaaggctgagtgtctggttgctttgggacggctccaagaggccagtcagacaatatccgacctcgaacgaaacttcacggcgacccctgctctcgcggatgtacttcctcagacgctccagagaaatctgcaccgacttaagatgaagatgcaggagaaggactccctgactgaaagttttcccgctgcactggcaaagacccttgaggatgccgcgctgcgtgaagagaatgagcagttatccaacgcctctagctcaatcggcctctgcgtagacccgctgaagggacggtgcctagttgccaccaaggatatcctcccaggcgagctgctcgttcaagaggacgcctttgtttccgtgcttaaccctggcgagttgcccccacctcatcacggactggactcaaaatgggacactcgcgtgaccaacggcgatctatactgccaccggtgcctaaaacataccctggccacggttccatgtgatgggtgtagctacgcgaaatattgttcccaggagtgcctccagcaggcatgggagctgtatcatcgaacagaatgtccactcggggggcttttgctgacactgggagtattctgtcacatcgctctgcgcctgaccctgctagttgggttcgaggacgtgcgcaagatcattacaaaactctgcgacaagatcagtaataaggatatctgcctgcctgagtctaacaatcaggtcaagactctgaactatggccttggcgaatccgaaaaaaatgggaacattgttgaaacacctatccctggatgcgacatcaatggcaaatacgagaataattacaacgctgtatttaacctgctaccacacaccgagaaccactcccctgagcacaagttcctgtgcgccctgtgcgtcagcgcactgtgccggcagctggaagcggcttctctccaggctattcctacagagcgaatcgtcaattcctctcaattaaaggccgctgtcacaccagagctctgtcccgatgtgaccatttggggagtggccatgctgcgacacatgttacagcttcagtgtaacgcgcaggctatgaccacaatccagcatactggtccaaagggatcaattgtgacagatagtcgacaggtgagacttgcaacaggcatatttccagtaatttccctgctgaatcacagctgtagccccaacacctcagtctcttttatatcgaccgtggctactatacgcgcaagccaaagaattagaaagggccaggagatcctgcactgttatgggccgcacaaatcgaggatgggtgtggcagaacggcagcaaaaactgagatctcagtacttttttgattgcgcctgtcctgcctgtcagaccgaggctcacaggatggcggcaggcccacggtgggaggccttttgttgtaacagttgcggtgctcccatgcaaggggatgacgtgctgcgctgcggaagccgcagctgtgccgagtcagccgtgagtcgggaccatctggttagcagactgcaggacctccaacagcaagttagggtggctcagaagcttttgagggacggtgagttggagcgcgccgtacagcgcctcagtgggtgtcagcgggacgccgagagcttcctgtgggccgagcatgccgtagttggcgagatcgcagatggactcgctagagcctgtgccgcactaggagactggcagaagtcggctactcacctccagcgaagcctgtacgtggtagaggtacgccacgggccttcaagtgtggaaatggggcacgaactgttcaagctggcacaaatcttcttcaacggtttcgcagtgcccgaggccctctcaaccattcaaaaagccgaagaagtgttgtcactacactgtggcccttgggacgatgagattcaggagctgcagaagatgaagagctgccttttggacctgcctccaaccccggtgggaccagcactgtag

SEQ ID NO: 50919 - DNA, 1059 bp, Artificial Sequence
  Description of Artificial Sequence: Synthetic coding sequence
atggcccggggccggaagatgagcaagccccgggccgtggaggccgccgcggctgcggccgctgtcgctgctactgcacccgggccagaaatggtagaacggcgcggtcccggaaggccacggaccgatggagagaatgtcttcaccggacagtctaagatctacagttacatgagcccaaacaaatgctctgggatgcggttccctttgcaagaagaaaattccgtcacccatcatgaggtgaaatgccaaggtaagcctcttgctgggatctatagaaagcgagaggaaaaacgcaacgccgggaatgcagtgcgctccgccatgaagtctgaggagcagaaaatcaaggacgcgcgcaaaggcccgttagttccattccccaaccagaagagcgaagcggcggagccacctaagaccccacccagctcttgtgacagcactaacgcggccatcgctaagcaggcgctaaagaagccaatcaaaggtaaacaggcgcctcggaaaaaggcccaaggtaaaacccagcagaaccgcaagctcactgatttctatcctgttcgccgctccagtcgtaaatcgaaagccgagctccaatctgaagagagaaaacgtattgacgagcttattgaatccggcaaagaagaaggaatgaaaatagacctcattgacggaaaggggcggggtgtcattgctacgaagcagttctcccggggtgacttcgttgttgagtatcatggtgatctgatcgaaatcacagacgcgaagaaacgagaagccttatacgcccaggacccaagcactggctgttacatgtactactttcaatacctatccaagacgtattgcgtcgacgcaactagagagacgaatcgcttggggcgtctgattaaccattccaaatgtggtaactgccagaccaagctgcatgatattgatggcgtaccgcaccttatcctgattgccagcagagatatcgccgccggcgaagaattgctgtacgattacggagatcggagcaaagcttccatcgaggcacacccctggctgaaacattag

SEQ ID NO: 50920 - DNA, 1059 bp, Artificial Sequence
  Description of Artificial Sequence: Synthetic coding sequence
atggcccggggccggaagatgagcaagccccgggccgtggaggccgccgcggccgcggccgcagttgcggcgacggctcctggacctgagatggtggagcggagggggcctggtagaccacggaccgatggggagaatgtgttcaccggacaatcaaagatctattcttatatgagccctaacaagtgttcaggcatgagatttccactccaggaagagaatagcgttacacaccatgaggtcaaatgtcagggtaagcctctggccgggatttatcgcaagcgtgaagaaaaacggaacgctggcaacgcagtcaggagcgcaatgaaatcagaggagcaaaagatcaaagacgcccgtaagggccctctcgtaccttttcccaaccaaaaatccgaggcagcagagccccctaagaccccccctagctcttgcgatagcacaaacgctgcgattgcgaaacaggctttgaaaaaacccatcaaaggcaagcaggctcccaggaagaaagcccagggaaagacccagcaaaaccggaagctgaccgacttctatcctgtgagacgttcttccaggaaatcaaaggccgagctacagagcgaggagcggaagaggattgacgagcttattgaaagcgggaaggaggaaggaatgaaaatcgatttgatcgatggaaaaggccgcggcgtaatcgcaaccaagcagttcagtagaggcgactttgttgtagaatatcacggggatctcatcgagatcacagacgcgaagaaaagagaggccctgtacgcccaggacccaagcactggctgttatatgtattactttcagtacctttctaaaacatactgcgtcgacgctactcgggaaacaaatcgacttggcaggcttatcaaccacagcaagtgtgggaactgtcaaactaagctccatgatattgatggagtacctcacttgatcctcattgccagccgcgacatcgctgccggggaggagcttctatacgactatggcgaccggagcaaggctagcatcgaagcacatccttggctgaagcactag

SEQ ID NO: 50921 - DNA, 1323 bp, Artificial Sequence
  Description of Artificial Sequence: Synthetic coding sequence
atgcagaagggcaagggccggaccagccggatccggcggcggaagttgtgtggttcctccgaatcccgtggagtcaacgagtctcataagtcggagtttattgaactcaggaagtggcttaaggctcgaaaattccaggactccaacctcgcacccgcctgctttcctggaacaggacggggcttgatgagccagacctcgctgcaggagggacagatgatcattagcctgccggagagttgcttgctgaccaccgatacagtgattcggagctatttaggagcatacatcacgaagtggaaacccccaccatcaccgctgctggccttatgtacatttctcgtgtcagagaagcatgcaggccaccgatccttatggaagccttaccttgagattcttcctaaagcttacacttgccctgtgtgcttggagccggaggttgtcaatctgctgccaaagtcactgaaagcaaaggcggaagaacaaagagcccacgtgcaagagttttttgcatctagccgtgatttctttagttctctgcagcccctgtttgccgaggcggtggactctatatttagttacagcgctctgctgtgggcctggtgtacagtaaacaccagggcggtctatctccgcccaaggcagcgtgaatgtttatcggcggagcccgacacttgcgccctggccccttacctcgacctccttaaccacagcccccacgtgcaggtcaaggctgcattcaatgaggagacacacagttacgaaatccggaccactagccgatggcgaaagcacgaggaggttttcatttgttacggtccacacgataatcagaggctgttcctggagtatggctttgtctctgtgcataatcctcacgcttgcgtgtacgttagccgtgaaattctggttaagtacctccccagcacggacaaacagatggacaaaaaaatcagcatcctaaaggatcacggatacattgaaaacctgacattcggctgggatgggccaagctggcgacttcttacagccctgaagttactctgtttagaagcagagaagtttacctgttggaagaaagtgttgttaggtgaggtcatcagtgacaccaacgaaaaaacttccctcgatattgcccagaagatttgttattattttatcgaagagaccaatgccgtgctccaaaaagtgtcccatatgaaggacgaaaaggaagccctgattaatcagcttaccctggtcgaatcactgtggacagaggagctaaaaattctccgagctagtgctgagacattacacagtcttcagaccgcttttacctag

SEQ ID NO: 50922 - DNA, 852 bp, Artificial Sequence
  Description of Artificial Sequence: Synthetic coding sequence
atgaacgagagccacaagagcgagttcatcgagctgcggaagtggcttaaagctagaaaatttcaagatagtaatttagcacccgcatgctttcccgggaccggccgcggactgatgtctcagacttctcttcaggaggggcagatgattatttccctcccggagagctgcctgttaacaaccgatacagtgatcaggtcttaccttggggcgtacataacaaaatggaagccgccaccgagcccgctgcttgctctttgtacgtttttggtgtccgaaaagcatgccgggcataggtctctttggaagccatatctggaaatccttcctaaggcctacacatgccccgtgtgtctggagccagaggtcgttaacctcctgccaaaatctttgaaagctaaagccgaggagcagcgggcccatgtccaagagttcttcgcatcatctcgcgatttcttctcatcgctgcagcccctcttcgcagaagccgttgactctatattttcctactcggccctcctctgggcctggtgcacagttaacactagggcagtatacctccggcccagacagcgggagtgcttaagtgcggagcccgacacttgtgccctggccccttacctggacctgctcaaccactcccctcacgtccaggtgaaggctgcatttaacgaagaaactcattcctacgagattaggactacaagtcgttggcgcaagcacgaagaggtctttatttgttacgggccacatgacaaccagagactgttcctggagtatggatttgtctcagtacacaacccgcacgcttgtgtctatgtttcccggggttggaaccagttgtgttcttag

SEQ ID NO: 50923 - DNA, 852 bp, Artificial Sequence
  Description of Artificial Sequence: Synthetic coding sequence
atgaacgagagccacaagagcgagttcatcgagctgcggaagtggctgaaagcacggaagttccaggactctaacctcgctcccgcttgttttccagggacagggcggggtttgatgagccagacctccctgcaggagggccagatgataataagcctaccagagtcttgcctgctcacaactgacacagtgatcagaagctacttaggggcctacatcacaaagtggaagcctccccctagtcccctgctcgcgctgtgtaccttccttgtaagtgagaagcacgcagggcaccgatcgttgtggaaaccctacctggagatattacctaaggcatacacctgcccagtctgcttggagccggaggtcgtgaacctgctcccaaaatcgttaaaagcaaaggcagaagaacagcgcgcccatgtccaggagttttttgcctccagtcgcgatttcttcagttccttgcagccattatttgcggaggctgtggactccattttttcttacagcgccctcctatgggcctggtgcacagtaaacacacgcgctgtatatttgcgcccaagacagcgcgagtgccttagcgcggagccggacacttgcgcccttgctccctatcttgatttactcaatcactcaccccacgttcaggtgaaggccgctttcaacgaggaaacacattcgtatgaaattagaaccacctctcggtggcggaagcacgaggaggtctttatttgctatgggccgcatgacaatcagagacttttcttagagtatgggtttgtgtctgtgcacaacccccacgcatgcgtctacgtgtctcgcggctggaatcagttgtgtagctag

SEQ ID NO: 50924 - DNA, 924 bp, Artificial Sequence
  Description of Artificial Sequence: Synthetic coding sequence
atgcagaagggcaagggccggaccagccggatccggcggcggaagctgtgtggtagtagcgaaagtagaggggtgaacgagtcccacaagagcgagttcatagagctccgcaaatggctgaaggccaggaagtttcaggactctaacctggcacccgcttgcttccccggcactggtcgcggactcatgagtcagacctcacttcaagagggtcagatgatcatctcactgccagaaagttgtttgctgaccactgacacagtcataagaagttacttgggtgcttatatcaccaagtggaaacctccacccagtcctctactggctctgtgcaccttcctggtcagcgagaagcatgccggccaccggagtctctggaagccataccttgaaatccttcccaaagcctacacttgtccagtgtgccttgaacccgaggtagtaaacttgctgcctaagagcctgaaggcaaaggccgaagaacaacgggcccacgtccaggagttcttcgcctcttcccgagatttcttctcttctctgcaacccctctttgcagaagccgttgactcaatctttagttactctgctctgctgtgggcctggtgtaccgtgaacactcgcgcagtatacctgcggccacgacagagggaatgtctgagtgccgagccagatacttgcgctctggccccatacttagatctacttaatcactctccacatgtgcaggttaaggctgccttcaatgaggagacacatagttacgagatcagaacgacatcaaggtggcgcaagcacgaggaagttttcatttgctatggtccacacgataatcagagactcttcctggagtatggtttcgtgagtgttcataacccacacgcgtgtgtttacgtcagccgcgggtggaaccagctgtgcagctag

SEQ ID NO: 50925 - DNA, 924 bp, Artificial Sequence
  Description of Artificial Sequence: Synthetic coding sequence
atgcagaagggcaagggccggaccagccggatccggcggcggaagttgtgcggtagcagcgaatctcgaggggtaaacgaatctcataaatccgagtttatcgaactgcgcaagtggctaaaggcccggaaattccaagacagcaaccttgctccagcctgttttccgggaactgggagaggactgatgtctcagactagcttgcaggaggggcagatgataatatctctacccgaatcctgtctgctgaccaccgataccgttataaggagctacctcggagcgtatatcaccaaatggaagcctcctcccagccctctcctggccctgtgcacattcctcgtgtcagaaaaacatgctggccatcgaagcttatggaagccataccttgagattctccccaaggcttacacatgccccgtttgtctggagccagaagtggtgaatttgttgccaaaatcccttaaggccaaggctgaggagcaaagggctcacgtccaggaatttttcgcgtcctcacgagactttttctcttctttacagccactgtttgccgaagctgttgactctatattctcctactcagccctgctctgggcctggtgcacagttaacactcgcgcagtttacctgcggccaagacaaagggagtgcctgtcagccgaacccgatacatgtgcccttgctccctatctagacctactcaaccacagtccccatgtacaagtgaaagcggcttttaatgaagagacgcactcttacgaaattcggacaacctcccgctggagaaaacacgaagaagtctttatctgctatggaccccacgataaccagcgcctgttcctcgagtatggcttcgtaagcgtccacaatccccacgcctgcgtctatgtgagcaggggatggaaccagctctgcagctag

SEQ ID NO: 50926 - DNA, 1251 bp, Artificial Sequence
  Description of Artificial Sequence: Synthetic coding sequence
atgaacgagagccacaagagcgagttcatcgagctgcggaagtggctcaaggctagaaagttccaagattcaaacctggcccctgcctgttttcctggcaccgggcgtggtctcatgtcccagactagcctgcaggaggggcagatgatcatcagtctccccgagtcctgcttactcactacggacaccgtgatccggtcgtacctgggagcttacatcactaaatggaagccacctcctagcccactcttagcactctgcaccttccttgtgtccgaaaaacacgcgggacatcgaagcctgtggaaaccctatctggagatcctgcctaaggcctatacatgtcccgtctgcctggagcccgaagtcgtcaaccttttgccaaagagtctgaaggctaaagccgaggagcagagggcccacgtccaggagttcttcgcttcctctagagactttttttcatcactccagccgctgtttgcagaagctgtcgactcaatcttcagctattcagcgttgctgtgggcttggtgtaccgtaaatactagagcagtctacctgcgtcctcggcagcgagaatgtttgagtgccgaaccagatacatgtgcattggccccttatcttgacctgctgaaccacagcccccatgtacaggtgaaagctgcatttaatgaagagacccatagctacgaaatccgtaccacctcccgctggaggaagcatgaggaagtattcatctgttacggcccacatgacaaccaaagactctttcttgagtacgggtttgtttctgttcataacccccacgcgtgcgtttacgttagcagagagatccttgtgaagtatttgcctagcacagacaaacagatggacaaaaagatctctattcttaaggaccatgggtacattgagaacctgactttcgggtgggatggccccagctggcggcttctgacagcccttaaactactgtgcctagaggccgaaaaatttacctgctggaagaaggtcctcttgggcgaggtgatctccgacactaatgagaagacgtcgctggatattgcccaaaaaatatgttactattttatcgaggaaactaatgctgtgctccagaaggtctctcacatgaaggatgaaaaagaggcactaatcaatcagcttaccctagtggaaagtctatggacagaggaactgaagatcctgcgcgcatccgccgaaactttacatagcctacagactgcttttacatag

SEQ ID NO: 50927 - DNA, 1323 bp, Artificial Sequence
  Description of Artificial Sequence: Synthetic coding sequence
atgcagaagggcaagggccggaccagccggatccggcggcggaagctctgcgggtcatcggaatctcggggggtgaacgaaagccacaaatctgaattcatcgagttgcgcaagtggctgaaagcacgcaaattccaggattccaaccttgcccccgcttgtttccccggtacgggacgaggcctcatgtctcaaacgagtctacaggagggccagatgatcatcagcctgcctgagagctgcctgctcacaaccgacacagtaatcagaagctacctaggcgcctatattacaaagtggaagccacccccaagcccgctccttgcattatgcacctttctcgtgagcgagaagcacgctgggcaccgtagcctttggaaaccttatctggagattctaccaaaggcgtatacctgcccggtgtgtctggaacccgaggtggttaatctgctccccaaaagcctcaaggccaaagctgaagagcagcgagctcatgttcaagagttctttgcttcctcaagagactttttcagttcactgcagcctctgttcgcagaggccgttgacagcattttctcttattccgcccttctgtgggcctggtgtacagtcaacacaagggcggtctacctgcgccctcgacagagagagtgccttagtgctgagcccgatacctgcgcgctcgccccctaccttgacctgctgaatcattcaccccatgtgcaagtgaaggctgccttcaacgaagaaactcattcttatgagattcggacaacatctcggtggcgtaagcatgaggaggtcttcatctgttacggcccccatgataatcagagactgtttctcgaatatggttttgtctccgtccacaacccccatgcctgcgtatatgttagcagagagatcttggtcaagtacttgccatccactgacaagcagatggacaagaagatatccatcctcaaagaccacggttatatcgaaaatctgacttttgggtgggacgggccgagttggaggctgctgacagctctgaaactcctgtgtctcgaggcagaaaaattcacctgttggaaaaaggtgctcctcggggaagtcatctcagatactaacgaaaaaacgtctctcgacatcgcacaaaaaatttgttattatttcatagaggaaactaatgcagttttacaaaaagtatcccatatgaaagatgaaaaggaagcgctgattaaccagctgacactggtggaatcactatggaccgaggagctgaagatcctgagggcgtcggctgagactctccattctcttcaaactgcctttacttag

SEQ ID NO: 50928 - DNA, 696 bp, Artificial Sequence
  Description of Artificial Sequence: Synthetic coding sequence
atgcagaagggcaagggccggaccagccggatccggcggcggaagctgtgtggttcaagcgaatcaagaggagtgaatgaaagccataaatctgagtttattgaactgcgtaaatggctcaaagctcgaaagtttcaggactcgaacctcgcccctgcatgcttccccggtaccggtcgcggactgatgagccaaacttcactccaagaaggtcagatgataatttccctccccgagtcgtgcctgctgactaccgacactgtcatacgcagctatttgggggcctacattacaaagtggaagccacccccctccccgcttctggcactgtgtacgttccttgtgtccgagaaacatgctggccaccgttcactgtggaaaccttatttggagattctacccaaagcctatacctgccctgtgtgcctggaacccgaggtagtcaacctgctgccaaagagcctgaaggctaaggccgaagaacagcgagcccacgtgcaagaatttttcgcgagctccagggattttttctcgtctctgcagccactgttcgctgaggccgtggattccatattctcctactccgctctgctctgggcttggtgtacagtgaatactcgagcggtttatttgcgccccaggcagcgcgaatgtctatctgcagaaccagatacctgcgccctggctccttactag

SEQ ID NO: 50929 - DNA, 678 bp, Artificial Sequence
  Description of Artificial Sequence: Synthetic coding sequence
atgcagaagggcaagggccggaccagccggatccggcggcggaagctctgtggctcatctgaaagcaggggggtgaacgagagccacaagagcgaatttatcgaactgagaaaatggttgaaggctcgtaagttccaggactctaacctggcccctgcttgctttccaggtacaggtcgagggctgatgtcacagacatctctgcaagagggtcagatgattatttccctgcccgaatcgtgcctgctgacaaccgataccgtgatccgttcatatctgggtgcttatatcacaaaatggaaaccccctcctagcccccttctcgccctgtgtaccttcctggtgagcgagaagcacgcaggccacaggtcactctggaagccctacctggagatcctccccaaggcctacacctgccccgtgtgcctcgagccagaggtcgtgaacctgctgccgaaaagtctaaaagcaaaggccgaggagcagcgagcacacgttcaagagtttttcgcctcctcacgcgattttttttcgagtcttcagcctttattcgcggaggccgtggatagtatcttttcatattcagcacttctgtgggcctggtgtaccgtgaatacacgtgctgtgtaccttcggcctaggcagcgagaatgtctctctgctgaacctgacacctag

SEQ ID NO: 50930 - DNA, 213 bp, Artificial Sequence
  Description of Artificial Sequence: Synthetic coding sequence
atgaacgagagccacaagagcgagttcatcgagctgcggaagtggctgaaagctcgcaaattccaggatagtaaccttgccccagcatgcttcccaggtactggtagagggctgatgtcccagacctctttacaggagggtcagatgatcataagcctccccgagtcatgcctgctcaccactgataccgtgattcgtagttatttgggctag

SEQ ID NO: 50931 - DNA, 204 bp, Artificial Sequence
  Description of Artificial Sequence: Synthetic coding sequence
atgcagaagggcaagggccggaccagccggatccggcggcggaagttatgtggcagtagtgaaagtagaggtgtgaacgaaagccacaaaagcgaattcattgaattgcgaaagtggttaaaagcaaggaagtttcaggattccaatctggccccggcctgcttcccaggtactggccgtgggctgatgtctcagaccagctag

SEQ ID NO: 50932 - DNA, 375 bp, Artificial Sequence
  Description of Artificial Sequence: Synthetic coding sequence
atgaacgagagccacaagagcgagttcatcgagctgcggaagtggctgaaggcacgcaagttccaggacagcaatcttgctcccgcttgttttccaggcacaggccgagggctcatgtctcagacatcactccaggaaggccaaatgattatatcccttccagaaagctgcctcttgaccaccgacacagtcattaggagctacttgggagcgtacattactaaatggaagcctccaccaagccccctgctggcgctatgcacctttcttgtatccgaaaaacatgccggacaccgctcactgtggaaaccatatcttgaaatccttcctaaagcttatacatgcccggtgtgtctggaacccgaggtagtttag

SEQ ID NO: 50933 - DNA, 4035 bp, Artificial Sequence
  Description of Artificial Sequence: Synthetic coding sequence
atgagccggggcaaggtgatccggctgcaccggcggaagcaggacaatatttcaggcggggattcttcagcaacggaaagctgggatgaagaattaagtccctccaccgttctgtatactgccacccaacatactccaaccagtatcactctcactgtccgtcgcaccaagcccaagaaacgcaagaagtcccccgagaaagggagggccgccccaaagactaaaaagattaaagccttcagggagggcagtaggaaatcactgcgcatgaagaactccccatccgaagctcagaacctggacgagaacaccactgagggttgggagaacagaatccgtctttggacggatcagtatgaagaagctttcacaaaccagtattctgctgatgtccagaatgccttggaacagcatctgcactcaagcaaagagtttgtgggaaaaccaactattctggatactattaataagacggaattggcttgcaataatactgtgataggctcacagatgcagctgcaacttggcagagttacaagagtgcagaagcacagaaaaatcctgcgagccgcgagagacttggcccttgatactctcatcattgagtaccgaggaaaagtcatgcttagacagcagtttgaagtgaacggacacttcttcaagaagccgtatcccttcgtactgttttacagtaagtttaacggtgtagagatgtgtgtggacgcaaggaccttcggaaatgacgccaggttcattcgacgtagctgtaccccaaacgcggaagtgcgccatatgatcgcagatggcatgatccacctctgcatatatgctgtgtcagctattactaaggatgctgaggtgactattgcctttgactatgagtactctaattgtaattacaaggtggactgtgcttgccataaaggcaatcggaactgtcctattcaaaagcgaaaccccaatgccactgagttgccccttcttccccctcctccttcgctgccaacgatcggagctgagacaagacggaggaaggctcgaaggaaagagctggagatggaacagcagaacgaagcttcagaggagaataatgatcagcagtctcaggaagtgccagagaaggtcaccgtctcaagcgaccatgaagaggtcgacaatcccgaagagaaacctgaggaggaaaaagaggaagtgatagacgaccaggagaatctagctcacagccgacggacaagggaagacaggaaagtcgaggcaatcatgcatgcattcgaaaacctcgagaaaagaaaaaaacgccgggatcagccactagagcagtctaattctgacgtggagatcacaactacaaccagtgagacacccgtgggggaggaaaccaaaactgaggcccccgagtctgaggtgagcaacagcgtgagcaacgtgactatcccttccaccccgcagtctgttggcgttaatacccggcgctcttcgcaggctggagatattgccgccgagaagctcgtaccaaagccccccccagccaagcctagcaggcccaggcctaagagccgcatcagcaggtaccgcacttcctccgcacagagactgaaacgtcagaagcaggccaatgcccagcaggctgaattatctcaggccgctctcgaagagggcggaagcaattcactggtcaccccaacagaggcaggatcactagattcatcgggggaaaataggccactgacgggctccgatcctactgtcgtgagcattaccggttctcacgtaaatcgcgcagcgagtaagtaccccaagaccaagaagtacctggtcaccgaatggctcaatgataaagctgagaagcaggaatgtcctgtggagtgccctttacgtattaccaccgaccctacagtgcttgctactacactgaacatgctccccggtctcattcattccccactcatttgcactacacctaaacattatatcagattcggatccccattcatacctgagcgaagacggaggccccttctgccagatggaaccttctcttcctgcaaaaaacggtggataaaacaggctctggaggaaggaatgacacagacttccagcgtccctcaggagacaagaactcagcatttataccagtcaaacgagaacagctcctccagtagtatctgcaaggacaatgctgacctccttagcccgctcaagaagtggaagagtcgttacctgatggagcagaatgtgaccaaactgctgcgcccactgagccccgtgaccccaccccctcctaattctggctcaaaatcaccacagctggctactcccgggtcaagccatccaggcgaagaggagtgccgtaacggctattccctcatgttttcccccgtgacgtccctgacaaccgcgagcagatgcaacacaccccttcaatttgaattgtgccacaggaaagatctggatctcgccaaggtcggctacctcgatagtaacaccaactcctgtgcagaccgccccagcttgttgaactcaggacactcagacctggcaccacaccccagcctgggccccacctcagaaaccgggtttcccagccgctcaggtgacgggcaccagactctggtgcgaaactctgaccaggccttccggaccgaatttaaccttatgtacgcatatagcccattgaatgccatgcccagagccgacggactgtataggggctccccgttagtaggcgaccggaagcccctgcatctagatgggggatattgttctcctgctgaaggttttagttccaggtatgagcacggcctcatgaaggatctctcccgcggcagtctgagtcctggtggggaaagggcttgtgaaggggtccccagcgcaccgcagaatcctccgcagcgaaagaaagtttcactgctggaatatagaaagcggaaacaagaagccaaggagaatagtgcgggcggtggcggcgactccgcacagtccaagagtaagagcgccggcgccggtcagggatccagtaacagcgtttctgacacaggagcccacggtgtgcaaggcagtagcgcacgcacacccagtagcccgcataaaaagttcagcccttcacacagcagcatgagccacctcgaggccgttagcccctctgattcccgaggcacctcgagcagccattgccgcccacaagagaacatttcttctcgctggatggtgccaacatcagtggagagactgcgcgagggcggatcaatccctaaggtacttcggagctcagtacgcgtggcccaaaagggagaaccctcacctacgtgggaatccaacatcacagaaaaggacagcgaccccgccgacggcgagggccctgagacgcttagttcagcgttaagtaagggagcaaccgtgtactcacctagtcgctatagctatcaacttctacagtgcgattcgccccgtacagagtcccagtccttattgcagcagagctcctctccattccgaggtcacccaacacagtcaccggggtacagttaccgcaccacagctttgcgcccaggaaatccgccctcccacggctcctccgaaagctcgctgtcttctacaagctattccagcccggcacaccctgtgtcaaccgatagcctggcgcccttcaccggtacccctggttacttttctagccagccgcactcaggaaacagtaccgggagcaatctcccacggcggagctgtcccagctcagccgctagcccaacgcttcagggaccatccgattccccaacttccgattctgtgtcacaatctagcaccgggaccttatcctctacttcttttccccagaatagccgaagcagcctaccttcagacctgcgaacaatttcacttccttctgcaggccagtctgctgtctaccaggcatcacgagtaagcgccgtcagcaattcccaacactacccccataggggatccggaggcgtccaccagtataggctccaaccactccaggggtcgggagtcaaaactcagaccggactgtcgtag

SEQ ID NO: 50934 - DNA, 4329 bp, Artificial Sequence
  Description of Artificial Sequence: Synthetic coding sequence
atgagcatcgccatccccctgggcgtgaccaccagcgacaccagctactctgacatggccgctggttctgatccagagagcgtggaggcaagtccagccgtcaatgaaaagagtgtgtacagcactcacaattacggaacaactcagcgccacggctgcaggggccttccatacgcaacgatcattcccagaagcgatctcaatggactgccctctcctgtggaagagcgctgtggagactccccgaactctgagggcgagaccgtgcctacttggtgtccatgcggcctcagtcaagacggattcctgctgaactgtgacaagtgccgggggatgtcaagaggaaaggtaatcaggcttcatcggcgaaagcaggacaacatttcaggcggggacagctctgccactgagtcctgggatgaagaactgtctccctccacagtcctttacacagccacgcagcacacacccacatccattacattaacggtgcgacgcacaaaacctaaaaagagaaagaagtcgccagaaaagggtagagccgctcccaaaaccaaaaaaattaagaactcaccttctgaggcacagaacctggacgagaacacaaccgaggggtgggaaaaccgtatcaggctgtggaccgatcaatatgaggaagccttcaccaaccaatactccgccgacgtccagaacgctttagagcagcaccttcactcatcaaaagagtttgtggggaaaccgaccatcttggacactattaacaaaacggaactggcatgtaataacacggtgatcggctctcaaatgcaactgcagctgggccgcgtgacacgggtccagaagcataggaagatcctgagagcagcgagagatctcgccttggacacgcttattatcgaataccgaggcaaggtgatgttaaggcagcagtttgaggtgaacggccatttcttcaagaaaccatacccctttgtgcttttctactctaaattcaacggggtggagatgtgcgtggatgcccggacattcgggaacgacgccaggttcataagaaggagctgtactcccaatgccgaagtgcgccacatgattgctgatggcatgattcatctgtgtatctatgcggtctcggccatcaccaaggatgcagaggtgacaattgcttttgactacgagtactccaactgcaactataaagtggactgcgcctgtcataaggggaacaggaactgtccaatccagaaaagaaatcccaacgcgacggaacttccactcctcccacccccacctagtttgcccaccataggcgctgagacccggcggcgcaaagccaggaggaaggagttggagatggaacagcagaacgaagcttctgaagagaacaatgatcaacagtctcaggaagtgcctgaaaaggtgaccgtgtcaagcgatcatgaggaggtggataaccctgaagagaagcccgaggaggagaaggaggaggtcattgacgaccaggagaatctggcccacagcagacggaccagggaagatagaaaagtggaggccattatgcacgcattcgaaaatctcgagaaaagaaaaaagcgccgagaccagccactggagcagtcaaactctgacgtggaaattaccaccactacatcagagacacccgtaggtgaggagacaaaaactgaggcccccgaatccgaagtaagcaactctgtaagtaatgtcacgatcccgagtacaccacaatccgtgggagtgaacacacgccggtcgagccaggctggtgatatcgccgccgaaaagctcgtccccaagcccccgccagctaagccctcaaggcccaggcccaaaagccgtatttctcgttaccgcacttcctccgcccagagactgaagagacagaaacaagccaacgctcagcaggctgaactgtcccaggccgccctggaggagggagggtctaactccctggtgacgccgaccgaagcaggctccttggacagctcaggggagaaccgtccattgactgggagcgaccctacagtcgtgtctattaccggatcccacgtcaaccgggcggcctcaaaatatccaaaaaccaagaagtacctggtgaccgagtggttgaatgacaaggccgagaagcaggaatgcccagtcgagtgtcccctgagaattaccactgatccgacagtcctcgcgaccacacttaatatgctccctggtttgatacatagccctctgatctgtacaacccctaaacactacatccgattcgggtccccgttcataccagaacgccgtagacggcctctgcttcccgatggcaccttcagtagttgcaagaaacgctggatcaagcaggcgctcgaggaagggatgacacagacatcctcagtgcctcaggaaacccgaacacagcacctgtaccagtccaacgaaaattcatctagctccagtatttgtaaggataatgccgacctcctgtctcccctgaagaagtggaagtctcggtacctgatggagcagaacgtcacaaaactgttgcgacctttgtcccccgtgactccccccccacccaactctggctcaaaatcaccacaattagccacaccagggagttcccaccctggcgaagaggaatgcagaaacggctattcccttatgttctctccagtgacttctctgactaccgctagccgctgtaatacaccactccagtttgaactctgccataggaaggatttagacctggcaaaggttggctatttggacagtaacaccaacagctgcgccgaccggccaagtctgctgaacagcgggcattccgacctagccccacacccatccttagggcccacgtctgagactgggttcccatcacgcagcggagatggccatcagacgctggtgagaaactctgaccaggctttccgaaccgagtttaacctgatgtacgcctattctcccttaaatgctatgccacgggccgacggattgtatcgtggatctcctctggtcggggatcgtaagcccctacatctggacggcggatactgctcgcccgccgagggattctcatcccggtatgagcatggtttgatgaaggacctctctcgaggctccttgtctcctggcggagaacgagcgtgcgaaggagtacccagcgctccacagaaccccccccagagaaaaaaggttagcctgttagagtatagaaagagaaaacaggaggctaaggaaaattccgcaggtggtgggggtgactcagcccagtcaaaaagcaagtctgccggcgctggccaaggttcttcaaactctgtgtctgatacaggagcacacggtgtgcaaggctcgagcgcaagaaccccttcatctccacacaagaagttcagccctagccattcatctatgtctcatttggaggcagtgtctccctcggacagcaggggaacttcctccagccattgccgaccccaggagaacattagcagcaggtggatggtaccgacctcggtggagagactacgcgagggggggtctatacccaaagtgctgaggagctcagtcagggtggcccagaaaggtgagcctagcccaacatgggagagcaatatcactgaaaaggattcagacccagcagacggcgaaggtccagagactctgagcagtgcattgtcgaagggtgcaacggtctactctccatctcgctattcataccagctgttgcaatgcgacagtcccaggacggaatcccaatctctactccaacaatcgtctagtcctttcagagggcacccaacgcagagccctggttattcctatcggaccaccgcccttaggcctggaaatcccccaagccacggctcatccgaatctagcctctcctcaacgagctacagctcccccgcccaccccgtatctactgacagcctggcgccttttaccggaacacctggttatttcagttcacaacctcatagtggcaatagcaccgggtccaatctgcctcgtcggtcgtgtccgagttctgcagccagccccactcttcaagggcctagtgacagccccactagtgacagcgtcagccagtcgagcactgggacattgagtagcacatccttcccacagaattcacgcagcagcctgccttccgacctccgaaccatttctttgccaagcgcaggacaatctgctgtctaccaagcaagtcgtgtgtctgcagtgtccaactcccagcattacccccacagagggagtggcggagtgcatcagtatagattgcagcccctgcagggctcgggggtcaagacacagaccggtttatcctag

SEQ ID NO: 50935 - DNA, 4035 bp, Artificial Sequence
  Description of Artificial Sequence: Synthetic coding sequence
atgagccggggcaaggtgatccggctgcaccggcggaagcaggacaatatttcgggaggggactcctccgctaccgaatcttgggatgaggagttatccccttctaccgtcctgtacaccgcgactcagcacactcctacgtcaattactctgaccgtgaggcggactaagcccaagaaaaggaagaaaagccccgagaaaggaagggccgctccaaagactaagaagatcaaggccttccgagaaggaagtcggaagtcactccggatgaagaacagcccgtccgaagcccaaaatctggatgaaaacaccaccgaaggctgggaaaaccggattcgattatggacagaccagtacgaggaagccttcaccaaccagtattctgcggacgtgcagaacgcgctggagcagcatctgcattcatctaaggaattcgtgggcaagccgaccatcttagacaccatcaataagactgaactggcctgtaataatacggtcatcggctcacaaatgcagctgcaacttggacgggtgacacgcgtgcagaagcacaggaagatccttagagccgcccgggatctcgctctggatacacttatcatagaataccggggcaaagtcatgctccgccagcagttcgaagttaatggacacttttttaagaagccatacccattcgtcctcttctatagcaaatttaacggagtggagatgtgcgtagatgccaggacctttggcaatgacgcacgctttattaggcggtcctgtacccccaacgccgaggtcaggcacatgattgctgatggaatgatacacttgtgcatctacgccgtatctgccatcactaaggacgcggaggtaaccattgcttttgactacgaatactctaactgcaactacaaggtggattgcgcctgccataaaggcaatagaaattgccccatccagaagcgcaaccctaatgcaactgagctgccgctcctaccacctcctccctcacttccaaccatcggagccgagaccagacgtagaaaggcacgaagaaaagagctggagatggaacagcagaacgaagcttctgaagaaaacaatgaccagcagagccaagaggtccctgaaaaagtgacagtcagtagcgaccatgaagaagttgataatccagaagagaagccggaagaagagaaggaggaagtgatcgatgaccaggagaacctggcgcatagtaggcggacaagagaggaccggaaggtggaagccattatgcacgcttttgagaacctggagaaaagaaaaaaaaggcgtgatcagcccctagaacagtcgaacagtgatgttgaaattaccactacaacaagtgagacacccgtaggagaagaaaccaagaccgaagctcccgaatctgaagtttcaaatagtgtgtctaacgtcaccattccttccaccccgcagtctgtgggggtcaacaccagacgctcatcgcaggctggggacattgccgctgaaaagctcgtacccaagccacccccagctaagccttcgaggccccgtccaaagagtaggatctcccggtaccgaacttcatccgcacagcgcctgaagcgacagaagcaggcaaacgctcagcaggccgagctatcacaggccgctctggaggaaggaggatccaattctctggtgacccctaccgaggccggatctttggattcctccggggagaaccgtcccctgacaggctccgatccaaccgtggttagtataacaggaagtcatgtgaaccgcgccgcttcaaaatatccaaaaacaaagaagtatctggtaaccgaatggctcaatgacaaggcagagaaacaagaatgcccggtcgagtgtcccttaaggatcacaacagatcctacagtgttggctaccactctgaacatgctgcccggtttgattcacagtccgctcatctgtactacacctaagcattatatcagatttgggtcaccttttatccccgaacggcgtaggcgccctctccttccagacggtacattttccagctgcaagaagcgttggattaaacaggcactggaagagggaatgacccagacctctagcgtcccccaggagactaggacacagcatctctaccagagcaacgagaactccagctctagttctatatgtaaggacaatgcagatctgctaagtcccctgaagaagtggaagtcccggtatctgatggagcagaatgtgacgaaattgctgaggcccctaagcccagtcactcccccgcctcccaattcaggttctaagtcaccacagctggccacacccggaagctcccatcctggggaggaagaatgccggaacgggtattccctcatgttctcccctgtgacttcacttaccacagcctccaggtgcaacaccccactccagtttgagctgtgccatcgtaaagatctggacctcgcgaaggttggctatctggattcaaacaccaattcctgcgcagatcgcccctcactgctgaacagtggccattctgacttggcgccccacccctccttggggcctacatctgagaccgggtttcctagcaggagcggcgacggccaccagacactagtgagaaacagtgatcaggccttccggaccgaattcaatctgatgtacgcttattctcccctgaacgctatgccccgggccgatggcctgtaccgagggtcccctcttgttggtgatcggaagcccctacacctagatggcggatattgctcacccgcggaaggattttcaagcaggtatgagcacggcttaatgaaagacctgagccggggatcgctcagcccggggggagaacgagcttgtgagggcgtgccgagcgcacctcaaaacccaccccaaaggaagaaagtctcgcttttagagtacaggaaacgaaagcaggaagccaaggagaactccgcagggggtggaggggactccgcccagagtaagtctaaaagcgccggggccggacagggttccagcaactcagtctcagatactggcgctcatggtgttcagggttcatcggccagaacacctagctctcctcacaaaaagtttagcccatcacattcctccatgtcccatctcgaggccgtgtcaccgtcagactctcggggaacgtccagttcccactgcaggccacaggaaaacatctcctccagatggatggtgcccactagcgtggaaaggttgcgagaaggaggaagcattcctaaggtcctgaggagttcagtgagagttgctcagaaaggggagccaagccctacctgggaatctaacataacagagaaggactcagatccggccgacggggaaggccccgagactctatccagcgcgctcagcaagggagcaaccgtgtatagtccatctaggtacagctaccagctgctccaatgcgactcgccaagaacagaaagtcagagcctgctccagcagtctagctctccatttcgaggacatcccacacagtctcctgggtacagctatcggacaacggccctgcgtcccgggaacccgccttcccacggttcctcagagtcctcactatcatccacctcctattcaagtcctgctcaccccgtctcgaccgactccctcgcaccattcaccgggacccctggatacttctctagtcaaccgcacagcggcaattccacgggatctaacctgcctcggcgcagctgcccctcctccgccgcatcacccactctgcagggaccgagcgattcaccaacctctgactctgtgagccagagctcaaccggcactctgtctagcaccagtttcccccagaactcccgttcctcattaccttcagacctaaggacaatcagcctaccttccgcagggcagagtgcagtgtaccaggcaagccgggtgagtgcagtaagcaattctcaacattatccacacaggggtagcgggggtgtccatcagtaccgactgcagccattgcaggggtctggagtcaaaactcagaccggcctatcatag

SEQ ID NO: 50936 - DNA, 4329 bp, Artificial Sequence
  Description of Artificial Sequence: Synthetic coding sequence
atgagcatcgccatccccctgggcgtgaccaccagcgacaccagctattctgacatggccgctggaagtgaccctgagtccgtggaagcctctcccgcagtgaacgaaaagtcagtgtactcgacccataattatggtactacacagcgacatggttgccggggcttgccctacgccaccatcataccccgctccgacctcaacggcctccccagtcctgtggaagaaaggtgcggagatagtcccaatagcgagggggaaaccgtgcctacttggtgcccgtgcggcctgagtcaggatggatttctgcttaactgcgacaaatgcaggggtatgtcccgcggcaaggtgattagactccatagacggaagcaagacaacatctctggtggcgattcctccgcaaccgagagctgggacgaagagctgtctccatctaccgttctgtacaccgccacccaacacacacctacttcgatcacacttactgtgcgaaggacaaaacccaagaagcggaagaaatcacctgaaaaggggcgagcggcccccaagaccaagaaaatcaaaaacagtccttccgaggctcaaaacctggatgagaacaccactgagggatgggaaaataggattcggctatggaccgaccagtatgaagaggcatttaccaatcagtatagcgctgacgtccagaatgccctcgaacaacacttacacagctctaaagaattcgtgggcaagcccacgatactcgacacaattaacaagactgaactcgcctgcaacaataccgtgataggcagccagatgcaactgcaactaggccgagtgacacgcgtccagaaacaccggaagatcttacgggccgcacgcgacctggccctcgacacactcattatcgagtaccgggggaaggtgatgcttagacaacagtttgaggtcaatggacacttcttcaaaaaaccttatccctttgtgctcttctacagtaagtttaatggcgtcgaaatgtgcgttgacgccaggactttcggcaatgacgctagatttatccgccgatcttgcacccctaatgcagaggtgagacatatgatcgcagatggcatgatacacctgtgcatatatgccgttagcgcgattaccaaggatgctgaggtcactatcgcattcgattatgagtactcaaattgcaactacaaggtagattgtgcctgtcacaagggcaaccgcaactgtcctattcagaaacggaaccctaatgccacagagctacctttgctgccccccccgccctcgctacccacgattggtgccgagaccagacgtcgcaaagcgagacggaaggagctggagatggaacagcagaacgaggcatctgaagagaataacgaccaacaaagtcaggaagtgccggagaaggtcaccgtgtcaagtgatcacgaggaggtggacaatccagaagaaaagccagaagaggagaaggaagaggtcatagacgaccaggagaatctggcccacagcaggcgaaccagggaggaccggaaggtggaagcaataatgcacgcattcgagaacttggagaaacgcaagaagaggagagatcagcctctcgagcaatccaatagtgatgtggaaataacgaccaccacctccgagacgcccgttggtgaagagactaaaactgaagcacccgaatccgaagtgtcaaatagtgtgagcaacgtgaccatcccttccacccctcagtcggtgggcgtaaacactagacgcagtagtcaggcaggtgatatcgctgctgaaaagttagtaccaaagcctcctccagcaaagccgtcacgacctaggcccaagtccaggatcagccggtacaggaccagttccgcacaacgcctgaagcgccaaaagcaggccaatgcgcaacaagcagagcttagccaggctgctttggaagaaggagggtctaactctctggtgacacctaccgaggcgggcagcctcgacagttcgggtgaaaataggcccctcactggcagcgacccaacagttgtgtctattaccgggagccatgtgaatcgcgcagctagcaaatatcctaagaccaaaaagtacctggtcaccgagtggctaaatgacaaggccgaaaagcaggagtgtcctgtggaatgcccactgagaatcactacagacccaactgtgctggcgacaactctgaatatgctgcctggactcatccattccccactcatttgtactacacccaagcactacattcgatttggaagtcccttcatccccgagagacggaggaggcccctgctgcctgatgggactttttcctcatgcaagaagcgatggatcaagcaggcccttgaggagggtatgacgcagacgtcatccgtgccccaggagacccgaacacagcatctgtaccagagcaatgaaaattcgtcctccagctctatctgcaaggataatgcggacctgctgtcaccgctaaagaagtggaagagtcggtatctaatggagcagaatgtgacgaagctcttgagaccattgagccctgtgactcccccccctcctaatagcgggtcaaaatcaccccagcttgcgaccccaggatcatcgcacccaggggaggaggagtgcaggaatgggtactctctcatgttttcacctgtaacttccttgacaaccgcctcccgttgcaatacaccactccagttcgagctctgccaccgcaaagacctggacctcgcgaaggtcgggtacctggatagtaatacaaactcctgtgccgatagacctagcctcctgaactccggccattcggaccttgctcctcacccctcattaggccccacctctgagacaggttttccatctcggagcggcgacggacatcagacgctggtccggaactcggaccaggctttcagaacggagttcaacttaatgtatgcttactcaccattaaatgcaatgccacgcgccgacggtctctacagaggatctccccttgtgggagacagaaaaccgctgcaccttgatggcggatactgcagccccgccgaaggcttttcgagcaggtacgagcatgggttaatgaaagacttgagcagaggctcattgagtcctggaggcgaacgcgcatgtgagggcgtaccgtcagcacctcagaatccgccacagagaaagaaggtctcactactagaatataggaagaggaagcaagaagccaaagaaaatagcgccggcggaggcggtgatagcgcccagtctaagtccaagtctgccggcgccgggcagggatcttccaatagtgtgtctgacaccggtgcccacggtgtccaaggatcctccgctcggactcctagctccccacataagaagtttagtccatcacacagctcgatgagtcatcttgaggcagtaagtcctagcgactctcggggcacctccagttctcactgtcggcctcaggaaaacatttcttctcgatggatggtgccgacgagcgtggagcggctgagagaaggtggctccatacccaaggtcctgagatcaagtgtgagagtggctcagaagggcgagccaagccctacatgggagtctaatataactgagaaggactcagaccccgctgacggggagggtcccgaaaccctgagctctgcgttgagtaaaggagccacagtttacagcccatcgagatattcttatcaactactgcagtgtgattcaccacgaacggaatctcagagcctgctccagcagtccagctcccccttccgtggacacccaactcagtctcctgggtattcctacagaacaaccgctcttcggccagggaatcctccatctcatggctcctctgaaagctctttaagtagcaccagttactcaagtcccgctcaccccgtgtctacagacagcctggctccatttactggcactcccggctattttagttcccagccacatagcggaaacagcaccggaagcaatctgcccaggcgtagctgtccaagttccgccgcatcccctacactgcaggggccgtctgactcccctacctcagattccgtgtcgcaatcaagcacaggtacacttagtagcacgtcatttccacagaattccaggtcttctctccctagcgacttgagaactatttcattaccttctgccggccagtcagccgtgtatcaggcgagccgagtgagcgctgtctcaaacagccagcattatccccatcggggcagtggaggagtgcaccagtatcgcctgcaacctctccaaggatcgggtgtgaagacccaaacggggctgagctag

SEQ ID NO: 50937 - DNA, 489 bp, Artificial Sequence
  Description of Artificial Sequence: Synthetic coding sequence
atgagcatcgccatccccctgggcgtgaccaccagcgacaccagctattcagatatggccgctggcagtgatcctgagtctgtggaagcatcaccggcagttaatgagaagagcgtgtacagcacccataactatgggaccacacagcgccacggctgccgggggttgccatatgcaacaatcatcccccgatccgatttaaacggtctgccctcgccagtggaggagcggtgtggcgattcacccaattctgagggagaaactgtccctacctggtgcccctgcgggttgagccaggatggctttctcttgaattgcgataaatgccgcgggatgtctcggggcaaagtgatccgcctgcaccgtcggaagcaagacaatattagtgggggagatagcagtgctaccgaatcctgggatgaggagctctcaccgtcgacagtgctgtatacagcaacccagcacaccccaacatctattacactgtag

SEQ ID NO: 50938 - DNA, 1731 bp, Artificial Sequence
  Description of Artificial Sequence: Synthetic coding sequence
atgcaggtgccccaggacggcgaggacctggccggccagccctggtaccatgggttgttgtctaggcaaaaggcggaggccctccttcagcagaatggcgatttccttgtgcgcgcctcaggctcccgcggaggaaaccccgtcatctcatgtcggtggcggggatcagctctgcatttcgaggtcttccgcgtggcactgagacccagacccggacggcccaccgcattgtttcaactcgaggacgaacagttccccagcattcccgctctggtccattcctatatgaccgggagaaggcccctcagccaagccactggtgcagtggtatcaagacctgtgacctggcagggcccactaagacggtcctttagcgaggacacgttaatggacgggcctgcgaggatcgagcccctgcgcgcacgtaagtggagtaatagtcagcccgctgatctggctcatatggggagatcaagggaggaccccgctgggatggaggctagtacgatgccaatttccgcgcttccccgaacgagctcagaccctgtcctgctgaaggccccggcccctttgggaaccgttgccgattccctccgggccagcgatggccagctgcaggccaaggcgcccactaaacctccacggacgccctccttcgagctgcccgacgctagcgaacgaccgcctacctattgcgagttggtgccacgggtgccctcggtgcaaggcacgagcccttctcagtcatgtcctgagcccgaagctccttggtgggaggccgaggaagacgaagaagaagagaatcggtgcttcaccaggccgcaggctgagataagcttctgcccacatgacgctcccagctgtcttctgggcccccagaacaggcccctggagcctcaggttctgcacacactgagaggattattcttagagcatcacccgggctcaacagccctgcatctgttgttagtggattgccaggctaccggtctgcttggcgtcacgcgcgatcagcggggtaatatgggcgtaagttccggcctcgagctccttaccctcccacacggccatcatcttcggctcgaactcctggagcgacaccagacactggccctggcaggagccttagccgtccttggctgttctggacccttggaggagagagctgcagccttgaggggacttgtcgaattggctctggcgctgcgtcccggggcagctggagacttgcctggactggcagccgtgatgggggccctcctcatgcctcaggtgtcaagactcgaacatacatggcgacaactgaggcgttcgcacaccgaagcagcactggcattcgaacaggaacttaaaccgttgatgcgagccctcgacgagggggccggaccctgtgatcctggagaggtggcactaccccatgttgcacccatggttaggctgttagaaggcgaggaggtcgcaggtccgctggacgagtcttgcgaaaggctgctgagaactctgcacggtgccagacacatggtcagggatgctcccaaattccgcaaggtcgccgctcagcgcctccggggttttaggcctaaccccgaattgcgcgaggctttaaccacgggcttcgtaagaagattgttgtggggaagcagaggagctggcgccccaagggctgagcggttcgaaaaattccagcgggtgctgggtgtgctgtcgcagcggttagagcccgatcggtag

SEQ ID NO: 50939 - DNA, 1452 bp, Artificial Sequence
  Description of Artificial Sequence: Synthetic coding sequence
atggagaagaccctgctggccaacctgggcaccaccgccagctgccccgcccgagcccgaaaatggagcaattctcagcccgccgatctcgcccatatgggtaggagccgggaggatcccgccgggatggaggcctccacaatgcccatatctgcgctgcctcggactagttctgaccctgtgctcctcaaagcccccgcccccctgggcactgtagctgactccctgcgggcttccgatggtcagctgcaggccaaggcccctactaagccaccgaggacaccatctttcgaactacccgatgcatccgaaagacccccaacatactgtgaacttgtgccccgtgtaccatcagtgcagggcacttccccttcccagtcctgccctgagcctgaggcaccgtggtgggaggccgaagaagatgaagaggaggaaaatcggtgttttaccagaccccaggcagagatcagtttttgcccacatgacgccccgagctgcctgctggggccgcagaaccggccccttgagccccaggtgctgcacacgctgcgcggtctttttctggaacaccacccaggaagcaccgctcttcacctgttattagtggattgccaggctacaggtttgcttggagtgacccgggaccagagagggaacatgggcgtatcttctgggttggaactgcttacgcttccccacggtcaccacttacgcctggagctgctcgagagacaccagacactggccctcgccggggccctcgccgtgctcggctgtagtggacccctcgaagagagagcggctgccctgagagggctcgtggaattggcccttgctcttagacccggcgcagcgggggaccttcccgggctggcagccgtgatgggcgccctccttatgccacaggtccggggcgaacagggcttggaggaggccggggtccgcgtgaccggcaaaaccggtgaggaggcatgcagtgatctatttagccaggtaagcagactggagcacacttggcgacagctgcgacgatctcacactgaggccgccctagcttttgaacaggagctaaaaccgctcatgcgcgcactggacgagggcgcgggaccttgtgatcctggcgaggtagctttacctcacgtagcaccgatggtccgcctcctggagggcgaagaagtggccggtcccctggatgagtcctgcgaaagactgctgcggacacttcacggagcgagacacatggtgcgtgatgcgcccaagtttcggaaggtggccgctcagcgcctcagaggtttcagacccaaccccgagctgcgggaagcactgacaacaggctttgtacggcgactgctctggggttccagaggcgcaggggcacctagagccgagagattcgagaagttccaacgcgtcctcggggtcctgagtcaacgcttagaaccggataggtag

SEQ ID NO: 50940 - DNA, 930 bp, Artificial Sequence
  Description of Artificial Sequence: Synthetic coding sequence
atgctgcccgaggacagcggcggcagccccgacgccgccgccagcgacaagcatatccagtggctcctcggtgcagatggggaagtatgggtttggatcatgggagagggccccggcgacaaaccatatgaggagatttccgaggagcttatagcagagagagcccgtctacaggcccagcgggaagccgaagaactgtggagacagaaagaagcagaaatcacgaaaaaattccgggatgcattggctaatgagaaagctaggatcctggcagagaagtggaaagttgagatggaggaccggaaggccgcaaaagtgttggaggaaagaatccacgaggagtttaagaggaaagaagaagaagagagaaagaggggagaggaacagatcagattgcaggaggagcaaagggcaaaggagttatactggactttaaagcaagcacagctgcattgccaggcttctgaaaaggaagagcgagagtgggaggaacaattacgccgcagcaaagcagccgatgaggagcgctcccgtagggcccagcgcgcccgcgatgaatacagacaccattcacttcgcgccatacagaagggcacagttgccggtctctcctccatgtttcgagagctcgggcaatcgcatgagcaggaggcacgactatatcaccacctgccagacccagggctgccacagcccctggcactgcccgtttctagaacgtgggaaagaccattgaggcccgtgagccgcgacgttattgttcggtggttcaaggaggagcagcttccccggcgagccggctttgagcggaatactaagttcatagccccctggtttcacggcggaaactaccactgttttcggagacgagtaacaagcgggacgctgcgaacagagggtcagccaacccgtcttccaagtgtggtgtag

SEQ ID NO: 50941 - DNA, 1074 bp, Artificial Sequence
  Description of Artificial Sequence: Synthetic coding sequence
atgctgcagcagatcctgcacgacatgtacatcgaccccgagctgctggccgagctgagcgacgtccagaaacacatactcttctataaaatgcgggaggaacagctgaggagatggaaggaaagggaaacctgggaagctctggcccaagacgagggactcaggcccccaaagaccaaacgggcagctagtgacaagcatatccagtggctgcttggtgcggacggcgaagtgtgggtatggattatgggcgagggtcctggagacaagccctacgaagagatctctgaggagctgattgctgagcgcgctaggctgcaagcccagcgcgaggcggaggaactgtggaggcagaaggaagccgagatcacaaaaaagtttcgagacgccctggctaatgagaaagcccggattctagccgagaaatggaaagtcgaaatggaggaccgcaaagcagctaaggttctagaggagcgtattcacgaagaatttaagaggaaggaagaagaagagcgcaagcggggcgaggagcagattaggctgcaggaggaacagcgggcaaaggagctttactggacactcaaacaggcgcagctccactgtcaggccagcgaaaaggaggaaagagaatgggaagagcaattacgccgttcgaaggcagccgatgaggagcggtcccggcgtgctcaaagggcaagggacgagtaccgtcaccacagcctgcgcgccattcaaaaagggactgttgcaggactaagtagcatgttccgggagctggggcagagccacgagcaggaggctcgcctttatcatcatctccctgaccccggtctgccacaacctcttgctttaccagtccgtacctgggaacgacccctcagacctgtcagcagggatgtgatcgtgagatggttcaaagaggagcagctccctcgcagggccggttttgaacggaacaccaaattcatagcaccctggtttcacggaggcaattaccactgtttccggcgcagagtcacttcgggtactctccggaccgagggccaacccacccgcctgccttcagttgtctag

SEQ ID NO: 50942 - DNA, 648 bp, Artificial Sequence
  Description of Artificial Sequence: Synthetic coding sequence
atgctgcagcagatcctgcacgacatgtacatcgaccccgagctgctcgctgaactgagcgatgtgcagaaacacatactattttacaaaatgcgtgaggagcagcttaggcgctggaaagaacgcgaaacatgggaggctctggctcaagacgagggtcttcggcccccaaaaacgaaacgcgcctccgataagcacatccagtggctgttgggcgccgacggggaagtgtgggtttggatcatgggtgaggggcccggtgacaaaccatatgaagaaataagcgaagagttgattgctgaacgcgcaagactccaggcccaacgcgaagctgaagagctatggcgtcagaaagaagccgaaatcactaaaaaatttcgcgatgctctggctaatgagaaagctcgaattttagcggagaagtggaaagtcgaaatggaagacagaaaagccgctaaggtgctcgaggaacgcattcacgaggaatttaaaagaaaggaagaggaggaacggaagcggggcgaggaacaaataaggctccaagaagaacagagggccaaagaattgtactggaccttaaaacaagcacaactccactgtcaggcttcagaaaaggaagagagagagtgggaggaacagtgtgagtag

SEQ ID NO: 50943 - DNA, 1296 bp, Artificial Sequence
  Description of Artificial Sequence: Synthetic coding sequence
atgctgcagcagatcctgcacgacatgtacatcgaccccgagctgttggccgaattgtcagatgtgcagaaacacatcctgttttacaaaatgcgcgaggagcagctgagacggtggaaggagagagaaacctgggaggctctcgcccaggatgaggggctgcgcccccctaagacaaaacgcgcctccgacaaacacattcaatggctgctgggggcagatggtgaggtgtgggtgtggatcatgggagaggggcccggcgacaaaccctatgaagaaatctcagaagagttgatcgcggaaagggcacgtctccaggctcagcgggaagcagaagagctctggcgccagaaggaagcagaaattaccaaaaaattccgggacgccctcgctaatgagaaagcacggatcttagccgaaaaatggaaggttgagatggaggaccgaaaggccgcaaaggtgttggaagaaaggatccacgaagagtttaagagaaaggaggaggaggagaggaagagaggcgaggagcagatacgcctacaggaggagcagagggctaaagaactgtattggaccctgaaacaagcccagctgcactgccaagcgtccgaaaaggaggaaagagagtgggaggagcagctgcggaggagcaaggctgcagatgaagaacgctcaagacgcgctcagcgcgctagggatgagtacagacatcacagccttcgagccattcaaaagggcacggtggcgggattaagtagcatgtttagggagctcgggcagtcccacgagcaggaggctaggttgtatcaccacctgccagatcccggactgcctcaacccctggcactgccggtccggacctgggagcggccactccggccggttagccgcgatgtgatcgtcaggtggtttaaggaggaacagttgcctcggcgagccggctttgaacgcaacacaaagttcattgcaccgtggttccacgggattatttcccgagaggacgccgaagcgctgctcgagaatatgaccgaaggcgcattcttagttcgcgtgagcgaaaagatttggggttacactctatcctaccgattacagaaggggttcaaacatttccttgtcgatgcatctggagatttctactcttttctgggcgtggaccctaatagacacgccaccctaactgatttagttgacttccataaagaggaaataatcacagtcagtgggggggaacttttgcaggagccatgcgggcagcgtgattctccacctgactatcacctcctgtttgagtag

SEQ ID NO: 50944 - DNA, 1020 bp, Artificial Sequence
  Description of Artificial Sequence: Synthetic coding sequence
atggcccacgccctgcggcggatcctgtacagcacctggtgccccgccgactgccagtttgcattcatggcaaggaatcccaggtctccagcttctaagctgttttgccaccttttcgtcggctctcagcctggtgaggtgcagattctgcacctgctgctgtgcaggagttttcagttggcatatctgctgcaacaccctgaagagcgcgctcagcccgagccatgtccagggccaactggagaggtaccactgaaacccctctctagcagcggcggcctggtgagagagcctttcggacgcgatcagctgagccagaacgtgcatgctcttgtcagttttaggcggcttccggctgaaggactggtgggaagcggcaaagaactccccgaaagcgagggtagagcgcggcacgcacggctgggtaacccatactgctcccctactctggttcgcaagaaggccattaggagtaaagtgatcaggtctggagcttatagaggctgtacatacgagacccaattgcagctatcagccagagaggcttttcccgccgcctgggaggcttggccaaggggccctgggggccattcatgtctggttgaatccgaggggtcgttgaccgagaacatttgggctttcgccgggatttcaaggccatgtgcccttgcactgctccgacgagacgtcctgggggcattcctgctgtggccagagctgggtgccagtggacaatggtgcctttcagtcaggactcagtgtggcgtcgtgccccatcaggtgttccgtaatcatctggggagatactgcttagagcacctgcccgccgaatttccatctctcgaggccctagtggagaaccatgcagtgaccgagcgctctttattctgccctctggacatgggacggctcaaccccacctacgaggagcaggattgcggtcctcctgggcgcccgcctcgaaccctccgtcccctttcccatgctaaaagtgaggctgaattgcagggcttagggtag

SEQ ID NO: 50945 - DNA, 1272 bp, Artificial Sequence
  Description of Artificial Sequence: Synthetic coding sequence
atgcagaaggccggcgccggcggccggcgggccagcgactgcggccttgccccacatcggccccggtgtattacgaagttcgcccagtacgtagggtcttttccagtggatgatctggatacccaagagtcagtctggttagtgcagcagcagttatgggccttgaaggattgtcccaggcggagggccgttatcctgaaattcagcctgcagggcctgaagatctatagtggtgagggggaggtgctccttatggcccatgccttgcgcaggatcctatacagcacctggtgcccagccgactgtcaatttgcctttatggcgcgcaatccccggtcaccagccagcaagttattctgccatctgtttgtcggatcacagccaggggaggttcagatactgcacttgctcctgtgtagatcgtttcagctcgcctatttgttgcagcaccctgaggaacgggcccaaccggaaccctgcccaggaccaaccggcgaagtgcctctcaagccgctttcatcaagcggcggacttgtccgcgaaccctttggcagagatcagttgtctcaaaacgtgcacgccctggtgtctttccgacgacttccggctgaggggttggtcggcagcggaaaagagttgcccgaaagcgagggacgagcccggcatgcgcgtcttggtaatccctattgttctccaacactggtgaggaagaaagctattcggagtaaggtgatcagatctggggcttataggggctgtacttatgagacacagctccagcttagcgcaagagaggcatttcccgctgcgtgggaagcttggcccaggggccccggaggacatagctgtctcgttgagagtgaaggctccttgactgagaatatttgggcctttgcaggaatcagtcgaccgtgtgcactggctctcctgcggagggatgtacttggtgcctttcttttatggcccgagctcggtgctagcggtcagtggtgtttgtcagtacggacccagtgtggcgtggtgccgcatcaggtttttaggaaccatctgggaagatattgtctggaacacctgcctgctgagtttccgtcactcgaagctctggttgaaaatcacgctgtaaccgagcggtccctgttctgccccctggacatgggcaggctgaatccgacatacgaggaacaggactgtggccctcctggccgacccccaagaaccttgcggcccctcagccatgcaaagagtgaagccgaactgcagggtcttgggtag

SEQ ID NO: 50946 - DNA, 381 bp, Artificial Sequence
  Description of Artificial Sequence: Synthetic coding sequence
atgcagaaggccggcgccggcggccggcgggccagcgactgcggcctggctccgcatcgtccgcggtgcattaccaagttcgcccagtacgtggggagtttcccagtggacgacctggatacccaggagtccgtgtggctggttcagcagcaactgtgggcactgaaagactgtccccgcaggcgtgcagtgatccttaaatttagcctgcaggggctgaagatatactcaggggaaggcgaagtcttgcttatggcccatgctcttcggaggatcctgtattccacctggtgccctgcggactgccaatttgcgttcatggctcggaatcctaggtcacccgcaagtaagctcttctgtcacctctttgtcggctcctag

SEQ ID NO: 50947 - DNA, 396 bp, Artificial Sequence
  Description of Artificial Sequence: Synthetic coding sequence
atgcagaaggccggcgccggcggccggcgggccagcgactgcggcctggctccacataggccccgttgcatcaccaagttcgctcagtatgtaggcagcttcccggtggatgatttggatactcaagaatctgtatggctggtacagcagcagttgtgggccctaaaggactgtccacgtaggcgggccgttattttgaaattctcactgcagggacttaaaatttatagtggtgagggcgaggtactgctcatggcacacgctctgcgacggatcctatactcaacttggtgtcccgccgactgtcagtttgcctttatggccaggaatcctcggtctccagcaagtaaacttttctgtcatctttttgtcggaagtcagcccggcgaggtgtag

SEQ ID NO: 50948 - DNA, 213 bp, Artificial Sequence
  Description of Artificial Sequence: Synthetic coding sequence
atgcagaaggccggcgccggcggccggcgggccagcgactgcggcctggccccacatagacctagatgcattaccaaatttgcacagtacgtgggttcctttcctgtcgacgacctcgacactcaggaaagtgtatggctggtgcagcaacaactgtgggctctgaaggactgccctcgtcggcgagccgtgattctgaagtttagcttatag

SEQ ID NO: 50949 - DNA, 528 bp, Artificial Sequence
  Description of Artificial Sequence: Synthetic coding sequence
atgtacgccagcagctaccccccccccccccagctgagcccccggagccacctgtgcccccccccaccacatcctacacccccccagctcaataatctgctcctcctggagggcagaaaatcatccctcccctcagtcgcccctacaggcagtgccagcgctgctgaggacagcgacctcctgacccaaccgtggtattcgggcaattgcgatcggtacgccgttgagtctgctctgctgcaccttcaaaaagatggcgcttatacagttcggcccagctcggggccgcatggatcccagccctttacccttgcggttttactacgtggaagagtgttcaacatccctatccgtcgcctagatggggggaggcactatgccctcgggagggagggccggaaccgcgaggagcttttctctagtgtcgcggcgatggtccaacacttcatgtggcacccactgccactggtggacaggcactccggcagtcgggaactgacgtgtctgctctttcctactaaaccatag

SEQ ID NO: 50950 - DNA, 432 bp, Artificial Sequence
  Description of Artificial Sequence: Synthetic coding sequence
atgcccagcggccccctgccccggaccagcgtggtgccccggcccaccaccgctcctcaggaaactcgaaatggaaccgccgatgccgcttccaaggaaggcagaaagagtagtctgccctcagtcgctccgactgggtccgcatcagcagcggaggatggcgcctacactgtccggcccagctcggggccccacgggtcacagccatttacattggccgtgctgctgagggggcgagttttcaacattcctatccgtcgccttgacggcggtaggcactacgccctggggagggaaggcagaaatagagaggagctgttctcctctgtggctgccatggtacaacatttcatgtggcaccctctccccctggtcgaccgacattccggttcccgagaattaacctgtctgctgtttcctactaagccttag

SEQ ID NO: 50951 - DNA, 1896 bp, Artificial Sequence
  Description of Artificial Sequence: Synthetic coding sequence
atgaacggcgccggccccggccccgccgccgccgcccccgtgcccgtccctgtgcccgtccccgattggcggcagttctgtgaattacacgctcaggcagcagcagtcgactttgcccataagttttgtcggtttctgagggacaaccctgcctacgacaccccagacgctggggccagctttagcaggcactttgccgctaatttcttggatgtgttcggtgaggaggttcgacgcgtattggttgccgggccaactacacgcggagccgccgtgagcgccgaagctatggagcccgagctggccgataccagtgccttgaaggctgcgccctacggacactcacggtctagcgaggacgtttccacacacgctgcaacaaaagcacgggttagaaaagggttctcgctgagaaacatgtctttgtgcgtcgttgatggagtaagagacatgtggcaccggagagcctcccccgaaccagacgcggccgctgcccctcgaactgctgagccgcgcgataagtggacgaggagactccgtctgagcaggaccctggccgccaaagtcgagttagtggacatccagcgagaaggcgcactgaggttcatggtggctgatgacgctgccgcgggtagcggcgggtcagcccagtggcagaagtgcaggttactgctacgtagggctgtcgctgaagagaggttcagactggaattcttcgtacctccaaaggcatctcgcccgaaggtctcgattcctctttccgcgattatcgaagtgcgcacgacaatgcctttggaaatgcctgaaaaagacaatacttttgtgttaaaggttgagaatggggctgagtacatcttggaaaccattgacagcttgcaaaagcacagctgggttgcagatatccagggatgtgtggatccagggcctggtccaggagacttagaggggtcatggacccggtcctgcctgcaccccaagcgcgcaagtgaacattgggagctaggccgggacggaagcgaatcccccaaagggtggggccccggcgctgtggcccatatatgcgatcccaacactttagggggtcccgcagtggagacaggttttcaccatgtaggacaagctggactagagctgcagacgtcctctgacccacctaattcagcgtccaggagtgctacttctggtgagcaaggagcggagactgaccccgaggccgagcctgaactggagctgagtgattacccttggtttcacgggactctgtcccgggtgaaggctgcgcagctggtactagccgggggcccacgcaatcatggactcttcgtcatcaggcaaagcgagacccgacccggtgagtacgtgttgacattcaacttccagggcaaagcaaaacatttaaggctgagtctgaatggccacggccagtgccatgtacagcacctatggttccagtccgtgctggacatgctgagacactttcacactcatccaattcctctggagtccggcggctcagccgacatcaccctgaggtcctacgtgagagcacaagacccccccccagaaccaggccctacaccacccgctgcccccgcgtcaccagcttgttggagcgattctcctggccagcactactttagttcccttgcagccgctgcttgccctcccgcaagccctagtgacgccgcaggagccagcagttcgtccgcatccagttctagcgccgcaagcggaccagcccctccccggcctgtggaaggccagctgagcgcacgctccagatcaaactctgcggagcggctgctggaagctgtggcagccaccgccgctgaggagccacccgaggctgccccggggagagcccgggcagtcgaaaaccagtattccttctactag

SEQ ID NO: 50952 - DNA, 714 bp, Artificial Sequence
  Description of Artificial Sequence: Synthetic coding sequence
tgagagcagggcgccgagaccgaccccgaggccgagcccgagctggagctctcagactacccttggttccatgggaccctctcgcgagtgaaagctgctcagctcgtgcttgccgggggacccagaaaccacggcctgtttgttatccgccagtcagaaactagaccaggggagtacgtgctgacctttaactttcaggggaaggctaaacatttgaggttgtctttgaatgggcacgggcaatgccatgttcagcatttgtggtttcagagcgtcctggacatgctgaggcactttcacactcaccctatcccgctggagagtggcggctccgccgatatcactttacggtcgtatgtccgggcccaggacccgccacccgaacccggacccacgccaccagctgcacctgccagtccagcttgctggagcgattcaccgggacagcactactttagttctcttgccgctgcagcttgccccccagcttcccccagcgacgctgccggagccagctcctcatcggcctcctcttcttctgccgcttcaggcccagccccacctagaccggtcgagggccagctcagcgcaaggtccaggagcaactcggccgagcggctcttggaggccgttgcagccactgccgcggaggagccccccgaagcagcacccggcagggccagggcagtggagaatcagtactcgttctactag

SEQ ID NO: 50953 - DNA, 927 bp, Artificial Sequence
  Description of Artificial Sequence: Synthetic coding sequence
atgaacggcgccggccccggccccgccgccgccgcccccgtgcccgttccagttccagttcccgattggaggcaattctgcgaactccatgcccaagccgctgccgtcgactttgctcacaaattctgccggttcctgagggataaccctgcgtacgatactcctgatgccggcgcgtccttttcaaggcatttcgcagcgaatttcttagacgtcttcggggaggaagtgcgtcgggtgctggtcgcgggcccgacaactaggggcgctgctgtctctgctgaagctatggaacccgaacttgctgatacatccgccctgaaggcagcaccctacggccactctcgctcatccgaggacgtgtccacccacgccgccactaaggctagagtccgaaaagggttttccctccggaatatgtctctctgtgtcgtagatggagtcagagacatgtggcataggcgggcatccccggagcctgacgccgccgcagccccacgtactgcagaaccaagggataaatggaccaggcgcttgagattatccagaacgttggctgccaaagtggaactcgtcgatatccaaagagagggtgctcttcgttttatggttgccgatgacgcagctgccggcagcggcggctctgctcagtggcagaagtgtcggctcttgctgcgtagagcagtggcagaggagaggttccgccttgagtttttcgtaccgcccaaggccagtcgtcccaaggtgtcaattcctctttccgccattatcgaggttcgtactaccatgccgctcgagatgccagaaaaggataacaccttcgtgcttaaagtggaaaacggagcggaatatattctggagacaatcgattcactgcaaaaacatagttgggttgccgacatacagggatgtgtggatcccggttag

SEQ ID NO: 50954 - DNA, 2016 bp, Artificial Sequence
  Description of Artificial Sequence: Synthetic coding sequence
atggaccccagctactgccccgcccacggcttccccagccaggacgccttgtggcccctcagcagccaacagtggagtagcgcacattactctgagcccgccgctgggggctgtgacggcactgaggcaatgaacggtgcgggtcctggacccgcagccgcagccccggttccagtgcctgtacctgtccctgactggaggcagttttgcgaactgcatgcccaagccgccgccgtcgactttgcccacaagttctgccgtttcctcagagataaccccgcctatgatacccccgatgcaggggcatcctttagccgccacttcgccgcaaactttctcgatgtattcggtgaggaggtgcgcagggtgctcgttgccggccccaccacgcggggagcagcagtttctgccgaggccatggagcccgagctggccgacacatccgctctaaaggctgccccgtacgggcactctcggtccagtgaggatgtgtccacgcacgcagcaacaaaggcacgggtgcggaaggggttctcactcagaaacatgtctctgtgtgtggtggatggggttcgggatatgtggcatcggagggcctcacctgaacccgatgccgctgcggccccgcgcacagccgagccgagggataaatggactcggaggctccgcttatcccggacactggctgcaaaagtggagctggtagatatccaacgtgaaggggcccttagatttatggtggcagacgacgccgccgcgggatctggcgggtcggctcagtggcagaagtgccggctgctactgcgccgcgcagtggctgaggagagatttagattagagttcttcgtccctcctaaagcctcaagaccaaaagtatctatcccgctgtcagcaatcatcgaggtgagaaccacgatgcccttggagatgcccgaaaaggacaataccttcgtgctgaaagtcgagaatggcgccgaatacatcctagagaccatagactccctgcagaagcactcctgggttgcagacatccaaggctgcgtagatcctggcctgtggccaggagatctcgagggatcttggacacggagctgcctgcacccgaaaagggcaagcgagcactgggagcttggacgggacgggagcgaatcccctaaaggatgggggcctggagccgttgcacatatttgttggagtcgcactcctgatttaaagagacatctgagcagccacatctacctgttcgtgccgctgagcccatccccgcatgtgcctcataccgtgatacctacttctggagaacagggtgccgagaccgatccagaagccgagcctgagctggaacttagcgattacccctggtttcacggaaccttatccagagttaaggcggctcagctggtgctggccggcggaccacggaaccacgggctgttcgtgatacgccagagcgagaccaggcccggcgaatatgtacttaccttcaacttccaaggcaaagctaaggcttcacacctgcggctgtcactgaacggccatggccagtgtcacgtgcaacacttatggttccagagcgtgctcgatatgctgcgccattttcacactcaccccattccactggagtctggcggttctgctgatataactttgaggagttacgtccgcgcccaggacccaccacccgaacctggaccgacgccacccgcggcacccgcatcccccgcctgctggagtgatagccctggccagcactatttctcgtctctggctgcggccgcttgcccccctgcctcccccagcgacgccgcgggcgccagcagttcaagtgcctcgagctcttccgcggcctccggccccgctcccccacgccctgtagaaggacagttgtctgcacgttcccggtcgaatagcgccgaaagactgctcgaggcagttgctgccacagcagccgaagagccgccggaagcagcgcccggaagggcccgggcagtcgaaaatcaatactctttttattag

SEQ ID NO: 50955 - DNA, 1899 bp, Artificial Sequence
  Description of Artificial Sequence: Synthetic coding sequence
atgaacggcgccggccccggccccgccgccgccgcccccgtgcccgtgccagtgccggtccctgattggcggcagttttgcgagctccacgcacaggctgctgccgtcgacttcgcacataagttctgccggttcctgagagacaacccagcttacgatacacctgacgcgggcgcttcattcagcagacactttgccgcgaatttcctcgatgtgttcggcgaggaggtgcgtcgtgttcttgtggctggacccactaccagaggtgcagccgtgtcagccgaagccatggagcccgaactggctgatacatctgcgctgaaggcagccccttatgggcactctaggtcttctgaggatgtctccacccatgccgccactaaagcacgcgtgaggaagggattttctttgaggaacatgagcctgtgtgtggtggatggtgtgcgcgatatgtggcataggagagcctcacctgaaccagacgctgctgccgcccctcgcaccgcggaacctcgagataagtggactcgcagactgagactcagtaggacactggcggccaaagttgagctggttgatatccagagagagggagctttgagatttatggtagccgacgatgccgccgctggtagcgggggctccgcacaatggcagaagtgccggttgcttctacgccgtgcagtcgccgaagagcgcttcaggcttgagtttttcgtcccgccgaaggcaagtagaccaaaggtcagtatacccttgagtgccataattgaagtaaggactaccatgcccctcgagatgcctgaaaaggataatactttcgttctgaaggtggaaaacggagccgaatacatcctggagactattgacagcttacagaagcattcttgggtagccgatattcagggatgtgtggatcccggtgattcggaggaggacactgagctgtcatgcactcggggtggttgcttagcgtcacgtgtggcgtcctgttcttgtgagctgctaaccgacgcggtggacctgccgcggcctccggagaccactgctgttggcgcggtggttacggccccacactcaaggggtcgggatgctgtccgggagagcctaattcacgtgcctctggaaacttttcttcagaccctggaatcacccgggggaagtggctccgattcaaacaataccggggagcaaggtgccgagaccgatcccgaggccgagcccgagctcgagttgtccgactacccttggtttcacggaacccttagccgtgttaaagcagctcagctggtcctagccggaggcccccggaaccatggactgttcgtcattcggcagtccgagactaggcctggagaatatgttctgacattcaatttccaagggaaggccaaacatctgcgtttgagcttgaatgggcatggccagtgtcatgtgcagcacctgtggttccagtcagtcctagacatgctgaggcacttccacacccacccgattcctctcgaaagtgggggatcagccgacattactctcaggagttatgtgagagcacaggacccgccccctgaacctggccccaccccaccagcagcccccgcctcccccgcctgttggagtgatagcccaggtcagcattatttctcatccttggccgcggcggcctgtcctccggcaagcccttctgacgctgctggcgcatcatcctccagcgcttccagttccagcgccgcctcagggcccgccccacctagaccagtcgaaggccagttgtctgccagatcacgctccaacagcgcagaacgtctgctcgaagccgttgccgcaaccgccgccgaggagccccctgaggctgcacccggacgagctagggcagtcgagaatcagtatagcttctattag

SEQ ID NO: 50956 - DNA, 1236 bp, Artificial Sequence
  Description of Artificial Sequence: Synthetic coding sequence
atgaccgagatgagcgagaaggagaacgagcccgacgacgccgccacccacagtccgcctggcaccgtctcggccctgcaggagacgaagttgcagcgcttcaagcgctcactctctctcaagacaatcctgcggagtaagagcctggagaacttcttcctgcgttctggatccgaactaaagtgccctacagaggtattgctgacccctccgaccccattgcctcccccaagcccccccccgacggcaagtgatcgggggttggcaactccgtctccgtccccctgtccagttccccgtccccttgctgcactaaaacctgtgagacttcatagctttcaggagcatgtcttcaagagagcttccccctgtgagctttgtcatcagctgattgtggggaatagcaaacagggcttgagatgcaagatgtgcaaggttagcgtccacctgtggtgcagtgaggagatcagccaccagcagtgtcccggcaaaacatcaacaagctttaggcgaaatttcagctctccactgctcgtgcacgaaccgcctcccgtttgcgccactagcaaggagtcacctccaacaggagactctggaaaagtagatcccgtttacgagacgcttcgatacggtactagcctagcactcatgaatcgttcatctttctctagcactagcgagtcacccaccaggtcactgtctgagcgcgatgagctgaccgaggatggagaaggttctatccggtcaagcgaagagggacccggcgacagcgcatcccccgtatttactgcgcccgccgagagtgagggacccggacccgaggaaaagagtcctggtcagcagctgcccaaggcaaccttgcgaaaggatgtcggcccgatgtacagttacgtggctctctataagttccttccacaagaaaataatgacctcgccttacagccaggcgaccgcattatgcttgtcgacgactctaatgaagattggtggaaaggtaagattggagaccgcgttggatttttccccgctaatttcgtccaaagggtgcggcctggcgaaaacgtgtggcgttgctgccaaccctttagcggcaacaaagaacagggatatatgagcctgaaagagaatcagatttgcgtaggggtaggccgttccaaagatgccgatggatttataagagtgtcttccggcaagaaaaggggcttggtcccagtggatgccctgaccgaaatctag

SEQ ID NO: 50957 - DNA, 1095 bp, Artificial Sequence
  Description of Artificial Sequence: Synthetic coding sequence
atgaccgagaaggaggtgctggagagccccaagcccagcttccccgcggaaacaagacaaagtgggctgcagcggctcaagcagctgctgcgcaagggatccaccggcacaaaggagatggagctccctccggagcctcaggccaatggcgaagctgtgggggcggggggcggtcccatctattatatttatgaagaggaagaggaagaggaggaggaggaagaggaacccccccccgagccacccaaattggtgaacgataagccacacaaattcaaggaccattttttcaaaaaacccaagttttgtgatgtctgcgccaggatgattgtactgaataacaagttcggtcttaggtgcaagaactgcaagacgaacatccacgaacattgccagtcctacgtcgagatgcaacgctgctttggcaaaatacccccaggcttccacagagcatactcatctcccctgtactcaaaccagcagtatgcctgtgtaaaggacctctctgccgcaaatcgtaatgatcccgtgttcgaaaccctcaggactggagtgattatggccaacaaagagcgcaaaaaagggcaggctgataaaaaaaatccagtcgccgcaatgatggaagaggaacctgaatcagcacgacctgaggaaggaaaaccacaggacggcaacccagagggagacaagaaagctgagaaaaagactcctgacgacaagcataaacagccaggattccagcaaagccattatttcgtggctttgtacaggtttaaggcactggagaaagatgacttggacttcccacccggagagaagatcacagtgatcgacgatagtaatgaggaatggtggcgcggaaaaattggcgagaaggtgggattctttcccccaaacttcatcataagagtccgggccggtgagcgcgtgcaccgggtcacccgtagcttcgtgggcaatagggaaatagggcaaataacactaaaaaaggaccagatcgtggttcagaagggagatgaggctggaggatacgttaaggtgtacactggaaggaaggtgggcctctttccgacggatttccttgaagagatctag

SEQ ID NO: 50958 - DNA, 507 bp, Artificial Sequence
  Description of Artificial Sequence: Synthetic coding sequence
atgaccgagaaggaggtgctggagagccccaagcccagcttccccgccgaaacacgacagtctgggctgcagcgtcttaaacagctcttaaggaagggcagcactggcaccaaggagatggagctgcctcctgagcctcaggctaacggggaggccgtcggagctggaggcggtcccatatactacatctatgaagaggaggaggaggaggaagaagaagaagaggagcctcctcctgagccacctaagcttgtaaatgacaagcctcataagtttaaggaccactttttcaagaagccaaagttttgtgatgtctgtgccaggatgatagtgctcaacaacaagttcggtctgaggtgtaagaattgtaagaccaatatccacgaacattgtcagtcctacgttgagatgcagcggtgcttcggcaagataccacctggcttccaccgagcttactcaagccccctttacagtaaccagcaatacgcctgcgtcaaggacctctag

SEQ ID NO: 50959 - DNA, 978 bp, Artificial Sequence
  Description of Artificial Sequence: Synthetic coding sequence
atggagctgccccccgagccccaggccaacggcgaggccgtgggcgccgggggcggtccaatctactatatatacgaggaagaggaagaggaagaggaagaggaggaagaacccccccccgagccccctaagctggtcaacgataaaccgcacaaatttaaggatcatttcttcaaaaaacctaagttctgcgacgtttgtgcgcgcatgatcgttctcaacaataaatttggcctcaggtgtaagaattgcaaaactaatatccacgagcactgccagagctacgttgagatgcaacggtgctttggcaagatcccacctggatttcaccgcgcttactcaagtcccctgtactccaaccaacagtacgcctgcgtcaaggatctatctgcagcaaatcgtaatgacccagtgttcgagactcttagaaccggggtgattatggcgaacaaggaaagaaagaagggccaggcagataaaaagaatcccgtggccgctatgatggaggaggagcccgaatccgcaaggccggaggaggggaagccacaagatggtaatcccgaaggcgataagaaagcggagaaaaaaactcctgacgataagcataagcagccagggttccaacagtcccactatttcgtggctctatatagattcaaggccttagagaaggatgacttagactttcccccgggtgagaagatcacagtgatcgatgacagtaatgaggaatggtggcgaggcaagattggcgagaaagttggcttttttcctcccaattttatcattagggtacgggccggcgagagggtccacagggtgaccagatcctttgtcggaaacagggagatcggccaaattacccttaagaaggatcaaatcgtggtgcagaaaggcgatgaggccgggggatatgtgaaggtctataccggtcgtaaagtaggcctgtttcctaccgacttcctggaagagatttag

SEQ ID NO: 50960 - DNA, 4194 bp, Artificial Sequence
  Description of Artificial Sequence: Synthetic coding sequence
atgcccagcaagcccgagggcgccgccaagaccatcggcagctacgtccccggcccccgaagtaggagtccgtccctcaataggctggggggtgcaggagaggatggcaagcgaccacagcctctgtggcacgtagggagtccctttgctctcggggcaaataaggactccctgtctgcttttgaatacccaggcccaaaacgtaagctttattctgcagtgcctggccggctgtttgtcgcagtaaagccataccagccacaagtcgatggtgagatcccattgcacagaggagatcgggtcaaggtgctgtcgattggtgagggggggttttgggagggatctgcaaggggtcacataggctggtttccagcagagtgtgtcgaagaagtgcagtgtaaacccagagatagccaggccgaaactcgcgctgataggagcaagaaactgttccgccactacaccgtgggatcttacgactcttttgacacctcttctgactgtataatcgaggaaaagacggtcgttttgcagaagaaggacaatgaaggatttggcttcgtactgaggggtgcaaaagccgatactccaattgaggagttcacacctactccagcttttcctgccctccagtacctggagtctgtggatgagggaggtgtcgcctggcaggccggcctgagaaccggtgactttctgattgaggtgaacaatgagaatgtcgttaaagtcggacaccggcaagttgtcaacatgattagacaggggggcaaccatttggtcctgaaagttgtgaccgtcacacgcaatcttgacccagatgatacagcccggaaaaaggcccccccaccccccaagagggcaccaaccacagcgttgacactgaggtctaagtcaatgactagtgaactcgaagagctggtcgacaaagcctcagtccggaaaaagaaggacaagcctgaggagattgtcccagcttctaaaccctcccgagctgcggaaaacatggctgtagaaccacgagtcgctaccatcaagcagcggccttcaagtaggtgtttccccgcagggtctgatatgaactcagtgtacgaacgacagggcatcgcagtaatgactccgacagtcccaggctcccctaaagcaccctttcttggaattcccagggggacaatgcggaggcagaaaagtattgatagtcgtattttcttgtctggcattacggaagaggagagacagttccttgccccccctatgcttaagttcacccgcagtttgtcaatgccagacacatccgaagatataccacctccaccgcagagcgtgccacctagccctccaccccctagtccgacaacttacaattgcccaaagtctccaactccccgtgtgtatgggacaatcaaaccagccttcaaccaaaatagtgcagcgaaggtgagcccggccacccgctctgatacagtggccaccatgatgcgcgagaaaggtatgtactttcggcgcgagctcgatagatattcactagacagcgaggacctgtacagccggaatgcaggcccacaggccaattttcgtaataaacgcggacagatgcctgagaatccttattcagaggtcggtaagatcgcctccaaggctgtctacgtgccggcaaagccggccagacgaaagggtatgctcgtaaaacagtctaatgtggaagactcccctgaaaaaacgtgctccatcccaattcccactataatagtcaaggagccctcaaccagttcctccggcaaatcgtctcagggttcgtccatggaaatcgaccctcaggcccctgagcctccttctcagttacggcccgatgagtcattgactgtatcaagcccgtttgcagccgcaattgcaggtgccgtgcgggacagagagaagcggctggaagcccgccggaactctccagctttcctgagcaccgatcttggggacgaggatgttggcttgggccctcccgctcctcgcactcggccttctatgttccctgaggaaggggactttgccgatgaggacagtgcggaacagttgtccagtccgatgccctccgcgactccacgagagcccgaaaatcactttgtggggggagctgaagccagtgcccccggtgaggccggccgccctctcaactctacttctaaggcacagggtcccgagtcctcaccagctgtaccctcggctagtagcggaacagcaggaccaggaaactacgttcaccccctgaccggtcgcttattagaccccagctcaccactcgcactcgcccttagcgctagagacagagcaatgaaggagagccagcaaggaccaaaaggcgaagctccaaaagccgacctgaataaacctctgtacattgacacaaaaatgagaccctcactggacgcaggctttcctaccgtgacaaggcagaatacccgaggcccactgcgcagacaggagacggaaaacaagtatgaaaccgatttgggcagagacaggaaaggcgacgacaaaaagaacatgctgatcgatatcatggacactagtcagcagaagtctgctggcctcctgatggtccacaccgtggacgcaactaagcttgacaacgccctacaagaagaggacgagaaggcagaagtcgaaatgaaaccggactctagccctagcgaagtgcctgaaggagtgagcgagacagaaggtgccctgcagatcagcgccgccccggagccaaccacagtgcccgggagaaccatcgtggcagttggaagcatggaagaggctgtgattctcccttttcgcattccgccccctccgctcgcatcggtcgacctggacgaagattttattttcacagagcccctgccccctccacttgagtttgctaactcttttgacatcccagatgaccgcgcggcaagtgtgccggcactgtctgacctagtgaaacaaaagaagagcgacactccgcaatctcctagtctcaattcatcccaacctacaaacagcgccgactcaaagaaaccagcatcgctgagcaactgcctaccagcttccttcctgccacctcccgaatccttcgacgccgtggctgattcagggattgaagaggtggacagcaggtcaagcagcgaccaccaccttgagacaacgtcaaccattagcaccgtgtcttcaattagcaccctgtcttcagaaggcggggagaatgtcgacacttgcactgtctacgcagacggtcaagccttcatggtggacaaacccccggttccacccaaacccaagatgaagcccatcattcataaaagcaacgctctataccaagacgcactggtagaggaagatgtcgactcttttgtcattcctccccctgcccccccacctccccctgggtctgcacagcctggcatggcaaaagtgcttcagcccaggacgtccaaactatggggcgatgtcactgaaatcaagagccccatcctgtccggccccaaggcaaacgtcatcagtgagttgaactccatcttgcagcagatgaatagagaaaagctggccaagccgggtgaagggctcgatagccccatgggagccaagtcagcctctctcgcacctagaagtcctgaaattatgtcgaccatctccggaacgcgatccacaaccgtcacattcacagttaggcctgggacctcccaacctatcacactccagtctcggcctcctgactatgagtcccgtacgagcgggactcgcagggccccaagccccgttgtctcccctacggagatgaataaagagacactcccagctcctctgagcgccgcaacagcaagcccatctcctgcactcagtgacgtgttttccctcccgagccagcctccatcaggcgatctgtttggcctcaatccagcaggaaggtctcggagccccagcccctcaatactgcagcagccaattagtaataaaccgtttacaacaaagcccgtccacctgtggacgaagcctgacgtcgccgactggcttgagtccttaaatcttggagagcacaaggaggcttttatggacaatgaaatcgacggtagtcatctccccaacctacagaaggaagacttgatcgacctgggagttacacgggtcggacatcgaatgaacattgagcgcgctttaaagcagcttcttgataggtag

SEQ ID NO: 50961 - DNA, 4011 bp, Artificial Sequence
  Description of Artificial Sequence: Synthetic coding sequence
atggagaacctgcccgccgtgaccaccgaggagcccacccccatgggacgtggcccagtggggccctcgggtggaggtagcactagagatcaggtgcggaccgtcgtgatgagacccagcgtcagctgggaaaaggccggccccgaggaggcaaaggcgcctgtgagaggcgatgaggcaccccctgcccgcgtggcgggtccggccgctggcacccctccatgtcagatgggcgtgtaccccactgatcttacattgcaactgcttgcagtccgccgaaagtctcggttgcgcgatcccggcctccaacagacacttaggggtcagttgcgtctgcttgagaacgatagccgggagatggcaagggtgctgggagagttgagcgcgagactcctgtcaatccacagcgaccaggacagaattgtagtgacctttaagacattcgaggagatttggaagttttcaacctatcatgcgctcggcttcacccatcactgcctggctaaccttcttatggatcaggccttttggttgctcctcccatcagaggaggaagaaacagccatccaggtgcacgtggatgagaatgcactgcgcctgacccacgaatctcttctgattcaggaaggcccgttctttgtgctgtgtcccgaccatcatgtgcgggtgatgactggtccacgagatgcaggtaatggacctcaggcactgaggcaagcgtcaggcgcaccacagggagaagctgcccccgaaaccgattcttccccccccagtcctagcgtcagctccgaagaggtcgccgtcgccgccgcgcccgagcccctgattccttttcaccagtgggccctgcgtattcctcaggatcccattgatgatgccatgggggggccggtcatgcccggcaatcccctaatggccgtcggactcgcatctgccctcgcggattttcaaggcagtgggcctgaggagatgacctttcgtggaggtgatctcatagagatcctcggggcacaggttccttctttaccctggtgcgtggggagacacgcggcctcaggtcgagtggggttcgtcagatcttccctaatcagtatgcaaggacctgtgtccgagttagagtcagctatttttttgaacgaggaggaaaagtctttcttttcagagggttgtttctctgaagaggatgccagacagttactccgccggatgagcggtacagatgtgtgctcagtttattctttggacagtgtggaagaagccgaaacggagcagcctcaggagaaagagatacccccaccatgtctgtcactagagcctcaagaaacgcttcagaaggtcaagaacgtgctggagcagtgtaagacatgccccggttgccctcaggaacccgcatcatggggcttgtgtgcggcctcttccgatgtttcgctacaagatcccgaagagcctagcttctgtctcgaagcagaagatgattgggaagatcccgaggccttgtccagcctgctactgtttctgaatgcacccggctataaggcaagcttcagggggctgtatgacgtagctttgccttggctgagcagtgtgttcaggagcttctctgatgaggaagaactaaccggccgtctcgcccaggccaggggcgccgcaaaaaaagccggcctgctcatggccctcgccaggctgtgcttccttctggggagactgtgttctcgcaggctcaaactgagccaagccagagtgtatttcgaggaagccctgggtgccctggaggggtcgttcggagacctcttcctggtggtggccgtctacgctaatctggctagcatctatcggaagcagaagaacagggaaaagtgcgctcaggtggtgccaaaagccatggctctcctgctggggacccccgatcatatctgcagtactgaggcggagggtgaactcctgcagcttgcactcagacgagccgtcggaggccagagcctgcaggcagaggcacgtgcgtgctttctgcttgcacgccatcatgtccacctgaagcaacccgaggaggctcttccattcctagagcggctattgctcctgcatagggattcaggtgccccggaagccgcgtggctgtccgactgttatttattgctcgccgacatttatagccggaagtgcctgcctcatctcgtgctatcttgcgttaaggtggctagcctgcgcacgcgaggctctttggccgggagtctcagaagtgttaatctggtcttgcaaaacgcaccacaaccacattcccttcctgcccagacgtcacactacctgcggcaggcccttgcctctctgactcccggcacaggacaggctctgaggggccctctgtataccagcctggctcaactctacagtcaccatgggtgtcacggccccgccattacattcatgactcaggccgtcgaagcgagtgcgatcgctggggtgcgcgctatcgtggatcacttggtggcccttgcatggctccacgtactacatggtcagagccctgtggcccttgatatcctccagtccgtgcgggacgccgtagttgcatccgaagaccaagaaggagtgatcgctaatatggttgcagtggcacttaagagaactggcagaacgcgacaggccgctgagtcctattaccgcgcgctgcgtgttgcaagggatcttggccagcagcgcaaccaggcagtcgggttagctaactttggcgccttgtgtctacatgccggcgcatcccgcctggcccagcattatttgttagaggccgtgagacttttttctaggctcccactgggcgagtgtggacgcgacttcacgcatgtgctactgcagttagggcacctttgcacgagacagggccctgctcagcagggcaaggggtattatgagtgggctttgttggtggccgtcgaaatgggccatgtggaatctcagctgagggccgtgcagcggctgtgccatttctattcggcagttatgccatctgaagcacaatgtgtgatctaccacgaattgcagctgtccttggcttgcaaggtggccgacaaagttttagagggacagctgttggaaaccatctcacagttgtacctttcactcgggaccgagagggcttacaaatcagccttggactataccaaacgctcactcggtatcttcatcgatctgcagaagaaggagaaggaagctcacgcatggcttcaggccggtaaaatttattacatcctgcgacagtcagagctagttgatctgtatatccaggttgcccagaatgtggcgctgtatactggggaccctaaccttgggctcgagcttttcgaagcagccggagacatcttttttgatggggcctgggagcgtgagaaggctgtctccttctatcgggatcgggccctacccctcgccgtgactacaggcaatcggaaagctgaactcaggctgtgcaacaagttggtggctttgcttgctaccctcgaggaaccacaggagggcctggaattcgcccacatggcccttgccttatctatcacactgggcgatagacttaacgagcgggtggcttaccaccggttagctgcgctccaacatcgtctcggccacggcgagttggctgagcacttctatttgaaggctctaagcctttgcaactctccattagagtttgatgaggagaccctgtactacgtgaaagtgtaccttgtactgggtgacatcatcttctacgacctcaaagacccctttgacgccgcagggtactaccagctagccctggccgcagcagtggatctcggaaacaaaaaggcccagctgaaaatttatactcgccttgctaccatctatcacaactttctcctggatcgcgagaagtctttatttttttatcaaaaagctcgaacattcgccacagagttaaacgtacgcagggtgaatctgcctcccctgcccctttgtggctgggccccatggcttgcgccttcacaccctcgctag

SEQ ID NO: 50962 - DNA, 2469 bp, Artificial Sequence
  Description of Artificial Sequence: Synthetic coding sequence
cccacccgggccagcagcagcaagaagcagcggccccccagcagcgggagccggtgggctctccggatccctcaggatcctatcgacgacgcgatgggagggcctgttatgccaggaaatcctctgatggcagtcgggctggctagtgcattggctgacttccagggaagcggccccgaggagatgacatttagggggggcgatcttatcgagattctcggggctcaggttccatccctgccttggtgcgtcggacgccatgcagctagcggcagggtcggctttgtgagaagcagcctaattagtatgcaggggcctgtcagcgagcttgaatccgctatctttctcaatgaggaggagaagtccttcttttcggagggctgcttttcagaggaagacgccaggcagttactgcgccgcatgtcaggaacagatgtgtgctctgtgtattctctggatagtgtggaagaagccgaaactgagcaaccccaagaaaaagaaatcccacctccttgcctctcactggagccacaggagaccctgcagaaggtcaagaatgttctcgaacaatgtaagacatgcccaggatgccctcaggaaccagcgtcatggggattgtgcgctgcaagttccgatgtctccctacaagatcctgaagaaccaagtttctgcctggaagccgaggatgattgggaggatcccgaagcgctgagctctctccttctcttcctcaatgcccctggctataaagccagtttccgcggcctgtacgatgtcgccctcccctggctgagttcggtgttcaggagtttcagcgatgaagaggaactgacaggtagactggctcaggctcgcggagcagccaaaaaagcgggtctattgatggcactggcccgattatgcttcctcctcgggcggctgtgcagtaggcgactcaagctgtcccaggcccgggtttactttgaagaggcactcggtgccttggaaggctcctttggtgatctctttttagtggttgctgtttacgcaaatcttgccagtatctaccgtaagcagaagaaccgcgagaaatgtgcacaggtggtccctaaagctatggcgttactgttggggaccccggatcatatttgctcaacagaggcggaaggcgaactcctgcaactcgctctgcgacgtgctgtcggggggcagagtctacaggccgaggccagggcatgcttcctgcttgcaagacaccacgttcacctcaagcagcctgaggaagccctccccttcttggagaggctcctgcttctccacagagactccggggcccctgaggccgcctggctgtctgactgctatttgttactggctgacatctattcaaggaagtgcttaccgcacttggtcctaagctgtgtgaaagtggccagcctaagaacgaggggttcccttgccggttctctgagaagcgttaacctggttttgcagaacgcaccccaacctcattctctgccagctcagacctctcactacttacgccaggccctcgctagtctgacacctgggaccggccaggctctccggggccccctgtataccagtttggctcaactgtatagccaccacgggtgccacgggccagctattacgtttatgacccaggccgtcgaggcgtctgcaatcgctggggtgcgtgcaatcgttgatcatttagtcgctctcgcctggttgcacgtcttgcacggccagagtcctgttgcactagacatcctccagtctgttcgtgacgccgtggtggcatccgaagaccaggaaggcgtgatcgccaacatggtggccgtcgccctgaagagaacggggcggacccgccaggcggcagagtcatactacagagcattaagagttgctcgagatctgggccaacaacgaaatcaggctgtcgggttggcgaactttggggcgctatgtttacacgcgggtgcctcaaggctggcccaacactacctcctggaagcagtaaggctcttctccagacttcctctgggcgagtgcgggcgcgatttcactcatgtgctgttacagctggggcacctgtgtacccgtcagggccccgcgcagcaaggaaaagggtattacgaatgggctttgctggtggccgtggaaatgggccacgttgagagccagcttcgggcagtacaacgtctatgccatttttattccgccgtgatgccctctgaagcacagtgtgtgatttaccacgagctacagctaagcctggcgtgtaaggttgcagataaggtgctcgaaggtcaactgcttgagactattagccagttatacctgtcgctgggtacagagcgctcaagtcagccccagcagaagcaacttcatgccttctgggctgtgctccctacttggtggttattgagctcggacctgtgtctgccacgggtgttcacacccggccttcatctctcaccctag

SEQ ID NO: 50963 - DNA, 285 bp, Artificial Sequence
  Description of Artificial Sequence: Synthetic coding sequence
atggagaacctgcccgccgtgaccaccgaggagcccacccccatgggcagggggccggtcggacctagtggcggaggatccacacgcgatcaggtaaggaccgttgtgatgcgacccagcgtgtcttgggagaaggcagggcctgaagaagcaaaggctcccgtacgcggagacgaagcccctcccgcacgcgtagcaggcccagcagccgggacccctccctgccagatgggtgtttaccctaccgatctcaccctccagctcctcgccgtgcgccggaaatag

SEQ ID NO: 50964 - DNA, 3195 bp, Artificial Sequence
  Description of Artificial Sequence: Synthetic coding sequence
atggaccaggccttctggctgctgctgcccagcgaggaggaggagacagcaatccaggtgcacgtggacgagaatgcacttaggctgactcacgaaagcttgctcatacaggaaggtccattctttgtgctttgtcccgatcaccacgtgcgtgtgatgaccggaccacgcgacgcaggtaacggaccccaggcccttaggcaggcttcaggcgctcctcaaggggaggccgcccctgagacggactcatcgcctccctctccaagcgtgagcagcgaggaggtggccgtcgccgcagcacctgagcccttgatcccctttcaccaatgggcccttcggatcccccaagatccaattgatgacgcaatggggggtcctgtgatgccgggtaatccactcatggccgttggactagccagcgcgctggcagactttcaggggtcaggccctgaggagatgacatttagggggggggatctgatcgagattctcggggcccaggtgccgtcactgccatggtgcgtcggccggcacgccgcctccggtcgggtgggattcgtccgcagctccttgatcagtatgcagggaccggtgtcggagttggagagcgcaatcttccttaatgaggaggagaagtcctttttctcagagggctgtttcagtgaggaggatgctcgccagttactcagaaggatgtcaggtacagatgtgtgcagcgtttatagcctggattccgtggaagaggccgaaactgagcaaccccaggaaaaagagattccacctccatgtctcagcctggaacctcaggaaacactgcagaaagtaaagaatgtcctagagcagtgcaagacctgtccaggctgtccccaagaacccgcaagctggggcctctgtgcagctagttccgacgtgtccctgcaggatcccgaggagccaagtttttgcttggaagcggaggatgattgggaagatcccgaggctctatcttcactgctgttgtttctcaacgcacccggatacaaagcttcattccggggattgtatgacgtggccctgccttggctgagttcagtatttcgctctttctctgatgaggaggaactgaccggccgactcgctcaagccagaggcgctgctaagaaggcgggcctcctgatggccctggcccggctatgcttcctgctgggtcgcctctgttctaggcgcttgaaactgtcacaggctcgggtgtatttcgaggaggctctcggcgctctggagggaagtttcggcgacctgtttttggtagtggccgtgtacgccaatctggcctcaatttaccgcaagcagaagaatcgggagaaatgcgctcaggtggttcctaaagcaatggcccttcttctgggaacacccgaccacatttgcagtaccgaggctgagggggaactgcttcagctagctctgaggcgcgccgtaggaggccagtcacttcaggccgaagctcgcgcctgctttttgttggccaggcaccacgtgcacctgaagcagcccgaggaggccctacccttccttgagagattgctgctgctacacagagacagtggagcccccgaggccgcctggctgtcagattgttacctgctcctggctgacatatactctaggaaatgtctgcctcacttagtgctttcttgcgtcaaagtggcaagtctgcgaactagaggaagcctggcaggaagcctgagatcagtgaatctggtgttgcagaatgctcctcagcctcattcactgcctgcgcagacaagccattacctcaggcaggcactcgcctcattaactcctggtaccggccaagcattgcgcggccccttgtacacgtccctagctcagctctacagccaccacgggtgccatgggccagctattacattcatgacgcaggccgttgaggccagcgccattgccggggttagagccattgttgaccacttagtggctttggcatggcttcacgtgttgcatgggcaaagtccagtcgcactggatatcctgcagagcgtgcgtgacgcggttgttgcctctgaagatcaagaaggggtgattgccaacatggtggctgtggccttgaaaaggactggacgcactagacaggccgcagagagttactaccgtgctttacgggtggccagagacttgggtcagcagaggaatcaggccgtgggtcttgccaacttcggagccctctgcctccacgccggcgcatcgagactagcccaacactatcttcttgaggcagtccgactgttctcaagactgcctctgggcgaatgtggaagggatttcacacatgtgctactgcaattgggccatttatgcacgcgacagggccccgcgcaacagggcaagggctattatgagtgggcccttttggtagccgtggaaatgggccacgtcgaaagccaactgagggctgtccaaaggctgtgtcacttttactcggctgtgatgccatcggaggcccagtgcgtcatatatcacgaacttcaacttagcctcgcctgcaaagtggcagacaaggttctggagggacagctgttggagaccattagccagttgtacctgtcactcggcaccgagcgcgcctataaatccgccctggattatactaagcgcagtctgggcatttttattgacttgcagaaaaaggagaaggaggcccacgcctggctgcaggccggtaaaatatattatatcctccgccagtctgaattggtcgacctatatatccaagttgcacagaatgttgcactgtacactggtgatccgaatcttggactggaactgtttgaggctgccggcgatattttttttgatggcgcttgggagagggagaaggccgtgtctttctaccgggacagagccttgcctctggccgtcactactggaaatagaaaagcagagctgagactgtgcaacaagcttgtggcactgctggccacattggaggagcctcaggaaggcctcgagttcgcccatatggcattagccctctcaatcactctcggagaccgactcaatgagcgagtggcctaccacaggctcgcagctctccagcaccgtttaggacatggggagctggccgagcatttctacctcaaggcactgagcctctgcaactcacctctggagtttgacgaggagactctgtacacttag

SEQ ID NO: 50965 - DNA, 3783 bp, Artificial Sequence
  Description of Artificial Sequence: Synthetic coding sequence
atgggcgtgtaccccaccgacctgaccctgcagctgctggccgtgcgacgtaaatcccgcctgagagatcctgggctgcagcagacactgaggggccagctcagactactcgagaacgatagcagggagatggctagagtgttgggggagttgagtgcccgtttgttatccatacacagcgaccaggacaggattgtcgtcacctttaaaacattcgaggagatctggaagttctccacttaccacgctcttggttttacacatcattgtctggctaacctgctgatggatcaggcgttttggctgcttctcccatctgaggaggaggagacagccattcaagtccatgtggacgagaacgcattaagactaacccatgagtctctattgattcaggaaggccccttctttgtgctgtgtccagaccatcatgtgcgggtgatgaccggccctagagacgcgggaaacggacctcaggcacttcgccaggcttccggtgcccctcagggcgaagccgcacctgagacagattccagccccccttcgccctctgtgagtagtgaagaggtagctgtggccgcggctccagaaccactcatccccttccaccagtgggcccttcgtatcccccaggatccaatcgacgatgcgatggggggcccagtgatgcccggtaatccactgatggcggttggccttgcatccgccctggcagatttccagggctctggtccggaggagatgaccttccggggcggcgatctgatagagattttaggggcgcaagtcccttcgctgccatggtgcgtgggtcgccacgccgcttccggccgcgttgggtttgtgcggtctagcttaatttcaatgcagggaccagtttccgagttggaatcagccattttcctgaatgaagaggaaaagtcttttttttcagagggttgtttctcagaggaggacgctcggcagcttctgcggagaatgtcaggaactgacgtctgctctgtgtattctctggatagcgtggaagaggccgagacagagcagcctcaggaaaaggagataccccctccttgcttatcactggagcctcaagagaccctgcaaaaggtgaaaaacgtgctggaacagtgcaagacgtgcccggggtgcccccaggagccggccagttggggtctctgcgctgcatcgtcagatgtgagcttacaggaccccgaggagcccagtttttgtcttgaagccgaagatgactgggaagatcccgaggccttgtcaagtttgctgttgtttctcaatgctcccgggtacaaggcttcttttcgcggactgtatgatgtggctcttccgtggctgtcatcggtttttcgatctttctctgacgaggaggagctgacgggccgacttgctcaggctcgaggcgcagctaagaaggcagggctcttgatggcactcgctaggctatgcttcctgctgggacggctgtgcagtagaagactcaagctgtctcaggccagggtttatttcgaagaagccctgggggctctggaaggtagctttggcgatcttttccttgttgtggcagtttatgcaaacctggcaagcatctacagaaagcagaagaatagagaaaagtgcgcacaggttgtacctaaggctatggccttgcttctcgggactcccgaccatatctgttctactgaagccgaaggggagctactgcaactggctcttagacgggcggttggcggacagtctctgcaggcagaagccagagcctgctttcttctggctcgccatcacgtgcacctgaaacagccagaggaggcccttccctttctggagcggttattgctgttgcaccgagactctggcgctccagaggcagcttggctttccgactgttatctgctactggcggatatctacagccggaagtgtctgccccatctggttctcagctgcgttaaggtggcctctctgcggacacggggatcactggcggggagtctccgctcagttaacctggtcctgcaaaacgcacctcagccccactcactccctgcccagacatcccactatctacggcaggcactcgcaagcttaacccctggaactgggcaagcactccgcggtccactctatacctccctcgcacagctgtattcacaccatggctgccacggacccgctatcacgtttatgactcaagcagtggaggcttctgccattgcaggcgtacgggcaatcgtagatcacctggtggctcttgcctggttgcatgtgttgcatgggcagtccccagttgcgcttgacattcttcagagtgtcagggacgccgttgtggctagtgaagatcaggagggcgtgatcgccaatatggttgccgtggctctgaagcgtacaggacgcacacggcaggcagccgaaagctactatcgggccctgagggtcgctagagacttggggcagcagaggaaccaggcagtcggcttggccaatttcggcgcgctgtgccttcatgccggtgcatcacggttggctcagcactatctccttgaagccgttagattgttttccagactgccactgggtgaatgtggaagagacttcacccacgtgctgctgcagttagggcacctgtgtaccaggcaaggacccgcccaacagggcaagggatactatgagtgggcacttttggtggctgtggagatggggcacgtggaatcgcagcttcgagccgtgcagcgactctgtcatttttatagcgcagtcatgccttcagaagcacagtgtgtaatctaccacgagttgcagctgtctctcgcatgcaaagtcgcagataaagtgcttgaaggccagttgctggagactattagccagctctacctgtccctgggcacagaaagggcatataagtcagcactcgactacaccaagcgcagcctcggcattttcattgatttgcagaagaaagagaaggaagcccacgcttggcttcaggccggcaagatttattacatccttaggcagtcagagctggtcgatctgtacatccaagtggcccagaacgttgcgttgtatacaggcgaccccaacctggggttagagcttttcgaagcggccggggacatcttcttcgatggggcatgggagagagagaaagcagtgtccttttaccgggatcgggcactgcctctagcggtgactacagggaatagaaaagctgaactgcggctctgcaataagctggtcgccctgcttgccaccctagaagagcctcaagaggggctagagtttgcacatatggccttggctctgagtatcaccctcggcgataggctcaacgagcgcgtggcctatcaccggctggccgcgctacagcaccgcctcggccacggagaactcgccgaacacttttacctcaaagccctatcactatgtaattcgccactcgaatttgacgaggagacactttactacgttaaagtgtacctcgtgctaggggatataatcttttacgatctcaaggacccttttgacgccgccgggtactatcagctggccctggcagctgccgtggacctcggaaacaagaaggcccagctcaagatatacactagactagcgactatctaccacaactttctgctggatcgcgagaagagcctgttcttctatcagaaagcccgcaccttcgcaaccgagctgaatgtccgtagagtgaacctaccaccattgcccctatgcgggtgggccccctggctggctcctagccacccccggtag

SEQ ID NO: 50966 - DNA, 1209 bp, Artificial Sequence
  Description of Artificial Sequence: Synthetic coding sequence
atgcccgacaagaccgccacccccgagcggccccccgcccccgagaacgctccaagctcaaaaaagatacctgctccggacaaagtcccctctccggagaaaacacttactctgggtgacaaagcatctattcctgggaactccacatctgggaagattcccgcacccgataaggtgccaacgccagaaaaaatggtaactcccgaggacaaggcttctattccagagaacagcatcattccggaagaaactctcaccgttgacaaaccatccacgccagagagagtgttcagtgtcgaagaaagccccgcactggaggcacccccaatggacaaagtgccaaaccccaagatggctcccctgggcgatgaggcaccgaccctggaaaaggtactgacaccggagctttccgaggaagaggtgagcacccgggacgatatccagttccatcacttttctagtgaagaagcccttcagaaggtcaagtatttcgttgcaaaagaggacccttcttctcaggaagaagcgcatacgccagaggctccaccgccccaacctccgtccagtgagcggtgtctaggcgaaatgaagtgtacacttgtcaggggggatagtagtcctcgccaagccgagctgaagagcggaccagcatcccgaccagcgctggagaaaccgcaccctcacgaggaagcgactacgcttccagaggaggctcccagtaatgatgagcggacccccgaagaagaggctccaccgaacgaacaacggcctttgcgtgaagaggttcttccgaaagagggggtcgcgtcaaaggaggaggtgacccttaaagaggaactacccccaaaggaagaggtggccccaaaagaagaagttccacctatagaacgcgcgtttgcccagaagaccagacccatcaaacctccgcctgactcacaggaaactctggctctgcccagcctggttcctcagaactacaccgagaacaagaatgaaggcgtcgatgttactagcttgcgcggtgaagtcgagagtcttcggcgcgctctggagctcatggaggtccagctggagaggaagttgacggacatttgggaagagttgaaatcagagaaagaacaacggcggaggctcgaggttcaggtcatgcaaggaactcagaagagtcagactcccagggtcattcacacgcagacccagacatactag

SEQ ID NO: 50967 - DNA, 1923 bp, Artificial Sequence
  Description of Artificial Sequence: Synthetic coding sequence
atggtgcagagcgagctgcagctgcagccccgggccggcggccgggctgaggccgctagctggggtgacagagggaacgataaggggggcctgggaaatcccgacatgcccagcgtctcgcctggcccacaacggccccctaaactgtctagcctcgcatatgattccccacctgattatctccaaactgtgtcccaccctgaagtctacagggtgcttttcgattatcagcccgaggctcctgacgaactggctctgcgtcggggtgacgtagtgaaagttttgtctaagacgactgaggataaggggtggtgggagggcgagtgccagggccgcagaggcgtctttcccgataacttcgtcctccccccaccgccaattaaaaaacttgtgccccggaaggttgtgagtagggaatcggctccaataaaagagccaaagaagcttatgccaaaaaccagcctgccaacagtcaagaaactcgccaccgctaccaccggaccgagtaaggccaagacctctaggacaccatcacgcgattcccagaagctgacatcacgcgatagcggccccaacggcggatttcagtccgggggtagctatcaccctggacgtaaacgaagtaagacccagacaccacagcagagatccgtgagtagccaagaggaagagcattcctctcccgtgaaagcaccctcagtcaagagaacacccatgcccgacaagacagcgaccccagaacggccgcccgcccctgaaaatgccccttcttccaaaaaaatacccgctccggacaaggtcccaagccccgagaaaacacttaccttgggtgacaaggcctccatccccggaaactcaacatcggggaagattcctgcccccgataaggtgccgactcccgagaaaatggtgactccggaggataaggctagcattccagagaatagcatcattccagaggagacactgaccgttgataagcccagtacaccagaacgcgtgttttcagtggaagagagcccagccctggaagcaccccccatggacaaggtaccaaaccccaagatggcccctctgggcgacgaggctccaaccctggaaaaggtgctgacacctgagttgagtgaggaggaggttagtactagggatgatatccaatttcaccactttagctcagaggaggcattgcaaaaagtaaagtacttcgtcgccaaagaggatcctagttcccaggaagaggcccacacccctgaggccccaccaccacagcctccaagcagtgagcgttgcctgggggagatgaagtgtaccttggtgcgaggagatagctcaccgagacaagcggaactaaagagcgggccggcatcccgtcccgccttagaaaaacctcacccacacgaggaggcaacaacactgccagaagaggcgccatccaacgacgaacgaactccggaggaggaagctcctccaaatgaacagcgaccccttagagaggaggtgctgccaaaagaaggcgtggcctcaaaggaagaggttactttgaaagaggaactacccccgaaggaggaggtggcacccaaggaagaggttccccccattgagagggctttcgcccagaagaccagacctatcaaaccccctcccgacagtcaggagacccttgctctcccctctctggtcccccaaaattacaccgaaaacaaaaatgaaggggtagatgttacttccctccggggcgaagttgagagcctcagacgagctcttgagcttatggaagtacaattggaacggaaattgactgatatttgggaggagttgaagtccgagaaggagcagcgccgccggttggaagtccaggtgatgcaagggacccagaaatcccagaccccccgggttatacacacccagactcagacatattag

SEQ ID NO: 50968 - DNA, 2271 bp, Artificial Sequence
  Description of Artificial Sequence: Synthetic coding sequence
atggaggtgctggtgctggccggctaccgggcccagaaggaggacgagctgagtttagcacccggcgatgtggttcgacaggtccgctgggtccctgcccgcggctggcttaggggcgagtttggcggacgctacggattgttccccgagaggctcgttcaggagatccccgaaactttgcgaggaagcggtgaagccaggcggcccagatgcgcccgccgccgcggccacccagctaagcatccacgcccccagcggtggtgtaaggtcaatttttcttactcaccggagcaggcggatgagcttaagctgcaggcaggtgagatcgttgaaatgattaaggagatcgaagacggatggtggcttggaaagaaaaatggacagctgggcgcattccccagtaatttcgtggagctgttggatagtggtccaccttcccttggcaacccagacatgccatcggtgagtcctggaccccagcggcccccaaagctgagctcacttgcatacgattccccgcccgactatcttcagaccgtttctcacccagaagtgtatagggtactgttcgattaccaaccagaagcccccgatgaactggctctgcggcgtggcgacgtggtcaaagtgctcagcaaaaccacagaggacaaggggtggtgggagggtgagtgtcagggccgtagaggagtgtttcctgacaactttgtgctgccacctccccctattaagaaactggtcccgcgcaaagtagtgtcacgcgagagcgcccctataaaagagcccaaaaagctgatgcctaaaacctcgctgccaactgtgaaaaagctagctaccgcgaccaccggacctagtaaagccaaaacctccaggaccccctctagggacagccagaaactgacttcccgagacagtggcccaaatgggggctttcagtctggaggatcgtaccacccaggacgcaagagaagcaagacccagacccctcaacagaggagtgtgtcaagccaagaggaggagcattcgtcgcccgtcaaggctccctccgtaaagcgaaccccaatgcccgacaagactgcgacccccgagcgacctcctgcccccgagaacgcacccagcagtaagaaaatccctgcacctgacaaggtacccagccccgagaagaccctcacactgggtgataaagcctccatcccaggtaatagcacctccgggaagattcctgcccctgataaagtgcctacacccgagaaaatggtaacccctgaagataaagcgtccatccccgaaaacagcataatccccgaggagactctgaccgtggacaagccaagcactcccgaaagggtcttctctgtggaagagagccctgcgctggaggcccccccaatggataaagttcccaatccaaagatggcacccctgggagacgaggcgcccactctcgagaaggtgctgacccctgaactctcagaagaagaggtctccaccagagacgacatccagtttcaccacttctcctccgaggaggccctgcagaaggtgaaatatttcgtcgccaaagaagatccctcaagccaggaagaagcccacacccccgaggccccccctccgcagcctccttcctccgagaggtgcctgggtgagatgaagtgcacactcgtcaggggagattcctcaccccgccaggctgaactgaaaagtgggcctgccagtcggccagcccttgaaaagccacacccccacgaggaggcaaccaccctgccagaggaggcaccctccaacgatgagagaacccctgaggaggaggctccacctaatgagcagcgtccacttagagaggaggtgctcccaaaagaaggagtcgcaagtaaggaggaggtcactctcaaggaagagctgcctcctaaggaggaagtggcacctaaggaggaggtcccccccattgaacgcgcgtttgcccagaagactagacccattaaaccccctcccgactcacaggagactttggcgttgccgtcactggtgccacagaattataccgaaaataaaaatgaaggtgtcgacgtgacatctctgagaggcgaagtggagagcctgcgtagggccttggaattgatggaagtgcagctcgagcggaagcttacagacatatgggaggaacttaagagcgagaaggagcaacgtcggcgactagaagtacaggtcatgcagggcacccagaaatcccagactccaagggtgatccacacacaaactcagacatattag

SEQ ID NO: 50969 - DNA, 1938 bp, Artificial Sequence
  Description of Artificial Sequence: Synthetic coding sequence
atgatcaaggagatcgaggacggctggtggctgggcaagaagaacgggcagctcggtgcgttccctagcaatttcgtagagctccttgactccggtccgcctagtctgggcaacccagacatgcctagcgtatcaccgggaccccaacggcctcccaaattatcgtctctggcatacgattctccaccggactaccttcaaaccgtcagtcacccagaagtataccgggtgctctttgactaccagcctgaggcacctgacgaactggcactgaggcggggtgacgtggtgaaagtgctatcaaaaaccacagaggataagggttggtgggaaggtgaatgtcaggggaggcgtggcgtgttccctgataactttgtgctccctcctcctcccatcaaaaagcttgtcccccggaaagtggtcagtcgcgaaagcgctcccatcaaagaacctaagaaactaatgccgaagacttccctgcctacagtcaaaaagctcgccaccgccactaccggccccagtaaggccaagacatccaggacaccttctcgcgattcccaaaagctgacctccagagactccgggcctaatgggggcttccagtccggtgggagctaccaccctggcagaaaaagatcaaagactcagactccccagcaacggagcgtgtcatcccaggaagaggagcattcatcacctgtaaaggcaccaagtgtgaagcggactcccatgccggacaagacagcaacccccgagcgccccccagcccctgaaaatgcgccaagcagcaagaaaatccctgcacccgacaaagtgccttctcccgagaaaaccctgacactgggagacaaggcatccattcctggcaacagcactagtgggaagattcccgctcccgacaaggtcccaacacctgagaaaatggtcacccctgaggataaagcctccatccccgagaactctatcatccctgaagagactctcaccgtggacaaaccgtccacaccagaaagagtgttctccgtcgaggaatcccccgccctcgaggctcccccaatggataaggtccctaaccccaaaatggcccccctcggcgatgaagcacccacactggaaaaagtgctgacccccgagttatcagaggaggaggtgagcacccgagatgacatacaatttcatcatttctcctctgaggaggcccttcagaaggtgaagtatttcgtggcgaaggaagatcccagctcccaggaggaagcccatacaccagaggcgccgccgccccagccgccctcttctgagagatgtctgggagagatgaagtgcacgctggtccggggcgactcctccccccgtcaggctgaactcaagagcggaccggcctcgaggccagctcttgagaaaccacaccctcatgaggaggcaactacactgccagaggaggcacccagtaatgacgagagaacgcctgaggaagaggcaccacccaatgaacagcggcctctgcgcgaggaagttttgccaaaggagggggtcgcctccaaggaagaggtaacactgaaggaggagctcccaccaaaggaggaagttgcccccaaggaagaggtaccaccgatagaaagagcctttgcacaaaaaacacgccctatcaaacctcctcccgactctcaagagacactcgcgcttcctagcttggtgccacagaactatactgagaataagaatgaaggagttgacgtcacttccctgaggggggaagtggaatccttaaggcgtgcactcgagctcatggaagttcaacttgagcgcaagctgacagacatttgggaagaactgaagtcggagaaggagcagcgcagacggctcgaggtgcaggtgatgcaagggacgcagaagagtcagactccgcgggtgatccatacacaaacccagacgtactag

SEQ ID NO: 50970 - DNA, 2649 bp, Artificial Sequence
  Description of Artificial Sequence: Synthetic coding sequence
atgctgctgggcgccagctggctgtgcgccagcaaggccgccgccgctgccgcccaaagcgagggcgacgaggatcgccctggagagaggcgcaggaggcgcgctgccgcaaccgctgcaggggccggggaagatatggatgagtcaagtctcctggacctgctcgagtgctccgtgtgtctcgaacgactggatacgacagccaaggtgctgccctgtcagcacacattctgtaggaggtgtttagagagtattgtttgcagtcgacacgaactcaggtgtcctgaatgccggatactggttggctgcggtgtggatgagttgccagcgaacatccttctagttcgccttctcgatggcattaggcaacgacccagggctggaacctcaccaggggggagcccaccagcccgcccaatcccaggtcagagtgcagccccaactctggctgggggggggggaggggcagctgggtcaacgcctggtagtcccgtattcctgagcgcggccgccggttcaacggcaggctccctgcgagagttagcgacctcacgtacggcgcctgccgctaagaatccttgtttactgccatacgggaaggctttgtactcttatgaggggaaggaacccggtgacctaaaatttaacaaaggagacatcatcgtgctgcgccgcaaggttgatgaacagtggtaccacggcgagctccatggcacccaaggatttctgccagccagttatattcagtgtatccagcccttgccgcatgccccccctcagggtaaagccctctatgacttcgagatgaaggataaggatcaggataaggattgcttgaccttcaccaaggacgaaatccttaccgtgctaagacgcgttgacgagaattgggcagaaggcatgctaggcgacaagattggcatttttccactcttgtatgtggagcttaacgactcagccaagcaattgattgagatggacaaaccttgccctgctgcagcctcaagttgtaacgcctccctcccgtccgatagcggggccgtcgctagcgtggcgccaagccccacactgagctcctccggagccgtgtctgccttccaaagaagggtggacggtaaaaagaataccaagaagcgccactcattcacagccttaagcgtgacgcataggagctcacaggcagcatcacaccgccattccatggaaatctcagccccagttttgatctcaagtagcgacccacgtgcagctgccagaatcggtgatctcgcacacctttcgtgcgctgcacccacacaggatgtttcctcttccgcggggagcaccccgacagccgtcccccgagccgcatccgtcagcggggagcaggggaccccacccaaggtgcaacttcccttgaatgtttacctggcactatatgcctacaagccacagaaaagcgatgagctcgagctccataagggtgaaatgtatcgggtgttggagaagtgccaagatggctggttcaaaggtgcttcactgcgtacgggagtgagcggcgtgttccccggcaactatgtaactcccgtgtcccgtgtgcccgccggaggcgccggaccccctagaaacaatgtcgtgggtgggtctcctcttgcgaaaggaattactaccaccatgcatcctggctctggctcactgagctcattggccacagcgacccgccccgctctaccaataacgactccgcaagcccacgcccagcatccaaccgcctcacctcccacaggaagttgcttacgccacagcgcccagcccacagctagccaggcccgctctacaatctctacagcagctcattctgccgctcaggcgcaagatcggcccactgcaaccgtatcacccctgcggacacagaactctccctcccggttacccgcaacatccctgaggccccacagtgttgtgagcccacagcactctcaccagcccccggtccagatgtgtcctcgtcctgccatccccctaacttccgccgcatccgccattacaccccccaatgtgagcgctgccaatttgaacggcgaggcaggcggtggccctattggtgtcctttcaacctcaagcccaactaatactggttgtaaactcgacgagaaaaagtcagagaaaaaagagaagaagagcgggctgctaaaactcttagccggcgcctctacaaagaaaaagtccagaagcccgccaagtgtgtccccaacccatgacccgcaggtagccgtggatgcactgttgcagggcgctgtcggtcccgaggtgagcagtctctctattcatgggcgagccgggagctgccccatcgagtctgaaatgcaaggggccatgggaatggaacctctccatagaaaggctggatcactcgatctgaattttacatccccttcccggcaggcccccctgtctatggctgctattcgccccgaacccaagttgctgccccgagaacggtaccgcgtcgttgtctcttaccccccccagtctgaggcagagattgaactgaaagagggagacattgtatttgtccataagaagagggaggacggatggtataagggaactcttcaaaggaacggaagaacagggctgttcccaggcagtttcgtggagagtttctag

SEQ ID NO: 50971 - DNA, 2151 bp, Artificial Sequence
  Description of Artificial Sequence: Synthetic coding sequence
atgctgctgggcgccagctggctgtgcgccagcaaggccgccgccgcagctgcccaatcagaaggcgatgaggatagacccggcgagcggaggcgcagaagggccgctgcaaccgccgccggcgctggtgaagacatggacgagtcctcactgctcgatctgttggaatgctcagtttgcctggagagactcgatactactgccaaggtacttccctgtcagcacaccttctgccggcggtgcctggagtcaattgtttgctcaaggcatgaactccgctgtccggaatgtcgcatcttggtcggctgcggcgtggacgaactgccagcaaatattctgctggttcgtttgctcgacgggatcagacaacgcccccgggcaggtacgtccccgggcgggagccctcctgcacggcctattccaggtcaaagcgccgcacccacactcgcaggcggtggcgggggagccgcaggctcaactcctggtagtccagtctttctgtctgctgcggctggatctaccgccgggagcctccgtgagctggctacttccaggactgcccccgcagctaaaaacccgtgtctcctcccctacggtaaagcactctattcttacgaaggaaaagagccaggcgatctgaaatttaataagggtgatattattgtgctcagaaggaaagtcgacgagcaatggtatcatggagaactgcatggtacacaagggttcctgccagccagctacatccaatgcatccaacccctgccccacgcacctccccagggaaaagcactgtacgattttgagatgaaggacaaggaccaggacaaggactgtctgacctttacaaaggacgaaattctgacagtccttcggagggtggacgaaaattgggctgagggaatgctgggagataaaatcggaatctttccgcttctgtacgtggagctgaatgatagcgcaaaacaacttatagagatggacaagccttgcccagcagctgcctcttcctgcaatgcgtctctcccctctgactcgggagctgttgcctcagtggccccatcacctaccttaagtagctccggcgctgtaagcgcctttcagcgaagagtggacgggaagaaaaatacgaaaaagaggcattcttttaccgctctatcagtcacacacaggagttctcaggcagccagccaccgccattccatggagatctcggcacccgtgctcatctcatcatctgatccccgtgcagccgctaggatcggggatcttgctcacctatcctgtgcggcacccacacaagacgtgtcctcttctgcggggtctacccctacagccgttccgcgcgctgcaagtgtctccggcgaacaggggacaccgcccaaggtgcaactcccactaaatgtctacttggccctgtatgcctacaagcctcagaagtcagatgagcttgaactccacaaaggagagatgtaccgcgtgttagaaaagtgccaggatgggtggtttaagggcgcttccctccgcaccggagtgagcggcgtctttcccggaaattacgtcaccccagttagccgtgtgccagccggcggggccggaccacctcgcaataacgtggtgggagggagccctctggccaaagggattacaaccacaatgcaccccggcagcgggtctctgtcctcactggccacagccaccaggcccgcattgccaatcacgacacctcaggcgcatgcacagcatcccactgcctccccacccacaggatcctgtcttagacatagcgctcagcctaccgcctcacaggcccgcagcacaattagcaccgctgcacacagcgcagctcaggctcaggatcgacccacagccacagtttctcctctacgcacccagaactcccccagtagattgccggccacatctctgcgcccccactctgtggttagtccccagcattcgcaccaaccccccgtgcaaatgtgtccgcggcccgcgattccgttaacaagcgccgcaagtgcaatcacgcctccaaatgtttccgctgctaaccttaacggggaggccggcggtggaccaattggagttttgtcaactagttcacccacaaacactgggtgcaaactcgacgagaagaaatccgagaagtag

SEQ ID NO: 50972 - DNA, 171 bp, Artificial Sequence
  Description of Artificial Sequence: Synthetic coding sequence
tgataccgggtggtggtgagctaccccccccagagcgaggccgagatcgagctgaaggagggtgatattgtgttcgtacataagaagagagaggacggatggtataagggtactctgcagcgcaacggaagaaccggcctcttccctgggtcattcgttgagtcgttctag

SEQ ID NO: 50973 - DNA, 1029 bp, Artificial Sequence
  Description of Artificial Sequence: Synthetic coding sequence
atgaacaaccccatccccagcaacctgaagagcgaggccaagaaggccgcaaagattttgcgggagttcactgagatcacctccagaaacgggccagacaagattattcccgcacatgtcatcgctaaagccaaagggctcgcaattctgtctgtcattaaggctggtttcttggtgactgcccgaggcggatccggaattgtcgtggccaggcttccggacgggaaatggtctgccccatctgctatcggcatagctggtctcgggggcggctttgaaatcggaattgaggtctcggacctggtgattatcttgaattatgaccgcgcagtggaggcattcgctaagggaggaaatcttacgctggggggtaacctgaccgtggcggtaggcccactgggtagaaacttggaaggcaatgtggccctgcgctcctcggcagccgtttttacctactgtaaaagccggggtctctttgccggagtgtcactggagggctcctgcctaatcgagcgaaaagagaccaaccgcaagttttactgtcaagacattagagcttacgacatcctgtttggcgacaccccccgaccagcccaagctgaggatctgtatgagatactggattcattcactgagaagtacgagaacgaaggccagagaatcaacgctcgtaaggctgctcgggagcagaggaaatcgtctgcaaaggaactgccccccaagccactaagtagacctcaacagtcgagcgcccctgtgcagttaaattcagggtcccagagcaataggaatgagtacaagctttaccctgggctgtcaagctaccacgagcgagtcggtaatttgaatcagccaattgaggtcactgcactctacagctttgagggacagcagcccggagatctgaatttccaagctggcgaccggattactgtgatatctaaaacagactctcacttcgattggtgggagggtaagctgcgagggcaaacaggaattttcccagccaattatgtcacaatgaactag

SEQ ID NO: 50974 - DNA, 684 bp, Artificial Sequence
  Description of Artificial Sequence: Synthetic coding sequence
atggtgagcgacctggtgatcatcctgaactacgaccgggccgtggaggcttttgcaaaaggtgggaatttgactttaggcggaaatctaacggtggcggtcggaccactaggacgcaatctggagggtaacgtggcgctccgatcatcagcagccgtctttacgtactgcaaatctagaggcctctttgccggcgtgtccctcgaaggatcatgcctgatcgaaaggaaggagaccaatcggaaattttattgccaggatatccgtgcatacgacattctgtttggggacacaccccgacctgcccaggcagaggacctgtacgagatcctggactctttcacagagaagtatgaaaacgaaggtcagagaataaacgcaagaaaggccgcccgtgagcagcggaaaagtagcgccaaggagttacctcccaagcctctgtccagaccccagcagtctagtgctcccgtgcagctcaattccgggtcccagtcaaacctgaaccagccaattgaggtcacagccttgtattcttttgagggccagcagcccggtgacctcaacttccaggccggagaccggattaccgttatatcaaagactgacagccactttgattggtgggaaggaaagctgagggggcagacaggtatatttcctgccaactatgttaccatgaattag

SEQ ID NO: 50975 - DNA, 684 bp, Artificial Sequence
  Description of Artificial Sequence: Synthetic coding sequence
atggtgagcgacctggtgatcatcctgaactacgaccgggccgtggaggccttcgcaaagggtgggaatcttaccttgggcggcaacttaactgtcgcggtgggtccgctaggtagaaacttggagggaaacgtagcactgcgcagttccgctgcagtctttacatattgtaaatcacgagggttgtttgccggggtgagcttggagggtagttgtctcattgaacgaaaagagaccaacagaaaattttactgtcaggatatccgcgcctatgacatactgttcggggacacgcctagaccggcccaggctgaagacctgtatgagatcttagatagttttactgagaaatacgagaacgagggccagagaatcaacgctaggaaggccgcacgagaacagaggaaatcatctgccaaggaactgccccccaagccactgtccaggccgcagcagagcagtgcaccagtgcagttgaactctggctcgcaatctaatttgaatcaacctatcgaagttacagctctttattcttttgaaggacagcaaccgggcgaccttaactttcaggccggagatcgaattactgtgatttcaaagactgattcccatttcgattggtgggaaggtaaactgaggggacagactggcatctttcctgctaactatgtgactatgaattag

SEQ ID NO: 50976 - DNA, 972 bp, Artificial Sequence
  Description of Artificial Sequence: Synthetic coding sequence
atgaacaaccccatccccagcaacctgaagagcgaggccaagaaggctgcgaagatactgcgggagttcacagaaatcacgagccggaacgggcccgacaagatcatacctgcccacgttattgcgaaagcaaaagggctggcaatcctgagtgtgatcaaggccgggttcctcgtaacagcccgcggaggctctggcatcgtggtggcccgcctgccagacggcaaatggagtgctccttctgcaatcggcatagcaggactagggggcgggttcgaaatcggcattgaggttagtgacctcgtcatcatactgaattacgacagggctgttgaagcattcgccaagggcggcaatctgacactgggtggcaacctaacggttgctgtaggccctcttggccgcaatcttgagggcaatgtcgccctgcgatccagcgcagcggtttttacttactgtaagtccagggggctctttgctggcgtgagtctggaaggttcatgcctcattgaaagaaaagagactaatagaaagttctactgccaggacatccgtgcatatgatatcttattcggggacacgccgcgcccggcgcaggcggaagacctttatgagatcttggattcttttaccgagaaatacgagaacgagggtcagagaatcaacgccagaaaagccgctagagagcagcggaagagtagcgcaaaggagctgccgcccaagcccctaagcaggccacagcagtcatctgcacctgtgcagctcaattccggctcgcaatccaacctaaaccagccaatcgaagtcaccgctctatactccttcgaggggcaacagcctggggacctcaactttcaggctggtgatagaatcactgttatatcaaagacagattctcacttcgattggtgggagggcaagttacgcggtcagacggggattttccccgctaactatgtcactatgaactag

SEQ ID NO: 50977 - DNA, 1029 bp, Artificial Sequence
  Description of Artificial Sequence: Synthetic coding sequence
atgaacaaccccatccccagcaacctgaagagcgaggccaagaaggccgccaaaatactccgggagttcactgagatcaccagccgcaacggcccggacaagatcattcctgcccacgtgatcgcgaaggccaaaggacttgcgatcctcagcgttatcaaggctggattcctagtcactgcgcgaggcggtagtggaatcgtagttgcccggcttcccgacggaaagtggagtgcaccatccgctatcggaatcgctggactgggaggcggcttcgagatcggtattgaggtgagtgacttggtaattatcctgaattatgaccgagcagtcgaggcattcgcaaaggggggaaatttgaccttgggtggcaacctaacagtggccgtcgggccactgggacgcaacctcgagggcaacgttgcgctcaggtcgtcggcagctgtctttacttattgtaagtcccggggtctgttcgcgggcgtctcactggaggggtcctgtcttatagagagaaaagagacaaatcgaaagttctactgtcaggatatcagagcatatgacatactttttggtgatacccccagacccgcacaggctgaagatctgtacgaaatcttggacagctttacagagaagtacgagaatgaagggcagcgcataaacgctaggaaggccgccagggagcagagaaaaagctctgctaaagagctgccccctaaacccttgagtagaccccagcagtcctcagccccagtccagcttaacagcgggtcccagagcaacagaaacgagtacaaactctatcccgggctgtcatcataccatgagagagtgggaaacttaaaccagccaattgaggtcaccgcgctgtattccttcgaaggccagcaacccggggatttgaacttccaggctggcgacaggatcaccgtgatatccaaaactgatagtcacttcgactggtgggagggtaaactacggggacagactgggatattccctgctaattatgtgaccatgaactag

SEQ ID NO: 50978 - DNA, 741 bp, Artificial Sequence
  Description of Artificial Sequence: Synthetic coding sequence
atggtgagcgacctggtgatcatcctgaactacgaccgggccgtggaagccttcgccaaaggtggtaatcttactctaggcggtaacctaacagtggcagtcggccctctgggccgtaacctggaaggcaatgtggctctaaggagtagtgccgccgtcttcacttactgcaaaagccgaggtctgttcgcgggcgtgtccttagagggctcgtgtctcatcgagaggaaagagactaataggaaattctattgtcaggacatcagggcctatgatattctgtttggcgatacgccccgccccgcacaagctgaggacctgtatgaaattctggattcctttactgagaaatacgagaacgaggggcagcggataaatgctcgaaaagcagctcgggaacagcgtaagtcctccgccaaagagctgcccccaaaacccctaagcaggccccagcagagtagtgcccccgtgcagctcaattcaggatcccagtcaaatcggaacgagtacaagctttaccccggattgtcctcatatcatgagcgcgttgggaatttaaaccagcccattgaagtaaccgccctgtattctttcgaggggcagcagccaggggacctgaattttcaggcgggagatcgcattactgtaataagcaaaacagattcgcacttcgactggtgggaaggcaagctccggggtcagacaggaatcttccctgccaactacgtgacaatgaattag

SEQ ID NO: 50979 - DNA, 156 bp, Artificial Sequence
  Description of Artificial Sequence: Synthetic coding sequence
atgaacaaccccatccccagcaacctgaagagcgaggccaagaaggcagcaaaaatactgcgggagttcacagagatcacatcaagaaatggtcccgacaagattatcccggcccatgtcattgcgaaagccaaaggtttggcaattctatcctag

SEQ ID NO: 50980 - DNA, 1047 bp, Artificial Sequence
  Description of Artificial Sequence: Synthetic coding sequence
atgcccggcaagcagagcgaggagggccccgccgaggccggcgcctccgaggacagtgaggaagagggcttagggggcctgactctcgaggagctgcagcagggacaggaagccgcgcgggccctagaggacatgatgaccctgtctgcacaaacacttgtgcgggcggaagtggacgagctttatgaggaagtgcggccactgggacaggggtgctacggccgggtcctgctggtaactcatcggcaaaaaggtacaccattagccctcaagcaattgcctaaacccagaacaagtcttcgaggatttctctatgagttctgtgtcgggttgagcttgggtgcgcattcagccatcgtcactgcatatggtattggcatcgaatccgctcactcttacagttttctgaccgagcctgttctgcacggggatttaatggcgttcatccagccaaaggtcggattgcctcagcccgcagtccaccgctgtgctgctcagcttgcttcagcgctggaatatatccatgctcgaggtctggtgtaccgcgacttaaagcctgagaatgtcctcgtgtgcgaccctgcttgtcgaaggtttaagttgaccgacttcggccacacccgtccacggggaacacttctgcggctggcaggcccaccgataccttacaccgcccccgaactgtgtgcgcccccacctctcccagagggcctgccgattcaacccgctctggatgcctgggccctcggagtgctactgttctgcctcctcacaggctactttccatgggatcgacccttggcagaggccgatcctttctacgaagactttctgatttggcaggccagcggacagccgcgcgaccgcccccaaccttggtttggactcgcagctgcagcagatgctctgctgagggggctgctggatccacatcctcgccggaggtctgccgtgattgccattagggagcacttaggccgcccatggcgccagagagagggcgaggcagaggccgtgggagctgtggaggaagaagccggccaatag

SEQ ID NO: 50981 - DNA, 1047 bp, Artificial Sequence
  Description of Artificial Sequence: Synthetic coding sequence
atgcccggcaagcagagcgaggagggccccgccgaggccggcgcctctgaggactccgaagaagaaggacttggaggactgacactcgaggagctgcaacaggggcaggaagccgcacgtgcattggaggatatgatgacactgtccgcacagactcttgtccgcgctgaggtggatgagctatacgaggaggtccggcccctcggtcaggggtgctatgggcgggttctgctggttactcaccgccagaagggcactcctcttgctttgaagcaactgccaaaacccagaacttctctacgcggcttcttgtacgagttctgcgttgggctgtccttaggcgcccactctgcaatcgtcactgcatacggcattggcatcgagtcagcccattcgtacagttttctgacagagcccgttctacatggtgacctgatggcgtttatccagcccaaagtgggacttccccagccagccgtgcaccgctgcgctgctcagctggcttcggctcttgagtacattcatgctcggggcctggtgtatcgcgatcttaagcctgagaatgtgctggtttgtgatccagcttgtaggcggttcaagctgaccgatttcgggcacacaaggcctagaggaactctcctgaggttagccggccccccaattccttacacggcacccgagttgtgtgcaccccccccacttcccgaagggcttccaatccagccggctctggatgcttgggcactcggcgtcttgctgttctgcctgctaacgggctactttccttgggacagacctctagcggaggccgaccctttttacgaagatttcttaatttggcaggcatctggacagccgagggaccgcccacagccgtggtttgggcttgccgccgcagctgatgcgttactccgcggacttctcgatcctcatcctcgccgccgaagcgcagttatcgccattcgggagcacctgggtagaccctggcggcaaagagaaggcgaggctgaggccgtaggggccgttgaagaggaggcggggcagtag

SEQ ID NO: 50982 - DNA, 1182 bp, Artificial Sequence
  Description of Artificial Sequence: Synthetic coding sequence
atggccgagctgcggcaggtgcccggcggccgggagaccccccagggggagctgcgaccggaagtggtggaggatgaggtcccccgtagtccagtcgctgaggaaccgggcggggggggctcatccagctccgaggcaaaactctccccacgggaggaagaggaactcgatccacgtattcaggaggagctggagcacttaaaccaagcatcggaagagatcaatcaggtggaactccaattggatgaagctcgcacaacataccgacggatcctgcaggaatccgccaggaaactgaatacccaagggagtcatctgggatcctgcatagagaaggctaggccttattatgaggctcggcgactcgcaaaagaagcgcaacaagagacccagaaagctgccctcaggtacgaaagggcggtgtcaatgcataacgcagctcgcgaaatggtgtttgtcgccgaacagggcgttatggctgataagaacagactggacccgacttggcaagagatgttaaaccatgctacatgcaaggtgaacgaagccgaggaagaacgcttgaggggggaaagggagcaccagagagtgactaggctctgccagcaagctgaagccagggtccaggctcttcaaaaaaccctccgacgggccatcggcaagagccgaccctatttcgagctaaaagctcagttctcccagattctcgaggaacataaggctaaggttactgagctggaacagcaggtggcccaggcaaagactaggtattcagtggcattgaggaaccttgaacagatctccgagcaaattcatgcacggagacgtggcggtcttcccccacacccgcttggccctcgccgatctagccccgtgggtgctgaggccggtcccgaagacatggaagacggagattcagggattgaaggggccgagggagcgggattagaggagggatctagtctaggccccggtccagcccctgacactgatactttgagcttactctccctaagaacagtcgcttccgatctacagaagtgtgatagcgtggagcatttgcgaggcctgagcgaccatgtttcactcgatgggcaggagcttggaacccgctccgggggccggagaggaagcgatggtggggcacggggggggcggcatcaacgctctgtgtcattatag

SEQ ID NO: 50983 - DNA, 1086 bp, Artificial Sequence
  Description of Artificial Sequence: Synthetic coding sequence
atgtaccaggtgcccgaccggcaggagagcttctggcagagcccctatctgctttcttttcccgaatgcttgacctcattcccttgggaagaactggagcacctgaaccaggcatctgaggagatcaatcaggtcgaattgcaactagacgaggctaggacaacctacaggcgcatcttgcaagagagtgcccgtaaactgaatacccagggaagtcacctgggtagttgtatcgagaaggcccgtccatattacgaagcacgtagactcgctaaagaagcccaacaggagacacagaaggcagctctgcgctatgaacgggccgtttccatgcacaatgccgcccgagaaatggtgtttgtggccgaacagggcgtcatggccgataaaaaccgtctggaccccacttggcaggagatgttgaaccatgccacatgtaaggtaaatgaagcagaggaggaacggctgaggggtgagagagaacaccagcgcgtgacacgactgtgtcagcaggcagaggcgcgcgtccaagcactccagaaaacccttcggagagcaattgggaaaagccgaccctactttgaacttaaagctcagttcagtcagatcctggaagaacacaaagccaaagtgactgagctagaacaacaggtggcacaggctaagaccagatattctgttgccctgcgaaacctggagcagatctctgagcagattcacgcacgcagacgcgggggattgcctccacatcccctggggccacgtagatccagtcccgtcggagctgaggcggggcccgaggacatggaggacggcgattccggcatcgaaggggcagaaggagcgggtttggaagaaggaagttccctcggaccaggacccgcgcctgacaccgacaccttgtccctgttgtccttgcgtaccgttgccagtgacctccaaaagtgcgactccgttgagcacctgagaggcttgtctgaccatgtttcactggacggtcaggagcttggtacaaggtctggaggtcggagaggcagcgacggcggcgcccgcggtggcagacaccagcgaagcgttagcctttag

SEQ ID NO: 50984 - DNA, 2169 bp, Artificial Sequence
  Description of Artificial Sequence: Synthetic coding sequence
atgcggccccaggaccccgccctgtacccccaggccccccaccccctggcgctcggccgggcttcacacccctcccagtcacgaaacactccccctgggagaccacgcgccgccgcccggtgcggccctagaagggcccctatcggccagtctgggaggggccgcgagaagtggccgaccgctgccagtgctctcggacttctacgcaggtggaggagatccaaagcatcagtgccggccgattctttcagaaccatcagccccgatcgacgtggagagaagagtgcaagcgccgtttccggtgatactgccgccgcgaccacactgaagggcaccgctatcccggtgcgcagcgtggtcgcttcacctagaccggtgaaaggtaaggccggaagggagaccgcaagactgcgactgcagagactccccgctgctcaggccgaagacaccggggaggcagcggccgccgcagccgaagagcctctcctacccgttcccgaggacgaggaggaggcccaaccattgcccccagtatgtgtaagccgtatgcgcggcatgtggagagatgaaaaagtctcgctgtactgtgatgaagtactgcaggactgtaaagccgaggacgccgacgaggtcatgggtaagtatctctccgagaaattaaaactgaaggacaagtggctgggtgtgtggaaaactaaccccagcgtgttttttgtgaagtacgaggaagctagtataccatttgtgggcatcctggtcgaagtcacttgcgagccctatcaggacagctctagtagattcaaggttactgtaagtgtggcggagccgttttcaagcaacattgctaatatccctcgagacctagtcgatgaaatattagaagagctcgagcactccgtgcccctacttgaggtctatcctgtagagggccaggataccgacatccacgtgatcgcactggctctcgaggtggttaggttcttttacgattttctgtggagagattgggacgatgaagagtcatgtgagaactacaccgctctaatagaggaaaggattaatctgtggtgcgatatacaggatgggaccatccccgggcctatagcccagaggttcaagaaaacactagaaaaatataagaacaaaagagtcgagctaatagaataccagtcaaacattaaggaggatccgtcagctgctgaagcagtggagtgttggaaaaagtattacgagatcgtgatgctgtgtggacttttgaaaatgtgggaggacctcagattacgcgtccacggtccgttctttccccggatcctccgccggcggaagggcaagcgagaatttggcaaaaccatcacccacatcgtggccaagatgatgacaactgagatgattaaggacctgtcgtctgatacccttttgcagcagcacggtgacttggacctggcactcgataactgctattccggggacacagtgattattttccccggcgagtatcaagcagcaaatctggccttgctgacggacgacatcatcataaaaggtgtcggtaagcgggaagagatcatgattacctccgagccaagtagggatagcttcgtcgtctccaaagctgataatgtgaagttgatgcacctgagcctcatacagcagggaacagtggacggcattgtggtcgtcgagtctggccacatgacgctcgaaaattgtattctgaaatgtgagggaactggagtttgtgtcctgactggagccgcactgaccatcaccgacagtgaaattactggtgctcaaggcgctggcgttgaactgtacccagggagtatagccatcctcgagcggaatgagatccaccattgtaataacttgcgtacctccaacagttccaaatccacattggggggagtgaacatgaaagtgctccctgctcccaaactgaagatgaccaataatcacatctattccaataagggctacggagtttccatactgcaacccatggagcaattctttatcgtggccgaagaagctctcaacaaacgggcctcatctggagacaaaaaggacgacaaaatgctattcaaagttatgcagaacctgaatctggaaatgaacaataacaagatcgaggcaaacgtgaagggagatattcggatagtgactagctag

SEQ ID NO: 50985 - DNA, 1962 bp, Artificial Sequence
  Description of Artificial Sequence: Synthetic coding sequence
atggccagcggcagcaaggccagcgtgcccgccgacagcttccggaccatctctccggacaggaggggagagaagagtgctagcgctgtgtccggcgataccgctgccgccacgacactgaaggggaccgctatcccagtccgaagcgtggtggcctctccaaggcccgtgaagggaaaggcgggccgtgagactgccaggctgcggctccaacgcctgccggccgcacaggcggaagataccggggaggccgccgcagccgctgccgaggagccactgctccccgtccctgaggatgaagaggaggcccagcctcttccacccgtgtgtgtcagtcgcatgaggggtatgtggcgggacgagaaagtaagtctctactgcgatgaggtgttacaagattgtaaagctgaagatgctgacgaggtcatgggaaaatacttgtccgaaaagttaaaacttaaggataagtggctgggagtgtggaaaactaatccatccgtcttctttgtgaagtatgaggaggctagcatccccttcgtgggtattttggtggaggtaacttgtgagccgtatcaggactcatcttcaaggtttaaagtaaccgtctctgtggctgaaccattctcctcaaatatagccaatattccacgggacctggttgatgaaattctcgaggaattggagcattccgtcccactgctggaagtttatcctgtggaggggcaggatactgatattcacgtgattgctctggcactggaggtggtgcgcttcttctacgactttctgtggagagactgggatgatgaagagtcttgcgagaactatacagcccttattgaggagagaatcaacctttggtgcgacatacaggacgggaccatacccgggcctatagcccagcgttttaagaaaaccctcgagaaatataaaaacaaacgcgtggaattgattgagtatcaaagcaacataaaagaggatccttcggcggccgaggctgtcgaatgttggaagaaatattacgagatagtgatgttgtgtggcctgttgaaaatgtgggaggaccttcgtctgagggtgcacggacctttctttccacggatcttgcggaggagaaaggggaagagagagttcgggaagaccattacccatattgtcgccaagatgatgaccacggagatgataaaggacttgtcttcagacacactcctccagcagcacggggacctggatcttgccttggataattgctactctggtgatacagtgattatattccctggtgagtaccaggcagccaacctggcgcttctaacggatgatatcattattaagggggtcggcaagagagaggagataatgattacctctgagccgtcccgcgactcgttcgtggttagcaaggcggacaatgttaagcttatgcatcttagcctgatccagcagggaaccgtggatgggatcgtcgtcgttgagagcggtcatatgactctcgagaattgcatcctgaagtgcgaagggactggcgtgtgtgtgctcaccggggctgccttaaccattactgatagcgagataaccggagcccaaggcgccggggttgagctgtatcctggctccatcgccatcctggagcggaatgagatccaccactgtaataatctccgcaccagtaatagcagtaaatcaactctaggcggagtcaacatgaaagtcctgcccgcccctaaactgaagatgacaaacaatcatatctactctaacaaaggttacggtgtgagtatccttcagccaatggaacagttttttatagtggccgaggaggccctcaataaaagggcctcttcaggggacaaaaaagatgacaagatgctttttaaggttatgcagaacctgaatctggaaatgaataacaacaaaattgaggccaatgtgaaaggcgacataagaatagttaccagttag

SEQ ID NO: 50986 - DNA, 1605 bp, Artificial Sequence
  Description of Artificial Sequence: Synthetic coding sequence
atgggcttcctgcagctggtgcggctggacagcaacagccggccccaagcagaggacgctgacgaggttatggggaaatatctgtctgaaaagttaaagcttaaagacaagtggttgggggtctggaagactaacccctccgtattcttcgtcaagtacgaagaagcctccatccccttcgtaggcattcttgttgaagtcacctgcgaaccgtatcaagactcaagtagccgatttaaagtaaccgtaagcgtagctgagcccttcagctccaacattgccaacattccccgcgacttggttgatgagattttagaggagcttgagcattcggtacccctcctcgaggtgtacccagtggagggtcaggacacggacattcatgtcattgctctcgctctggaggtggtccgcttcttttacgatttcctgtggcgggattgggatgacgaagagtcctgcgaaaactacactgcactgatcgaggagaggatcaatctgtggtgtgacattcaagacgggaccattcccggcccaattgctcagagattcaaaaaaacactggagaagtataaaaacaaaagggtcgaactgatcgagtatcagagtaatattaaggaagatccctcggccgccgaggctgtggagtgctggaagaaatactacgagatcgtgatgctgtgcgggctgcttaagatgtgggaagatttgcgtctgcgcgttcacggaccgttcttccctagaattctgcgaagaagaaagggaaaacgagaattcgggaagaccattacccacatcgtcgctaaaatgatgactacggagatgattaaggatttatcaagcgatacactgttgcaacagcacggggatttggatctcgccttagataattgctactctggagacactgttattatctttcccggtgagtaccaggccgcaaatttggctctgctcaccgacgatatcatcatcaagggggtcggcaagcgcgaagaaatcatgatcaccagtgaaccctctcgagactccttcgtcgtgtccaaagccgacaatgtgaagctgatgcatctatccttgatccagcagggtactgtcgatgggatagttgtggtggagtcaggtcacatgacactggaaaactgcattcttaagtgtgaaggcacgggtgtctgtgtgctcacgggagctgcactcaccattaccgattcagaaattactggcgcccaaggagccggcgtggagctgtaccctggctcaattgctatcctagaacggaatgagatccaccattgcaataatctgaggacctcgaactccagcaagtcaactttaggcggggtgaacatgaaggtgcttcccgcccctaagcttaaaatgaccaataatcatatttattccaacaagggatatggtgtcagtatcctacagcccatggaacagttcttcatagtggcagaggaagccttaaacaaacgcgcctcatccggggacaaaaaggacgacaagatgctatttaaggtgatgcagaaccttaatctggaaatgaacaacaacaaaatagaggcgaacgtcaaaggggacatcaggattgttaccagctag

SEQ ID NO: 50987 - DNA, 1617 bp, Artificial Sequence
  Description of Artificial Sequence: Synthetic coding sequence
atgcccgccctgctgctgctggtgctgctggccagcagcgccggccaggctcgcgcccggccctctaacgcgacaagtgccgaacccgcagggccattgcccgctcttctcgcccacttacgccgtttgactggggcgctgactggaggcggaggggccgcatctccaggagctaatggcacaagaacaggccctgcaggaggagcaggtgccgctgccagggctccaccccccgctgagttgtgtcacggctactacgatgtgatggggcagtatgacgccactttcaactgctcaactggaagctaccggttttgctgcgggacttgccactaccgtttttgctgtgagcacaggcacatgagacttgcccaggctagttgcagtaactacgataccccgcgctgggctactacacctcctccactcgctggaggagccggcggagctggcggagccgggggaggacctggcccaggacaagccggctggctggaaggcggaaggactggtggggcgggtggaaggggcggagaagggcccggagggtcaaccgcctacgtggtgtgtggagtgatttctttcgcattggccgtgggcgtgggcgccaaggtggctttttccaaagcctctagggccccaagggcccatcgggacattaacgtcccccgggctctcgtagacatactgcgccaccaggcaggtcctgggaccaggccagaccgcgcaagatctagctcgctcactccggggatcggaggacccgattccatgcctcctcgtactcctaagaatttatacaacacagttaagacaccaaatttggactggagggccctgcctccaccgagcccatcattacattacagcactttgagttgctcaaggtcctttcacaacttatctcatttgcccccatcttacgaggctgccgtgaaatcagagctgaaccggtactcttcgctgaagaggcttgccgaaaaggacctcgacgaggcctacttgaaacggagacccctggaactgcctcggggcaccctccccctacacgcactgagaagacccggcacaggcgggggctatcgtatggaggcgtggggcgggcccgaggagctgggcctcgccccggctccgaatcccagaagagttatgagccaggagcacctgttaggggatggaggcaggagccgttacgagtttaccttacctagggcacgactggtgtcacaggagcatcttctcctttcaagccctgaggccctccgccagagtagggagcatcttttgagccctcccagaagccccgcccttccaccagatccgactgccagggctagcttggccgcctcccacagtaacctgttgctcggaccaggggggccgcccacaccactgcgcggcctgccccccccatctagtttgcacgctcatcaccaccatgccctccacgggtcaccacagccagcctggatgagcgatgccggcgggggtggtggaaccctggcgcgccgacccccctttcaacgccagggcaccctggagcagttacaattcatccctggtcaccacctgccacagcacttgcggacggcgagcaagaacgaggttaccgtttag

SEQ ID NO: 50988 - DNA, 960 bp, Artificial Sequence
  Description of Artificial Sequence: Synthetic coding sequence
atgggctggcggcggaagcgggtgccccagcggggccggaaggcccccccaccccaactccacgggaatatcaacaatttgtatttccctatcagatggcgcgataggctccactgggactcccccaatccagccgccgagtgtcagaggcacgaagtcacactggtttcaagaaagccaggccccgggaggataacttgggacgaattggcggcgtctggcctgccctcctgcgacgcagcagtgaatttagccggtgagaatatattgaatcccctgcggaggtggaacgaaacatttcaaaaggaagtgataggcagcagacttgaaacgacccagctgctcgcaaaggccattaccaaggccccccagcctccgaaggcgtgggtgttggttaccggagttgcttactatcagccaagtttgaccgctgaatacgatgaggactcacccggaggggacttcgacttttttagcaatcttgtaaccaagtgggaagccgccgctaggctgcccggggactctactcggcaggtggtggtgagatctggcgttgtgttaggtagaggaggaggagccatgggccacatgctgctgccatttcgattaggactgggcggacccattggcagcgggcaccagttcttcccttggatccatataggtgatctggcaggcattctgacccatgcactggaggccaatcatgtccatggtgtactcaacggcgtagctccctcaagtgctacaaatgccgaattcgcccagacactgggagccgcactgggccggcgggctttcatccctctccccagtgccgtggtgcaagccgtctttggtaggcaacgcgctatcatgctgcttgagggacaaaaagttatcccccagaggaccctcgcgacagggtaccagtacagctttccagagctgggtgctgccctgaaggagattgttgcatag

SEQ ID NO: 50989 - DNA, 597 bp, Artificial Sequence
  Description of Artificial Sequence: Synthetic coding sequence
atggccctgagccccaacggcgagatcctgcgggcccgggaggcctactaccaacccagtcttaccgctgaatatgacgaagactcgcctggaggggacttcgattttttctccaacttggtcactaagtgggaggctgctgcgcggctcccaggtgattctaccagacaggtggtggtccggtcaggcgttgtgctcgggagggggggtggcgccatgggtcatatgttgttgccttttaggttaggcttggggggccctattggatcaggccatcaattctttccgtggattcatatcggagatctggccggtatcctgacgcacgccctggaggccaaccacgtgcacggagtccttaatggcgtagccccatcaagtgcaaccaatgccgaatttgcccagacactgggagcagcactgggcagaagagccttcatccccctcccgtccgctgtcgtgcaggcggtttttggccgacagcgtgcgataatgttgttagagggacagaaagtaatccctcagaggacactggccacagggtaccaatacagtttccctgaactgggagccgccctgaaggagatcgtggcctag

SEQ ID NO: 50990 - DNA, 882 bp, Artificial Sequence
  Description of Artificial Sequence: Synthetic coding sequence
atgcgggtgctggtgggcggcggcaccggcttcatcggcaccgccctgacacaactgctgaacgctcgtggccatgaggtcactctggtgtcacggaagccaggacccggtagaatcacttgggacgagctggctgcctcaggactgccgagttgtgacgccgcagtgaatcttgcgggagagaacatactgaatccactgcggaggtggaatgagacatttcaaaaggaagtgatcgggtctcgccttgaaactacccaactgctcgcgaaagcaatcacaaaggcaccacagccacccaaagcctgggtgttggtgaccggagtggcatactaccagcccagtcttactgccgaatatgacgaggatagtccaggcggcgattttgacttcttctctaatctcgtgacaaaatgggaggccgcagctaggctgcccggtgactcaactcggcaggtggttgtacgatcgggcgtggtcctgggacgagggggcggggccatgggacatatgctgttgccttttagactgggcctaggcgggcccattggcagcggacatcagttcttcccctggatccacataggggacctcgcagggatcttgacgcacgcgttagaagcaaaccatgtgcacggggtcttgaacggtgtcgccccctcaagtgccaccaacgccgaattcgcacagactcttggggctgcattgggaaggcgcgctttcataccgctaccttctgctgtcgtccaggccgtattcggtcgacagcgggccattatgctgctcgagggacagaaagtcatcccgcagaggaccctagctaccgggtatcagtactctttccctgagctgggggcagcgctgaaggaaattgtcgcctag

SEQ ID NO: 50991 - DNA, 468 bp, Artificial Sequence
  Description of Artificial Sequence: Synthetic coding sequence
ttccacgtggccagctacggcatgagcggcgccgagaagctgcagaaggaacaaatagagtcaattaacgtgggaggaacaaagctggtcatagacgtgtgcgttcggcgaagagtgccgagactgatatacacctccaccgtcaatgtggcctttggaggaaaacctattgagcagggggacgaggacagcgttccttacttccctcttgatgagcatgtggaccactatagtaggaccaaagctattgccgaccagctcacactaatggctaatggcatgccactgcctggtggcggaactcttagaacctgtgtcctccggccaccagggatttacgggcctgaagaacagcgtcacctcccccgagtagccgggcatatcaagaagagactctttatgttccgatttggagaccacaaggcccgcatgaactgggtgcatgtgcacaacttggtgcaggcatag

SEQ ID NO: 50992 - DNA, 4482 bp, Artificial Sequence
  Description of Artificial Sequence: Synthetic coding sequence
atggagaaccggcccggcagcttccagtacgtgcccgtgcagctgcaggggggcgccccatggggctttacactgaagggtggcctggagcattgtgaaccactgacagtttccaaaatcgaagatggagggaaggcagcccttagtcagaagatgaggacaggggatgaactggtcaacatcaacgggactcccctgtatgggagccgacaggaggctctgattctaatcaagggaagctttagaatactgaaacttatcgtgcgtaggagaaatgctccagtgtccaggccacactcctggcacgttgccaagctactggagggatgcccagaggccgcgaccacaatgcactttccgtctgaggcttttagtttgagctggcattctggatgtaacacttctgatgtgtgcgtgcagtggtgccccctgtcaaggcactgcagcactgagaagtccagctccatcggttctatggagtctctggaacagccgggccaagcaacctacgagagccaccttctgccaattgaccagaacatgtatcccaaccagagagatagtgcctattccagcttctctgcttctagcaacgccagcgactgtgcactgtcccttaggccagaagaaccagcctccacggattgtatcatgcagggaccaggtcccacgaaggctccatcaggtagacctaatgtcgccgaaactagcggtgggtcccgacgtacaaacggcggtcacttaaccccgtcatcacaaatgagctccaggcctcaggagggataccaatcagggccagcgaaagctgttcgtggcccgccccagcctcccgtccggcgcgactccctgcaagcctcaagggcccaattgttgaacggggaacagcggagggcctccgagcctgtggtgccgctaccccaaaaggaaaagctatctctggaaccagttctcccagcgaggaaccccaaccggttttgttgcctgagtggccatgaccaagtaaccagtgagggacaccagaactgtgaattcagtcagccccctgaaagctcccagcaagggagtgagcatctgcttatgcaggcttcgacaaaggccgtggggtcccctaaagcctgtgaccgcgcttccagcgtggactcaaatcctctcaatgaggcttcagccgagctggccaaagcgtcttttgggagaccgccccatctcatcgggcccaccggccacaggcattccgctcctgaacagcttttagccagccatctacagcatgtgcatttggacaccaggggaagtaaagggatggagctgccgcccgtgcaagatggacatcagtggactctaagcccacttcactcttcccataaggggaagaagtccccctgcccccccaccgggggaacacatgatcaatctagcaaggagcggaaaacccgccaggtcgacgaccggtccctggtgctggggcatcagtctcagagcagccccccgcacggggaagcagacggacatcccagcgagaagggctttcttgaccccaatcgcactagccgagcggctagtgagttggcaaatcaacagcctagtgcttccgggtcattagtgcagcaagcaaccgattgcagctccaccaccaaggcagcaagcggcaccgaagccggtgaagagggcgacagtgagccgaaggagtgctcccgaatgggcggacgacggagcggcggcacacgcggccgtagcatccagaatagaagaaagtcggaaaggttcgcaacaaatttacgaaacgagattcagcggaggaaggctcagctgcagaaaagcaaagggccactgtcccaactgtgtgatacaaaagaacctgtggaagagacccaagaacctcccgaatcgcctccacttacagcctccaatacatctctgctgagctcttgcaaaaaaccaccaagccccagggataagctgttcaacaaatccatgatgctgcgcgcccgcagcagtgaatgcctgagccaagctccggagtcacatgaatcgcgtaccggactagaggggaggatttcccccgggcagcggcccggacaatcttctctgggactgaacacttggtggaaagcccctgacccttcgagtagcgatcctgaaaaggcgcacgcccattgtggggtgcgtggtggtcactggcggtggagcccggaacacaactcacagccccttgttgcagcagctatggaagggcctagcaatccaggagacaataaagaattaaaggccagtacagcccaggctggcgaagatgccatactcctgccattcgcagaccgaagaaaattcttcgaagaaagctctaagtctctgtccaccagccacctccccggtctgacaactcatagcaacaaaacattcactcagaggcctaaacctatcgaccagaactttcagcctatgagcagtagttgccgggagctgagacggcatcccatggatcagtcctaccacagtgctgatcagccttatcacgccactgatcagtcctatcactccatgtccccactgcagagcgagactcccacctattctgagtgcttcgcctccaagggactggaaaattctatgtgctgcaaacctttgcactgcggagatttcgattaccatcgcacgtgttcatattcctgttcagtacagggagcattagttcatgatccctgtatctactgtagcggggaaatatgcccagcccttctgaagaggaacatgatgcccaactgctacaactgccgatgtcatcaccaccaatgcatccgatgctccgtctgttaccataacccacagcattctgcccttgaagatagcagcctcgccccaggcaacacatggaaacctaggaagctaacagtccaggaattccctggtgataagtggaatcccatcacagggaacagaaagacttcacagagtggtagagaaatggcccattcaaagaccagtttcagctgggcaacacctttccacccatgcctagagaaccctgcactggacctgagcagttaccgggccatatcttcgctggacctactgggcgactttaagcacgcactgaagaaaagcgaagaaaccagtgtctacgaggaggggtcctcgctcgcgtccatgccacacccattacgtagtcgagcattcagcgagtcacacatctcactcgcgcctcagtccaccagggcctggggccagcaccggcgagagctgttttctaaaggtgacgaaacacagagcgaccttctgggcgcgagaaagaaggctttccctcctccacggccgcccccaccaaattgggaaaagtaccgtctcttccgcgccgcccagcagcagaaacaacagcagcagcagcaaaagcaacaggaagaggaggaggaggaggaagaggaagaggaggaagaagaggaagaggaggaagaggaggcggaggaggaagaggaggagctccccccgcagtactttagctcggaaaccagtgggagttgtgccctcaatcccgaagaggtgctcgagcagcctcagccgctaagctttggtcatctcgaaggaagtagacaggggtctcagagtgttcctgccgagcaagagagctttgccctgcactctagcgatttcctgcctcctatcagaggccatttaggttcccagcctgaacaagcccagccaccctgttactacgggataggtgggctgtggcgcacttcaggacaggaggcaaccgagtctgcaaagcaggaatttcaacacttcagccccccatcaggagctccgggcattccaacctcttactccgcctattacaatatcagcgtggcgaaagccgagctgcttaacaaattaaaggatcagcccgagatggctgagattggcttaggagaggaggaagtggatcacgagctagcacagaagaaaatacagcttatcgagtctatctcgagaaagttgtcggtgttgagagaagcccagcgagggctgctggaggatataaacgcaaacagtgcgctgggcgaggaggtcgaagccaacctcaaggccgtctgtaaatcgaacgaattcgagaaatatcacctgttcgtcggcgatctggataaagtggtcaacttactgttatctttgtccggaaggttggcccgggtagagaatgccttaaacagcatcgattctgaggccaatcaggaaaaactagtcctgattgaaaaaaagcagcagctgactggacaactggctgatgccaaagaactcaaggaacacgtcgatcgccgggaaaaattagtattcggcatggttagcaggtatttaccccaggaccagttgcaggattaccagcattttgttaaaatgaagagtgccttgataatagaacaacgcgagctggaggaaaagattaagttaggggaggagcagctgaaatgtctccgagagagcctgctgctgggcccgtccaacttttag

SEQ ID NO: 50993 - DNA, 1365 bp, Artificial Sequence
  Description of Artificial Sequence: Synthetic coding sequence
atggtgcccggccaggcccagccccagagccccgagatgctgctgcttcccctactgctccccgtcctgggcgcggggtcattaaacaaggaccctagctacagtctacaggtgcaaaggcaagtgccggttccggaaggcctgtgtgttatcgtctcatgtaaccttagctacccccgagatggttgggatgaatccaccgcagcctacgggtactggttcaagggctggacaagtcccaaaactggggcccctgtcgccacaaataaccagtcccgggaggtggagatgtccactcgcgataggtttcaacttacaggggacccggggaaaggtagctgctctttagtaattagggacgcacagcgggaggacgaggcctggtatttttttagggtcgagcgcgggagtagagtccgacactctttcgtgaataacctgttttccgtgtcggctccggccctgacacagaagccagatgtgtatatcccagagaccctggaacccggccagcctgtcaccgttatctgcgtcttcaactgggcattcaaaaagtgtcccgccccaagtttcagttggaccggggctgccctgtctccccgcaggacaagaccttcgacctctcactttagcgtccttagcttcactcctagcccccaagaccacgatacggacctgacttgccacgtggatttcagtcgaaagggcgtgagtgctcagagaactgtcagactgagagtcgcctacgctccaaaggacctgatcataagcattagtcacgacaacactagcgccttggagcttcagggcaatgtcatatacctagaggtgcagaaaggccaattcttacgcttactgtgcgctgcggatagtcagccacccgccactcttagttgggtgctgcaagacagagttctttccagctcgcacccgtggggcccacgcacgctcggtttagagctgcgcggggtgcgggccggggactcgggacgatatacgtgtcgtgccgagaatcggctggggagccagcagagagcccttgatctgagcgtccaataccctccagaaaatctaagggttatggtgagccaggcaaacaggactgtcttggagaatttgcgaaacggtacctccctacgggtgttggagggccagtctcttcgtctggtctgcgtgacacactcctccccaccagcccgtctgtcttggacccggtggggtcagaccgttggaccctctcagccttcagatcctggagtcctagagctgccacgggtccagatggagcacgaaggcgaatttacctgccacgcccgccaccccttgggatcacagagagtgtcactgtcgttcagtgttcactag

SEQ ID NO: 50994 - DNA, 1446 bp, Artificial Sequence
  Description of Artificial Sequence: Synthetic coding sequence
atgctgctgctgcccctgctgctgcccgtgctgggcgccggcagcctcaacaaggatccctcatattctcttcaagtccagaggcaggtaccggtgccggaggggctttgcgtcattgtgagctgcaatctgagctatccccgcgatggctgggacgagagcactgctgcctacggctattggtttaaaggatggacctctcctaagactggcgcaccagtggccactaacaatcagtctagggaggttgagatgtccacgagggatcgatttcagttaaccggtgacccgggcaagggctcctgcagcttagtcatccgcgatgcccagcgagaagatgaagcatggtatttctttcgcgtggaacgcggtagtagggtgcgccacagcttcgttaataatttgttttcagtgtcggccccagccctgacccagaagcccgacgtgtacatccctgaaacgctcgaaccaggacagcccgtcaccgtcatttgcgtgtttaactgggctttcaaaaaatgcccagcacccagcttcagctggactggcgccgccctatcccctaggaggaccaggccctccacctctcacttcagtgtgctgagctttactccctccccccaggaccacgacacagacctgacctgtcatgtggacttttctcgcaagggggtgtctgcccaacgtacagtgcggctgcgggtggccagcctggaactacaaggcaatgtgatttatttagaagtccagaagggtcaattccttcgcctactctgcgcagccgactcgcagccgcccgctactttaagctgggtcctgcaggacagagtgctgtcttcgtctcacccttgggggcctcgcaccctgggcctggaactgcgcggagtgagagcaggagactcaggtcgttatacttgcagggctgagaatcgtctgggatcccagcagagggccctggatttgtccgtccaatacccacctgagaatctgcgcgtgatggtaagccaggccaatcggaccgttctggagaatttgaggaatggtactagcctcagggtcctggagggtcagtcacttcgactggtttgtgtgacgcactcatcacctcccgcccggctgagctggactcgttggggccagacagtcgggccatcccaaccatcggaccccggagtattagaactccctcgggtgcaaatggagcacgaaggggaattcacctgccacgcaaggcatccattggggagtcagagagtcagcctttcttttagtgtccactgtaagtccggtcccatgaccggtgtagtgcttgtggctgtgggagaagtcgcgatgaaaatcttgctgctgtgcctttgccttatccttcttcgggtgcgttcctgcaggagaaaagccgcacgggccgctctcgggatggaggcagcagatgcggtgacagactag

SEQ ID NO: 50995 - DNA, 924 bp, Artificial Sequence
  Description of Artificial Sequence: Synthetic coding sequence
atggccgccgccgtggccgccgccctggcccggctgctggccgcctttcttttgctggcggcccaggtcgcttgtgaatatggaatggtccatgttgttagccaagctggtggacccgagggcaaggactactgcatactttataacccccagtgggcccatctaccccacgatctgagcaaggctagtttcctacagcttcgcaattggacagccagtctattatgctctgctgccgacctccctgcgaggggcttcagtaatcagatccctttagtggcacgcggcaactgcaccttttatgagaaggttcgcctggctcagggctccggagcaagggggctactcattgtcagccgagagaggctggtgcctccaggcggcaacaaaacccagtatgacgaaatcggcatccccgttgctctcctatcttacaaggatatgcttgacatcttcacacgctttggacggactgtgcgggccgccctctatgctcctaaggaacccgtgcttgattacaacatggtgataatcttcattatggcagtgggtaccgtggccatcggggggtactgggccggttcccgcgacgtgaagaagaggtacatgaaacacaagcgggatgatggacccgaaaaacaggaggatgaggccgtggatgtaacacccgtcatgacctgtgtcttcgttgtaatgtgctgctccatgcttgtgttgttgtattatttctacgatttgctggtatatgtcgtaataggcattttttgcctcgcaagcgcaacaggtctctactcctgtctggccccctgcgtccgccggctaccgagcggcaaaaagaggcctcaggcacgcatgctgttgctcgcccttttctgcgtcgcggtgtcggtagtctggggggtgtttcgcaacgaggaccaatag

SEQ ID NO: 50996 - DNA, 1533 bp, Artificial Sequence
  Description of Artificial Sequence: Synthetic coding sequence
atggccgccgccgtggccgccgccctggcccggctgctggccgccttcctcttgctcgctgcccaagtcgcctgcgagtatggaatggtgcacgtcgttagccaggccggcggccccgaggggaaagattactgcatattatataaccctcaatgggctcatctccctcatgatctgtctaaggctagctttttgcagctgcgaaattggaccgcttctctgctgtgttcagcggccgatctccctgccagaggattttctaatcagattcccctggttgcacgagggaactgcactttctatgagaaagtgcgactcgcccagggctccggcgcccgcgggctgttgattgtatccagagaaaggctagttccccccggtggtaataagacacaatacgatgagatcggcatccccgtagccctgcttagctacaaggatatgctggacattttcaccagattcgggcgaaccgtgagggcagctctctatgcaccaaaggagccggtgctcgattacaacatggtaataatttttattatggctgtgggcacagtggctattggtggatactgggctggatccagggacgtcaaaaaaaggtacatgaaacacaaacgcgatgatgggcccgagaagcaggaggacgaagcagtggatgtcaccccggtgatgacgtgcgtctttgtcgttatgtgctgctctatgctggttctcctctactacttttacgacctgctagtctatgttgtgatcggaattttctgtctggcctctgcaaccggcctgtattcatgtctcgcgccctgtgttaggagactcttcggtaaatgccggattcccaacaatagccttccatactttcacaagaggccccaagctcgcatgctgctgctggccctgttttgcgtggctgtttcggtcgtttggggcgtttttcggaatgaggaccaatgggcatgggttctccaggatgccttagggatcgctttctgcctctacatgttaaagacgatccggctgcctacattcaaagcttgcaccctcttgttgctggttctctttctctatgacattttcttcgttttcatcaccccatttctgaccaagtcaggcagttccatcatggttgaggtcgccactggcccttctgatagcgccacacgcgaaaaactaccaatggtcctcaaggtgcctcgattgaactcaagtcccttggcattgtgtgaccgaccattctccctgcttggctttggcgatattttagttccaggtctgctggttgcgtattgtcacaggttcgatatacaagtacaaagctctcgcgtctatttcgtggcttgcacaatcgcctacggagtcgggttgttagtgacattcgttgccctggccctgatgcagagaggtcagccagcccttttgtatcttgtcccgtgcaccctggtgacaagctgtgcagtggccctatggcgaagggaattaggcgtgttctggaccggcagtggctttgccgtgaacacttccctgctgtag

SEQ ID NO: 50997 - DNA, 522 bp, Artificial Sequence
  Description of Artificial Sequence: Synthetic coding sequence
atggccgccatggccagcctgggcgccctggccctgctgctgctgagctctctgtctcgttgttcagccgaagcgtgtttggaacctcagatcactccttcctactacactacatccgacgctgtgatttctaccgaaacagttttcatcgttgagatatccctgacttgcaagaatcgcgtgcaaaatatggcactgtatgcagatgtgggtggtaaacagttccccgtgaccaggggccaagacgtcggaaggtatcaagtttcctggagcctggatcataagtccgctcacgctgggacgtacgaagtccgttttttcgacgaggaaagttatagtttgctccggaaggcccagcgcaataatgaggatatttccattatcccccctctttttaccgtttcagtggatcaccgaggcacatggaatggcccctgggtcagcacggaggtgctagcagctgccattggactcgtgatatactacttggcctttagtgctaaatctcacatccaggcctag

SEQ ID NO: 50998 - DNA, 522 bp, Artificial Sequence
  Description of Artificial Sequence: Synthetic coding sequence
atggccgccatggccagcctgggcgccctggccctgctgctgctgagctccctgtctagatgtagcgcagaagcatgcctggaaccccagatcacaccgtcctattacacaacctctgacgcagtcatctccaccgagacagtgttcatcgttgaaatatcgctcacatgtaagaatagggtgcaaaacatggcactgtatgctgatgtcggcggaaagcagttcccagtgacacgaggccaagacgtgggtcggtaccaagttagctggtctttggatcacaagtctgcccatgcagggacgtatgaggtcagattcttcgacgaagagtcttattcccttctgagaaaggcccagagaaacaacgaggatatctctattattcctcccctgtttacagtatccgtggaccatcgcggaacgtggaacggtccttgggtaagcacggaagtgctggccgctgcaatcggtctcgtgatttactatttggccttcagtgcaaaaagtcacattcaggcatag

SEQ ID NO: 50999 - DNA, 522 bp, Artificial Sequence
  Description of Artificial Sequence: Synthetic coding sequence
atggccgccatggccagcctgggcgccctggccctgctgctgctgtctagcttgtccaggtgttccgcggaggcctgcctcgagccacaaatcactccttcttattatacaaccagtgacgcagtcatatctacagaaactgtttttattgtcgagattagtctaacttgcaagaatcgggtgcaaaatatggccctgtatgcagacgtgggcggaaagcaattcccagttacaaggggacaggacgtgggccgctaccaggtgtcgtggtctctggaccataaatccgcccacgcaggtacgtatgaggtccgtttttttgacgaggagtcctacagtctgctgcgcaaggcccagcgcaataatgaagacatctcgatcattcccccccttttcaccgtttctgtagatcacagaggcacctggaacggtccatgggtgagtaccgaggtattggccgcggccataggcctggtgatttactaccttgccttcagcgccaagagccacattcaggcgtag

SEQ ID NO: 51000 - DNA, 2961 bp, Artificial Sequence
  Description of Artificial Sequence: Synthetic coding sequence
atgccccgggccacctgggccaacagcaaggagcggagctgggccgaatcggagaggggcccccgcgacaccggcaatgggggctccaaggcagaacgacacatacaagaaatcgaaacggggcggggcggcgacagggccaaagcacaccgcaggcagcgtatgagacttcgggggacagagagagcgagcctgggcccgggtcgccgtctgggggattccagggggactgacatgcctggcgcacgtgcccaggggctggcagctgctatgactgaagagtccgaagaaacagtgctttatatagagcatagatacgtttgcagtgagtgcaatcagttgtatggttctctggaagaggttctgatgcatcagaacagccacgtacctcagcaacactttgaactggtaggggtggccgaccctggtgtgacagtcgcaacagacacggcctcgggaacaggactgtaccagactctggtacaggaaagccagtaccaatgcttggaatgcggtcagctcctcatgagtccctcacagcttttggaacaccaggagctgcacctgaagatgatggctcctcaggaggcggtacctgctgagcccagtccaaaagcaccaccgctgagctccagtacaatccactacgagtgcgtggactgtaaagcactgtttgcctcacaggaattgtggcttaaccaccggcagacccacctacgagccactcctacgaaggcacccgctcctgtggtgctcggatctcctgttgtgctgggcccaccggtcgggcaggcccgagtggccgtcgagcattcatatcgtaaagccgaagagggaggagagggggccacagttccaagcgccgccgccacgactacggaggttgtcaccgaagtggagttgctcctgtacaaatgttcggagtgttcacagttgtttcaacttccagctgattttctcgaacaccaggccacacactttccagcaccagtccctgaatcgcaggagccggcgctacagcaggaggtgcaagcatcaagtcctgctgaagtccccgtgagccagcccgatccactgccggccagtgaccacagttacgaattgcgtaatggcgaagcaattggccgggacagacgaggacgcagagctcgacgcaataatagcggggaggcagggggtgcagctacccaggagctattctgctccgcctgcgaccagctgtttctatccccacaccagctgcaacaacacttgagatctcatagggaaggggtcttcaagtgtcctctgtgctcacgagttttcccaagtccctctagtctggatcagcatctcggcgatcatagcagcgaaagtcattttctatgcgttgattgtggtctggcctttggcaccgaggctctgctgttggctcacaggagggcccacacgcctaatcccctccactcctgtccctgtgggaagacatttgtgaatttgaccaagtttctataccacagacgcacgcacggggtaggaggggtgccactgcctactacgccagtcccccccgaggagccagttataggtttcccagagcccgcccctgctgagacgggggagcctgaggcccccgagcctcctgtgtcagaagagacaagcgcgggtcctgctgcaccgggtacctaccggtgcctcctatgctctcgcgagtttggtaaggcactccaacttacacggcaccagcgtttcgtccacagactggagcgccgccacaagtgcagtatttgtggcaagatgtttaaaaaaaagtcccacgtgaggaaccatctgcggactcacacaggcgagcggccgttcccttgtcccgactgttcaaagccatttaatagccctgcaaacttggcgaggcatcgtctcacacacactggtgagagaccgtacagatgtggtgattgtggtaaagctttcacacagagttcaactcttagacaacacagactggtgcacgcccagcactttccgtaccgctgccaggaatgcggtgttaggttccaccgtccctatcgactgctgatgcacaggtatcatcacaccggtgaatacccttataagtgcagggagtgtccccggtccttccttctccggagactgctggaggtgcaccagctggtggtgcacgctgggagacagccccatcgctgcccgtcgtgtggcgcggcatttccctccagtctgagattgcgcgagcaccgctgcgccgcagccgcggcacaggcaccgaggaggttcgaatgcggcacctgcggtaagaaagtgggctctgctgcgcggctgcaagctcacgaggctgcccatgccgctgcaggacccggtgaagttctcgcgaaggaacctcctgctccaagagcccctcgcgcaacaagagcacccgttgcatccccagccgccctggggagcacagcaacagcttccccagctgcccctgctagacgtcgggggctcgagtgttctgagtgcaaaaaactcttcagcactgagactagcctgcaggtgcaccggcgcattcacaccggcgaaaggccatacccatgtcccgactgcgggaaagcgtttcgacagtccactcacttgaaagatcatcggagactccataccggcgagaggccgtttgcttgtgaggtatgcggcaaagcatttgctatcagtatgcggctggcagaacacaggaggatacacacgggggaacgaccctactcctgccccgactgtggcaagtcatatagatcattctccaatttgtggaagcatcgaaagacccatcaacagcagcaccaggccgctgtccgccagcaactggccgaggccgaggccgccgttggcttggctgtgatggagacagctgtcgaggcattacctctagtggaagcaatcgagatctaccctttggccgaggccgagggcgtccaaatctcaggatag

SEQ ID NO: 51001 - DNA, 447 bp, Artificial Sequence
  Description of Artificial Sequence: Synthetic coding sequence
atgttccggcggcccgtgctgcaggtgctgcggcagttcgtgcggcatgagagcgaaacaactaccagccttgttttggaacggtccctgaacagggtgcatcttctcggccgcgtcggtcaggatccagtgctgcgtcaggttgagggcaagaatccagtgacaatcttcagtctggcaaccaacgagatgtggcgtagcggagacagtgaggtctaccagctaggtgacgtgagccagaaaacgacgtggcaccggatatccgtattccggcctggcctacgagatgttgcatatcagtacgtgaaaaaaggatcaaggatttatctcgaaggcaagatcgactatggagagtatatggacaaaaacaacgtgcggaggcaagcaacaaccatcatagccgataatatcatcttcctctcggatcagacgaaggagaaagaatag

SEQ ID NO: 51002 - DNA, 447 bp, Artificial Sequence
  Description of Artificial Sequence: Synthetic coding sequence
atgttccggcggcccgtgctgcaggtgctgcggcagttcgtgcggcacgaatcagagaccactacgagtctcgtgttggaacgcagcctgaaccgcgttcacctgctcggaagggtgggtcaggacccagtgcttagacaggtggagggcaagaatcccgtcacaatattcagcctggctactaatgaaatgtggagatccggcgatagcgaagtgtatcagctgggagacgtttctcagaaaacaacctggcacagaatctctgtctttagaccaggtctgagggatgtggcgtaccagtatgtcaagaagggatctagaatttacctggagggcaagatcgattacggcgaatacatggataagaataacgtgaggagacaggctactacgatcattgcagacaatataatcttcctcagcgatcagactaaagagaaggagtag

SEQ ID NO: 51003 - DNA, 408 bp, Artificial Sequence
  Description of Artificial Sequence: Synthetic coding sequence
atgttccggcggcccgtgctgcaggtgctgcggcagttcgtgcggcatgagtcagaaaccacaacatcgttggtgctggagcgttccctgaatagagtgcatctgttgggaagagtgggccaggatccggtgctgcgccaagtcgaggggaaaaacccagtcacgatcttttctctggccacgaacgaaatgtggagaagtggcgactctgaagtataccagctgggcgacgtatcacaaaagaccacgtggcatcgaatttcagtttttaggcccggactgcgggacgtagcataccagtacgtgaaaaagggatcccgcatttacctcgagggaaagatcgattatggcgagtacatggataagaataacgtgcgaaggcaggctaccaccattattgctgattag

SEQ ID NO: 51004 - DNA, 447 bp, Artificial Sequence
  Description of Artificial Sequence: Synthetic coding sequence
atgttccggcggcccgtgctgcaggtgctgcggcagttcgtgcggcatgaatcagagaccaccactagcttggtgctggaacggtcactgaaccgggttcacctcctgggcagggtcggtcaggatccagtgctgcgccaggtcgaggggaagaatcctgtcactatcttcagcctggccaccaacgagatgtggcgctcaggcgacagcgaggtgtaccagttaggagatgtcagtcagaagacgacctggcatcgcatatctgtctttcgccctggtctgcgcgacgtggcttaccaatatgtgaaaaagggtagccggatttacctcgaggggaaaatagactacggagaatatatggataagaacaatgtgcgacgccaggctactaccatcatagcagacaacatcatatttctgtctgaccagaccaaagaaaaagaatag

SEQ ID NO: 51005 - DNA, 576 bp, Artificial Sequence
  Description of Artificial Sequence: Synthetic coding sequence
atgggctacaagctgcaggacctgaccgacgtgcagatcatggccaggctccaggaggaaaataagcttaggcgctccatgcctaatctggcccggatgccctctacgactgccattagcagcaatatttcttcacccgtcacagtccgtaacagccaatcattcgactcgtctcttcacggagccggcaacggcattagcaggattcagtcctgtatcccttcacccggccagcttcagcacagagtccattctgtaggccacttcccggttagcatccggcagcctctgaaggccacggcttatgtctccccgacagtgcagggtagttcaaatatgccactgtccaacgggttacaactctatagtaatactgggattccaacaccaaataaggctgcagcttccggcataatgggtcggagcgcactaccacgcccttcactcgctatcaacggatcaaatctcccccggtcaaagatagcccagcctgtccgctccttcctacagcctccaaagcctctctcgtctctgagcacactgcgggatgggaactggagagacgggtgctattag

SEQ ID NO: 51006 - DNA, 918 bp, Artificial Sequence
  Description of Artificial Sequence: Synthetic coding sequence
atgggctacaagctgcaggacctgaccgacgtgcagatcatggccaggctccaagaggaaagcctgcgccaggattatgctagtactagcgccagcgtgtcacggcactcctctagtgttagcttgtcttctgggaagaaaggaacatgctcggaccaggagtacgatcagtattcactggaggatgaggaggagtttgatcacctgcctcctccccagccccgtttgccacgctgctccccctttcagcgggggataccccatagccagacattttcctctatacgggagtgtagacggtcccctagctctcagtacttccctagcaataactaccagcagcagcagtattacagtccacaggcacagactccggatcagcagcccaacaggactaacggagacaaactgaggagaagcatgccaaacctggctcggatgccgtctacgactgctatctccagcaacatctcttccccagtcacggtgcgaaactcacaatcttttgactcttctcttcatggagctggcaatgggatttcacggatccagagttgtatcccttccccaggccagctccaacatagggttcactcagtggggcacttccccgtgagcatccggcagccccttaaagccactgcctacgtaagcccaactgttcagggatcaagcaatatgcctctaagtaatggcctccagttatactccaacacaggcataccgaccccaaacaaagcagccgcatccggaattatggggcgcagtgccctgcccagaccgtccttggctattaatggctccaatctcccgcggagcaagattgcacaacccgtgagatcattcctgcagccacccaagccattatcctcactatccacactgcgcgacgggaactggcgcgatggctgctattag

SEQ ID NO: 51007 - DNA, 918 bp, Artificial Sequence
  Description of Artificial Sequence: Synthetic coding sequence
atgggctacaagctgcaggacctgaccgacgtgcagatcatggccagactccaagaagaaagcctgaggcaggactatgcgtctacttccgcaagcgtttcacgacatagttcttcagtgagcctgtcaagcggaaagaagggaacctgctccgatcaggagtatgaccaatatagcttggaggatgaagaggagttcgatcatcttccgccacctcagccccgtctgcccagatgttcgcctttccagcgtggcatcccgcacagccagacgttcagttctatccgcgagtgtagacggagcccttcctcccagtatttcccctctaataactaccagcaacagcagtattactctccccaggctcagacccccgaccaacagcctaatcggaccaatggggacaaactgaggcgttcaatgcccaacctggcccgaatgccctctacaacagctatctcatctaacatatcatcacccgtgacagtcaggaacagccagtcatttgatagcagtcttcacggggcaggaaacggcataagtcggatccaaagctgcataccttcacctggccagctccagcaccgcgtgcacagtgtcggacactttcctgtgtccattaggcagcctctaaaagccacagcttacgtgtctcctactgtccagggaagttccaatatgcctctgtctaacggcttgcaactgtactcaaatactgggatccctacccctaataaggccgccgctagtggaatcatgggtagaagtgctctgcctcgacctagcctcgccatcaacggttccaatctgcctcgctctaagatcgcacaacccgtacgaagttttctccaaccacctaagccactgtcgagtttgtcaacccttagggatgggaattggcgcgacggctgctattag

SEQ ID NO: 51008 - DNA, 255 bp, Artificial Sequence
  Description of Artificial Sequence: Synthetic coding sequence
atgtaccggtaccagagctgccggtggaagaacaccctgttcctgtgcgtctccggttataccagtaggggaagcccactgagccctcagtcctccatcgacagcgagttgtccacctctgagctcgaagacgattccatttccatgggttacaagctccaggacttgacggacgtgcagatcatggctaggcttcaggaggagagtttaaggcaggattatgcctcaacatctgcgtccgttagccgccactag

SEQ ID NO: 51009 - DNA, 1707 bp, Artificial Sequence
  Description of Artificial Sequence: Synthetic coding sequence
atgatggccgagcaggtgaagtgcgccagcgccggcgtgagcagcggcgccgggagcggaccagtagttaatgctgagcttgaggtaaagaagctccaggaactcgttcgaaaacttgagaagcagaacgagcagctgagatctcgggcggcctcggctgccgcggctccacacctccttctgctgccacctccaccacctgctgctccgccaccagccggactgcaacctctggggccaagaagccctcccgccgctacagccaccgctgccgcaagtggcggcctgggtcccgcattcccaggaactttttgccttcctagcccggcaccgtcgcttctgtgctccctggctcagccacccgaggcaccctttgtgtacttcaaacccgccgccgggttcttcggagctggtggtggggggcccgaacctggtggcgctgggacacccccgggggcagccgctgcccccccttcacctcctcctacccttctcgatgaagtggaactcctggatttagaatcagtagccgcctggagggatgaggatgactacacttggctgtatatcgggtccagcaagacatttacgagcagcgagaagtcactgactcctctgcagtggtgcagacatgtgctggacaatccgaccccagaaatggaggctgctagacgcagcctctgttttcgacttgaacagggctacacttccagaggatctccactcagcccccaaagctccattgatagtgagttaagcactagcgagctggaagacgattccatatccatggggtacaagcttcaagaccttacggacgtacagatcatggcccgcctgcaggaagaatccctgaggcaggactacgccagtacctctgctagcgtcagccgtcacagctcttccgtgagcctttctagcggcaagaaagggacttgctctgaccaggagtacgaccagtactccctcgaagatgaggaagagtttgaccatctccctcccccgcagccacgactcccccgctgcagtccatttcagcgcggtattccacacagtcaaacctttagcagcattcgggagtgcaggagaagtccttcctcacagtatttccccagcaacaattatcagcagcaacagtactactctccccaggcacaaacgcccgatcaacagcctaacaggaccaatggcgacaaattgaggaggagtatgcccaatcttgctcgtatgccatccactacagcgatcagctccaacatatcctccccagtgacggtccgcaattctcagtcgtttgacagctccctccatggcgcgggcaacggcatctccaggatccaatcctgcatcccttcacctgggcaactgcagcatagggtgcatagtgttggccacttccccgtttcaatcaggcaacctctgaaagctaccgcttacgtgtcgccaaccgtccaaggtagtagcaacatgcccctatctaacggcctacagctgtacagcaatactggtatacccacccctaataaggccgccgccagcggtataatggggagatctgcgctcccgcgcccaagtctggccataaacggttccaacttacccagatctaagatcgcccagcccgtgaggtccttcctacagccccccaagccactgtccagtctgtcgacactgcgggacggaaattggcgcgatgggtgctattag

SEQ ID NO: 51010 - DNA, 1050 bp, Artificial Sequence
  Description of Artificial Sequence: Synthetic coding sequence
atggaggccgcccggcggagcctgtgcttccggctggagcagggctatacatccaggggatcgcctttgtctccacaatcttctatcgatagcgaactgtccacctcagagttggaagacgactccatatcaatgggatacaaattgcaggatttgaccgatgttcagatcatggccagactgcaggaagaatcacttcgccaggactatgccagtacctctgccagcgtgtctaggcattcatcctctgtgtccctgagcagcggcaaaaaagggacttgttctgaccaagagtatgaccagtactctctagaagatgaggaagaattcgaccacctgcctccgccacagccccgcttgccccgttgttctccgtttcagagaggaattcctcacagccaaaccttcagttctatccgggagtgtcgccgatctcctagctcccagtactttccttctaataactatcagcagcagcagtactatagccctcaggctcaaactccagaccagcaacctaaccgtaccaacggggataagttaagacgatccatgccgaatcttgccagaatgcctagcaccacagccatcagctctaatatttccagcccggtgacagtccgcaattcgcaaagcttcgacagttctctgcatggagccggaaatggaatctccagaatccagtcttgcatcccctctcctggtcaattgcagcacagagtgcacagcgtgggtcatttccctgtctctatcagacaaccattgaaagctactgcttatgtgtctcccacagtacaagggtctagcaatatgcctttaagcaacggattacagctctactcgaatactggcatcccaacccctaacaaggctgctgcctccgggatcatgggccgctctgcccttccaaggccatccttagctataaatggctctaatctccctagatccaaaatagcccagccggtcagatcgtttctccaaccccctaagccactgtcctccttgagcaccttaagagacggcaattggcgcgatgggtgttactag

SEQ ID NO: 51011 - DNA, 723 bp, Artificial Sequence
  Description of Artificial Sequence: Synthetic coding sequence
atgggctacaagctgcaggacctgaccgacgtgcagatcatggcccgcctgcaggaagagtcattaagacaggattacgccagtacgagtgcgagcgtgtcgcggcactcatcttcagtgtcgttgtcttcggggaagaaaggcacctgttctgaccaggagtacgaccaatattctctggaggacgaggaagaatttgaccatctccctcccccacagccacggctaccccgctgttctccattccagagaggcatcccgcatagccaaaccttcagttctattcgcgaatgccgacgttcaccctccagccaatatttcccttctaacaattaccaacagcagcaatattactcacctcaggcccagacccccgaccagcagcctaacaggactaatggggacaaactaagacgcagtatgccaaatctcgctcgtatgccatctaccacagccatcagcagcaacattagttcgcctgttacggtgcggaattctcagagctttgatagtagcctccacggcgccgggaatgggattagtaggatacagtcatgcatccccagccccgggcagcttcagcatagagttcattctgtgggccactttccagtgagtattagacaacccctcaaggcaactgcttacgtgagccctactgttcaaggctccagcaatatgcctctgtccaacggcctgcagctgtattccaacactggatag

SEQ ID NO: 51012 - DNA, 1707 bp, Artificial Sequence
  Description of Artificial Sequence: Synthetic coding sequence
atgatggccgagcaggtgaagtgcgccagcgccggcgtgagcagcggagccgggagcggaccggtggtaaacgccgagctggaggtgaagaaactgcaggagctcgtccgcaagctcgagaaacagaatgaacagttacggagccgcgccgccagtgcagccgcagcacctcacttgcttcttttgcctcctccaccacccgccgcaccaccaccggccggtctccaaccactgggccctcgttctccgcctgccgcgaccgcaacggccgccgcctccggaggcctcggccccgcgttccccgggactttctgcctcccaagccccgctccatctctactttgcagcttagcccaaccccccgaagcaccttttgtgtattttaagccggccgcggggttctttggagccggaggcggtgggccagagcccggaggagccggcaccccacctggggccgcggcagctcctccgagtcccccccccaccctattagatgaagtggaactgctcgacctcgagagcgtggcggcctggagagacgaagatgactatacttggctgtacatcggatctagcaaaacttttacctcctctgaaaagtcacttacacccctgcagtggtgtcgccacgttctggacaatccaacacccgagatggaggccgccaggagatctctgtgttttaggctggagcagggatacaccagtcgggggagccctctctctcctcagagctctattgacagcgaactctctactagcgagctggaggatgattctatctctatgggctacaaactgcaggacttaactgacgttcaaataatggctcgcctgcaggaggaatctctccggcaggattatgcatcaacatccgccagcgtttctcgccattcctcctctgtgagcctgagcagcggtaagaagggcacatgttccgaccaggaatatgatcagtacagcctggaagacgaagaagaattcgatcaccttccccctccacaacctaggctgccacggtgcagtccttttcagaggggcatccctcactcccagacattctcctcaattcgcgaatgccggcgttcgcccagctcccagtatttcccctccaacaactatcagcagcagcagtactattctcctcaggctcaaacaccagaccagcagccgaatagaaccaatggcgataaactcagacggagtatgccgaatttggccaggatgccttctacaaccgcaatttcatccaatattagctcccccgtgacagtccggaattcacaatcttttgattccagtctgcatggagccggcaatgggatatcacgcatacagtcttgtatcccaagtccagggcaacttcagcatcgcgttcattccgttgggcatttccctgtttccattcgccaacccttaaaagcaacggcctacgtcagcccaacagtgcaaggctcttcaaatatgccactgtccaacggcctgcagctatattccaataccggcatcccaacacctaacaaggctgccgccagcggtatcatgggacgatccgcactgcctcgccccagcttagcaattaatggatctaacttaccacgctcaaagatcgcacaacccgttaggagtttccttcagccaccgaagcctttgagtagcctttcaaccctccgggacggaaattggagggatggctgttattag

SEQ ID NO: 51013 - DNA, 444 bp, Artificial Sequence
  Description of Artificial Sequence: Synthetic coding sequence
atgggctacaagctgcaggacctgaccgacgtgcagatcatggccagacttcaagaggagtctctcagacaagattacgcctccactagcgcaagtgtgagccggcatagctcctctgttagtctgtcaagcggaaagaagggcacatgctccgatcaggaatatgaccagtactcgctggaggacgaagaggaatttgaccacctccccccaccccaaccgcgtctgcctcgttgcagcccctttcaacgtgggatcccacactctcagacattctcgagcatccgagagtgccgaagatcaccttcctcacagtacttcccctccaataattaccagcaacaacagtattactcgccccaggcccagacccctgaccaacagccaaacaggacaaatggcgataagctgaggcggagcatgcccaatttagcacggatgtag

SEQ ID NO: 51014 - DNA, 39 bp, Artificial Sequence; identical to SEQ ID NO: 24716
  Description of Artificial Sequence: Synthetic coding sequence

SEQ ID NO: 51015 - DNA, 1281 bp, Artificial Sequence
  Description of Artificial Sequence: Synthetic coding sequence
atggtgggcgtgggcctgtgcctgcggctgctgctgttcttccggtttaagagaacactggatcgaatttgcgtgttgtttctgctgggctggcacagaaaaccgcgctctgatggtagccttttcatcgaaaggctttacatcggcagcagtaaaacctttacctcttcggagaagagcttgacccccctccagtggtgcagacatgttctggataaccccacccctgaaatggaggccgctcggcggtctctctgcttcaggctcgagcagggctatacgtccaggggaagcccactatccccccagtcttccattgattctgaattgtccaccagtgaactcgaagatgactctatcagcatgggctataagctccaagatctcacggacgtccagataatggctcgactccaagaggaatcactaaggcaagactacgcatccacgagcgcctcagtttcgcggcattctagctctgtctcattgtcttcaggcaagaaggggacctgctcggaccaggagtatgaccagtacagtctcgaggacgaggaggaattcgaccatctcccacccccccaaccgagactgcccaggtgttcaccattccagcgagggattccccattcgcagacgttctcgtccatccgcgagtgtagacggagcccctcctctcagtacttccccagcaataactatcagcaacaacagtactatagccctcaggcccagacacctgaccagcagcctaataggaccaacggagataagctgcgccgctccatgcctaacctggctcgaatgccgagtaccactgcaattagttccaatatttcctcgccggtgacagttcgaaactctcaatcttttgacagctccctccacggcgctggaaatggcatcagtaggattcagagttgcattccaagtccagggcagttgcagcacagggttcatagcgtcggacacttcccggttagtattagacagcctctgaaggcaacagcctatgtgtcacccacggttcaaggaagctcaaatatgcccttgagtaatggactgcagctgtactcaaatactggcattcccacccctaacaaagcagccgcctccggaattatggggcgaagcgccctaccaaggcctagtcttgcgatcaacgggagcaatctcccaaggtcgaaaatcgctcaacccgtgcggagttttctccagccccctaagccactttcaagcttgagcacactcagagatgggaactggcgggatggctgttattag

SEQ ID NO: 51016 - DNA, 408 bp, Artificial Sequence
  Description of Artificial Sequence: Synthetic coding sequence
atgggctacaagctgcaggacctgaccgacgtgcagatcatggccaggctccaggaggaaagtctcagacaggactacgcatccacttccgcgtctgtcagcagacatagctcttcagtgtcactcagttctggaaaaaaaggcacatgtagcgatcaggaatacgaccagtactctctggaggacgaagaggaatttgaccaccttccccccccacagccgaggctgcctagatgctcaccattccaaagggggattcctcattcgcaaacatttagttccataagagagtgtagacgaagccctagcagtcagtattttcctagcaataactaccagcagcaacaatactactcgccccaagcccagacccccgaccagcagccaaaccgcacgaatggagggtag

SEQ ID NO: 51017 - DNA, 2538 bp, Artificial Sequence
  Description of Artificial Sequence: Synthetic coding sequence
atgctgagcggcgtgtggttcctgagcgtgctgaccgtggccggcatcctgcaaaccgagagccgcaagactgcaaaggacatttgcaagattaggtgtctgtgcgaagaaaaggagaacgtcctgaacatcaattgcgagaacaaagggttcacgaccgtgtctcttctgcaacccccccaataccgtatttaccaactttttctgaatggcaatctcctgacccgtctgtaccccaatgagttcgtcaattacagcaatgctgtaaccctgcatctgggtaataatgggcttcaggaaattcggaccggggctttttccggactgaagacacttaaaagattacaccttaacaataacaagctggagattctgcgcgaggatacattcttgggcctcgagtcattagagtatctgcaggctgactacaactacatctctgccatcgaagccggggcctttagcaagctgaataagctgaaggtgttgatccttaacgacaatctgctgttgtcactgcccagcaacgtgtttcggtttgtactgctgacgcatttagacctgcgcgggaaccggctgaaagtgatgccattcgcgggagtgctggagcacattggaggcatcatggaaatccagcttgaggaaaacccgtggaactgcacatgtgatctgctgcctctgaaggcatggttagatacaattacagtcttcgtcggagagattgtctgtgagaccccttttagattgcacggaaaggacgtgactcagctgactcgccaggatctttgtcctcggaagtcagccagcgattctagccaacggggctcccacgccgacactcacgtgcagcgcctgtcaccaaccatgaatcccgctctcaatccaaccagggcccccaaagcttccaggccccccaagatgagaaatcgccccacgccgagagttaccgtgagtaaagaccgtcagtcatttggcccaatcatggtatatcaaacgaagtcaccggtcccactgacctgcccctcctcttgcgtgtgtacaagccagtcttccgacaatgggctgaatgtcaactgccaagaacgcaagttcacgaacatctcagaccttcagcctaaaccaacttccccgaaaaaattgtacttgacaggaaattatctgcagaccgtctacaagaacgacctccttgagtactcctcactagatctgttgcacctcggcaataatcggattgcagttatccaagagggggcttttaccaacctgactagcctgcgccgcctctacctgaacggcaactatttggaagtgctgtatcctagcatgttcgatggtttgcagagccttcagtatctgtacttggagtacaacgtgattaaggaaattaaacctctgactttcgatgccctgattaacctgcagctgttattcctgaacaacaaccttcttagaagtttaccagataacattttcggaggcactgctttaactagactgaatttacgtaacaaccacttctctcatctgccagtaaagggagtgcttgatcagctccccgctttcattcagattgatttacaggagaacccgtgggattgcacttgcgacattatgggtctgaaagactggaccgagcacgcaaatagccctgtcattatcaatgaagtgacttgcgagtcccctgctaagcacgctggggagatcttgaaattcctgggaagggaggccatatgtccggattcccccaacctgtctgacggcaccgtgcttagtatgaatcacaatacagacactcccagaagcttgtctgtttctccctcaagctatcccgagctacatacggaggtgccgctgagcgtgcttatcttgggtctgctggtggtgtttatcctatctgtctgttttggcgcagggctgttcgtcttcgtgttaaaaagaagaaagggcgtgccctctgtgccccggaataccaacaacctcgacgtttcttcatttcagctgcaatacggatcatataacacggagacccacgataaaacagacggtcatgtgtacaactatatcccgccccccgtgggccagatgtgtcaaaatcctatttacatgcagaaggaaggtgacccagttgcatactatcgcaacctacaggaatttagctatagcaacctggaagagaaaaaggaggagccggctactccagcgtacactatttcagctaccgagctcctggagaaacaggcaacccccagagaacctgagctgctctatcagaacattgccgagagagtgaaggagttacccagcgccggactggtgcactacaacttctgcaccctgcctaaacgccaatttgcaccatcttacgaatccaggagacagaaccaggaccggattaataagaccgtcttatacggcacaccccgaaaatgctttgtcgggcagagcaagcccaaccatcccctcctccaagctaagccacagtccgagccggactacctggaggtcctcgagaagcaaacggccatctcacagctgtag

SEQ ID NO: 51018 - DNA, 2538 bp, Artificial Sequence
  Description of Artificial Sequence: Synthetic coding sequence
atgctgagcggcgtgtggttcctgagcgtgctgaccgtggccggcatactgcagactgagtctcgtaaaactgctaaggatatctgcaaaatccgctgtctgtgcgaagagaaagagaacgtgctgaacatcaattgtgagaataagggtttcaccacagtgagccttctgcagccaccgcaatatcggatctatcagctatttttaaatggcaatcttttaactaggctttacccaaacgagttcgtgaactatagcaacgcagttacgctgcacctggggaacaacggccttcaggagatacgaacaggggcattttcaggtctcaagacactgaagagacttcatcttaataacaacaaactcgagattctccgggaggataccttcttaggcttggagagcctggagtacctccaggctgattacaattacatctcagcaattgaggcaggggccttcagcaagctgaacaagctgaaggtcttaattcttaacgacaatctcttactcagcctgccttcaaacgtctttcgcttcgtgcttttgacacatctggatctccgaggaaatagattgaaagtgatgccatttgcgggggtgctcgaacacatcggagggatcatggaaatacagttggaggaaaacccttggaattgcacatgcgacttactgccactgaaagcttggctggacacgattacggtgttcgttggggagatcgtttgcgaaactccctttaggttgcacggcaaggatgtgacacagttaacccggcaagacctgtgccccagaaagtctgcaagtgactcctctcagagaggaagccacgcagacacccacgtccaacgactgagccccacaatgaaccctgccctgaacccaactcgcgccccaaaggcctccaggccgcccaagatgaggaacagacccactccacgcgtcactgtcagcaaggatagacagtcctttggcccaatcatggtgtatcaaactaagagccccgtgccgctgacctgcccgagttcatgcgtatgtaccagtcaatcgtctgacaacggtctgaacgtgaattgtcaagaacgtaaattcacaaacatctccgatctgcagcctaagcccacttcccccaaaaagctctatctgaccggtaactatttgcaaaccgtctataagaacgatctgctcgagtattcatcactagacctgctacaccttgggaacaaccgcatcgcagtgattcaagagggcgcctttactaacttaacctcgcttcgacgactttacttgaatggcaactacctggaggtgttgtatccctccatgtttgacggtttgcagtcactccaatacctctacctggaatataatgttatcaaggagattaaacccttgacctttgatgccctgatcaacctccagctgcttttcctgaacaacaacctgctaagatcactgcctgacaatatcttcggaggcactgcccttacgaggctcaacctgagaaataaccacttttcgcacttgcccgtcaaaggtgtcttggatcagctacccgccttcatccagatcgacctccaggagaacccttgggattgcacgtgtgacatcatgggccttaaagattggactgagcatgcaaacagtccagtcatcataaacgaggtcacttgtgaatcccccgccaagcacgcaggagaaattttgaaatttcttggacgcgaagctatctgcccagactctcccaatctgagtgacggcaccgtgctgtctatgaatcacaacaccgatacaccgcgctccctgtctgtctcacccagctcctaccctgagctccacactgaagtgccattatctgtgctcatcctgggcctgctggtcgtgtttatactgtctgtttgcttcggtgccggactttttgtttttgtactgaagcgcagaaaaggcgtgccttccgtgccaagaaacacgaataacctggacgtttcatcatttcagctgcagtacggctcgtacaatacagagacccacgataagactgacggccacgtgtataactatattcctccccctgtaggccaaatgtgtcaaaacccaatctacatgcagaaagagggagacccagtcgcatactacagaaatcttcaggaattctcctactcaaatcttgaggagaaaaaagaggagcccgctactccagcatatactattagtgccacagagttactcgagaagcaggccaccccgagagagccagaactgctgtaccagaacatcgcagagcgcgtgaaggagctaccttcagcaggtcttgtccactataacttctgcaccctgcctaagagacagttcgctcctagctacgagtcgaggagacagaaccaggacaggattaataaaacagttctctacggcactcccagaaagtgctttgtggggcaaagtaagcctaaccatccgttgctgcaggcgaagccacaaagcgagcctgactacctcgaggttttggaaaagcagacggcaatttctcaattgtag

SEQ ID NO: 51019 - DNA, 2538 bp, Artificial Sequence
  Description of Artificial Sequence: Synthetic coding sequence
atgctgagcggcgtgtggttcctgagcgtgctgaccgtggccggcatattacagaccgagagccgcaagactgcgaaagatatttgcaagatcaggtgcctgtgtgaggagaaggagaacgtactcaacattaattgtgagaacaagggctttacaacagtgtccctcctccagccacctcagtaccgtatctatcaactctttttgaatggaaatctgttgacacgcttgtacccgaacgaatttgtgaactattcaaatgctgtcacactacatctgggaaataatgggttgcaagagatccgtactggagcattctccggcctcaaaacacttaaaaggcttcacttaaacaacaataaactggagattttgcgcgaagacacattcctaggcctggagagcctggaatatctacaggccgactacaactacatctctgccatcgaggccggagcatttagcaaactgaacaagttaaaggtgttgatcttgaatgacaacctccttctgtctttaccgagtaacgtgtttcgatttgtcctgttgactcaccttgacctccgaggcaatcggctaaaggtgatgcctttcgctggcgtgttggaacacataggcggcatcatggagatccagcttgaggagaatccctggaactgtacctgcgatttgctgcccttgaaggcctggctggacacgataaccgttttcgtgggagagatcgtgtgcgagacgccttttcgcctccacgggaaggacgtgacccaactgacccgacaggacttatgtccaagaaaatccgcatctgattctagtcagagaggcagccacgcagacacccatgttcagagactgtcgcccaccatgaatcctgcactgaaccccacccgcgcccccaaagcatctcgcccaccaaagatgagaaatcgcccaactccgcgggttactgtatcaaaagacaggcaatcttttggcccgataatggtttatcaaacaaaaagtcccgttcctttgacgtgtcccagcagctgcgtttgcaccagccagtcttctgataacggtttgaatgtaaattgccaggaaagaaaattcacaaacatcagcgatcttcagcccaagcccacttccccgaagaaactttatctgaccggaaattacctacagaccgtgtataagaacgatttgctagagtactcctcgctggatctgctccatctaggcaataataggattgctgtgatacaggaaggagcatttacaaaccttacctctcttcggcgcttgtaccttaacggaaattacctggaagtactgtatcccagcatgtttgatggtctccagtcactgcagtatctgtatttggagtacaacgttataaaagagattaagccactgactttcgacgctctcatcaatctgcagctgctgttcttgaataataatctgctcaggtctcttcccgataatatcttcggcggcactgcactcactcgactcaacctgcggaacaaccacttctcccatttaccagttaagggcgtgctggatcaacttcctgcttttatacagatagacctgcaggaaaacccatgggattgcacttgtgacattatggggctgaaggattggactgagcacgcaaatagtccagtgatcatcaatgaagtaacgtgtgagagcccagcaaaacatgcaggcgagattctaaaattcctgggtagagaagccatctgtcccgacagtcccaatctgtctgacggaacagtcctgtccatgaaccacaacacggatactcccaggtctcttagtgtgagcccctcgtcttatcccgagctgcacactgaagtgcccctgagtgtgctgatactggggcttctcgtggtcttcatcttgtcggtgtgtttcggggccggtctgttcgtgttcgttcttaaacgcaggaagggggttccttctgtgccgcggaatacgaacaatctggatgtcagttcttttcaacttcagtacggttcttacaacactgaaacacacgacaaaaccgatggtcatgtgtacaactacattcccccccctgtcgggcagatgtgtcagaaccccatttatatgcaaaaggagggcgacccggtagcttactaccgaaacttgcaggaattcagctactcaaatcttgaggagaaaaaggaggaacccgctacaccagcttacaccatcagtgcaactgagctgttagaaaagcaggctaccccacgcgagcccgagctactttatcagaatattgccgagcgtgtcaaggagctgccttctgccggactggtacactataatttttgcactctcccaaaacggcagttcgcccccagctatgaatcacgtcgccagaaccaggatcggataaataaaacagttctttatggtacccccagaaaatgcttcgtgggtcagtccaagcccaaccaccccctcctccaggctaaaccccagtcggagccagactatttggaagtcttggaaaaacagaccgcaattagccaactatag

SEQ ID NO: 51020 - DNA, 333 bp, Artificial Sequence
  Description of Artificial Sequence: Synthetic coding sequence
atggcccggggcaaccagcgggagctggcccggcagaagaacatgaaaaagacgcaggagatttcaaaaggcaaacggaaggaggatagcctgactgccagtcagaggaagcagagctctggcgggcagaaaagcgaaagtaaaatgagtgcagggccacacttacctctgaaggcacctcgcgagaacccatgcttccccctgcctgctgccggcggtagcagatattacctagcttatggatcaattactccgatctccgccttcgtgtttgtagtcttttttagcgtgttctttcccagcttttacgaagacttttgctgctggatctag

SEQ ID NO: 51021 - DNA, 189 bp, Artificial Sequence
  Description of Artificial Sequence: Synthetic coding sequence
atggcccggggcaaccagcgggagctggcccggcagaagaacatgaagaagactcaggaaatttcaaagggcaaacggaaagaggattcgctgacagcgagtcagcgtaaacagagagacagtgaaataatgcaggagaaacagaaggcggcgaacgaaaagaagtccatgcagacaagggagaagtag

SEQ ID NO: 51022 - DNA, 915 bp, Artificial Sequence
  Description of Artificial Sequence: Synthetic coding sequence
atgagcagcatcaagcacctggtgtacgccgtgatccggttcctgcgggagcagtcccagatggatacctacacgtccgacgagcaggagtcccttgaggttgctattcagtgcctggaaaccgtcttcaagatctctccagaggacacgcatctcgctgtgtcacagcccttgaccgaaatgtttacatcctccttttgtaagaatgatgtgttgccgctttctaactcagtaccagaagacgtgggaaaggcggaccaacttaaggacgaaggcaacaatcatatgaaagaggagaattacgccgccgcggtcgactgctacacccaggccatcgagttggaccctaataatgctgtttactattgtaatcgcgccgccgcacagtccaagctgggccactacacagacgccatcaaggactgcgagaaagcgatagccatagacagtaaatactccaaggcttacggccgaatgggtctggctctgactgcgctcaataagtttgaagaagccgtgacctcctaccagaaagccctggacctcgaccccgaaaacgactcatacaagtccaacctcaagatagccgagcagaaattacgtgaagtcagcagcccaaccggcacaggcctgtcctttgatatggcctcgttgattaacaatccagcctttatatccatggccgcctcgctcatgcaaaatcctcaggtccagcaactgatgtccggaatgatgaccaacgcgatcggcggacctgccgctggggtcggcggattgacggatctctccagcttaattcaggctggccagcaattcgctcagcaaattcagcagcagaatcctgagctgattgaacagctgcggaaccacattcgtagcagatccttcagctccagcgccgaggagcattcatag

SEQ ID NO: 51023 - DNA, 588 bp, Artificial Sequence
  Description of Artificial Sequence: Synthetic coding sequence
atgagcagcatcaagcacctggtgtacgccgtgatccggttcctgagggaacagtctcagatggacacatacaccagcgacgagcaggaatcactcgaagtggccatccagtgtctggaaactgttttcaagatctcacctgaggatacccacctggcggtgtcacagccactgactgaaatgtttacatcctctttctgtaagaacgacgttcttccactgtctaacagcgttcctgaggatgtcgggaaagctgatcagctaaaagacgaaggcaacaaccacatgaaagaggagaattatgcagctgccgtggattgttacacccaggcaattgaactggaccctaacaatgccgtgtactactgcaaccgtgccgctgctcagagcaaactaggccactatacagacgccattaaggattgtgagaaagctatcgcaatcgatagtaaatacagcaaagcttatgggcgaatgggcctggcgctgacagcccttaacaaatttgaggaggcagtaacaagttatcagaaggcacttgatctggatccggagaacgactcctacaagagcaacctgaagatctag

SEQ ID NO: 51024 - DNA, 237 bp, Artificial Sequence
  Description of Artificial Sequence: Synthetic coding sequence
atgcagccccaggagagccacgtgcactacagccggtgggaggacggatccagagatggggtatctttgggtgctgtgagctcaacagaggaagccagtcgatgcagaagaatatcgcagcgtctttgcactggtaagctgggaatcgcaatgaaggttttgggcggagtcgcattgttctggattattttcatcctgggatacctgacagggtattacgtgcacaagtgcaaatag

SEQ ID NO: 51025 - DNA, 189 bp, Artificial Sequence
  Description of Artificial Sequence: Synthetic coding sequence
atggaccagctggtgttcaaggagaccatctggaacgacgccttctggcaaaatccttgggaccaaggcggcttagctgtgattattctttttatcaccgctgtgttgctccttattctgttcgccatcgtctttggcctgctcacatcaactgagaatactcaatgtgaggcaggagaggaagagtag

SEQ ID NO: 51026 - DNA, 279 bp, Artificial Sequence
  Description of Artificial Sequence: Synthetic coding sequence
atggcctacagcggccagggccagaaggtgcagaaggtgatggtgcagcctattaacttgattttccgatatctgcagaataggagccagatccaggtttggctgtatgaacaagtaaatatgcagattgagggatgcatcattggttttgacgagtacatgaatcttgtcttggatgacgctgaggaaattcattccaaaaccaaatcgaggaagcagttgggcagaataatgctgaaaggggataacataacactgttgcagtcagtttctaactag

SEQ ID NO: 51027 - DNA, 297 bp, Artificial Sequence
  Description of Artificial Sequence: Synthetic coding sequence
atgcaggtgcccctgacccccctgtgggagctgggcctgggccgggtcgtggagaacgcggacgctttggccattgcaattgtgttgaacaaccagtggagccttgtcccaaaccgaggcatcctgtatttcctgcctgtaagtatgaaactgggcggcgatcgggtgagctgtcagtttcttaccgccactagccatcaatggcttcactccgtaagcttaacccaacatatggcacaagaatgtctcccctcagtctctgtgtccaccgccgctatcccccgatgctggtcctag

SEQ ID NO: 51028 - DNA, 423 bp, Artificial Sequence
  Description of Artificial Sequence: Synthetic coding sequence
atgcggcggtgcctgcgggtgaagacccggcggggccagctgggcctggcttcgtcttgtttcgagcagcatagttgcttttctcccagagtcaatcggattttgagtgcagtacaaaatacattgtgtaccggaccctcgagccaggcgcccccccaacctccgcaggcctctccgcctgcagccgcagatcactcgaggacgccgagcttgctggcctcctctcatagcgcgtcaggaggagagtccttgttccagttatacatcgcctccctcgcttggccacagaattgttgtgtgttggagtcgtgccgccggattcccctgggggggctatcttccatggaaaacagaaggcctctgcttagaaagggccgcttacttcgggggcagattcaccactcccaaaccaatgagctgtag

SEQ ID NO: 51029 - DNA, 2814 bp, Artificial Sequence
  Description of Artificial Sequence: Synthetic coding sequence
atgatcagcgcccccgacgtggtggccttcaccaaggaggaggagtacgaggaggaaccatacaacgaacccgcccttcccgaggaatactccgtgcctttatttccttttgcaagccagggagctaacccctggtcgaagctcagcggcgccaagtttagccgagactttattcttatatcagaattctctgagcaggtgggaccccaacctcttctaactatcccaaacgacacgaaggtgtttggcacattcgatctcaactatttctcactgcgaataatgtctgttgattaccaagcatctttcgtagggcacccgcctggcagcgcttaccctaaacttaatttcgttgaggactccaaagtagtgcttggagactcgaaggagggcgcattcgcatatgtgcaccacctcactctttacgatttggaggcgcgcgggtttgtgcgccctttttgtatggcctacatatcagctgatcagcacaagatcatgcagcagttccaagaactttctgctgagtttagtagggcttctgagtgtttgaagaccggtaatagaaaagctttcgcaggagaattggagaagaagctcaaagatctggactatacaagaactgtgcttcacaccgaaaccgaaatccaaaaaaaggccaacgacaagggcttttacagctcccaggccatcgagaaagcaaacgagcttgcctctgtcgagaaatctataattgagcatcaggatttgctcaagcagattaggagctatcctcaccgaaagctgaagggacatgatctgtgcccaggggagatggagcacatccaggatcaagcaagccaggctagtacgaccagtaacccggatgagagcgcagacaccgacctctatacctgccggcctgcctacactcccaagctgattaaggctaagtctaccaaatgcttcgataaaaagcttaagactctggaggaactatgtgacaccgagtattttacccagactctagctcaactgagccatatcgagcacatgttcaggggagatttatgttatcttctgacttcccagattgatagggcactcctcaagcagcagcacatcaccaacttcctcttcgaggatttcgtagaagtcgacgaccgtatggtggagaagcaggagagtattcctagtaaacccagccaagatcgcccaccctcatcgagccttgaagaatgccccatcccgaaggttctgatcagtgtaggctcttacaaatcttcagttgagtccgtattaattaaaatggaacaggagctgggtgacgaagagtacaaagaggtcgaagtgacagagttgtctagtttcgatccccaggagaatctggactatctggacatggacatgaagggatcaatctctagcggggagtcaatcgaggtcctcggcacagagaagtcaacctccgtcctgagcaaatctgattcccaggcctcactgactgttccactgagtccacaggttgtgagatctaaagcggtgagccaccggaccatcagtgaggacagcatcgaggtcctgtccacatgtccttctgaggctctaattcctgatgacttcaaagcttcctacccatctgcaattaacgaagaggagagttaccctgacggaaatgagggcgccatccgtttccaggctagcatcagtcctccggagctcggagagaccgaggagggctccatcgagaacaccccatcccaaatagactcgtcgtgctgcattggaaaggagagtgacggccagttggtgctcccctctacacctgctcatactcacagcgacgaggacggcgtggttagttcccctccacaaagacaccgtcaaaaggaccagggtttccgagtggacttcagcgttgagaacgcgaatccctcctccagagacaatagctgtgaagggttccccgcctacgaactcgatccttcccatctgttggcgtcgcgcgacatttcaaaaacttccctggataattactcagatacgacttcctacgtgtcctctgttgcttctaccagcagcgaccgcatccccagcgcctatcctgccggcttgagctccgacagacataaaaagcgcgccggccagaacgctctgaaatttatccgccagtacccctttgcacatcctgccatctattccctcctgagtggtcgaaccttggtggtactcggcgaggacgaagctatagtgagaaagcttgttactgcgcttgctattttcgtgcctagctatggatgttatgccaaacctgtcaaacattgggcatcttccccccttcacataatggactttcaaaagtggaagttaatcggtctgcagcgggtggccagccctgccggggcagggactctgcatgccctgtcgcgttactctcgctataccagtattctggacttggataacaaaaccctgagatgccccctgtaccggggaaccttagtacctagactggctgaccatcgaacacaaatcaagcgtggctccacatactatcttcacgtgcaatctatgctgacacagctgtgttcaaaagcgttcctttatacgttctgtcaccatctgcacctaccaactcacgacaaagagacagaggagctggtggcgagcaggcaaatgtcatttctgaagctcaccctggggctggtaaatgaagacgtgcgcgtggttcagtacctggctgaacttttgaagctgcactacatgcaagagagccccggcacctctcatcctatgctgcggtttgattacgtgccttcctttctttataagatatag

SEQ ID NO: 51030 - DNA, 954 bp, Artificial Sequence
  Description of Artificial Sequence: Synthetic coding sequence
atgcggaagaccagcaacagctgcatcatggagaacggccaccagccaggggccggacccggggacggacctcctgaaatcgcccaaaacttttctgccccagatccaccgcgacccaggcccgtgagcctttcactgagactccctcatcaaccagttaccgcaatcactagagtgtccgatcgcttttctggcgaaaccagcgctgccgccctctcccccatgtccgcagctaccctgggaggcctgaacccctctccttccgaagtgatcactccttggactccctctcccagcgagaaaaatagttcattcacatggagtgtgcctagctctggctatggcgcggtgaccgcctctaagcattctaatagtccaccgcttgttacgcctccacagtcccccgtcagccctcagcccccagcaattactcaggtgcatagacagggcgagcgacgcagagagttagtacgcagccaaactctaccaaggacttcagaggcccaggcacgaaaagcattattcgagaagtgggaacaagaaaccgctgcaggaaagggcaagggcgaggcacgagcacggctgaaacgctcccagtcctttggggttgcatccgcttcatctatcaagcaaatcctgctggaatggtgtcgttctaagactctcgggtaccagcacgtggacttacagaattttagtagttcctggtccgacggcatggcgttctgcgccctcgttcactcttttttccccgacgcgttcgattacaattccctgtcccccacccagcgacagaagaacttcgaactggccttcacaatggctgaaaatttggctaactgcgagagactgatcgaggtggaagatatgatggtaatggggagaaaacctgaccccatgtgtgtgttcacttatgtacagagcctctataatcatctgcggaggttcgaatag

SEQ ID NO: 51031 - DNA, 1386 bp, Artificial Sequence
  Description of Artificial Sequence: Synthetic coding sequence
atggagcccgcccccgacgcccaggaggcccggaccgtgcgggaggcgttaggccgatacgaggccgcgctcgaaggcgcagtgagagctttgcatgaagatatgcgaggcttgcagcgaggtgtggagcggagagtggcagaggccatgagattggcaggcccactcgctcgcactgtagctgaccttcaacgcgacaatcagcggctgcaggcacagcttgaaaggttgaccaggcaggttgaggccttgggcctggccagtgggatgtcaccggtgcccggcacaccaggcacgccgtctcccccccctgccccaggcgtgcccgatcgtgcacccagattaggttcagcacgatttgcgagtcacgccactttttcattaagtggcagaggacagtccctggaccacgatgaagcaagcgagtcggaaatgcgcaagacgagcaatagctgcatcatggaaaatggacatcagccaggagcaggcccgggggatgggcctcccgagattgcccagaacttctccgcccctgaccctccacggccacggcctgtatctctgagcctgcggcttccacatcagcccgttacggctatcacaagagtgtcagatcgcttcagtggcgaaacatctgcggctgccctgtctcctatgtccgcggccacactgggtggactaaacccgagcccgtccgaggtcataaccccatggaccccaagtccttcagagaagaactcttccttcacgtggtcagtcccctcctccggatacggagcagtcacagcatcaaaacatagcaattcacctccccttgtcaccccaccccagagtcctgtgtctccacaaccccctgctatcactcaggtccatcgccagggtgaacgccgcagagagctggtgcgtagtcagactctacctcgcaccagcgaagctcaggctagaaaggctctctttgaaaaatgggagcaggaaacagctgcgggcaaagggaagggcgaagcacgggccagactcaagagaagccagtcgtttggtgtggcctctgcctcttcaattaagcagattctgctggagtggtgtcgttccaaaactcttggctaccagcacgtcgatctgcaaaatttttcttcgagttggtcagatgggatggcattctgtgctttggtgcacagcttcttccctgatgcattcgactataattccttgtcacccacccagaggcagaagaactttgagcttgccttcactatggcggaaaacctggccaactgtgaacgcctcatagaagtggaagacatgatggtgatgggccgaaagccagacccaatgtgcgtgttcacctacgtgcagagcttgtataaccatcttcggagattcgaatag

SEQ ID NO: 51032 - DNA, 216 bp, Artificial Sequence
  Description of Artificial Sequence: Synthetic coding sequence
atggccgacgagaagcccaaggagggcgtgaagaccgagaacaacgatcatatcaacctcaaggtcgcaggacaagacgggtctgtggttcaatttaagatcaagagacacactccattatcaaaactgatgaaagcatactgtgaacggcaattggagatggaagacgaggacacaattgacgtgtttcagcagcagacaggaggagtttactag

SEQ ID NO: 51033 - DNA, 288 bp, Artificial Sequence
  Description of Artificial Sequence: Synthetic coding sequence
atggccgacgagaagcccaaggagggcgtgaagaccgagaacaacgatcacataaatcttaaagttgccggccaggacggatccgtcgtccagtttaagataaagagacacactcccttgagcaagctgatgaaagcttactgtgagaggcaaggtctgtctatgcggcagattcgttttcgctttgacgggcagcccatcaacgaaacagacacccccgcacagctagagatggaagatgaggatactatcgatgtgttccagcagcagaccggaggagtctactag

SEQ ID NO: 51034 - DNA, 1257 bp, Artificial Sequence
  Description of Artificial Sequence: Synthetic coding sequence
atggccgccagcatgtgcgacgtgttcagcttctgcgtgggcgtggccggccgcgctagggtaagcgtcgaggtgcgcttcgtgagctctgccaaggggaagggtctattcgctactcagctgattagaaagggagaaacgatcttcgtggagaggcctctggtggcagctcaatttctctggaatgctttatacagatatcgggcatgcgaccactgcctgcgggctcttgaaaaagccgaggagaatgcgcagcgacttactggaaaacccggtcaggtcctccctcatccggaattatgcaccgtccggaaggatctccatcagaactgcccacattgccaggtgatgtactgtagtgccgagtgtagactagccgctacagagcagtatcaccaggtgctgtgccctggcccaagccaggacgatcccctccacccactgaacaaactacaagaggcgtggcggagcattcactatcccccagaaacagctagcatcatgctgatggcacgcatggttgctaccgtcaaacaagcaaaagacaaagacagatggatccgattgtttagccagttctgcaataagactgcgaatgaagaggaggagattgtgcacaaactcctgggggataagtttaaaggacaacttgaactattacggagactgtttacggaagccctttatgaggaggcagtatcccagtggtttactcccgatggttttcgctctctcttcgctttggttggtaccaacggacagggcatcgggacgtcttcactatcccagtgggtgcatgcctgtgatacccttgagctcaagcctcaggaccgggaacagctggacgccttcatcgaccagctctataaggatatcgaagcggcaaccggcgagttcctgaattgcgaggggagtggactatttgtactccaaagttgttgtaatcactcatgcgtgccaaacgccgagacctcctttccagagaataactttctgttgcacgtgaccgccctggaagacataaaacccggcgaagagatatgtattagttacctggactgctgccaacgtgagagatctagacatagccgccataagatacttcgcgagaattacctgttcgtgtgttcttgcccaaaatgtctggccgaagctgacgagcctaatgtcacttccgaggaagaggaagaggaagaagaggaggaggagggcgagcccgaagacgctgagcttggagatgagatgacggatgtgtag

SEQ ID NO: 51035 - DNA, 285 bp, Artificial Sequence
  Description of Artificial Sequence: Synthetic coding sequence
atggagcaggcccgggaccacctgcacctgcggtggaccaccgagcaacatatgccagaggtagaagttcaggttaaataccgcaccgctgccctcagcaatcaggagtgtcaattatacctgaggcacagtcagcagcagcaagtgctggttgtggactttcaggccaagctcaggcaggtgttcattactgaaacacctcggtgtggcaagaaaccttactggaataacgaggaggcagagagcaagcagaatcccgggtcaatctattgccttctgttgtag

SEQ ID NO: 51036 - DNA, 1128 bp, Artificial Sequence
  Description of Artificial Sequence: Synthetic coding sequence
atggccggcttcaacatgggcggcgacctgcgggagcccgccgcctcaattccgcccggcagtctggctgccgtgggcatcagctggtttctgtatattatatttgtcttcctgttaggcgcaatctgtacacgggaggccctacgctacgatttcctgatagcagaaaaggtctccctcatgggatttctgtttctgttgggcttatatatcagcagtttggccagctgcatgggaggtctatacggtgcgcctcgaattctacaatgcattgctcaagaaaaagtaatccctgctctcgcttgtctggggcagggcaaggggccgaataagactcctgtagcagctatctgcctcaccagccttgtgactatggctttcgtctttgttggccaggtgaacgtgctggctccaatcgtgactattaatttcatgctgacctacgtggcagtagactacagttactttagcttgtccatgtgcagctgtagcctgaccccagttccagagccagtgctcagggaaggcgcagaggggctgcattgctctgagcacctgttgcttgagaaagcccccagctacggatcagaaggtcccgcgcagagggtgctcgaggggaccctgctggagtttacgaaagatatggaccagctgctccagctcacacggaagctcgagtcttctcaaccaaggcagggtgagggtaatagaactcctgagtcgcagaagcgcaaatccaagaaagcaaccaaacaaacattacaggactccttcctgttggatctgaagagtcctcccagcttcccggtcgagatcagtgatcgattgcctgctgcttcttgggaaggccaggagtcgtgttggaacaagcaaacatcgaaaagcgaaggaacccaaccagagggcacctacggtgaacagctcgttcccgaactttgtaatcaaagcgaatcttcaggggagggggatctgagatccccccaggagcagattattcttgcgccttccctggcgaaggtggacatggagatgactcagctaactcaggaaaacgccgacttcgcaacacgtgataggtatcaccactcatccctggtgaaccgggagcagctgatgccgcattactag

SEQ ID NO: 51037 - DNA, 2232 bp, Artificial Sequence
  Description of Artificial Sequence: Synthetic coding sequence
atgctgcccctggagcggaccatcacctaccgggacatgagcagctttatccaagttaagaaccattttaacgtggttaacgtgacatgcgtgtcctataggtctacgtgttttcgagatatgagacgctttatactcgatgctcttgctcagccgcagccatggtggaaaactcagctgtttatgtgggaacccgtcctctttggaacctgggatggagtgtttacttcctgtatgattaatatctttggggtcgttttattcctccgaactggctggctcgtaggcaatacgggtgtgctcttgggtatgttcctggtgtccttcgtgatccttgtcgccctagtgacggtgctaagtggcatcggagtaggtgaaaggtctagtattgggagcgggggcgtctatagtatgatttcctcggtgttgggcggtcagaccggagggacgattgggctcttatacgtgtttggccagtgtgtagccggcgctatgtacatcaccggctttgccgagtcaatcagtgatctgttggggctcggcaatatttgggcagttcggggtatttccgtagccgtcctgctcgcgctactcggcatcaacctcgccggtgtcaaatggatcattagactgcagctccttctgttattcttattagcagtgtccaccctggacttcgtggtgggcagttttacacatcttgatccagaacatggctttatcggctattccccagagttattacagaataataccctgcctgactactcacccggcgaatccttctttacggtgttcggcgtgttctttcccgccgcaacaggagttatggccggctttaacatgggcggcgaccttagggaacccgccgcaagtatcccaccaggctcactcgcagctgtcggcatctcttggtttctgtatataattttcgtgtttctgctaggagccatttgcacaagggaggccctccggtatgactttcttatcgccgagaaggtgtcattgatgggattcctgttcttgttgggattatacatctcctcactggcttcctgcatgggaggcctgtacggcgcgccccggatactacagtgtatagcgcaggagaaggtgatccccgccctggcctgcttggggcagggcaaggggccaaacaagacccctgtggctgctatttgcctcacaagcctcgttacaatggccttcgttttcgtgggtcaagtaaacgtgctggcaccaatcgtgaccataaactttatgctgacctacgttgccgtagactactcttacttttcacttagcatgtgtagctgtagtttgacccccgtcccagaaccagttctccgggagggggctgaggggctccactgtagtgagcatctcttgttggagaaggcaccgtcttatgggagtgaggggcctgcccaacgagtgttggagggcaccttgctggagttcacgaaagatatggatcagttacttcaactcacacgcaaactggagtcctctcagccacgacagggcgagggaaaccgaacccctgaaagccaaaagaggaaaagtaaaaaagccaccaaacagactctccaagattctttcctgctggatctcaaaagccccccatcattccccgttgaaatctccgaccgactaccagccgctagctgggaaggccaagagtcctgctggaataagcagacgtctaagagcgaaggcacgcaacctgaggggacctatggcgagcagttggtccctgagctgtgcaaccagtccgaatcttcaggggaggactttttcctgaaaagccggctgcaggaacaggatgtgtggagaagaagtacctccttctacactcatatgtgcaacccatgggtctctcttctgggggctgtggggagcctactcattatgttcgttatccaatgggtctacacgttggtgaacatgggtgtggccgctatcgtgtacttttacatcggcagagcctcaccaggactacaccttggttcagcctccaatttctcatttttccggtggatgcggagcctcctgctcccctcctgtcgctctctaagatcaccgcaggaacagataattcttgcaccaagtctggctaaagtggatatggaaatgacacagctgactcaggagaacgcagattttgcaactcgagacagataccatcactctagtttagttaaccgtgaacagctgatgccgcactactag

SEQ ID NO: 51038 - DNA, 1548 bp, Artificial Sequence
  Description of Artificial Sequence: Synthetic coding sequence
atgcggcgggccgccgccggcggcctggccgtgggccagctgcccggggagggcccagcaggcgaggagggggccgctctggggaaggcaatgcgcggtggaggttgttcccctcattcaccttcaggatgcctgtccggcgtgatggccggctttaatatgggcggggacctgcgggaacccgcggcatccattccccccgggagtcttgcagcagtcggtatctcctggttcctgtacatcatctttgtgttcctgttaggagctatctgcacacgggaagcccttcgatatgatttcctgatcgctgaaaaggtgagcctgatgggatttctgttcctgcttggactctacattagctccctggcatcatgcatgggcggcctgtacggagcccctcgcattctgcagtgcatcgcacaggagaaagtcatacctgccctcgcctgtctgggccagggcaagggcccaaacaagacccctgtcgctgcaatctgtttgacgtccctggtgaccatggcgtttgtgtttgtaggacaagtgaacgttctcgccccgattgtgacaattaacttcatgctgacatatgttgcagtggactatagctacttctcgctctctatgtgctcttgcagcttaactcctgtccctgaacccgtgctcagggaaggcgccgagggactccactgttcagagcacctgctcctggagaaggctccctcctacggaagtgaaggacctgctcagcgcgtacttgagggaactctcctggagttcaccaaagatatggatcaactgcttcagttgaccagaaagctggaaagcagccaaccgagacagggggagggtaatagaacacctgagtcccagaaacgcaagagtaagaaagccacaaagcagacgttacaggattctttcctcttagacctcaagtctccccccagttttcctgtggagatctctgaccggctccctgccgctagctgggaaggccaggaatcttgttggaataaacagactagcaagtcagagggtacacagcccgaggggacatacggagaacaacttgtgcctgaactttgcaatcagtctgaaagtagtggggaggatttttttctcaaaagccgcctccaagagcaggatgtctggcgaaggtcgacaagtttctacacacatatgtgcaacccctgggtctctctgctgggcgctgttggatccttgctgataatgttcgtgattcagtgggtgtacaccctcgttaatatgggcgtggctgctatcgtatacttctacattgggcgtgcctcacctggcctacacttgggctcagcttccaacttttccttttttcgatggatgcgttctctgcttctgccaagctgtcgaagtcttaggtcacctcaagaacagataatcctcgcccctagcctggccaaggtagacatggagatgacccagttgacgcaggagaatgcagactttgctacaagagaccggtatcaccacagttctctcgtcaatagagagcagctaatgccccattactag

SEQ ID NO: 51039 - DNA, 723 bp, Artificial Sequence
  Description of Artificial Sequence: Synthetic coding sequence
atgcagaccacctacgtgctgcagagcctgcacctgcggatccccgagatctctaacattactactactccgcacacccttccggctgcctggttgaccatgttcgacgccgtacttatcttgctgctgatcccgctgaaagacaagttggttgaccctattctgcggaggcacgggctgctgcccagcagcctcaaacggattgccgttgggatgttctttgtcatgtgttcggcttttgcagcggggatactggagtcgaaacgccttaatttggttaaggagaagactattaatcagacaattggaaacgtcgtatatcatgcagctgacctcagtctatggtggcaggttccccagtatctgcttatcggaatctccgaaatttttgcaagcatcgcaggactagagtttgcatactctgccgctcccaagagcatgcagtcggctatcatgggtttgttttttttcttcagtggggttggctcctttgtgggctcaggactgctcgccctggtttcgatcaaggccataggctggatgtctagccacactgactttgggaatatcaacggatgttacctgaattactacttttttttactggctgcgatccagggcgctacattgttactcttcttgatcattagcgtcaagtacgaccatcatagagatcatcagcggtcacgtgctaacggcgtacccaccagccgacgcgcgtag

SEQ ID NO: 51040 - DNA, 1572 bp, Artificial Sequence
  Description of Artificial Sequence: Synthetic coding sequence
atgacccagaacaagctgaagctgtgcagcaaggccaacgtgtacacagaagtccccgatgggggctggggatgggccgtggctgtctcattctttttcgttgaggtcttcacttacggcatcatcaaaaccttcggcgtgttttttaatgatctgatggatagctttaacgagagtaactctcgaatttcttggattattagcatatgtgtattcgtgctgacattttcagctccactggccaccgttctctccaaccgctttggccacaggctggtggttatgctcggtggcctgctagtgagtacgggaatggttgccgcctcgttcagtcaggaggtaagccacatgtatgtggccataggcatcatatcaggtttaggctactgtttttctttcctgcccaccgtgacaattctaagccagtacttcgggaaacggcgctccatcgtcaccgccgtggcatctacgggggagtgctttgctgtgttcgcgtttgctcctgctatcatggctctcaaagagaggatcggttggcgttattcgttgctcttcgttggcctgctgcaactcaacatagtcatttttggcgcactgctgcgtcctatctttattagagggccagctagccccaaaatcgtgatccaggagaatcgcaaagaggctcaatacatgctggagaacgagaaaacgagaacctcgatcgactcaatagatagcggagtggagctaaccacatcacctaaaaacgtcccgactcacactaatcttgagctggaacctaaagccgatatgcagcaggtactggtcaagacctcccccagacctagcgagaagaaagccccgcttctcgatttctctattttaaaagagaagtccttcatttgctatgccctttttggcctctttgccaccctgggcttcttcgcgccgtccctgtatattatccctctgggcatcagcctgggcattgatcaggacagagctgccttcttgttgtctaccatggccatcgctgaagtgttcgggcgcatcggggccggcttcgtgttaaacagggagccaatccggaagatttatatcgagctcatatgcgtcattctgttgaccgtctcattattcgcattcactttcgctaccgaattttgggggctcatgagttgtagtatcttcttcggttttatggtgggcactattggaggcactcatatcccgctcctggctgaagatgacgttgttggcatcgaaaaaatgtcaagcgcggctggggtttacatcttcatccagagcattgctgggctggccggccccccactggcaggcctgctcgttgatcagagcaaaatctattctcgcgccttctacagctgcgctgccggaatggccctagctgcagtatgcctggcattggtcaggccttgcaagatggggttgtgccagcaccaccattctggcgagacgaaggtggtttcccatcgtgggaaaaccctgcaagacattccagaggattttttggagatggatctagcgaagaacgaacacagagttcacgtccaaatggaacctgtgtag

SEQ ID NO: 51041 - DNA, 453 bp, Artificial Sequence
  Description of Artificial Sequence: Synthetic coding sequence
atgcggtgcgccgagggcgcctggtggttcagccccgacggccccgctgggtcagctgcctctatttggcctgctgaaggcgcagagggtcttccaggccaactaggcagagacaggctagaggttgtctattccgtgccggataacgttcccggacagaacggatctcgcagaccgctagtctgtaaaatcaccggcaagtgtctgagcgtatgctcagaagagaacgctaaggcaggcgggtgcagtgcctttcccctgctgctttcccagctgggtgcccggatgacaggccgggaacacgctcacaaggggccagaactgaccaccccagacagtggccttccacggcccccaaaccctgcattggcaggattcagagcgctcgcccagcactctcctcccctgggcacttccaccccttctgctgtccttctatcagcggccacctag

SEQ ID NO: 51042 - DNA, 453 bp, Artificial Sequence
  Description of Artificial Sequence: Synthetic coding sequence
atgcggtgcgccgagggcgcctggtggttcagccccgacggccccgccggctcagctgcctctatttggcccgcagaaggggctgagggattgcctggccaactcgggcgggacagattggaagtggtctattctgtgcctgacaacgtacccgggcagaacggatctagaagacctcttgtttgtaaaattacagggaagtgcctgtcagtgtgcagtgaggaaaatgccaaggcaggtggttgttcagccttccccctgctgctgtcccaactgggtgccagaatgactggccgagaacatgctcataaggggcccgagctcacaacaccggactctggtctgccccgccctcctaatcctgccctggcaggttttcgcgccctggcccagcactctccacctcttggcacaagtacccccagtgccgttctcctctcagctgctacatag

SEQ ID NO: 51043 - DNA, 762 bp, Artificial Sequence
  Description of Artificial Sequence: Synthetic coding sequence
atgggcgagctgcccggcagcgagggcatgtgggagaactgccccttgggatgggtgaagaaaaaggctagtggcacgctcgctcccttagactttctcctgcagaggaagcgactgtggctctgggcgagcgaaccagtgaggccgcagccccaaggtattcatagattccgggaagctaggcggcagttctgcaggatgaggggttcgcgcctgacgggggggaggaaggggtttgggagctccgggctcagattcgggcggggtgggttctctgaggaagtcatgccacagccagtcttaaaggcgatgaggtgtgctgaaggtgcctggtggttctctccggatggtccggcaggaagcgcggccagcatctggccagctgagggagctgaagggctgcctggccagctgggacgagaccggttagaggtcgtgtattccgtgccagacaacgtcccaggccaaaatggttcaagacggcccctggtctgcaaaataacagggaagtgtttgtctgtgtgctctgaggagaacgcgaaggcaggaggctgctctgcctttcccctgctgctgagtcaactcggggcccggatgacggggcgcgagcacgcccacaagggacccgagctaacaactcccgattcaggactcccaaggcctccaaatccagccttagccggctttcgtgccctggctcagcatagcccccccctgggtacttcgacaccttctgcggtgctgttgagtgccgccacctag

SEQ ID NO: 51044 - DNA, 825 bp, Artificial Sequence
  Description of Artificial Sequence: Synthetic coding sequence
atggaccggcccggcttcgtggccgccctggtggccggcggcgtggcgggtgtgagcgttgatctgatactgtttccactggacacaataaagactcgactgcagagcccccaggggttctccaaggcaggggggtttcatgggatctacgcgggagtgccgtctgccgctatcggtagcttcccgaacgccgcagccttcttcattacatatgagtatgtaaagtggttcctgcacgcagatagttcaagctacctcaccccaatgaagcacatgcttgccgcttcagccggcgaggttgttgcatgtctgataagggttccatccgaggtggtgaagcagcgtgctcaagtcagtgcctcaacccgcacattccaaatcttctcaaacatcctgtacgaggagggcatccagggactgtacaggggatacaagtccaccgtgctcagggagatacctttttcgctggtgcagtttcctctctgggaatccctgaaggcactgtggagctggcggcaggaccatgtcgtcgacagctggcagtcggccgtgtgtggtgcgttcgctgggggtttcgctgctgcagtgactaccccactggatgtggccaaaactaggatcactctggccaaagcaggttccagtacagcagacggaaatgtactgtccgtccttcatggcgtgtggcgtagccaaggcctggcaggacttttcgccggcgtgtttccacgcatggcagcaattagtctgggcggcttcatcttccttggggcatacgaccggacacactctctacttctggaggtggggaggaaatccccatag

SEQ ID NO: 51045 - DNA, 927 bp, Artificial Sequence
  Description of Artificial Sequence: Synthetic coding sequence
ctgctggtggccctgctgggcggcggcctgcccgccggcttcgtggggcccctgtcacgaatggcataccaggcaagtaatcttccaagtctcgagctggttatttgcagatgcctctttcacctgcctatagcattgctcctcaaactgaggggtgacccactcctcggtccccctgatatccgcggcaggacctgtttctgcgccctgctgaatgtgctgaacatcggctgcgcatactccgctgtccaggtcgtgccgacagggaacgcggccacagtccgaaagcattcaagcactgtctgctccgccatattaacgctttgtctggagtcccaggttctttccggctatgattggtgtggactcctcgggtccattcttggcctgattattattgtgggcccagggctctggacattgcaggaaggcaccactggtgtatatacaggcctcggctatgtccaggcttttttagggggcctcgcgttaagcctgggcctgctggtgtacagatctctacacttcccgtcctgcctgccaaccgtggcctttctgtccggtctagtcggattattaggctctgtgcccgggctctttgtgctgcagagccctgttctcccatctgatctgttaagctggtcttgtgtcggcgctgtggggatcctgactttggtctctttcacttgcgttgggtacgctgttaccaaagcccatccggctttggtatgcgccgtcctccatagtgaggtggtcatggccttgattctgcagtacttcatgctccacgaaaccgtcgctccaagtgatataatgggcgctggcgtagtgctggggtcgattgctattatcaccgctagaaacctaatctgcgaacgtacaggcaaggtggaagagcagagactgaagacaaagaaaaagaagtag

SEQ ID NO: 51046 - DNA, 1017 bp, Artificial Sequence
  Description of Artificial Sequence: Synthetic coding sequence
atggccggcagccacccctacctgaacccccccgacagcacccacccaagccctcctagcgcaccacctagcctgaggtggcaccaatgttgtcagccgtcggacgcaaccaatggcctgctcgtggccttgctgggggggggacttcccgccgggtttgtgggaccgctcagtcacatggcatatcaagcatcaaatctacccagcttggaactcctgatctgcagatgtctttttcaccttcccatagcgctcttgctcaagctacgtggcgaccccctgcttggcccccctgatataagggggagggcttatttctatgcgctgctcaatgtgttgagcattggttgtgcctactctgccgtgcaggtggtgcctgcaggcaacgcagccacagtgcgcaagggctcgtcaacggtgtgcagcgcggtattgaccctttgcctcgagtcccaagggctgagcggctacgactggtgcggcttgctgggttcaatcctggggctgatcattatcgtcggtccagggctgtggacactgcaggagggaatcacaggagtctacacggctttaggatacggacaagctttcgtcgggggcctcgccttgtctttgggattgctggtttacaggagtctgcatttcccatcttgtctgcctacagtggcctttctgtctggcctcgtcggactgctgggaagtgtaccaggcctcttcgtcctgcagccgccagtgctaccttcggacctcccatcatggtcttgcgtcggcgctgtagggattctcgcactcgttagcttcacctgcgttagttacgccgtgacaaaagcacacccggccttggtttgcgccgtgctccactcagaagttgtagtcgccctgatcctgcagtattacatgttacacgaaacagtggccccctccgatatcgtgggtgctggcgtggtgctgggttcaatcgcaataatcacagcgtggaatctctcatgtgagcgcgaaggcaaagtggaagaatag

SEQ ID NO: 51047 - DNA, 1308 bp, Artificial Sequence
  Description of Artificial Sequence: Synthetic coding sequence
atggagggccagacccccggcagccggggcctgcccgagaagccccatcccgccacggcggcagcaacactcagctctatgggagccgtttttatcttaatgaagagtgcccttggggccggcctgctgaattttccctgggcgtttagtaaagcgggaggcgtggtgccagcatttcttgtcgaactggtatcccttgtgttcttaattagcggcctggtgattcttggttacgctgctgccgtctcaggacaggctacgtaccaaggcgttgtgagggggctgtgcggccccgctattggcaagctttgcgaggcttgctttctcttaaacctgttgatgatttcggtggcgtttctcagggtaattggggatcagctcgagaagctttgtgattccctactctccggcacgccacccgccccccagccctggtatgccgatcaaaggtttaccctgcctcttctctcagtactagtgattttgccacttagtgccccacgcgaaattgctttccaaaagtacacatccatcctcgggacccttgctgcatgctatttggccctggtcatcactgtccaatactatctgtggcctcagggattggtgcgcgaatcgcatccgagtctctcaccagcttcttggacaagcgtttttagcgtgttcccaaccatatgcttcggtttccagtgccacgaagcagctgtgagcatatactgcagtatgcgaaagcggtcattatcacattgggctctcgttagcgttctgagtctgcttgcctgttgtttaatttattctttaacgggcgtttatgggtttctgaccttcggcacagaagtctctgctgacgtcctgatgtcatatcccggaaatgatatggtaattattgttgcacgggtcctattcgcagtatctatcgttacggtgtatccgattgtgctgtttctgggccgaagcgttatgcaggatttttggaggcggagttgcctcggtggttgggggccatccgcacttgccgatccatccggactgtgggttcgcatgccgttaacaatcctatgggtgacagtaacgctggccatggcactgttcatgccagatctgtccgagattgtgtctatcataggcggcatcagctcattctttattttcatttttccgggtctgtgcctgatttgcgccatgggtgttgagcctataggacctagggtgaaatgctgtctggaagtatggggagttgtaagtgtgctcgttgggacatttatcttcggccaatctaccgccgccgctgtttgggagatgttctag

SEQ ID NO: 51048 - DNA, 2397 bp, Artificial Sequence
  Description of Artificial Sequence: Synthetic coding sequence
atgggcaaggccagccccgccagcggcctgagccggcccaagaccttggtgtctccactgaggtcaaatcagtggagtctgcaaaagggtcttcctgaacagtattacagtctaacatggttcttgtcacctatcctaggtcttattttcaccccactcatcggatccgcctcggacagatgtacactctcctggggtcggaggagaccgtttatactcgccctttgcgtgggtgttctcttcggagtcgccttgtttctcaatggcagtgccattggacttgcccttggtgatgtgcccaacaggcagcccatcgggatagtgcttaccgtgctgggagtagtcgttttggatttcagcgctgatgccacggaaggccctatccgcgcctacctactggacgtggttgatagcgaagagcaggacatggccctgaacattcatgcattcagcgccggcctgggcggcgctatcggctacgtgctgggcggcctggattggacccaaaccttcctcggtagctggtttcgcacccaaaatcaggtattgtttttctttgcagccatcatatttaccgtgtccgtcgctctccatttgttcagcatcgatgaagagcagtattctccgcagcaggagagaagtgcagaggagcccggcgcactcgacggcggggaaccccacggcgtgcccgccttcccggatgaagttcagtccgaacatgaactggccctggactacccggacgtcgacatcatgcggtccaaatcggacagtgccctgcatgtgcccgatacagccctggatctggaacctgagcttttgtttctgcatgacattgaaccatcaatcttccatgatgctagctaccccgccacgcccaggagcacctctcaagagttggccaaaaccaagctgccacggctggcaactttcctgaaggaagcagctaaggaggacgagacactgttagataatcatctcaatgaggcaaaggtgcccaatggtagtggttccccaaccaaggatgcactgggggggtacacacgggtggacactaaaccttcagccacttcatcctcaatgaggaggaggcgacatgccttccgacgacaggcctctagtactttcagttattacggtaagctgggcagtcactgctataggtataggagagctaacgccgtcgtccttatcaaacccagtcgatcaatgagcgacctttacgacatgcaaaagcgccaacggcagcaccgtcacaggaatcagagtggcgccaccacaagctctggagacacggaatccgaggaaggtgagggagagactaccgtaaggcttttgtggcttagtatgctcaaaatgccaagagagctcatgcgactgtgtctgtgtcaccttctcacctggttttccgtaatcgccgaagctgtcttctataccgacttcatgggtcaggtcatcttcgaaggcgatcccaaggctccttcaaacagcaccgcttggcaggcatacaatgccggggtaaagatgggttgttggggactcgtgatctatgctgccacaggtgccatttgtagcgcattgctccaaaagtatttggacaattatgacttgagtgtacgagtcatctatgttctggggactctgggattctctgtaggcactgcggtgatggcgatgttccctaacgtttacgtggcgatggttacaatttccacgatgggcatcgtgtctatgtcaataagttattgcccttatgcccttcttggccagtatcacgatattaaacagtacatacatcacagccctgggaacagcaaaagggggttcgggatagactgtgcaattctgagttgccaggtatatatatcccagatcctggttgcatctgcactaggaggtgtcgtcgatgcggttgggacggtgagggttatccccatggtcgcgtcggttggctcttttctgggctttctcacagctacttttctagtgatttatcctaacgtgtctgaagaagctaaagaggagcagaagggacttagttctcccctcgcgggcgaaggtcgcgctggtggtaactcggagaaacccacagttttaaagctgacgcggaaggaagggcttcagggacccgtggaaaccgagcggctgcaggtgctgacctccgtccgttctaggcacataggctggtgtcggagctgctggagagtcttcttttttatgatcatcctggagaaaaagttcagcttcccgcagtgtggctcactgagaagaatgacatacctgctcttcttgtcagagctggatactctctgtcctggtcagccctgtccctgggctgcgactgcacatcagagttgggaagaggccggaccgggtgggctgggccgacgccagtag

SEQ ID NO: 51049 - DNA, 2253 bp, Artificial Sequence
  Description of Artificial Sequence: Synthetic coding sequence
atgttcggccgggagttctgctacgccatggagaccgccctggtgacgcccatcctgttgcagatcggcctccctgagcagtactattctctgacgtggtttctgagtccaatcctggggcttatatttaccccactaatcggcagcgctagtgaccggtgcactctgtcttggggccgtagaaggccctttattctcgcactgtgcgtgggagtattgttcggagttgctcttttccttaacggctcagcaattgggttggcccttggcgacgttccgaacaggcaaccgattggaattgtcctgacggtgctcggagtcgtggtgctagatttctccgcagacgcaaccgaggggcccatcagggcctacctgctagacgtggtagatagcgaagaacaggatatggccctcaatatccatgcatttagtgcaggactcggaggcgccataggctatgtgttgggcggtctggattggacacagaccttcctcggaagctggtttcgtacccagaatcaggtgctcttctttttcgcagcaattatctttaccgtatccgtcgctctgcatctctttagcatcgatgaggagcagtacagcccccagcaggagcggtccgccgaagagcctggtgcactggatgggggagagccgcatggggtccctgcgttccccgacgaagtccagtctgagcatgagctggcactcgactacccggacgttgatataatgagatctaagtccgatagcgcactgcatgtcccagacaccgctctcgacctagaacctgagctcctatttctccatgacatcgaaccatctatcttccacgacgcatcctatccggcaaccccaaggtccacctcacaggagctcgcaaaaacaaaactacctagattagccaccttcctgaaggaggcagccaaagaagacgaaacattgcttgacaatcatctgaatgaggcaaaggtgcccaacggaagcggctccccaactaaagacgcgctgggtgggtacacccgggttgataccaagccatctgcaacatcctccagcatgaggagaaggaggcatgccttcaggcggcaggcaagctccacattttcttattacgggaagctcggaagccattgctaccgatatagacgagccaacgccgtggtgctgatcaaaccatcacgttccatgagcgatctttacgacatgcagaaacggcagagacagcatcgtcataggaaccagtcgggtgcaactaccagctcaggcgacactgagtccgaggagggcgaaggggagactaccgtgcgcctgctgtggttaagcatgttaaagatgcctagagaactcatgagactgtgcctctgtcatcttctcacttggttctccgtgatcgcggaggccgtcttctacaccgatttcatggggcaagttatattcgagggagatcccaaggcacccagtaactcaacagcgtggcaggcctataacgcaggcgttaagatgggatgttggggtctggtgatctacgccgcaaccggggcaatctgcagcgccctgctgcagaagtaccttgacaattacgatctcagtgtaagagtgatttacgtcctgggtacactggggttcagcgttgggactgccgtcatggcaatgtttccgaacgtatacgtggccatggtgaccataagtacaatgggtatcgtctccatgagcattagttactgcccatacgctctcctgggccagtatcatgacattaagcagtatattcaccacagcccaggtaactcaaagaggggcttcgggatcgattgcgctatactgagctgccaggtgtacatctcgcagattctggtggctagcgcactgggcggtgtggtcgatgccgtgggcaccgtacgcgtgatccccatggtcgctagcgttggctcttttttaggatttctcactgctacattcctcgttatctatcccaacgtgtcagaagaagctaaagaggagcaaaaaggtctgagttccccgcttgctggggagggaagggcaggaggtaacagcgagaagcctacagtcttgaaattgacccggaaagaggggttgcaaggccccgttgaaactgaatccgtcaccccagccggcatcgatgtttgccaaatatcgagccattggttggtgccccagttacttgagtcgatttttttgtatgactactttaggaaaaaaatctttttcagcacaatgtggtttagctag

SEQ ID NO: 51050 - DNA, 2427 bp, Artificial Sequence
  Description of Artificial Sequence: Synthetic coding sequence
atgaagatggccccccagaacgccgaccccgagagcatgcaggtgcaggaacttagcgttccactgcctgacccacagaaagctggcggggccgaagccgagaactgcgaaaccattagtgaggggagcatcgaccgcatacctatgagactgtgggtcatgcacggcgcagtcatgttcggaagggagttttgttatgccatggaaaccgccctggtgacccccattttactgcagattggtctgcctgagcaatattactccttgacatggtttctatcccccatactgggattaatcttcactcccctgattggcagcgcgtccgatcgctgcaccctctcatggggcagacggagaccttttatactcgctttgtgcgtgggcgtgttgttcggggtcgctcttttcctgaatggcagcgcaatcggattggctctgggagacgtcccaaatagacagcccatcgggatcgtcctcaccgtgctgggcgttgtggtactggactttagtgccgatgccacagaggggccaataagggcctatcttctggacgtggttgacagcgaggagcaagatatggcgctcaatattcacgcctttagtgctggtctcgggggagccatcggctatgttttaggagggctcgactggacgcaaaccttcctgggatcatggtttcgaactcagaaccaggtgctgttcttcttcgctgctatcatctttaccgtgtccgtggcccttcatttattcagtatcgacgaggaacagtactcccctcaacaagaacgatctgccgaagagcctggcgctttggatggaggagaacctcatggcgtgccagccttcccggatgaagtgcaaagcgaacatgaactcgctctggactacccagatgtcgacatcatgaggagtaagtctgactccgctctgcatgtaccagacacggctctggacctggaacctgaactgctgttccttcacgatattgagccctccatctttcatgacgcttcttaccctgccactcctcgctcgacctctcaggagctcgccaaaaccaaactcccccggctcgccacattcctgaaagaagcagctaaggaggacgaaaccctgctggataatcatttaaacgaggctaaggtgcccaacgggagtggctcgccaacaaaagacgcgctcggcggttatacgagggtagataccaaaccaagcgccacatcctccagcatgaggaggcgccgccatgctttcaggcggcaggcttcatcaacattctcctattatggtaagctgggtagtcattgttacaggtataggcgtgcaaatgccgtggtgcttattaaaccttcacggagcatgtccgacctttacgatatgcagaagaggcagcgacagcatcgccaccgcaaccagagtggcgcaactaccagcagcggagataccgaaagtgaggagggagagggggagaccaccgtgcgtcttctgtggctctcaatgctgaaaatgcccagggagcttatgaggctgtgcctgtgtcatctactgacgtggttctccgtcattgctgaggctgtcttttacacagacttcatgggtcaggttatttttgaaggggaccctaaggccccttcaaatagcacagcatggcaggcctataatgctggcgtgaaaatgggatgttggggactcgtgatctatgcagccacaggtgcaatctgcagcgcactgctacagaagtatctggacaattacgacctgtccgtacgggtgatatacgtactcggcactctggggttctctgtcggcacagccgtcatggctatgtttcccaacgtctacgttgcgatggtcacaatctcgaccatgggcattgtgtcaatgagcatcagttattgcccatatgctctccttggccagtaccacgatatcaaacagtatatccaccacagcccgggtaacagcaagagagggttcggcattgactgtgccattctctcatgtcaggtgtacattagccagattctggttgcatccgcactggggggcgtcgtggacgctgtgggaacagttcgcgttatacccatggttgccagcgtaggatccttcctggggtttctaactgccaccttcctggttatctacccaaatgtatcggaagaggccaaggaagaacagaagggcctttctagtcctctggctggggaagggagagctggagggaactcagagaaacctacggttttaaagctgaccaggaaagaaggccttcaggggccggtggagacagaaagcgttacccccgctggcatcgatgtgtgtcaaataagcagtcactggcttgtcccacaactccttgaaagcatattcctatacgattatttccgaaagaaaatttttttcagtaccatgtggttcagttag

SEQ ID NO: 51051 - DNA, 2154 bp, Artificial Sequence
  Description of Artificial Sequence: Synthetic coding sequence
atgggcaaggccagccccgccagcggcctgagccggcccaagacccttgtatcccctctacggtcgaatcagtggtcactccagaaaggtctcccggaacagtactattccctgacatggttcctatctcctattttgggcttgattttcaccccactgataggatctgcaagcgacagatgcactctgtcatggggtagaagacgcccttttatactggccctctgcgtaggagtcctgtttggggttgcgctgttcctgaatggctctgctatcgggttggccctgggcgacgtgcccaacaggcagcctatcgggattgtgctgacagtgcttggggtggtagtcctcgattttagtgcagacgccactgagggcccaattcgagcctacttgctggatgttgtggatagcgaggagcaggatatggccttgaatatccacgccttctccgctggcctgggaggggctattggctacgtcctggggggcctagactggactcagacatttctggggagttggtttcggacgcagaaccaggtcctgttcttctttgctgccatcatcttcacagtgtctgtggcgctgcaccttttctccattgatgaagagcagtattctccccagcaggagagaagtgctgaggagcccggtgcactcgatggaggtgagccgcacggtgttccggccttcccagatgaggtccaatcagaacacgaactggcactggactatccagatgttgatattatgcgcagtaaatccgattccgctctccacgtgcccgatacagctttggacctggagcctgagcttttattcctgcacgacatcgagccttcgatttttcacgacgcctcttaccccgctactccccggtccacctcccaggagctggctaaaacaaaattacctcggttggctaccttcttaaaagaagcagctaaagaagatgaaactctgttggataatcatctgaacgaggccaaggttccaaacggatccggaagccccactaaggatgcactgggcggttataccagagtagacaccaaacccagcgctaccagtagttcgatgcgaagacgaaggcacgcctttaggcggcaggcctcgagtactttttcgtattatggcaagcttggctctcactgctatagatacaggagagccaatgccgtcgtactgatcaagccctcccgctcaatgtccgacctgtatgatatgcagaaacgtcagagacagcaccgccatagaaatcagtcaggtgcaactacgtcctctggtgacacagaatctgaagaaggcgagggagagacaacggttcggcttctatggctgagcatgctaaagatgcctagagagctcatgagactgtgtctgtgtcatcttcttacatggttttccgtaatcgccgaagcggtgttttatacagatttcatggggcaggttatattcgagggcgatcctaaagccccttctaacagcacagcctggcaagcctacaacgctggggtgaaaatgggctgctgggggctggtgatttatgccgccacgggagcaatctgctctgccctgctgcagaaatatctggataattatgacttgtcagtcagagttatttacgtgctaggtacattgggtttctcagtgggcaccgcggtgatggccatgttcccaaatgtgtacgtcgcaatggtgactataagcactatggggatcgtgtcaatgtccattagctactgcccctatgccctgcttgggcagtaccacgatattaagcaatatatccatcatagtccaggaaattcaaagcggggttttggtatagattgcgccatccttagctgtcaagtgtacatctctcaaatcctagtagcttctgccctcggcggggtggtggatgccgtgggcacggtgcgtgttattccaatggtggcgtccgtcggtagtttcttaggcttccttacggctacttttctggtcatttacccaaatgtgagtgaggaagccaaagaagagcaaaagggcttgtccagccctttagccggcgaaggacgcgccggcggcaacagcgaaaagcctaccgtcctcaaactgacccggaaggaaggcttacaaggaccggtcgaaacagagtcagtggtgtag

SEQ ID NO: 51052 - DNA, 1338 bp, Artificial Sequence
  Description of Artificial Sequence: Synthetic coding sequence
atggccgcccccacccccgcccggcccgtgctgacccacctgctggtcgcactcttcggcatgggttcctgggcagcggtaaatggaatctgggttgagcttcctgtcgtcgtgaaagagttgccagaaggctggagccttccctcctacgtctctgtactggttgccctcggcaacctcggactgctggttgtcaccctctggaggcggctggcacctggaaaagacgaacaagtgcccattcgcgttgtgcaagttcttggtatggtgggtactgcgctattagcctcgctgtggcaccacgtcgctcccgtggcaggccagctccactctgtcgcttttctagcactggcattcgtcctggcactggcttgctgcgcttctaatgtgaccttcttgcccttcctgagtcacctgcccccacgtttcttgcggagtttctttttgggtcaaggactgtcagctctgttaccctgtgtgctggccctcgttcaaggggtaggacggctggagtgccctcccgcaccaattaacggcacaccagggcctcctttggactttctggagcggttccctgcttccactttcttttgggctctgacagctctgctagttgctagcgcggctgcattccaaggacttcttctgctcttgccaccacctcctagcgtgcccaccggagaacttgggtcaggcctgcaggtgggtgcccccggagcggaagaagaagtggaggaatcctcccccctccaggagccgccatctcaggccgccgggactactcccggaccagatcccaaagcttatcaactactgagcgctcggtccgcttgcttgctcggattgctggcagcaaccaacgccctaaccaacggagtgttaccagcggttcagtctttttcatgcctcccgtacggcaggttggcataccacctggctgtggtccttggctctgccgccaatcccctggcctgctttctggccatgggcgtcttgtgccgctccctggccggcctgggaggcttgagcctcctgggcgtcttctgcggcggatatttaatggcccttgccgtactgtcaccatgcccaccgttggtgggaacctctgccggtgtggtgctggtcgttctcagttgggttctgtgcttgggtgtgttctcttatgtcaaagtggccgcatctagcctacttcatggcgggggcagacctgcgctgcttgcagcgggcgtggcgatccaggtcggatctcttctgggcgctgtggcaatgtttcctccaaccagtatctatcacgtgttccactctcgaaaggattgcgcagacccatgtgactcatag

SEQ ID NO: 51053 - DNA, 1338 bp, Artificial Sequence
  Description of Artificial Sequence: Synthetic coding sequence
atggccgcccccacccccgcccggcccgtgctgacccacctgctggtcgcacttttcggcatggggtcctgggcagctgttaatgggatttgggtggagctgcccgtggtcgtgaaagagctgccagaaggatggtcccttccttcctacgtcagcgtgcttgtagccctaggaaatttagggttgctagtggtaacactctggcgccgattggcaccaggcaaggacgagcaggtgccgattcgtgtcgttcaggtgctgggaatggtgggcaccgcactgttggcgtccctctggcatcacgtcgcgcctgttgccggacagcttcactccgtggctttcctcgccctcgcattcgtactggctcttgcctgttgtgcaagcaacgtcacgtttctcccttttcttagccacctcccacctagatttttgcgcagttttttcctaggacaaggcctttccgccttgctgccttgcgtgctcgccctcgtgcagggagttggccgtttggagtgtcccccggctcccataaacgggacacctggcccccctttggatttcctggaacggtttcccgcctctacgtttttctgggcacttactgctctcctcgtggcttcagccgccgcattccaagggctgctgcttctgctcccacctccaccttccgttccaaccggggaattgggaagcggcctccaggtgggggccccaggggcagaagaggaggtggaggagtccagccctctgcaggaacccccttctcaggcggccggcaccacacccggtcctgacccgaaagcttatcagttgctttcggccaggtccgcctgtctgctaggcctgcttgcagcgaccaacgctctgactaacggggtgctgcccgctgtgcagtccttctcctgtctcccgtacggacgcctagcataccacctcgccgtggtgctgggctcagctgcaaacccactggcctgtttcttagctatgggggtcttatgtcgcagcctggccggacttggcggcttgtcactcttaggtgttttctgcggcgggtatttgatggctctggccgtcctgagcccttgtccaccattggtggggacttccgcgggggtcgttctggtcgtgctctcatgggttctctgcctaggggtcttttcctacgtcaaggtcgccgcctctagcctcctgcacggcggcggccggcctgcactgctagctgccggagtggccattcaggtagggtcactcctcggcgccgtcgccatgtttccccctacgagcatctaccacgtgttccactctaggaaggactgcgccgatccttgcgatagctag

SEQ ID NO: 51054 - DNA, 1338 bp, Artificial Sequence
  Description of Artificial Sequence: Synthetic coding sequence
atggccgcccccacccccgcccggcccgtgctgacccacctgctggtagctctcttcggtatgggcagctgggccgccgtgaatggcatatgggtggaactccctgtggtagtgaaggagctgcctgagggctggagcctgccatcctatgtaagcgtgctggtggcattgggaaacctagggctgttagtcgtcactctctggaggaggctcgctccagggaaggatgagcaagttccaattagagtcgtgcaagtgctgggcatggtcggaactgccttgctggcctctctctggcatcacgtggcacccgtcgccggccaactccatagcgtagctttcttggctctggctttcgtgctagcgcttgcctgttgtgctagcaacgtgacgttcctacctttcttatctcacttgcccccacggtttctgaggtcatttttcttggggcagggactcagcgcattactcccctgcgttctagctctggttcagggagttgggcgattagagtgtccacccgcccctattaacggaactccaggcccccccctagatttcctagagaggtttccagcctccacctttttttgggctctaaccgccctgctggtggcctctgccgccgcttttcagggtctgcttctactgcttcctccccctccatctgtgcctaccggagaattgggttcaggattgcaggtgggggctcctggggccgaggaggaagtggaggagtcatctccactgcaagagccaccaagccaggctgcgggcaccacaccgggtcctgaccctaaagcctatcagctcctgagcgctcgttccgcatgtttactgggcctgctcgccgccaccaatgccttgaccaatggggtacttccagctgtacagagcttctcatgccttccctacggaagattggcctatcatctggctgtggtgctcggatccgccgctaatcccctagcatgttttctcgctatgggcgtattgtgtagaagcctcgctggcctcggcggactgagtctgctcggggtgttctgcggcggctacctcatggcccttgccgtgttgagcccttgtccccccctagttgggacgagcgctggcgtcgtgttggtggtgctgtcatgggtgctctgtctcggcgtcttcagttatgttaaggtggccgccagctccctgctgcacggcggtggacggccagctctactggctgcaggagtagccatccaggttgggagcctgcttggggcagtagcaatgtttcctccaactagcatttaccacgttttccacagtaggaaggattgcgccgatccttgtgattcctag

SEQ ID NO: 51055 - DNA, 1923 bp, Artificial Sequence
  Description of Artificial Sequence: Synthetic coding sequence
atgaagatcagcaccacccagatcgagcggcggttcgagatcagcagcagtcttgtgggtttgatagacggctcttttgaaattgggaatttgttcgtaatcgtctttgtcagctattttggctctaagctgcatcgcccaaagctgattggaatcggatgcttcctgatgggcaccggctcgattctgatggctctgccacacttcttcatgggctattacaggtacagcaaagaaacaaacatcgatccaagtgaaaattcgactagcaatctgcccaactgcctaattaaccagatgctgagcctcaatagaactccctccgagatcattgagcgcggctgtgtcaaagagagcgggtcccatatgtggatctatgtatttatgggaaatatgctccgtggcatcggggagactccaatagtgccgcttggcatctcttatattgatgacttcgctaaggagggtcacagtagcctgtatctgggcacagtgaacgtgatgggcatgacaggtctcgtcttcgcctttatgcttggctcattgttcgcgaaaatgtatgtggacatcggatacgtggatctctctactattcgaatcactcctaaagattccagatgggtcggcgcatggtggctgggattcttagtatccgggattgtgagcattatatcttcaatcccgttcttctttctcccactgaacccaaacaagcctcaaaaggaaagaaaagtcagcttgtttctgcatgtgctgaagaccaatgataaaaggaatcagatcgcgaatctaactaataggcgtaaatatatcactaagaatgttacgggtttcttccagtccctgaagtccatcctgaccaacccactctacgtcatcttcgtcatcttcaccttactgcatatgagcagctacatcgccagtctgacatacatcatcaagatggtggaacaacagtatggttggagcgcatcaaaaactaacttcctcctgggcgttctcgctctgcctgccgtggcaattggaatgtttagcggaggctacataatcaagaagttcaagctttccctggtcggtctcgctaaactggccttctgctccgctacagtgcaccttctgtctcaggtgctgtatttttttttgatctgcgagtccaagagtgtggcaggcctcactttaacttacgatgggaattcccctgtcagatcccacgtcgatgttccactgtcctattgcaatagtgagtgcaactgtgacgaatcacagtgggaaccagtgtgcggaaacaacggtatcacatatctgagcccctgtctggccgggtgcaaatccagctctggcaataaggagcctattgtgttttataactgctcttgtgtcgaggttataggcctgcagaataagaattacagtgcacacctgggcgaatgccctcgggatgacgcctgtacaagaaaatcttacgtttactttgtaatccaggtactggatgctttcctctgcgccgtcggactgacctcttattcggtgctggtgataaggatagtccaacctgagctgaaggcgctggccattggattccacagcatgattatgcggtcacttggcggaatcttagtgccaatatactttggtgctttgatcgacactacttgcatgaaatggtccactaattcctgcggggctcgtggggcgtgtcgaatttacaattcaacctatttgggtagggcattttttggacttaaagtggccctcatatttcctgtgctggtgctgctgacagtgttcatctttgtcgtcaggaagaaaagccatggtaaagataccaaggttctggagaacgagagacaggttatggatgaagctaatctggagttcctaaatgacagtgaacatttcgtcccaagcgcagaggagcaatag

SEQ ID NO: 51056 - DNA, 2064 bp, Artificial Sequence
  Description of Artificial Sequence: Synthetic coding sequence
atggaccagcaccagcacctgaacaagaccgccgagagcgccagctcagagaaaaagaagaccagacgatgcaacgggttcaagatgtttctggccgctctctccttttcctacattgcaaaagcactcggggggattataatgaagatttctatcacgcagatcgaaaggcgtttcgatatttccagttcactggccggactgatcgacggaagctttgagataggtaatctgcttgttattgtgttcgtcagctactttggctcaaagcttcatcggcctaagttaatcgggatcggctgcctcctgatggggacagggtccatcctgacctcgctaccacacttctttatgggttattataggtactccaaggagaccaacatagatcctagcgagaattccacctcaaaccttcccaattgcctgattaatcagatgctgagtcttaacagaactccaagcgaaattatagagcgcggatgtgtcaaagagtctggctcacacatgtggatctacgtgtttatgggcaacatgttgagggggattggagaaactccgatcgtgccactgggaatcagttacatagatgatttcgctaaggaaggacacagcagcctgtacctcgggactgttaatgtgatgggcatgacgggtctggtgttcgctttcatgctggggtccctgtttgccaaaatgtacgtagatattggatacgtggacctgagcaccataagaatcacccctaaggatagtaggtgggtgggagcttggtggctcggctttctggttagtggcattgttagcatcatctcatctatcccttttttctttttgcccctcaatccaaacaagccacaaaaagagaggaaggttagtttgtttctgcatgttctgaaaactaatgataagcggaatcagatcgctaacttgaccaatcgcagaaagtacatcaccaagaacgttacaggattctttcagtctctgaaatccatcttgaccaaccctttgtacgtgatctttgtaatcttcactctgctccatatgtcctcatatattgcctcactaacatacattatcaaaatggtcgaacagcagtacggttggagcgccagtaagacaaacttcctgctgggggtgctagccctgccagccgtcgccatcggcatgttctctggagggtatatcattaaaaaatttaaactatccctagtgggattggcaaagctcgctttctgcagcgccaccgtgcacctgctctcccaagttttgtacttctttctcatctgtgagtctaagtcagttgccggcctgacactcacatacgacgggaactcccctgttcggagtcatgttgatgtcccactgtcctattgtaactcagagtgcaactgcgacgaaagtcagtgggaaccggtctgcggcaataacggaatcacatacctctctccttgtcttgctggctgtaagtcttcgtccggcaataaggagcctatcgtcttttataattgctcatgcgttgaagtgatcggcttgcagaacaaaaactactcggcacacttgggcgagtgtcccagggacgatgcatgcacacgcaagagctacgtgtacttcgtgatccaggtcttggacgcttttctctgcgctgttgggttgaccagttattctgtgctcgtaattcgcattgtccagccagaactgaaggccctggcgatcggcttccatagcatgattatgcgttctttgggcggcattctcgtgcccatctacttcggggcattgatcgatactacgtgtatgaagtggtctacaaatagctgcggtgcccggggggcttgtagaatttataactcaacttacctaggtcgggccttttttggacttaaagtggccctgatttttcctgtacttgtccttctgactgtctttatcttcgttgttcgcaaaaaatcacacggtaaagatacaaaggtgctagagaacgagagacaagtcatggacgaggcgaatctggagttcctaaatgattcggaacactttgtgccctccgcagaagaacagtag

SEQ ID NO: 51057 - DNA, 813 bp, Artificial Sequence
  Description of Artificial Sequence: Synthetic coding sequence
atgggcttctggtgccggatgagcgagaaccaggagcaggaggaggtcattaccgtgagagtccaggaccccagagtgcagaatgagggctcgtggaattcctatgtggactacaaaatcttcctacacaccaactctaaagccttcaccgccaaaacttcctgtgtaagaaggagataccgggagtttgtttggctgaggaagcaactgcaaaggaatgccgggctggtacccgtcccagagctcccaggcaagagcacgtttttcggcacaagtgatgagttcatcgaaaaaagaagacagggcctgcaacatttcctcgagaaagtgctccagtctgttgtactgctgagtgacagccagcttcacttgtttctccagtcccagctgtccgtacctgagatcgaggcatgcgttcaggggaggtccacaatgacagtatcagacgcaattctgcggtatgccatgtcgaattgtggctgggctcaagaagagcggcagtcttcttcgcacctggcgaagggtgaccaacccaagtcatgttgttttctgcccaggtccggtcggcgctctagcccctcaccgccgcctagtgaggaaaaagatcatttagaagtgtgggcccccgtggtcgatagcgaggttcctagcctcgaaagccctacgctgcccccgttgtcctccccactctgctgcgatttcggccggccgaaggagggaaccagcacgctgcagtccgtccgtcgcgccgtggggggggaccatgctgtccctttagatcccggacagttagagaccgtactggagaaatag

SEQ ID NO: 51058 - DNA, 813 bp, Artificial Sequence
  Description of Artificial Sequence: Synthetic coding sequence
atgggcttctggtgccggatgagcgagaaccaggagcaggaggaggtgattacagtgcgcgtccaggatccccgagtgcagaacgagggcagctggaacagttatgtggactacaaaatcttcctgcacacgaatagtaaggcctttaccgccaagacttcttgtgtgcgaaggcgttatcgcgaattcgtttggctaagaaaacagctacaacggaacgccggattggtgccggtacccgaattgccaggtaaatccactttcttcggcacatctgacgaatttattgagaagcgccgccagggactgcagcactttctcgagaaggtcttacagagcgtagtgctgttgagcgactcgcagctgcacctgtttctccaatcccaactctccgtacctgagatcgaagcttgcgtccaaggccggtctacaatgaccgtcagtgacgctatactgaggtacgctatgagtaactgtggttgggctcaggaggagcgacagtcttcaagtcacttggccaaaggtgatcagcccaaatcatgttgctttctgccccggtctggccgccgatcatcgccttctccccccccctcagaggaaaaggatcatctggaagtctgggcccctgtagttgacagtgaagtgccgagcctggagagtccaactcttcctccgctctccagccccctgtgttgcgacttcgggcgcccaaaagagggaacatctactctgcagagtgtcagaagagcggtgggcggcgatcatgctgtccccctcgacccagggcagcttgagaccgtgcttgagaagtag

SEQ ID NO: 51059 - DNA, 630 bp, Artificial Sequence
  Description of Artificial Sequence: Synthetic coding sequence
atgcgggcccccggcaccctgatgtggatcatccggtacagcagcatgccggtgcccgagctccctggcaaatcaactttctttggaacctcagacgagttcatcgagaaaaggcgccagggactgcagcacttcctcgagaaagtgctgcagtctgtggtgctgctgtcagattcccagctccacctatttctgcagagtcagttgagtgtaccagagatcgaggcatgtgtacaaggccgaagtactatgacggtgtccgacgcgattctcaggtatgctatgtcaaactgcggatgggcccaggaggaacgtcaatcttcttcacatcttgcaaagggagatcaacccaaaagctgctgtttcctgcctcggtccgggaggcggagttccccctctccaccccctagtgaggaaaaggaccatctcgaggtttgggcacccgtggtggacagcgaagtacccagtctcgagagccccactctgccgccacttagctctcccctttgctgtgacttcggcaggcccaaggagggtaccagcacgctccaaagcgtcaggagggccgtgggaggagatcatgccgtgcctctggacccaggccagctcgagactgtgctcgaaaagtag

SEQ ID NO: 51060 - DNA, 381 bp, Artificial Sequence
  Description of Artificial Sequence: Synthetic coding sequence
atgaccgtgagcgacgccatcctgcggtacgccatgagcaactgcggttgggctcaggaggaaagacagagttccagtcatctggctaagggggatcagccaaagtcatgttgtttcctgcctaggtcggggcggcggtcatccccttcacccccgccgtctgaggagaaagatcatctggaagtgtgggccccagtagtcgactcggaagttccctccctggagtcccctacactcccaccgctctcttcccctctgtgttgcgattttggcaggcccaaggaggggaccagcaccctccagtccgtgcgaagggctgtgggtggagaccacgctgtccctttagacccagggcaattggaaacagtgctcgaaaaatag

SEQ ID NO: 51061 - DNA, 477 bp, Artificial Sequence
  Description of Artificial Sequence: Synthetic coding sequence
atgagcgacaccgccgtggccgacacccggcggctgaacagcaagccgcaggacctaaccgacgcgtacggacctccctccaattttctggagattgatattttcaacccccagacagtgggggttggacgcgctcgcttcactacttatgagaccaacttaccaatctttaagctgaaggagagctgcgtgcggaggcgatactctgactttgaatggctgaagaacgaattggagcgtgactcaaagatagtggtccctccgctgccaggtaaagctctgaaaagacagcttcccttccggggtgacgagggcatttttgaggaatctttcatcgaggagaggcggcaagggctcgagcaatttattaacaagatcgccggccacccactcgcccagaatgagcgctgtcttcacatgtttctgcaggaggaagctatcgaccggaactacgtgccaggaaaggtcaggcagtag

SEQ ID NO: 51062 - DNA, 489 bp, Artificial Sequence
  Description of Artificial Sequence: Synthetic coding sequence
atgagcgacaccgccgtggccgacacccggcggctgaacagcaagccccaagacttgactgacgcatacggacccccctcaaatttccttgagattgacatctttaacccacagactgtgggtgtcggccgggcaaggtttaccacttatgaggtaaggatgagaacaaatctgcctatttttaagctcaaggagtcctgcgtgcgccggaggtactcagacttcgaatggctcaaaaacgagctggaacgcgattcaaaaattgtggttccacctctgcccgggaaggcactcaagcggcagctgcctttcaggggggacgagggaatctttgaggagtcctttatcgaggagcgacgacaggggctagagcagttcattaacaaaatcgctggtcacccccttgcacaaaacgaacggtgcctccacatgttcctccaggaagaggctatcgatcgcaactatgtgccagggaaggtgagacagtag

SEQ ID NO: 51063 - DNA, 3327 bp, Artificial Sequence
  Description of Artificial Sequence: Synthetic coding sequence
atgagcagcgtgaagcggccccggggccggccccccagcagcaagaagagtgacggctctggcacctatacaaaattgcagaacacccaagtgagggttatgtctgaaaaaaagcaaaggaaaaaagtggagtcggagtccaaacaggaaaaagctaataggataattagcgaagcaatcgctaaagctaaggagcgtggcgaacgcaatatcccacgcgttatgtcccccgaaaattttcccacggcctcagtggagggcaaggaagagaagaaaggccgacgcatgaagagcaagccgaaagacaaagactccaagaaaaccaaaacatgttccaagctaaaggaaaaaactaaaatcgggaagctaatcatcactctggggaagaagcagaagcgaaaaaatgaaagttccgacgaaatcagcgatgccgagcaaatgccccagcataccctgaaggaccaggattctcagaagcgaagatctaatagacaaattaagcgtaaaaaatacgctgaggacatagaagggaaacaatctgaggaagaggtgaagggaagcatgaagataaagaaaaacagtgcaccactgcctggtgaacagcctctgcagctgtttgttgaaaatcctagtgaagaggatgccgccattgttgacaagatcctatcgagccggaccgtgaaaaaggaaatttccccgggagtgatgatagacaccgaagaattctttgtgaagtataagaattattcctacctgcactgcgagtgggctaccgaagagcagctgttgaaggataagcgcatccagcaaaagattaagcgcttcaagctgcgccaagcccagcgggctcacttctttgccgacatggaagaagagccatttaaccctgattatgtggaagtcgatcgcgtcttggaggtttcattctgcgaggataaggacaccggagaacccgtgatatattacttagtaaagtggtgctcactcccttatgaggatagtacatgggagctgaaagaagatgtggacctagccaaaatagaagagtttgaacaattgcaggccagcaggcccgacactcgcaggctggaccgtcccccaagcaacatttggaaaaagattgatcagtcccgagactacaaaaacggcaatcaactgagagaataccagctcgaaggcttaaactggctactctttaattggtataaccgccgaaattgcattctagccgacgaaatgggactcgggaaaacaattcagagtataacattcctgtacgagattttactaacaggaatccgagggcccttcctgatcatcgcaccgctaagcactatcgcaaactgggaaagggagtttcggacatggacagacattaacgtggtggtgtaccatggctccctaatctctcgccagatgattcagcagtatgagatgtattttcgcgacagtcagggcagaataatccggggtgcttatagatttcaggcgataatcacaacattcgagatgattttaggggggtgcggagaactgaatgctattgagtggagatgcgtcattatcgatgaagctcaccggcttaagaataaaaactgtaagcttctggaggggcttaagcttatgaatcttgaacataaagtgctgcttactggcactcctctgcagaacactgtggaggaactgttctccctgctccattttttagagcccctgagattcccctccgagtcaacatttatgcaagaatttggggacctgaagaccgaggagcaggtccaaaagctgcaggctatcctgaagccaatgatgttacggaggttgaaggaagacgtggaaaagaagctggctccgaaggaagaaactatcattgaggtcgagttgaccaacatacaaaagaagtattatcgggctattttggagaaaaattttagctttctgtccaaaggggccgggcagacaaatgttccgaacctggtgaatactatgatggagttgcgcaaatgctgcaaccacccttacctgattaaaggcgcagaagagaaaatactcggagagtttcgagacacatataatcccgcagccagcgatttccacctgcaggccatgatacagtcagccgggaaacttgtcctaattgataagctgctgcccaagatgaaggccggcggccacaaggtgcttattttctcccagatggtcagatgcctggacatcctggaggattatctgatccacaaacgatacctctacgaaagaattgacggacgggtaagaggcaacttgcggcaggcggcaatcgatcgattctctaagcctgattctgataggttcgtgttccttctgtgcactcgcgcaggaggactgggcatcaacttaacagcggcggatacctgtatcatttttgattctgattggaatccacagaacgatcttcaagctcaggcaagatgccatagaatcggtcaaaacaaagccgtcaaagtgtaccggctggtcactaggaatagctacgaacgggagatgtttgatagggctagcctcaaactgggtttagataaggccgtcctccagagcatgtcaggccgggagtcaaatgtaggaggtattcagcagctatcaaaaaaggagattgaagatctgctgagaagaggcgcttacggggccattatggaagaggaagatgaaggcagtaaattctgtgaagaggacatcgatcaaatcttactcagaagaacaaaaactataaccatagagagcgaaggcaggggatccaccttcgccaaggcctccttcgtggcttcgggtaacaggactgatatcagcctcgacgatcccaatttttggcagaaatgggcgaaaaaggccgaaatcgacattgaggccatctctggacggaatagccttgtgatcgacacaccccggatcaggaagcagacacgaccttttagcgctacaaaggacgagctggcggaactcagtgaggccgaatctgaaggagatgagaaaccaaagctgaggaggccatgtgacaggtctaatggctacggtaggaccgaatgttttagagtcgaaaaaaacctcctcgtttacggatggggaaggtggcgagagatcctctctcacggccgtttcaaaagacagctaaacgaacacgacgttgagataatatgtcgggcactgctggcttactgtctggtgcattacaggggcgatgaaaaaattaagggtttcatctgggacctgataacccccacagaggatggccaaactcgcgagctgcagaaccacttgggcctctccgccccagtgccccggggaagatag

SEQ ID NO: 51064 - DNA, 1128 bp, Artificial Sequence
  Description of Artificial Sequence: Synthetic coding sequence
atgagcggcagccagaacaacgacaagcggcagttcctgctggagcgcctactcgacgcagtcaagcagtgccagatccgcttcggggggaggaaggagatcgcgagcgactccgattcaagggttacctgcctctgcgcccagtttgaagccgttttacagcacggactgaaaagatccagaggcctggccctgacggctgcggcaatcaagcaggccgccggctttgcgtctaaaaccgaaacggagcccgtgttctggtattacgtgaaggaagtattaaacaagcacgaattgcaaaggttctattccctgcgtcacattgcctccgatgtgggaagagggcgcgcctggctgcggtgtgccctcaacgagcattcgctggaacgctacctgcatatgctgctggcagatcggtgtcgactgagcaccttttacgaggattggtcttttgtaatggatgaggagcgtagtagcatgcttcctacaatggccgctggcctgaacagcatccttttcgctataaatattgacaataaagacctgaacggtcagtctaaattcgccccaaccgtctctgatctgctgaaagagtccactcaaaatgtgactagtctgctgaaggaatcgacccagggggtcagctccctctttcgagagattactgcaagctcagcagtgtccatcctgattaaacccgaacaggaaaccgatcccctgccggtcgtgtccagaaacgtcagcgctgatgccaagtgcaaaaaggagcgtaagaagaaaaaaaaggtgactaacattatttccttcgatgacgaagaagacgagcagaactctggagatgtgttcaagaaaactccgggtgctggagaaagtagcgaagataatagcgatcggagttctgtcaacataatgagcgcgttcgagtcgccattcggccccaactcgaacggctctcagagttctaactcctggaaaatagatagtttatcgttaaatggggagtttggatatcagaagcttgacgtgaagtccatagatgacgaggacgtagacgagaatgaagatgatgtatacggcaactccagcggtcgcaaacaccggggccactctgaaagccccgagaagtag

SEQ ID NO: 51065 - DNA, 1287 bp, Artificial Sequence
  Description of Artificial Sequence: Synthetic coding sequence
atgcacagctgggcccccctgaaggtgctgcacaacgacagcgacattttgttccccgtgtctggagtgggctcttactcacctgctgacgctcccctgggctctctagaaaacgggacgggcccagaggatcacgttcttccagaccccggcctgcgatatagcgtggaggcctcctcccctggccacggctccccattatcttcattactcccctctgctagcgtgcccgaatctatgaccatcagcgaacttaggcaggctactgtcgccatgatgaataggaaggatgaactcgaggaagaaaatagatcgctgagaaatctactggacggagagatggagcactcagccgctctccggcaggaagtggacaccctgaaacgtaaagtggcagagcaggaggaacgccaggggatgaaagtgcaggctcttgcaagggagaatgaggtcctcaaggtgcaactgaagaagtatgttggggctgtccagatgctcaaacgtgagggacagacagcagaggtgcctaatctatggagtgtggacggcgaggttaccgtggccgagcaaaaacctggagagattgccgaggaactagcgtcttcttacgagaggaaactaatcgaggtagcagagatgcacggtgagttaattgagttcaacgaaagattacaccgggccctggtagctaaggaggcactggtgagccaaatgcggcaggaactcatagatctacggggccccgttcctggcgacctcagccagaccagcgaggaccaaagcctctccgactttgagattagtaaccgggccctgatcaacgtctggatcccttccgtgtttttgcgcggtaaggccgctaacgcttttcatgtgtatcaagtgtatattaggatcaaggacgacgaatggaacatatatcggaggtacactgaatttcggagcctgcaccacaaactgcagaacaagtacccacaagtccgggcttacaacttcccgcccaaaaaagcgatcggtaataaggacgccaaattcgttgaagagcgtagaaagcaactgcaaaactatttacgctcagtgatgaacaaggtcatccaaatggtgcccgagttcgccgcctctccaaagaaagagaccctgatccagctaatgccattctttgtggacatcactccccctggcgaaccagttaatagccgaccaaaagccgcctctcggtttcctaaactgagtcgagggcagccacgcgagaccaggaacgtggaacctcaaagtggcgatctgtag

SEQ ID NO: 51066 - DNA, 1227 bp, Artificial Sequence
  Description of Artificial Sequence: Synthetic coding sequence
atgcacagctgggcccccctgaaggtgctgcacaacgacagcgacatactgttccccgtgtcgggtgttggctcctatagtccagctgacgcgccccttgggtccctcgaaaacggaactgggccggaggatcatgtactccccgatccagggttgaggtactctgtcgaggcgagctcccccggtcacggaagcccgctctcatcactccttccgtcagcctccgtccctgagagtatgacaattagcgagcttagacaggcaaccgtcgctatgatgaaccgcaaggacgaacttgaagaggagaaccgtagtctaaggaacctgcttgatggggagatggagcacagtgcagctctcagacaggaggtggacaccctgaaacgcaaagtggccgagcaagaggagcggcagggtatgaaggtgcaagccctggcaagggaaaatgaggtgttgaaggtacagctgaagaagtacgtgggagccgtgcagatgctgaaaagggagggtcagaccgcagaggtgcctaatctctggtctgtcgacggcgaggtgactgtggccgagcaaaagcctggtgaaattgctgaggagcttgcttcctcttacgagcgtaaactgatcgaagttgcagagatgcatggagagttgatagaattcaatgagcgcctgcatagggccctggtcgcaaaagaggccctggtcagccaaatgagacaggaacttattgatttacggggacctgttcccggagacctgtctcagacttccgaggaccaatcgttgagcgattttgagatttctaatagggccttaattaacgtctggatcccaagcgtgttcctccgcgggaaagctgcaaacgctttccatgtgtatcaagtgtacatacgcatcaaggacgacgaatggaacatctatcggcgttacacagagttcagatccctgcatcacaagctccagaataagtatccacaggtaagggcctacaacttcccacctaagaaagcaatcgggaataaggatgcaaaattcgttgaggagcgccgcaaacagctccagaactatcttaggtcggtgatgaacaaagtgatacaaatggtgcctgagttcgccgcatcccctaagaaagaaaccctgattcaactgatgccctttttcgtcgactggataagtctctttggtaatgggagggattctagtagggaggagttctcgtcttcctag

SEQ ID NO: 51067 - DNA, 750 bp, Artificial Sequence
  Description of Artificial Sequence: Synthetic coding sequence
atggacgaggagcggagcagcatgctgcccaccatggccgccggcccaaactccattctttttgccattaatatcgacaataaagacctcaatggccagtctaagtttgcccctaccgtttctgatctactgaaggagtccacacaaaatgtcacattattgaaggaaagcacccagggagttagctccgtgttccgcgagataaccgcgtcaagcgctatctccatcctaataaagccggagcaggaaactgatccactcccagtggtgtcccgaaatgttagcgctgatgcgaaatgcaaaaaagagcgaaaaaagaagaagcaggtcactaacatcatcagtttcgatgacgaggaggacgaacagaactccggagatatgttcaagaaaacgcccggcgctggcgaatctagcgaggacaatagtgatcattcttccgtcaatatcatgtctgccttcgaatctccattcggaccaaactcaaacggatcccagagttcgaatagctggaagatagactcactgagtctgaatcgagaattcggttatcagaaactggacgtgaagtctattgacgatgaggacgtcgacgagaacgaagacgacgtctacggcaattcttctggtagaaagcatcgggggcactccgaatctccagaaaaaaacggtgcccactccgtgactcaggctggcgtccagtggcatgacctcagctcgctgcaacctctgccaccggggtttaagtag

SEQ ID NO: 51068 - DNA, 750 bp, Artificial Sequence
  Description of Artificial Sequence: Synthetic coding sequence
atggacgaggagcggagcagcatgctgcccaccatggccgccggcccaaattctatcctgttcgcaatcaacatcgacaacaaagacttgaatggacagtccaagttcgccccaactgtcagtgatctcttgaaggaaagcacacagaatgtgactctgcttaaggagagcacccagggagtttcatcagtattcagagagattaccgcctcaagcgccatcagcatccttattaaacctgaacaggaaacagatcccctccccgtcgtgtcaaggaatgtatcagccgacgctaaatgcaaaaaagagagaaaaaagaaaaaacaggttactaacataataagctttgatgatgaggaagacgagcaaaacagtggcgacatgttcaagaagactccaggcgccggcgagtcgagtgaagataatagcgatcatagcagcgtcaacattatgtccgcattcgagtctccattcgggcctaacagtaatggatctcagtcctcaaattcatggaaaatagactccttatcactcaatcgtgaattcggttatcaaaaactggacgtaaagtccatcgatgacgaagacgtggatgaaaatgaagatgacgtctacgggaactcttcaggccgtaaacaccgcgggcactctgagagtcccgaaaaaaatggagctcacagtgtgacccaggccggcgtccaatggcatgatctgtcttcccttcagccgctccctccaggctttaaatag

SEQ ID NO: 51069 - DNA, 807 bp, Artificial Sequence
  Description of Artificial Sequence: Synthetic coding sequence
atgctgctggccgaccggtgccggctgagcaccttctacgaggactggtccttcgttatggatgaagaacgatcttccatgctgcctaccatggcagctggccctaattctatactttttgcaatcaacattgacaataaagatctcaacggccagtcaaagttcgcgcctactgtgagcgacttgctcaaggaatctacccaaaatgttaccctcttaaaggagtcaacccaaggtgtgtcttccgtgttcagagagattacggccagcagcgccatctccatcctcatcaagccggagcaggagaccgaccctctgcctgtggtgtcccgcaatgtgtctgccgacgcaaagtgcaagaaagagcggaagaagaaaaaacaggtgacgaatatcatttccttcgacgatgaggaagacgaacagaattctggcgacatgtttaaaaaaaccccgggcgccggggaatcttcagaggacaacagtgatcactcatcagtgaatattatgagcgcttttgagagcccattcgggcccaacagcaacggatcacaaagcagtaattcctggaaaattgacagcctttccctgaatcgtgaatttggatatcaaaaactagatgtgaagagcatagatgacgaggacgtcgacgaaaatgaggacgatgtgtacgggaactcctctggaaggaaacaccggggacattcagagtcccctgaaaagaacggtgctcattctgttacccaggctggggttcagtggcatgatctcagcagtctccagccccttccccccgggttcaagtag

SEQ ID NO: 51070 - DNA, 351 bp, Artificial Sequence
  Description of Artificial Sequence: Synthetic coding sequence
atgctgctggccgaccggtgccggctgagcaccttctacgaggactggtcattcgtgatggacgaggagcgaagttctatgctgccaactatggccgccgggccaaattcgatcttgttcgccatcaacatcgacaacaaagacctaaacggacagagcaagttcgcccccacggtaagtgatcttctgaaagagagtacccagaatgttacgctgctaaaggaatctacacagggagtgagctcagtgttcagagagataacggcctcctctgctatatccatcctgataaaacctgagcaagaaaccgatccacttcccgttgtatcccgtaacgtgagcgctggctag

SEQ ID NO: 51071 - DNA, 1323 bp, Artificial Sequence
  Description of Artificial Sequence: Synthetic coding sequence
atgaagatgcacttctgcatccccgtgagccagcagcggagcgacgcgttaggcgggcggtacgtcctgtatagcgtgcatctggacggattcctgttttgtagagtgcgatattcacaattgcatggttggaatgagcagctgcgaagggtctttggtaactgtttgccacctttcccacccaaatactatttggctatgactaccgcaatggctgatgagcgaagggaccagctcgaacagtacctgcagaacgtcactatggacccaaatgttttgcggtctgacgtgttcgtggaattcctcaagcttgcgcagctaaacacctttgacatcgctactaaaaaggcgtaccttgatatttttctccccaacgaacagagtatccgcattgaaatcattacctctgacacagccgaacgagtgttggaagtagtttctcacaagattggcctgtgccgcgagcttctcggctatttcggactgtttctgatacgtttcggtaaggaaggcaaactgtcggttgtcaagaaactggcagactttgagctgccctatgtgtctcttggttcttcagaagttgaaaattgtaaagtggggttgcgcaagtggtatatggcaccgagccttgactctgtgctgatggactgtcgtgtggccgtcgacctcctgtatatgcaggccattcaggatatcgaaaagggctgggccaaaccaacacaggcccagcggcaaaagcttgaggcattccagaaggaggactcacagacgaagttcctcgagctggctcgtgaggtgcgacattatggatacttgcagctcgacccttgcacttgtgactatccagagtctggctctggcgctgtcttatccgtgggcaataatgagatttcttgttgcatcacgcttccagacagccaaactcaagatatcgtgtttcagatgtccagggtcaagtgttggcaggtcaccttcttagggaccctgctagatacagatggtcctcagaggaccctgaaccaaaatctggagctccggtttcaatattctgaagattcatgctggcaatggtttgtgatttacaccaaacaggcttttctcctctccagctgcctgaagaagatgatttccgagaagatggtgaaattggctgccgaaaatacggaaatgcagatcgaagttccagagcagtctaaaagtaagaaatatcacattcagcaaagtcagcagaaggactactcttcattcctctctcggaagagcaagataaagatcgccaaagatgattgcgtcttcggtaacattaaggaggaagacctttag

SEQ ID NO: 51072 - DNA, 1026 bp, Artificial Sequence
  Description of Artificial Sequence: Synthetic coding sequence
atgctgggcaacaccgagaactggaacaccttcgacatcgccaccaagaaagcatatctggatatttttctgcctaatgaacagtccatccgtatcgagatcattacttccgacaccgccgaacgcgtcctggaggtggtgtcccacaagatcggcctatgccgcgagcttcttggctatttcgggttgttcctcatcagattcggtaaggaggggaaactttccgtggtgaagaagctggccgatttcgaactgccttacgtgagcctggggtctagtgaggtagaaaactgcaaggtgggcctccgcaaatggtatatggccccgtctctcgactccgtgctgatggattgccgggtggccgtcgacctgctctatatgcaggctattcaggatatcgaaaaaggatgggctaagcctacccaagctcaacgccaaaagctcgaagcctttcagaaggaagatagccaaacaaagttcctcgagttagccagagaagtgagacactacggataccttcagttagatccatgtacgtgtgattacccagaatctggctccggcgccgtactgagcgttggcaacaacgagatttcatgttgcatcaccctcccagatagccagacccaggatatagtctttcagatgagcagagtgaaatgttggcaggtaaccttcctggggacccttctggacactgacggccctcagcgaactctcaaccagaatctcgagctacggttccagtattctgaggactcttgttggcagtggttcgtcatttacacaaagcaggcattcttactcagtagctgcctgaaaaagatgattagcgaaaaaatggtcaagctggccgctgagaacacggagatgcagattgaagtgccggagcaatcgaaaagcaagaaatatcacattcagcagagtcaacagaaggattatagctccttcctatcaaggaagtccaaaataaagatagctaaggacgattgtgtgtttggaaacattaaagaggaagacctgtag

SEQ ID NO: 51073 - DNA, 1212 bp, Artificial Sequence
  Description of Artificial Sequence: Synthetic coding sequence
atggagacctacgccgaggtgggcaaggagggcaagcccagctgcgcctcagtcgacttacagggtgactcaagcctgcaggtggagatctccgatgctgtctccgaacgcgacaaagtcaagttcaccgtgcaaaccaaatcctgtttgccccacttcgcccagacggaattctcagttgtacggcaacacgaggaattcatctggttacacgatgcctacgttgaaaatgaggaatatgccggactcattataccaccagcgccacccagaccagatttcgaagccagccgggagaagctgcagaagctgggcgaaggcgattcctccgtgacgcgtgaagaatttgcgaaaatgaaacaagaactggaggccgaatatctggcaatatttaagaaaactgtcgccatgcacgaagtctttctgcagagacttgcagctcaccccacattgcgccgcgaccataactttttcgtgtttctagagtacggtcaagatctctcagtaaggggcaaaaaccgcaaagagctactgggcggattcttgagaaatatcgtcaaaagtgccgacgaagccctgattactggtatgagtggactgaaggaagttgatgatttttttgaacatgagcgtacctttctgctagagtaccacacccggattagggatgcctgtttgagggccgaccgggtgatgagggcccataaatgtctcgcagacgactacatccccattagtgcggctctgtcgtcactggggacccaagaggtgaaccaattacgtacgtctttcctgaagttggccgaactcttcgagaggctccggaaactggaaggcagagtcgcaagcgatgaagatttgaagctctcagacatgctgagatactacatgagggattctcaggcagccaaagacctgctgtaccggaggcttagagcgcttgcagattacgaaaacgccaacaaggcactggataaagctcgcacacgcaatcgtgaagttaggcccgccgaatctcaccagcaactctgttgccaaaggtttgaacgcctctccgacagcgccaaacaggaactgatggattttaagagtcgaagggtgagcagttttcgcaagaacctcatagagctcgctgagctggagctgaaacatgcaaaggcctcaactttgattctgaggaacacgctggtcgccttgaagggcgagccctag

SEQ ID NO: 51074 - DNA, 384 bp, Artificial Sequence
  Description of Artificial Sequence: Synthetic coding sequence
atggagacctacgccgaggtgggcaaggagggcaagcccagctgcgcgtcggtggacctgcaaggagacagtagcttgcaggtcgagatctccgacgcggtttcagaaagagataaagtgaaatttacagtgcagaccaagagctgcctacctcacttcgcccagacagaattcagcgttgtccggcaacacgaagagttcatttggttgcacgacgcatacgtggagggaaaagcgaccgagattgggagggggggtcagctctgccacagcggacgagtatgccaagatgaggccggcgcaggttcggtgagtgccccatcctttccgtgccaccctcagagccctgacgtcttccccagttacttgccaatgaatgtgtag

SEQ ID NO: 51075 - DNA, 1725 bp, Artificial Sequence
  Description of Artificial Sequence: Synthetic coding sequence
atggccctgaagggccgggccctgtacgacttccacagcgagaacaaggaggaaattagcattcagcaggacgaagatcttgtgatctttagtgaaacttcactggatggctggctacagggacagaactctcgtggcgaaaccggcctgttccctgccagttatgttgaaatagtccgctctgggatttccaccaaccatgccgattattcatcatctccggcaggttcccccggggcccaggtaagtctgtacaattccccgagcgtagcaagtccagctcgatccggtggcggatctgggtttttaagcaaccagggcagctttgaggaagacgatgacgacgactgggacgattgggacgacgggtgtactgtcgtggaggagccccgagctggaggactcggaacaaacggccatccacctttgaacttgagttatcccggggcctatccaagtcagcacatggcattccggccgaagccaccactcgaacggcaggatagcctcgctagcgcgaagaggggctcggttgttggaagaaaccttaaccgtttttcctgtttcgtgcgatcaggtgttgaggccttcatcctgggcgatgtgcccatgatggcaaagatcgccgaaacatacagtattgagatgggaccaagaggccctcagtggaaagccaaccctcaccccttcgcctgttccgtggaagatccgactaagcagaccaaattcaaaggcatcaaaagctatatctcgtacaagctcaccccaactcatgcagccagcccagtgtaccgacgatacaagcatttcgattggctctataatcgtctcttgcacaagttcaccgtgattagtgtcccgcacctgcccgagaagcaagcaaccggtcgttttgaggaagatttcatcgagaagagaaaacgccgattgatcctgtggatggaccacatgaccagtcatcccgtcctgtcacagtacgagggctttcaacatttcctgagctgcctggacgataagcagtggaaaatggggaaaagacgcgccgagaaggacgagatggtgggagcgtcctttttactgacctttcagattccaacagaacatcaagatctccaggacgtggaggatagggttgacacctttaaggcctttagcaagaagatggacgacagtgttcttcaacttagtaccgtggcaagtgagctggttaggaagcatgttggtggctttcgcaaagagtttcagaaactgggctccgcattccaggcaattagccactcgttccaaatggacccgccattctgttcagaagccctgaatagtgcaatctcgcatacagggcgcacgtacgaagcgatcggcgaaatgttcgcggagcagccaaagaatgacctatttcagatgctcgacacactgagtctctaccaagggctactctctaacttcccggatattatccatctccagaagggggctttcgctaaggtaaaagaatctcagaggatgtcagacgaaggtaggatggtgcaggacgaagcggacgggattagacgaagatgcagagttgttggctttgcactgcaggccgaaatgaatcacttccaccaacggagggagctggatttcaagcacatgatgcagaactatctgcgacaacagatcctcttctaccagcgtgttggtcagcagttagagaaaacactacgaatgtacgacaatctatag

SEQ ID NO: 51076 - DNA, 312 bp, Artificial Sequence
  Description of Artificial Sequence: Synthetic coding sequence
atgggccagcagagcagcgtgcggcggctgaagcggagcgtgccctgcgagtctaacgaagcgaatgaggctaatgaggccaataagacgatgcccgagacccccacaggtgactccgatccccaaccggctccgaagaaaatgaagacaagtgagtcctctaccatcctggtggttagatatcggcgcaacgtaaagcgcacctcacctgaggagctgctcaatgaccatgccagagagaatcggattaaccctgaccaaatggaagaggaggaattcatagaaattacgacagaacgacctaaaaagtag

SEQ ID NO: 51077 - DNA, 294 bp, Artificial Sequence
  Description of Artificial Sequence: Synthetic coding sequence
atggacaagcagagcagcgccggcggcgtgaagcggagcgtgccctgtgactccaacgaagcaaatgaaatgatgcctgaaacatcctccggctacagcgacccccagccggcccccaaaaaactcaagacatctgagagctctaccattttggtcgtccgttacaggagaaactttaagaggacaagtcctgaagaacttgtaaacgaccacgcccggaagaaccggatcaaccctcttcaaatggaggaggaagagttcatggagatcatggtagagattcccgcaaaatag

SEQ ID NO: 51078 - DNA, 219 bp, Artificial Sequence
  Description of Artificial Sequence: Synthetic coding sequence
atggagcagcccaccagcagcatcaacggcgagaagcggaagagcccttgtgaaagcaacaacgaaaacgatgaaatgcaggagacacctaaccgggatctggcacctgaacccagcttgaagaaaatgaagacctctgagtactcaacagtattagccttctgttacaggaaagccaagaaaatccactccaatcagttggaaaacgatcagtcctag

SEQ ID NO: 51079 - DNA, 543 bp, Artificial Sequence
  Description of Artificial Sequence: Synthetic coding sequence
atggagcagcccaccagcagcaccaacggcgagaagcggaagagcccatgcgagagcaacaacaaaaaaaatgacgagatgcaggaggctcctaaccgggttctggccccaaagcagtccctccagaagactaaaactattgaatatctgaccattatcgtgtattattataggaaacacactaagataaactcaaatcagttggagaaggatcagagcagggaaaattcaattaatcccgtccaggaggaggaggatgagggcctggattccgcggagggaagtagccaggaagacgaagacctagactcatccgagggtagcagtcaggaggacgaagatctggattcgtcagaaggatctagtcaggaggatgaggacctggacagttctgaggggagctcgcaagaggatgaagatttagattcaagcgaggggagttcccaggaggacgaggatctggacccccccgaggggtcaagccaggaggacgaggatttggacagttccgagggctcttcccaggaaggcggggaggactag

SEQ ID NO: 51080 - DNA, 426 bp, Artificial Sequence
  Description of Artificial Sequence: Synthetic coding sequence
atggagcagcccaccagcagcaccaacggcgagaagaccaagagcccttgcgagtcgaataacaaaaaaaatgatgagatgcaggaagttcccaatagagttctggctccagaacagagtctaaaaaaaacaaagactagtgagtatcctatcatcttcgtgtattacctcaggaagggcaaaaaaataaatagcaatcagcttgaaaacgagcaatctcaggaaaatagcatcaaccccatccagaaagaagaagatgaaggagtggacctgtcagagggaagttccaatgaagacgaggacctgggcccctgcgagggtccttccaaggaagataaggatttggacagttctgaaggctcatctcaagaggatgaagacttaggactgagtgaaggcagcagccaggacagcggggaggactag

SEQ ID NO: 51081 - DNA, 300 bp, Artificial Sequence
  Description of Artificial Sequence: Synthetic coding sequence
atggaggagcccaccagcagcaccaacgagaacaagatgaagagcccgtgtgagagcaacaagcgcaaagtcgataaaaagaagaagaacctacaccgggccagtgcccccgaacaatctctcaaagagaccgagaaagcaaagtatcctacactggtattctactgtagaaagaacaaaaaaaggaattccaatcagctggaaaataatcagcctaccgaatcttctaccgaccctatcaaagaaaaaggagatctcgacatctctgcagggtctcctcaggatggagggcagaactag

SEQ ID NO: 51082 - DNA, 219 bp, Artificial Sequence
  Description of Artificial Sequence: Synthetic coding sequence
atggagaagcccaccagcagcaccaacggcgagaagcggaagagcccatgcgactcgaattctaaaaatgacgagatgcaggaaacacccaaccgggatcttgttctcgagccttccctgaagaagatgaaaacatccgagtatagtacggtgttggtactctgctatagaaaaaccaagaagatacactctaatcagctggagaatgaccaaagttag

SEQ ID NO: 51083 - DNA, 1011 bp, Artificial Sequence
  Description of Artificial Sequence: Synthetic coding sequence
atgcagaagcactacaccgtggcctggttcctgtacagcgcccccggggttgatccctcccctccttgccgatccctagggtggaaaagaaaacgcgagtggtcagacgaatctgaggaggagcccgagaaagagttagcccccgaaccagaggaaacgtgggtcgttgaaacattgtgcggactgaaaatgaagctgaagcaacagcgcgtcagccctatcttactcgaacaccacaaggactttaattcacaactggcccccggagttgacccaagccctccccaccgatcattctgttggaaaaggaaaatggagtggtgggataagtctgaggaaagcgaggaggagcctcgcaaggtgctcgcacccgaacccgaggaaatttgggtggccgaaatgctgtgcggactcaagatgaaacttaagcggcgtagggtgtccctcgtgctgccagagcaccatgaggcgtttaacagactgctggaagatcccgtcatcaaaaggtttctggcttgggataaagatcttcgagtttccgataaatacctgctcgcaatggtcatcgcctactttagtagggctggctttcccagctggcagtaccagagacttcacttttttctcgcactgtaccttgctaatgatatggaggaggacgacgaggattcaaagcagaacattttccatttcttatacggcaagaaccggtccaggatcccccttctgagaaagagaaggtttcagctgtacagaagtatgaacccaagagcaaggaagaaccgatctcacatccctctggtgcgtaagcgccgctttcagcttcgccgttgcatgaatccacgggccaggaagaacagatcacagattgtactttttcagaagcgacgttttcatttcttctgctcaatgtcctgcagagcctgggtgagcccagaggagctggaagaaatccaggcctacgaccccgagcattgggtgtgggctcgagatagagcgagactgtcatag

SEQ ID NO: 51084 - DNA, 777 bp, Artificial Sequence
  Description of Artificial Sequence: Synthetic coding sequence
atggagtggtgggacgagagcgaggagagcctggaggaggagccccgcaaggtcctcgcgccagaacctgaagagatctgggtggctgagatgttatgtgggttgaagatgaaactgaaacgcagaagagtgagtctggtcttgccagagcatcatgaagcatttaatcgcttgctggaggacccagtgatcaagcgcttccttgcatgggataaggatctaagagttagtgacaaatacctgctggcgatggttatcgcctacttctctcgcgccggtttcccaagctggcagtatcagaggatccacttctttctcgcgctgtatttggctaacgatatggaggaggacgatgaggatagtaagcagaatatcttccatttcctgtacagaaagaatagatctaggatccccttgctccgcaaaccttggtttcagttgggtcactcaatgaaccctcgggctagaaaaaatcgcagtagaatccccctgctgagaaagagaaggtttcagttataccgttccactaacccaagggccaggaaaaaccggtctagaattccccttctccgtaagaggcggtttcagctgtatagatcaatgaattcccgtgcgcgcaaaaatagatcccagatcgtgctctttcagaaacggagatttcatttcttttgttccatgagctgcagagcgtgggtgagtcccgaggagctagaagagatacaagcttatgatccagaacattgggtctgggcccgcgaccgcgctcatctgagttag

SEQ ID NO: 51085 - DNA, 777 bp, Artificial Sequence
  Description of Artificial Sequence: Synthetic coding sequence
atggagtggtgggacgagagcgaggagagcctggaggaggagcccagaaaggtcctcgccccagagccagaggagatttgggtagcagaaatgttgtgtggattgaagatgaaattgaagcggagacgcgtatccctcgtactgcccgagcatcatgaagctttcaacaggttgcttgaggacccagtgatcaaacgatttctagcctgggataaggacctgcgggttagtgataagtacctcctcgcaatggtgattgcctatttctcgcgcgcaggatttcccagctggcaataccaacggattcacttcttcctcgccctgtaccttgccaatgacatggaggaagacgacgaggattccaaacaaaatatcttccactttctttacaggaaaaaccggtcgaggatccccttgctgcggaagccttggtttcaactgggacactcaatgaacccccgcgccaggaagaatcgatcacggattcccctgttacgtaagaggcgctttcaactgtaccggagcacaaatcctagggccagaaagaaccgcagtcgcatccctctcctgagaaagcgcaggtttcagctgtaccggagtatgaactctcgagctcgaaaaaatcggagtcagatcgtcctattccagaagaggaggtttcactttttctgcagcatgtcctgccgagcttgggttagcccagaggaactggaagaaattcaggcatacgatccggaacattgggtttgggcccgggacagagctcacctttcctag

SEQ ID NO: 51086 - DNA, 1209 bp, Artificial Sequence
  Description of Artificial Sequence: Synthetic coding sequence
atggaccggaccgagacccggttccggaagcggggccagatcaccgggaaaataactacttctagacagcctcacccacagaacgagcagtctccgcagcgtagtacatctgggtacccactgcaagaggtggtggacgacgaaatgctcgggccctccgcgcccggagtagatccatcacccccctgccgaagcctgggatggaaacgaaagagagaatggagcgacgaatcagaagaggagccagagaaagaactggcaccggagcccgaggagacctgggtggtggagatgctatgcgggctgaagatgaaattgaagcaacagagggtgtccccaatattgcccgagcaccataaggactttaattctcagctcgccccaggcgtcgatccctcgccccctcaccgcagcttttgctggaagcgtaaaatggagtggtgggacgaaagcgaggaatcgttggaggaagaaccccgcaaagtgctggcccctgaacccgaggagatttgggtcgctgagatgctgtgcgggctgaagatgaaacttaagcggagacgcgtgtccctcgtcctgccggagcatcatgaagccttcaaccgcctccttgaggaccccgtcattaaacgcttcttggcctgggataaagacctgagggttagcgacaagtacctcctagccatggtgatcgcatacttcagcagagccgggtttccatcatggcagtatcagagaattcacttttttctggcactatacctggcaaacgatatggaagaagatgatgaggattccaaacagaatatcttccacttcctctaccgaaagaataggtcacgcatcccccttctgcgaaaaccgtggtttcagttaggtcatagcatgaacccccgggctagaaagaacaggtcccggatacccttgctgcgcaagagaagattccagctctacaggagcacaaatccgagggcacggaagaataggagtcgtatcccactgctccgaaagagacgatttcagctgtataggtctatgaactcccgggctagaaaaaatcgctcacaaattgtgctttttcagaagcgaagatttcattttttctgctcaatgtcttgcagggcctgggtgtcaccagaagagctggaagagatacaggcctatgatcctgagcactgggtttgggctagggaccgggctcacctttcctag

SEQ ID NO: 51087 - DNA, 1650 bp, Artificial Sequence
  Description of Artificial Sequence: Synthetic coding sequence
atgaccagccaccagccccagccccaggaggagcagagcccccagagaagtacctctggttatccacttcaagaagtcgtcgacgatgaggtcagcgggccttctgctcccggggttgaccctagccctccacggcgatctttgggctgtaagaggaagagagagtgcctcgacgagtctgatgatgaacctgaaaaagagttagcccccgagccggaggaaacatgggtggcagaaaccctgtgtgggctcaagatgaaggccaagagacgtagagtgagtctggtgttaccggagtactatgaggctttcaaccggctgctggctcctggggtggacccatcccccccccgcagatctttgggttgcaaaaggaaaagagaatgtcttgatgaaagtgacgatgagccagagaaagaacttgcccctgaacctgaggagacgtgggtggctgaaacactctgtggccttaagatgaaggccaaacggagacgggtgtcattagtcttgcctgagtattatgaggcctttaaccggctgcttgcccccggtgtggatccatcgcccccccgcagatccttaggctgtaagcgcaagagggagtgcctggacgagtcagatgatgagcccgagaaggaactcgcccctgaacccgaggagacctgggttgctgagacactgtgcggtttgaagatgaaagccaagagacggcgggtatctctggttctcccagaatactacgaggcattcaataggcttctagcgccaggagtggacccttcgcccccacggcggagcctcggctgcaaaaggaaacgcgagtgcctagacgaaagcgacgatgaaccggagaaggagctggcccccgaaccagaagaaacttgggtcgccgagacgctttgcgggttaaagatgaaagctaagcggcggagggttagcttggtgcttccggagtactacgaagcctttaatcgcctgcttgcacctggcgtggatcccagtcctccaagacgctctttaggttgtaagagaaagcgggagtgtcttgatgagtcggatgatgaacccgagaaggagctggctcctgaacctgaggaaacctgggttgccgagaccctgtgcggcctgaaaatgaaggctaagaggagacgcgtctctctggtgctgccagaatattatgaggcctttaatagactcttggaggatccggtcataaagcgctttctggcatgggataaagatcttcgcgtgtccgacaagtacctcctggccatggtcatcgcctatttttcccgggcggggctcccgtcttggcagtatcagagaatccacttctttttggccttatatctcgccaatgacatggaagaggatgacgaagcccctaagcagaagatcttttattttttatatggaaaaacccatagtcacatccctctgaggcccaaacattggttccagctgtgtcgccctatgaatcctcgggcacgcaaaaactgctcccaaattgccctttttcagaagcgccgattccagtttttctgctccatgagatgcagagcatgggtgtcccccgaggagctagaggagattcaggcttacgaccccgagcactgggtgtgggcacgagatagagcacacctctcttag

SEQ ID NO: 51088 - DNA, 519 bp, Artificial Sequence
  Description of Artificial Sequence: Synthetic coding sequence
atgaaggccaagcggcggcgggtgagcctggtgctgcccgagtactatgaagccttcaaccggctcttggaagatccagtgattaagagattcttggcatgggacaaagatctgagggtgagcgataaatacctcctagcaatggtcattgcgtacttttctcgagccgggctcccaagctggcagtatcagcgcattcatttttttcttgccctgtacctcgccaatgatatggaggaagacgatgaggcaccaaagcagaaaatcttctacttcctgtatggcaagacccacagtcacatccccctgagaccaaaacactggtttcagctctgccggccaatgaaccctcgggcgcggaagaattgctctcagatcgccctttttcagaaacgccgcttccagttcttttgttcaatgagatgtcgtgcttgggtttcgcccgaggaactggaggagatccaggcctacgaccctgaacattgggtctgggcccgggatcgagcacatctcagctag

SEQ ID NO: 51089 - DNA, 714 bp, Artificial Sequence
  Description of Artificial Sequence: Synthetic coding sequence
atggccagcggccaggcccggccccccttcgaggaggagagcccccaaccatcaaccaccgttaggagtcccgaagtagtcgttgacgatgaggtcccgggaccatcagccccttggattgacccaagcccccagccccaaagtctgggactgaagcgaaagagcgagtggagcgatgaaagcgaggaggagttggaggaagaactcgagttagaacgggcacctgagccagaagatacttgggtggttgaaacactctgcggtttgaagatgaagctaaagcggaagcgggctagttctgtgctgccagaacatcacgaggctttcaacaggcttctgggggacccagttgttcagaagttcttggcatgggataaggatcttcgcgtttccgataagtacctactggccatggtcatcgcctacttttcccgggcgggactgttctcatggcagtaccaacgcattcactttttcctggccttgtacctggctagcgacatggaggaggataaccaggcaccgaagcaagatattttttcttttctatacgggaaaaattatagtcagagaccactcttccacaagcttaggtaccagttgctgtgctctatgaggtggcggacgtgggtttcccctgaggagatggaggagattcaggcttacgaccctgagcattgggtctgggctagagaccggactctcattagctag

SEQ ID NO: 51090 - DNA, 1209 bp, Artificial Sequence
  Description of Artificial Sequence: Synthetic coding sequence
atggaccggaccgagacccggttccggaagcggggccagatcaccggaaaaatcactacaagccgacagcctcaccctcagaacgagcagtctccacagcggagcaccagcgggtacccactacaagaggtagtagatgacgaaatgctcggaccatccgcccctggcgtggatccctcccctccgtgtcggtcacttggctggaaacggaaaagagagtggagcgacgagtctgaagaggaacccgaaaaggagctggcgcccgagcccgaggaaacctgggtggtggaaatgctctgcggcctcaaaatgaagctcaagcagcaacgcgtttcaagcatcctgcccgagcatcataaggacttcaatagccagctcgcccctggcgtagatccgtcacccccccaccgtagtttttgttggaagcggaaaatggagtggtgggacgaaagcgaagaatccctcgaagaagaacccaggaaagtgctggcacccgagccagaagagatctgggtagcagagatgttgtgcggactgaagatgaaattaaagcggcgtcgcgtgtcgctcgtgctgcccgaacaccatgaagctttcaacagactgcttgaggaccccgtcatcaagcgcttcctcgcgtgggacaaagacttgagagtgtctgacaaatacctgctggcaatggttattgcctatttttcgcgtgcaggctttccttcttggcagtatcagcggatccacttttttttggcactgtaccttgctaatgacatggaggaagacgacgaggatagtaaacagaatatcttccatttcctgtaccgcaaaaaccgctcccggatccccctcctcaggaagccctggttccaactagggcactcaatgaatccacgtgccagaaagaataggtccaggatccctttactgaggaagcggcgttttcagctttacaggtccacaaatccacgcgcacgcaagaaccgatccaggataccgctcctccggaaaagaaggttccagctgtatcgctccatgaactctcgtgcgagaaagaataggtcccagatagtgctgtttcagaagcgaagattccactttttttgtagcatgtcgtgtcgcgcttgggtgtcacctgaagagctggaggagattcaagcttacgaccccgagcactgggtatgggccagagatcgagcacacttgagctag

SEQ ID NO: 51091 - DNA, 777 bp, Artificial Sequence
  Description of Artificial Sequence: Synthetic coding sequence
atggagtggtgggacgagagcgaggagagcctggaggaggagccccgaaaggtgctcgcccctgagccggaggaaatctgggttgctgagatgctctgtggtctgaagatgaaactgaaaagacgacgcgtttcgttagtcttaccagaacaccacgaggccttcaaccgtctgctggaagaccccgtcatcaaaagatttctggcttgggacaaagacctcagggtctccgacaagtatctacttgcaatggtgattgcttattttagccgagctggctttccttcgtggcaataccaacggattcacttttttctagctctgtatctggcgaacgatatggaagaggatgacgaagatagcaagcagaacatcttccatttcctttacagaaagaacagatctaggattcctttactaaggaaaccatggttccaactcggccacagcatgaaccctcgtgctcgaaagaacagatcccgaataccactactgcgaaaaagaaggtttcagctgtaccgctccacgaacccgcgagcacgaaagaataggtctcggatacccttgttgaggaaaagaaggttccagctgtaccggtcaatgaacagtcgagccagaaagaatcgctctcagattgtattgtttcagaaaagacgtttccactttttttgctccatgtcatgccgggcatgggtttcccctgaggaattggaggagatccaggcttacgatcccgagcactgggtttgggctagagatcgggcccacttatcctag

SEQ ID NO: 51092 - DNA, 1209 bp, Artificial Sequence
  Description of Artificial Sequence: Synthetic coding sequence
atggaccggaccgagacccggttccggaagcggggccagatcaccggtaagataacaacaagtaggcagccccacccccaaaacgaacagtctccccagcgctccacatccgggtaccccctccaggaagtggttgatgatgagatgctgggacccagcgcccctggcgtggatccttcccccccatgtcggtccctgggttggaagcgaaagcgggaatggtccgacgaatccgaggaggagcccgagaaggagttggccccagaaccagaagagacgtgggtggtggaaatgctttgtggtttaaaaatgaagcttaagcagcagagggtcagttcaatattgcccgagcaccataaagacttcaactctcaactggctcccggagttgacccttctcccccccaccgttccttctgttggaagcggaagatggagtggtgggatgaatcagaggaatccctcgaggaggagccacgaaaggtgctggcgccagagcccgaagagatctgggttgcagagatgttgtgtggccttaagatgaagctcaaaaggcgacgtgtcagcctggtcctcccggagcatcacgaggcttttaaccggctgctggaggaccccgtgattaagagatttctcgcctgggacaaggacctgcgggtttccgataaatatctcctcgccatggtgatcgcttacttctctcgcgcgggctttccatcttggcaatatcagaggatccactttttcctggcactgtacctggctaacgatatggaggaggacgatgaggattccaaacagaacatttttcatttcctgtatcgtaagaatagatctcgtatccccttgctgcggaaaccttggttccagctaggccattcaatgaaccctagagctagaaagaacaggtcccgaatccccctcttgagaaagcgaagattccagctgtaccgctcgacaaaccctcgcgctcgaaagaatagatctagaatccccctacttcggaaacgacggttccagctgtatcgctcaatgaactcccgagctagaaagaaccgctctcaaatcgtgcttttccaaaaacgtcgctttcacttcttttgtagtatgtcctgtcgagcatgggtctccccagaggagctcgaagagatccaggcctatgacccagagcactgggtctgggcacgagacagggctcatctgtcttag

SEQ ID NO: 51093 - DNA, 1545 bp, Artificial Sequence
  Description of Artificial Sequence: Synthetic coding sequence
atgagcgagatcctgtgccagtggctgaacaaggagctgaaggtgtcccgcactgtatcacccaaaagcttcgctaaggcattctcttctggatacttgctgggtgaagttctgcataaatttgagctacaggatgactttagtgagtttttggattccagagtgagcagtgccaaactaaataacttcagtcggctagagccgactctgaacctgcttggcgtccagtttgaccagaacgtggctcatgggataattactgaaaagcctggcgtggctaccaaactgctctatcagctttacattgccctgcagaagaagaaaaagtcagggctgactggagtcgagatgcagaccatgcagagactcactaaccttcgcctccagaacatgaagtccgatacgtttcaagagcgcctgcggcacatgatccccagacagactgatttcaacttgatgcgaattacctaccgcttccaggagaaatacaagcacgtaaaagaggacctcgcccacttacactttgaaaaattggagaggttccagaaactgaaagaagaacagcgatgtttcgatattgaaaaacaatacttgaaccgaaggcgccagaacgaaatcatggccaagattcaggccgctatcattcaaatacccaaacccgcatccaaccgtacactgaaagctctggaagctcagaagatgatgaaaaaaaaaaaggaagccgaggacgtggcggatgagattaaaaagtttgaagccctcattaaaaaagacctgcaggccaaggagagtgcctctaagactagcctcgatacggccggccaaacgacgactgatctccttaatacttacagtgacgatgaatacataaaaaaaatccaaaagaggttggaagaggatgcatttgctcgggagcagagagagaaacggagaagaaaactgctgatggaccaactgatcgcccacgaggcccaggaagaggcatatcgggaggagcagctgatcaatcggcttatgcgtcaatcccagcaggaacgccgtattgcggtacagctgatgcatgtgcggcatgagaaggaagtattgtggcagaaccggatcttcagagaaaagcagcacgaagagcgccgcctgaaggattttcaggacgccctggatcgtgaagcagccctcgcgaagcaagccaagatcgatttcgaagagcaattccttaaggaaaagcggttccacgaccagatcgccgtggaaagggcacaagcaagatatgagaagcactattccgtctgtgctgaaattctggaccagatagtagatctgtccacaaaggtggcggactaccggatgttaactaataatctcattccgtacaagctgatgcatgattggaaagagctgttctttaacgcgaaaccaatttatgagcaggcctcggtgaaaaccctgcccgctaatcctagccgggagcagctgacagagctggagaaacgcgatttactcgacacaaacgactacgaggagtacaaggtgcccacggacatgaaatag

SEQ ID NO: 51094 - DNA, 1860 bp, Artificial Sequence
  Description of Artificial Sequence: Synthetic coding sequence
atgcccagccagatcggcgaccggaagtggctgcacggcctgcaggcggctctacaaaattttttgaaagggtatcctgcaattgtgcggcagctccactcagcagggcgggggaagtcagatactagccagaagaagcctaaagagctgctcgaaagcctcttacaagcagatatagtgaagttcgcccattttctgctggatgttatgaatgtacttagcattctcagttgcgtgaataagaatcggaattcgagcattgccgatattttcgccacactggagtccatgcttgaaatgctgcagatgtatcagacccgactaggtcccaaagagcggatggtagactctgccacacatttccatggtaactgcctgagaggcaaggagaacattagtgctgtcaggaatattgttctgacacacctcattaaaagactacaaggctgtttccgggatgcgagccaaaatgttgtaagagctactgttatcggaagtttcaagttgtggccgacaaagattaaccaggaatttggtgaaaaggaggtgtcaatcctgaccgcacattatgagcccgtgctcgaagccgccaatgttaagctcagtgaggtggacactgagtggtctatgctgaagttggaaatatacgcccggtttcagaacatccgcaaattgacttgggattttgttaattctatttacctgcataagtatcctaacattctgactttggtggacctggtcctgaccctgcccgcttcatccgccgaggcagaacacggtttctctcaaatgaagtggactaaatcccatatgcatgcgaagatcaaagctgagtccatcattggcaataaggcttttaccgatatcctgattgatctggtcacccttaacctgggtacaaacaactttccatcaaattggatgcatttgacccagccggaacttcaggagttaacctctttgctaaccgtaaattcagaatttgtggattggagaaaatttctattggtgacgtcaatgccttggcccattccattggaggaagagttgctggagacactgcagaagtttaaggctgttgataaagaacagcttgggaccatcaccttcgaacagtacatgcaagccggactgtggtttactggcgatgaggacattaaaattcctgaaaaccctctcgaaccactgccctttaatcgacaggaacacctgatcgagttctttttccgtctgttcgccgactacgagaaagatcccccccagcttgactatacacagatgctgctgtactttgcctgccacccagatacagttgaaggtgtctatcgcgctctctcagtcgccgtcggcacgcacgtctttcagcaggttaaggcgagcatcccgtcagccgagaagacttctagcacagatgcaggaccagccgaagagttccccgagcccgaagagaatgcagccagagaggagcggaagctgaaggatgacaccgagaaacgcgagcagaaggacgaagagattcccgaaaatgcaaacaacgagaaaatgtctatggaaaccctgctgaaggtgtttaaagggggctccgaggctcaggactccaaccgattcgcgtctcacctgaagatagaaaacatctacgccgaggggtttataaagacatttcaggacttgggagctaaaaacctggaaccgatcgaggtcgcagtgctgctcaagcatcccttcattcaagatctgatctccaattacagtgactacaaattcccagacataaagattatactacaacgtagtgaacacgtgcaaggatccgacggcgagcgcagtccttcacgccatacagaggagaaaaaatag

SEQ ID NO: 51095 - DNA, 5469 bp, Artificial Sequence
  Description of Artificial Sequence: Synthetic coding sequence
atgagcgagatcctgtgccagtggctgaacaaggagctgaaggtgagccgcacagtatcgccaaagtcttttgcgaaagcctttagctctggctacctcctgggagaggtgttacacaagtttgaactgcaggatgacttttctgagttcttagactccagggtgagctccgcgaagctgaacaatttttctagactagaacccaccctgaatttgttgggcgtgcagtttgaccaaaatgtcgcacatggcataataaccgaaaagccaggagtggccaccaagctactctaccaactttacatcgctcttcagaagaagaagaaaagtggactgactggggtggagatgcaaaccatgcaacgcctaacgaatctgaggctgcagaacatgaaaagcgatacctttcaggagcgccttaggcacatgatcccaagacagacagactttaacctcatgcgcattacatacaggttccaagagaaatataaacatgtcaaggaagacctggcccacctacatttcgaaaaacttgaacgcttccaaaagctcaaagaagagcagcgctgctttgatatagaaaaacaatacctcaaccgccgtaggcaaaatgagatcatggccaaaatccaagccgccatcattcagatccccaagcccgcgtcaaaccgcactctgaaagcccttgaagctcaaaaaatgatgaaaaagaagaaggaggccgaggacgtggctgatgagattaagaaatttgaagccctgatcaaaaaggacctgcaagcaaaagaaagcgcgagcaagacctctcttgacaccgccggtcaaaccaccaccgacttactcaatacctacagcgatgatgagtatatcaagaagatccagaaaaggctggaggaggacgcgtttgcaagagaacagcgggagaagcggaggagaaagctgctcatggatcagttaattgcccatgaagctcaggaggaagcatacagggaggagcagctcataaatcgcctgatgagacagtctcagcaggaaaggcggattgctgtgcagctcatgcacgtgcgtcacgaaaaagaggttctgtggcagaatcgcattttcagagagaagcagcatgaagagagacggcttaaggacttccaggacgctctggatcgcgaggcagcactggctaaacaggcgaagatcgacttcgaggaacaattcctcaaggagaaacggttccacgatcaaatcgccgtagagcgagcgcaggcacgctatgaaaagcactacagcgtctgcgccgagattctcgaccagattgtggacctgtctacgaaggttgcagattacaggatgttgacaaacaacttgatcccctacaaactcatgcatgactggaaggaactgtttttcaacgccaagccaatctacgaacaggcgagcgtgaagacgctgccagccaacccctccagggagcaactgaccgaactcgagaaaagagatctcctcgataccaatgactacgaggaatacaaaaatatggtgggcgagtgggctctccctgaagagatggtggacaacctgccccctagcaacaattgcattctgggccacattctgcaccgactggccgagaagtctcttccaccacgcgcagagagtacaaccccagagcttccttcttttgccgtgaagggctgcctcctcgggaaaacactttccggcaagacgactattctgagaagtctgcaaaaggatttcccgatacagattttgtcaatagatacgctcgtgcaggaggcgatccaggccttccacgataacgagaaagtatccgaagtcctccccatacagaagaacgatgaggaagacgccctcccagtgttgcaggaggaaattaaggagtcccaggacccacagcacgtgttcagtgcgggtcctgtctctgacgaggtgttgcctgagactgaaggcgagaccatgttgtcagcaaacgccgataagacaccgaaggcagaggaggtgaaatcttccgattccttcttaaagctaaccacgagagcccaactgggcgcaaagtccgagcagctcctgaagaaaggcaagtcaattcctgacgttttactcgtggatattatcgtgaatgccatcaatgaaatccccgttaatcaggattgcatcctggatggcttccctatgactctgaaccaagcacaactgctcgaggaagctctgacggggtgtaatagaaatcttaccgaggtcgaaagaaagaaggcccagaaatccacattggccattgatcccgccacaagcaaagagatcccgctgcctagtcccgcctttgactttgtcatcctgctagatgtctcagacaccagctcaatgtctcgtatgaacgacatcattgcagaagagttaagctacaaaaccgcccacgaggatatcagccaacgtgtggcagcagagaatcaggataaagatggcgaccaaaatctgcgtgatcagatacagcaccgtatcatcgggttcctcgacaactggcctctgcttgaacagtggttttcagagcccgaaaacattctgatcaaaatcaacgcggaaattgacaaggaaagcttgtgtgaaaaggtcaaggagatccttaccactgaaattgccaagaagaagaataaggtggagaagaagttggaggaaaaagaggctgagaaaaaagctgcagcaagccttgccgagctccctctcccaacccccccccccgcccccccacctgagccagaaaaggagaaggagatccaccagagccacgtcgcgagcaaaactcccacggccaaggggaaaccccagtctgaggcgccccatgggaagcaggagagtctccaagagggtaaaggcaagaagggggaaaccgcactcaagcgcaaaggttctcccaaaggcaaaagctctggcggaaaagtgccggtcaagaagagcccagccgacagcactgacacatcacccgtggccatcgtgcctcaacccccaaagcctgggagcgaggagtgggtatatgtcaacgagcctgtccctgaggaaatgccactgttcctagttccatattgggagctcattgagaatagctatattaataccatcaagacagtgctccggcacctcagagaggatcaacatacggtgttggcatacctctatgagatcagaacatcttttcaggagtttctaaaacggcctgaccacaagcaggacttcgttgctcaatggcaggctgacttcaattctttacctgatgacctgtgggatgatgaagagacaaaggccgaattacaccagagagtcaacgatctcagagataggctgtgggatatctgcgacgcgagaaaagaggaagccgaacaggaaaggctggatatcatcaacgagagctggctccaggacacactgggcatgacgatgaatcatttcttttccttgatgcaagccgaactcaatcgcttccaggataccaaacggctgctgcaggattattactggggcatggaatctaaaatccccgtcgaggataacaaaaggtttaccaggataccactggttcagctcgattcaaaggataactccgaaagccagcttcggattccactggttccaagaatcagcatttctctggaaaccgtgacgcctaaaccaaaaaccaaatccgtgctaaagggcaaaatggacaatagccttgaaaatgttgagagcaactttgaggcagacgaaaagttagtcatggatacctggcaacaggcttcactcgccgtgtcccacatggtggcagctgagatacatcaaagactgatggaggaagagaaagaaaatcagcctgctgacccaaaggaaaagagtccacaaatgggtgctaataaaaaagtaaaaaaggagcctcccaaaaagaaacaagaggataaaaagcccaagggaaagagtccgccaatggctgaagccaccccggttatagtaacaactgaggagattgccgaaataaaaagaaagaacgaactacgagtgaaaattaaggaggaacatcttgccgcactacagtttgaagagatcgcaacgcagttccggctggagctgattaaaactaaggctcttgccctcctagaggatctcgtaactaaggtagtcgacgtgtacaagctcatggagaagtggctcggagagcggtacttgaacgagatggcttccaccgaaaaacttacagatgtagccagataccatatagagaccagtacgaagatccagaacgagctgtacctttcgcaggaggacttctttattaatggcaatattaaggtgttccctgatcccccaccatcaatcagacctcctcccgttgagaaggaggaggatgggactctgacaatcgagcagctcgacagcttaagagatcagttcctggacatggcacctaaagggattatcggtaacaaggcttttacggacattttgatagatctcgtgaccttaaacctggggaccaacaatttcccttctaactggatgcacctgacacagccggagctccaggaactgacaagccttctgacagtaaatagcgaattcgttgactggcggaagttcctcttagtaacatctatgccatggcctattccactcgaagaggaactgctcgagaccctccagaagtttaaggcagtggataaagaacaactcggaactatcaccttcgagcagtacatgcaggctgggttgtggttcacgggggacgaggatattaagattccagaaaatcccctggaaccattacccttcaaccgtcaggaacatctgatagaattcttttttagattgtttgccgactacgaaaaggacccgccccagctggactatacacagatgttattgtactttgcatgccatcctgacacagtcgagggcgtttatcgggctctgagcgtcgctgtgggcacgcacgtctttcagcaggtcaaggccagcatcccaagtgccgagaagaccagtagcaccgacgccgggccagctgaggagttccctgagcctgaggagaatgccgccagggaagagcgtaaattgaaagatgatacagaaaaaagggagcagaaagacgaagaaatccccgaaaatgcaaacaatgaaaaaatgtcaatggagacactgcttaaggtgttcaaaggcggttcggaagcccaggacagtaatcgatttgcgagccaccttaagattgagaacatctatgccgaaggatttatcaagactttccaggacctgggggccaaaaatctggaaccaatcgaagtcgccgtcttgttgaagcacccgtttatccaagacctgattagcaattattcagactacaagttcccagatatcaaaatcattttgcagcgcagcgagcatgtacaagggtctgacggggagcgaagtcctagcaggcataccgaagagaaaaaatag

SEQ ID NO: 51096 - DNA, 1410 bp, Artificial Sequence
  Description of Artificial Sequence: Synthetic coding sequence
atggacaaccggaacacccagatgtacaccgaggaggagaagaccgtgaatccgtttttgccctcgacccccgggccaaaaaaagcaaaagggggcggagaagcggtggagacacatccagcccctggacctctccctcctccagaggtcagagacatcggggaacggcgggagcccgatagagcacagcagcaaccacagaaaccagccgtggccgccggcacccagtcgcttgggaattttagacagggattcatgaagtgcctacttgaggtagagaaaatggaagcaagccacaggagagcaagcaaggcccgatctcagactgcccaaaaaagtccccgaacactcacgccagttcccacatccgcaccaagtctgccacagacccctgcatctgtccccgcaagtggaccatcctgggctagattaccagcccctggtccagagcctgcaccgatgggcgctccagtgcccacatccatgccatgccccgtacttctggggccagctctggatctggggtggcgtcgcatggagctgttgcatcagtcatcagagagaaccctgtcatatgccaaagcccgacaggagcccgaggagcagtccctgcagaaactatatcagaatagagaaaagtccgaagagcagttaaccctgaagcaggaggaagcctttaggagctactttgaaatctttaacgggccaggagaggtcgacgcgcagagtctgaaaaatattcttctcctgatgggattctccgtgactcttgctcaggtggaagacgccctgatgtctgccgatgtgaacggcgacggccgggtcgactttaaagacttcctggcggtcatgactgacactcggcgttttttctgctctgttgagcagaacgcccttagtgacatggcacctcataaccctcacaccctgttgtttgagattctgagcctgctggtggaaatgctcgcgctccctgaggctgtcctggaagagataacaaactattaccagaaaaaacttaaggaaggcacatgcaaggcccaggaaatggaagctgcggtcgggcggttacgtctgcagaaactaccatacaatccacagcaggaggaatcctccgaggtgcctgagcggaaggtgctgtcgattttgagccgcctgaagcaacagaattacgcgccgaatctgcagtctccatacgcacaggtgccttgtatcctactttgtcctcaactggataagaaaatggtgcggcggcagccatcaaaccactatgcactcgaccagtgcaccccccctgggctcgaccctgatataaggtcccctttctttcagagcggcagccagggtaatcgtgaacacaatagcgactcccggaaatggttgtctagtgtgcccgctagaacccattag

SEQ ID NO: 51097 - DNA, 603 bp, Artificial Sequence
  Description of Artificial Sequence: Synthetic coding sequence
atggacaaccggaacacccagatgtacaccgagggccggaccaaggccccaggaacccagccctctccgggcctccgtatcacaatcaaaagagcaggggtcgagccaatcattcctggcgtcagtaaggtcatgttccccgacgcatcagaggtggggagtaaaaagcacctgtcttccgcaagccgaggtccagaaaaaggtccacgcctccgcgatgcattcgagaaaggcccctcggaactccgtatacaggaacagggacctccggcccggccagggaaaaagcagccatcttgggttccccaggagggctcccaggagctgcaggcaggccaggaccagagcgaattgggccttctgccatcttgggtaccagaggtgcctgaagggctgcagcagctgggaagcggcaaggaaattaagggacagcagggcaggcagcgcaaccggggaatcggagaagaccaacctccggaatcctgccaggccggccacggcggttctcgcttgttgatacctgccctcctcgaagctgagggtggtcgttcaccagaggtaaaaacttcacttgccaacatggttaagccttgcttgtactag

SEQ ID NO: 51098 - DNA, 1341 bp, Artificial Sequence
  Description of Artificial Sequence: Synthetic coding sequence
atggcccagcccggcgccgtggagcacgcctgccaccccagcaccctcggcggccagggtggggggtcattggaagaagtcagagatataggggaacggcgcgagcccgaccgggcgcagcagcagccacaaaagcccgccgttgcagccggcacacagtccctcgggaacttccgtcaagggttcatgaaatgcctgcttgaagtggaaaaaatggaagccagtcatagaagagcatcgaaagcaagatcacagacagcacagaagagcccacggacccttacacctgtgcccaccagtgctccttccctaccccagacccccgcctccgtgccagccagcggacccagctgggcacggctgcctgcgccaggcccggagccagcaccaatgggggccccagtgcctaccagcatgccatgtcccgttctcctgggccctgctctggatctcggctggcgacgcatggagctcctccaccagagttccgaacggaccctaagctacgccaaagctaggcaggaacccgaagagcaatctttgcagaaactttaccagaaccgtgagaaaagtgaagagcaactgactctaaagcaggaagaggcctttaggtcttatttcgaaatctttaatgggccgggggaagtggacgcccagagcctgaagaatatcttgctgctgatgggctttagcgttacactcgcccaagtggaagacgcccttatgtctgctgatgtgaacggggacggtcgggtggacttcaaggattttttggcagtgatgactgacacgcgccgatttttctgcagcgtagagcagaacgctctgtcagatatggcccctcacaaccctcacacactcctgtttgaaatcttgagcttactcgttgagatgctggccctcccagaagccgtacttgaggaaattaccaattactaccagaaaaaactcaaagaggggacatgtaaggcacaagagatggaggcagccgttggccggttaagactgcagaaactcccctacaatccacagcaggaagagtcttctgaagtcccagagcgaaaggtgctgtctatcctaagtcgactgaaacagcaaaattatgcccccaacctgcagtccccctacgcccaggtgccgtgcatcctcctgtgccctcagctggataagaagatggtcaggcggcagccgagcaaccattatgctttggaccagtgtacccccccaggcctagaccctgatatcagatcccccttctttcaatcgggctcccaaggaaaccgcgaacacaactcagacagcaggaagtggctctcttctgtgcccgccaggacgcactag

SEQ ID NO: 51099 - DNA, 810 bp, Artificial Sequence
  Description of Artificial Sequence: Synthetic coding sequence
atgaagcggagcctgaacgagaacagcgcccggagcaccgccggctgcctgcctgtgcctttattcaaccaaaagaagagaaatcgccagccgctgacatcaaaccccctaaaggatgattcaggcatctcaaccccttccgacaattatgacttcccccccctccccaccgactgggcctgggaagctgtgaaccccgaattggccccagtgatgaagactgtcgatacaggccagattcctcattctgtctctaggcctttgaggtcacaggattcggtgttcaattctatccagtcaaacactggccgaagccaagggggatggagttacagagatggaaataaaaacacttccctcaaaacgtggaataaaaacgactttaaaccacagtgcaaacgtacaaatttagtagcgaatgacgggaaaaatagctgcccagtatcctctggtgctcaacagcagaaacagttgaggatccccgaacctcccaacctctcccgaaacaaggagactgagctgctccggcagacacatagctcaaaaatctcaggctgtaccatgcggggactggataaaaatagcgctctacaaacccttaagccgaatttccagcagaaccagtataagaagcagatgctcgatgacattcctgaggataacacactcaaggaaacatctttatatcagctgcagtttaaagaaaaggcatcctcgctcaggatcatcagcgctgtcattgagtccatgaagtattggcgcgagcatgcacagaagaccgtgctgctctttgaggttctggggtcttag

SEQ ID NO: 51100 - DNA, 963 bp, Artificial Sequence
  Description of Artificial Sequence: Synthetic coding sequence
atgaagcggagcctgaacgagaacagcgcccggagcaccgccgactgggcatgggaggccgtgaaccctgagcttgcccctgttatgaagacagttgatacaggacaaatccctcacagcgtctccaggcccctgcggagccaagatagtgtttttaattctattcagagtaacacaggccgaagccaaggaggctggtcatatcgcgacgggaataagaacacctctctgaaaacctggaacaaaaacgatttcaagcctcagtgtaagcgaaccaacctggtagcgaacgacgggaaaaacagctgccccgtcagcagcggcgcccaacaacagaaacagctgaggatccccgagcctcccaatctgagccgcaataaagaaacagagctgctcaggcagactcactctagcaagatctctggctgtaccatgagagggctcgacaaaaattcagcactgcagacactcaagcccaactttcagcagaatcaatacaaaaagcagatgctggacgatatccccgaggataacaccctaaaggagactagcctctaccaactccagtttaaggagaaggcaagcagtctacggatcatatcagccgttattgaatccatgaagtattggagagaacacgctcagaagacggttctattgttcgaggtcctggccgtgcttgatagtgcggtgactccaggcccctactatagcaaaaccttcctgatgagagacggaaagaacactctgccgtgtgttttttacgaaatcgaccgggaacttcctcgactgattcgaggcagagtgcaccgttgcgtaggcaactacgatcagaagaaaaacatcttccagtgtgtgagcgtaaggcctgcgtctgtctcagagcagaagacctttcaggctttcgtgaaaatcgcagatgtggagatgcagtattacatcaatgtgatgaacgaaacctag

SEQ ID NO: 51101 - DNA, 1092 bp, Artificial Sequence
  Description of Artificial Sequence: Synthetic coding sequence
atgaagcggagcctgaacgagaacagcgcccggagcaccgccggctgccttcccgtccccttgtttaatcagaagaagcggaatcgccagcctctgacctcaaacccactgaaggacgatagtggaatcagtacgccgtctgacaactacgactttccgcctcttccaacagattgggcctgggaggcagtcaatcccgaactcgcgcccgtcatgaagaccgtggacaccgggcaaatcccacatagcgtgagcagacctctccgcagccaggactccgtattcaacagtattcaatcaaacacaggccgatcacagggggggtggtcctacagggacggcaataaaaatactagtctcaagacctggaacaaaaatgacttcaagcctcagtgcaagcggaccaatctggtagcaaacgatggcaagaacagctgccccgtttcgagtggagcacagcagcaaaaacagctccgaatcccagaaccaccgaacctgtcacgcaacaaagaaactgagctgctcagacaaacccattccagcaaaatctcgggctgcacgatgcgcgggcttgataagaatagcgccctgcagacactgaagccaaacttccagcagaaccaatataagaagcagatgttggatgacatccccgaggataacaccttgaaagagaccagcctgtaccagctgcaatttaaggaaaaagcatcttccctccgaatcatcagtgcggtgattgagagcatgaagtattggcgagagcatgctcaaaagacagtgttgctctttgaagtcctagcagtcttggattccgcggtgactccaggcccttactacagtaaaacttttctgatgcgcgacggcaagaacaccctgccatgcgtgttctacgagattgaccgcgagcttcctagactgattcgaggtcgcgtgcatagatgcgttggtaattatgatcagaagaaaaatatattccagtgcgtgagtgtgaggcctgcctcggtgtccgagcagaagactttccaggctttcgtaaaaatcgccgatgttgagatgcagtactacataaacgtaatgaatgagacttag

SEQ ID NO: 51102 - DNA, 1044 bp, Artificial Sequence
  Description of Artificial Sequence: Synthetic coding sequence
atgaagcggagcctgaacgagaacagcgcccggagcaccgccggctgtctgcctgttcccctcttcaaccagaagaaacgcaatcgtcagccactgacgagcaaccccctgaaggacgactcggactgggcttgggaggcggtgaaccctgaattggcgcccgtaatgaaaacagttgacaccggccagatccctcactctgtgtcccgccctcttaggagccaagatagcgtatttaattctatccagagcaataccggacgatctcagggcggatggagttaccgagacggtaataagaatacatctctcaagacctggaacaagaatgatttcaagccacaatgtaagcggactaacctcgtagccaatgatgggaaaaacagttgccccgtgtcttcaggagcccagcaacaaaagcagctgaggatacctgagcccccaaacctgagccggaataaggaaacggaactgttaagacagacacactcttccaaaatctctggatgcacaatgcgcggcctcgacaaaaatagtgccctccagacccttaagcctaactttcagcagaaccagtataagaagcagatgcttgacgacatccctgaagacaacactcttaaagaaaccagcctgtatcagctgcaattcaaagaaaaagcctcatccctgcgaatcataagtgccgtcatcgagtccatgaagtactggcgcgaacatgcccagaaaactgtgcttctgttcgaagtcctagcagtgttggattcagctgtcactccaggtccctactactccaagaccttcctgatgcgcgacggtaaaaataccctgccttgcgttttctacgagatcgatcgcgaactgccaaggcttatccgtgggagagttcatcggtgtgtgggaaattatgatcaaaaaaaaaatatctttcagtgtgtgagtgttagacccgcctccgtgagcgagcagaaaacattccaggcttttgtgaagatcgccgatgtggagatgcagtactacatcaatgtgatgaacgaaacctag

SEQ ID NO: 51103 - DNA, 1092 bp, Artificial Sequence
  Description of Artificial Sequence: Synthetic coding sequence
atgaagcggagcctgaacgagaacagcgcccggagcaccgccggctgcttgcccgtgcctctgtttaaccagaaaaagagaaaccgccagccgctgacttctaacccactgaaagatgacagcggcatcagtaccccaagcgacaactacgacttcccgcctcttcccactgattgggcctgggaggcagtgaaccctgagcttgcaccagtcatgaagactgtagacaccggccagatcccccattctgtcagtcgacctctcagatcacaagattcagtgtttaacagcatccagtccaatactggaagaagtcagggtggttggtcctatagggatgggaataagaatacatctctgaaaacatggaataaaaacgactttaagccccaatgcaagcggacgaatctcgttgccaacgatggcaaaaactcgtgtccggtgtcttctggagcgcagcaacagaaacagctgcgcatacccgagcccccaaatctgagtaggaataaagagaccgagttgctcagacagacccattcttcaaagatctcaggatgtacgatgcgcggtctggacaagaactctgcactccagaccctaaaaccaaattttcagcagaaccagtacaagaagcagatgttggacgacatacccgaagacaatacactgaaggaaacctctttataccagcttcagtttaaggagaaagccagctcgctccggattatatcggcagtgattgagtcaatgaaatactggcgggagcacgctcaaaagacagtgctgctgttcgaggtgcttgccgtgctcgactccgccgtcacaccaggtccctactattctaagaccttcctcatgagggacgggaaaaatactttaccttgcgtgttctacgagattgacagggagctgcctcgactgattcggggccgtgtgcacagatgcgtcggaaactatgaccaaaagaaaaatatcttccagtgcgtctcggtcagacccgccagtgtgagcgagcagaaaacatttcaggcctttgtgaagattgcggatgttgagatgcagtactacataaacgtgatgaatgaaacctag

SEQ ID NO: 51104 - DNA, 1092 bp, Artificial Sequence
  Description of Artificial Sequence: Synthetic coding sequence
atgaagcggagcctgaacgagaacagcgcccggagcaccgccggctgtttgcccgtgcctctttttaaccagaagaagcgcaatcgacaaccactcacctccaatcctcttaaggacgacagcggcatttcaaccccttccgataactatgactttccacctctgcctacagattgggcttgggaagcagtgaatcccgagctagctcccgtcatgaaaaccgtggacactggacagataccccactccgtttcccggcctctccgctctcaggacagcgtgtttaatagtatccagagcaacacgggacgcagtcaaggaggttggtcatacagggatggtaacaaaaatacctccctgaagacatggaataaaaacgattttaaaccacaatgcaagcggacaaacctcgtggctaatgacggaaagaattcctgtccagttagcagcggtgcccagcagcaaaagcagcttcgtatccctgaacctcctaaccttagcaggaacaaagagaccgagcttctgagacagacccacagcagcaagattagcggctgcactatgcggggcttagataaaaatagcgccctccaaacactcaaaccgaatttccagcagaatcagtataagaagcagatgctcgatgacatccccgaggataatacactgaaggaaacttccctataccagctgcagtttaaggaaaaggcctcatctctgcgaattatttccgccgtcattgagtctatgaaatactggagggagcacgcccaaaaaacagttttactgttcgaagttctcgcagtgttagatagcgccgtgacgccaggaccctattatagtaaaaccttcctcatgcgtgacggcaagaacactctgccatgcgtcttctatgagatcgatagagagctcccccggttaatacgaggcagggtccaccgctgcgtgggcaattatgaccagaaaaagaacatcttccagtgtgtcagtgttcggcccgcatccgtctctgaacagaagacattccaggccttcgttaaaatagctgacgttgaaatgcagtactatattaatgtaatgaacgagacctag

SEQ ID NO: 51105 - DNA, 1275 bp, Artificial Sequence
  Description of Artificial Sequence: Synthetic coding sequence
atgggcagcagcagcctgagcgaggactaccggcagtgcctggagagggagctgagaaggggccgcgccggcgtttgcggagatccatcacttcgcgccgtgttgtggcagattctggtggaagatttcgatcttcacggcgcgctgcaggatgatgccctggccctgctcacagatggactctggggtagagccgatctggccccagccctcagaggcctagcccgtgcctttgagctcctggagctcgctgcagtgcacttatatctgttgccttggcgaaaagaattcaccacaataaaaactttctctggcggctacgtgcatgtgctgaagggtgtgctgtctgacgatttgctcctaaagagttttcagaaaatgggatacgtgcgccgcgactcccatagactgatggtgaccgctctcccaccggcctgtcagctggtccaggttgcgctgggctgctttgccttgcggcttgagtgcgaaatactcggtgaggtgctagcgcagctcgggaccagtgtacttccggccgaggagcttctgcaggcacgcagagcaagtggcgacgtggcatcatgcgttgcgtggcttcagcagcggcttgcacaggatgaagaaccccctcccctgccccccagggggtccccggctgcgtatagggctcctttggatctttaccgggatctgcaagaagatgagggttccgaggatgctagtctgtatggcgaaccatcacccggtcccgactccccaccagctgaactggcttaccggcctcctttgtgggaacagagcgccaaactctggggcaccgggggccgagcatgggagccacccgcagaggagctgcctcaggcctcctcccccccttacggggccctggaagaaggcctagaaccggagcccagcgccttttcctttctaagtttgcgacgagaactgagcaggccaggcgacctcgcaacaccagaaagttccgccgctgcttctccacgaaggattcgggccgagggtgtgccagcctcagcctaccggtcagtctcagaaccaccaggataccaggcacatagttgcctgtcccccggagctttaccaaccttgtgctgcgacacatgccgacagctgcacgctgcgcattgcgccgcccttccagcttgtcgcccaggccactccctgcgggttctactcggcgatgctcagcggagattatggctccagagggcccagatggataccctgctttataactccccaggggccaggccctag

SEQ ID NO: 51106 - DNA, 459 bp, Artificial Sequence
  Description of Artificial Sequence: Synthetic coding sequence
atgggcagcagcagcctgagcgaggactaccggcagtgcctggagagagagctgcgtcggggcagggcaggtgtttgcggggacccatcgctaagagccgtcctgtggcaaattctagtcgaggacttcgatcttcatggggcactgcaagatgacgctctcgcattacttactgacggcctgtgggggagggccgacctggcccccgcgctgcgcggactcgcccgggccttcgagctattggagttggcggccgtgcacctctacctgttgccgtggagaaaggagtttacaactattaaaacattcagcgggggatacgtgcacgtactgaagggagttttgagtgatgacctgttgctgaaaagctttcaaaaaatgggatatgtgagaagggactctcaccggttgatgctgtgctggagtcagagtgccggcctctgtagggtgcacgggtag

SEQ ID NO: 51107 - DNA, 552 bp, Artificial Sequence
  Description of Artificial Sequence: Synthetic coding sequence
atgaagaaggtgaagaagaagcggagcgaggcccggcggcaccgggactctaccagccagcacgccagtagcaactccacctcacagcagccaagcccggagtcaacaccacaacagccatcccccgagtccacaccgcaacactcgagcctggaaaccacctcccgacaaccagcatttcaagctctccctgcgccagaaatccgccgcagctcctgttgtctcctgagcccggatgccaacgtcaaagcagcccctcagagcagaaaggccggtcctcttattcgagccggaccgcactcctgctcttgtgcaacctgtccgtgtagctcggcttgctggagaaggctcggattgtgtcactcccgcatttttgacgtcctgctgccccgagattggcagatggcccctggccgcggcttgcccaatctcctgacattctatagaaaatctagcagaaagcccagtagtcaccggaacgcctgtccccccagtccccggaactgcgggtgtgggagtggtgggtcacgatcatgcctgctccaccattag

SEQ ID NO: 51108 - DNA, 579 bp, Artificial Sequence
  Description of Artificial Sequence: Synthetic coding sequence
atgaagaaggtgaagaagaagcggagcgaggcccggcggcaccgggactccacctcccagcatgcttcctcaaattccacttcccagcaaccctctcccgaatccactcctcaacaaccctcccctgagtccacaccccagcaaccctctccagaatccaccccccagcattctagtttagaaacaaccagtcgtcagccagcgtttcaggccctccccgcccctgaaattagacgaagttcttgttgcctactgtcccccgacgctaacgttaaggccgcgccacaatcgcggaaagctggaccccttatacgcgcaggtccccatagttgcagttgtgcgacttgcccatgctcctccgcgtgctggcgcaggctcggactgtgtcacagtaggattttcgatgtactgctgcctcgagattggcagatggctcccggacgtgggctacctaatctactgacattctacagaaagtcttcccgcaaaccgagctctcaccgcaacgcctgccctcccagtccgaggaattgtggctgtgggagcggcggttcacgcagctgcctcttacatcactag

SEQ ID NO: 51109 - DNA, 579 bp, Artificial Sequence
  Description of Artificial Sequence: Synthetic coding sequence
atgaagaaggtgaagaagaagcggagcgaggcccggcggcaccgggacagcaccagccagcacgcctcctctaatagcaccagccaacaaccttcaccagaatccaccccacagcagccttcccccgaatctacccctcagcaaccctctccagagtcaacaccccagcattctagtctagaaactacatctaggcaaccagcattccaggctttgccagcacctgaaatcaggaggtcatcgtgttgtctgctgtcccctgatgcgaatgtcaaggccgctcctcagtctcgtaaagcgggccccctcattagggccggccctcactcttgctcttgtgccacttgtccatgttcctccgcttgctggagaaggctgggcctatgtcactctaggatttttgacgtcctgttgccgcgggactggcagatggcacccgggcggggactcccgaacctgctgacattttataggaagtcctccagaaagccctcttcacataggaatgcctgtccaccaagtcccagaaactgtggatgtgggtccggtggtagccgctcgtgcttgctgcaccattag

SEQ ID NO: 51110 - DNA, 579 bp, Artificial Sequence
  Description of Artificial Sequence: Synthetic coding sequence
atgaagaaggtgaagaagaagcggagcgaggcccggcggcaccgggacagcacctcacagcacgctagctcaaactcaactagtcagcagcctagtcctgagtctacaccccagcagcctagcccagagtctacaccgcagcagccttcacctgagtccaccccacaacactcctctctagaaacaaccagtagacaacccgcctttcaggcattgcccgcaccagaaatccgccgctcaagctgctgtttgctgagcccggatgcgaatgtgaaggctgccccccaatcgcggaaggctggacctttaattagggcgggccctcattcctgctcgtgtgctacctgtccctgcagcagcgcttgctggcggaggttggggctttgtcatagcagaatctttgacgtcttgttaccgagagactggcagatggcgccaggacgcggcctcccaaacctcctcacattctacagaaagtcctctcgtaaaccaagttctcatagaaacgcctgcccaccatcgccccgtaattgcgggtgcggctccggaggtagcaggagctgcctgttacaccattag

SEQ ID NO: 51111 - DNA, 579 bp, Artificial Sequence
  Description of Artificial Sequence: Synthetic coding sequence
atgaagaaggtgaagaagaagcggagcgaggcccggcggcaccgggatagcaccagccagcatgcgtcttctaacagcacaagtcagcaacctagccccgagagtactccccagcagccttctcctgagagcacgccacagcagccctctcctgaaagtaccccccagcattcctcacttgaaacgacatctaggcagcccgcattccaggcactccctgccccagagattcgtcgctctagctgctgtctgctgtccccagatgctaatgttaaagccgccccccagagtcgaaaagctggtcccctgatccgggcaggaccacactcttgctcttgtgccacctgtccctgcagcagcgcatgttggaggcggctcggcctgtgccacagccggatttttgacgtgctgctgccaagggactggcaaatggcgccggggaggggccttcctaatctattaacattttataggaaatcttcacgaaaacctagcagccaccgcaacgcttgccccccatctccccgaaattgtgggtgcggaagtggaggcagccgctcttgtttgctccaccactag

SEQ ID NO: 51112 - DNA, 21 bp, Artificial Sequence
  Description of Artificial Sequence: Synthetic coding sequence
tgatgcctgctgcaccactag

SEQ ID NO: 51113 - DNA, 1005 bp, Artificial Sequence
  Description of Artificial Sequence: Synthetic coding sequence
atgcccctggaggtggtggtggagctgcagatccgggccatcagctgcccaggcgtttttcttccgggcaaacaggacgtgtacctgggagtttaccttatgaaccagtatcttgagactaattcatttccctctgcatttcccataatgatccaagagagcatgaggtttgaaaaaggaatcgctcccaagattgaattttctaccaggacagcaatcagggaatgtgtattcctccaccggaataggttccttgaagagaggcacgagagtcggcggccgcttagcacgagtcacgaaccaattttcccactgaatactattaagatgaaactcaaggagaacaatctgaacaggcttcctaaagggatgcaggcccgggcaccttctcagtactcaactcggcacttcttccaggaccaacctgcccagctcaatctagggaacaatttcaagatctcgggggggtctaaaccaccctttgttgtacgccatgtggattctgctaaacccttcggggagaacatcagtgaacatcacttacgccgcagtaggcgaaaatcaaaattttctgacttcccctttcctactcgtagggcttcctctctcgacagtcttgccgctaatgtcaaagtgatcaaggaacctgacgagcggatcgtcctccggagtgattcctcctcttgtctggacagcagtcagttcggcaagtccagtagctccaaacagggggacgccgatttccacgggaaggcaagctttgccacgtatcagcactcgacctcacccgggccgctggatcagcctctgctcagagaacgttttcatcctggatctcagagcacatggaaaaatatacacgaaagagtgtgtagtctactaacgagtcacagagcccagctgcaccagaataaagaagacagcactagcgaggtgaattacatcattgagagacccagctacccactgaaaaagtactctctccatgagcagagatacttctag

SEQ ID NO: 51114 - DNA, 903 bp, Artificial Sequence
  Description of Artificial Sequence: Synthetic coding sequence
atgagccccagcatgctgaccggcaacagcccccggggctgccggctgccctctatctcatcaacgacttgtggcaggcaactggagaaggttccggaaaagcgcgactccggcatgactgaggtagaaaggacatacagtgcaaattgcagcgatttcctggaatcaaagggctgcttcgccaatacgacaccctccggaaagagcgtgagctcgtctagcagcgtggagacaggaccctccgtcagtgagccccccggcttgcctcgggtgtccgcgtatgtagatacaaccgccgacctcgataggaaactgagcttttcgcactcagaccacagctcagaaatgagcttgccagaagtgcagaaagacaagtaccccgaagagttcagcttgctgaaattgcagaccaaggatggccacaggcccgaatggactttttatccacggttctcgtccaacattcacacttaccatgtgggtaagcagtgcttctttaacggagtcttcctgggcaacaagcgcagcctaagcgaacgcaccgtagacaagtgtttcggcagaaaaaagtatgatattgacccaaggaatggaattcccaagctgacacctggtgacaacccctatatgtatccagaacagtcaaagggcttccataaggccggaagcatgcttccaccagtgaactttagcatcgtcccttacgagaagaaatttgacacattcatcccactggagccccttccccaaattcctaatctgcccttttgggtgaaggagaaagctaacagtttaaagaacgaaatccaggaggtggaagagctggacaactggcagccggccgtccctctaatgcacatgttgcatctgtcaggggccctcgatttccctagacaaagttag

SEQ ID NO: 51115 - DNA, 903 bp, Artificial Sequence
  Description of Artificial Sequence: Synthetic coding sequence
atgagccccagcatgctgaccggcaacagcccccggggctgccggctcccttctatctcttctacgacctgcgggagacagctggagaaagtccccgaaaaacgggatagcggtatgaccgaagttgaacgcacttatagtgccaattgctccgacttcctggaatcaaaagggtgtttcgccaacactactcccagcggtaagagcgtttcctcttcaagttcagttgagacaggaccttctgtctctgaaccaccaggactacctagagtcagtgcctacgtagacacaactgcggatctggatcgcaagctctcgttttcccactctgatcattcatccgagatgagcctgccagaggtgcagaaagataagtatcctgaggagttttctctgcttaaactgcaaaccaaggacggacaccgccccgaatggaccttttaccccagattctcttccaatatccatacctatcacgtgggcaaacaatgttttttcaacggtgtgttcctgggcaacaaacgctcgctctcagaaaggaccgtggacaagtgctttgggcggaaaaagtatgatatcgacccccggaatgggattccaaaactgactcctggagataacccatacatgtaccctgagcagagcaaagggttccataaggcagggagcatgctgccccctgtcaatttcagcatcgtcccttacgagaaaaagttcgacaccttcattcctctggagcctctcccccagattcctaatctccctttctgggtgaaagaaaaagctaactccttgaagaacgaaatccaggaggtagaggagctcgacaactggcagccggcagtccctctgatgcacatgctgcacctctccggggcactggattttcctcgccaatcttag

SEQ ID NO: 51116 - DNA, 1338 bp, Artificial Sequence
  Description of Artificial Sequence: Synthetic coding sequence
atgagcccccccggcatgtggcagcccggcgtgcagcagcccggcatttcacaacaagtcccatctcatcctgacatgtctcagcccggtatgtcccagcaagtgcccagccaacccggcataaggcaaccagatacatcgcaatcttgcaaaaaccagaccgatatgtcacagcctgatgctaatcagagctccctgagcgactcaaaccagacaggtattattcaaccctcccctagtctgcttgggatgaatcagatggacatgaaccagtggtccgctagtctgtatgaaatgaatcaggttgatatgaaacaaccttcaatgtcacaagctgggatgcgccagtccggcacaaatctgccagacatcaaccagccagggatgaaacaacccgggacctggcagctgggccgctcccagcccggaatgtggccacagtccctgtcagagctggtgctgagtgaggcctctatttcccagcctggaccacctcagcgggcccccagccaaagtgggcccaggcaaagctccacctctcaagccggtaccaatcagtcgggtatctcgcaacctgtcatgtggcaactggacatgaggcagtcggggggctctcagccttccatgaggcaagtgggcacatcccagtccggcaccagccagattgggatgagccagccaggcacctggcagacaggattatctcagcctgtgccccgacagcccaataaaagtccccctggtatgtggcagcgtgggatgtggcagcctggaatgtcccagcaggtaccgagccagctcggcatgaggcagccaggtacatcccagtcctcgaaaaaccagaccggaatgagccaccctggacggggccaacccggaatctgggagccaggaccgtcgcaaccaggactgtcccagcaggacctgaaccaactagtgctttcccagcctggtttgtctcaacccggtcgctcccaaccaagcgtgtctcagatgggcatgcgccagacatcaatggactacttccaaatccggcacgccgaagctggagactgcccagaaatcctcaggcttattaaagaactcgccgcctgcgaaaatatgctggatgcaatggaactcacggccgcagatttattacgagatggctttggagataatccactgttttactgtctcatcgcggaagtgaatgatcaacagaagccttctggcaagttgaccgtggggttcgctatgtattactttacttacgattcctggactggaaaggtgctatatctagaagatttctatgtgactcaggcttaccaggacagtcaccataacagcatgtag

SEQ ID NO: 51117 - DNA, 1527 bp, Artificial Sequence
  Description of Artificial Sequence: Synthetic coding sequence
atgagcccccccggcatgtggcagcccggcgtgcagcagcccggcatctctcagcaagttcctagccatcctgacatgtcccagcctggtatgagccaacaggttccatcgcaacccggaatcaggcagcccgatacttcgcagtcatgcaagaatcaaacagatatgtcacaacctgacgccaaccagtccagtctctccgactccaatcagactggaatcattcagccttctccaagccttctgggcatgaatcagatggacatgaaccagtggtctgcctccttgtatgaaatgaatcaagtggatatgaaacagccctcaatgtcccaggccggaatgaggcagtctgggacgaatcttccagacatcaatcagccaggcatgaaacagcccggcacctggcagctgggacgctctcagcctggcatgtggccgcagagcttatctgaactcgtgctgtccgaggcatctatttcgcagcccggaccaccacaacgtgccccatcccagtccggacccagacaaagttcaaccagtcaggccggtactaatcagagtggcatctctcagcctgtgatgtggcaactcgacatgaggcagtcaggaggaagtcagccgtctatgagacaggtcggaactagtcaaagcggtacttctcaaattggtatgtcccagcctgggacttggcaaaccggcctctctcagcctgtgccacgccagccaaacaagtctcccccaggaatgtggcagagaggcatgtggcaacccggcatgagccaacaggtgcccagccagctgggtatgcgacaacccggaacttctcaatcctcaaagaatcagaccggtatgagccatcccggccggggccaaccgggcatttgggagcccgggccctcccaaccaggcctttcccagcaggatctcaatcaactcgtattgtcccagccaggcctctcccagccgggacggagtcaaccatcagtctctcagatgggcatgcggcaaacaagcatggattatttccaaattaggcacgcagaagcgggagactgtccggagattctgcggctgatcaaggaacttgctgcttgcgagaacatgctggacgccatggaactgaccgccgccgatttacttagggatggtttcggtgacaaccctctattctactgcttgatcgccgaagtgaacgaccagcagaaacccagcgggaaactgaccgtgggcttcgctatgtactatttcacatacgactcctggacaggtaaagtactgtatcttgaggatttttacgtgactcaggcgtatcagggactggggattggagcggagatgctgaaacgtctctctcagatagctatcacaacccagtgtaactgcatgcactttctcgttgtcatctggaatcaggccagtatcaattattacacctctcgcggagcactcgacttgagcagcgaggaggggtggcatctgttccggttcaaccgcgaggagctgctcgatatggcctgggaggagtag

SEQ ID NO: 51118 - DNA, 1899 bp, Artificial Sequence
  Description of Artificial Sequence: Synthetic coding sequence
atgaaccagagcggcaccaaccagagcagcctgagcgacagcaaccaggccgggattaatcagccttcaacaaactccttgggaatgaaccagatggacatgaaccagggaagtgcctctttatacgaaatgaaccaggttgacatgaaacagccaagcatgagtcaagctggcatgcgacagtcgggtacgaatctgcccgatataaatcaacccgacatgaagcagcctgatacctggcagctcggccgcagccagccgggcatgttgcagcaggagctgagtcagctggttctttcaaaggctggtattagccaacctgaccccagtcaaccgggaccctcacaatcaggcccgtcacagagccgaatgagacagatcggaaccaaccagtctggcatgtcacagccagtgatgcagcagcttgactctcagagtgggggcagtcagcccagcatgcggcaagtgggaaccagtcagctggggacatctcagattggcatgtctcagcctgggacgtggcaaacaggcctgagccagccagtactgcggcaaccgaatatgagcccccctgggatgtggcagcccggcgtgcagcaaccaggaatcagtcagcaggtgcctagccatccagacatgtctcagcccggcatgagccagcaagttccttcccagccgggtatccggcagccagacacatcccagtcatgcaagaatcaaactgatatgagtcaaccagatgccaatcaatctagcctctccgactctaaccagaccggcattatccagccctcgccctccctcctgggcatgaatcaaatggacatgaaccagtggagtgccagcctgtacgaaatgaaccaggtggacatgaaacagccgtcaatgagccaagccggcatgagacagtcaggtactaacctcccagatatcaaccagcccggcatgaagcagcctggtacttggcaactgggaaggagccagccaggtatgtggccccaaagtctttcagaactcgtgttatctgaggcttccatttcgcagcctggacctcctcagagggccccatcacagagtggtccccggcagtcgtctaccagtcaagctgggacaaatcagtccggcatttctcagccagtcatgtggcagttggacatgagacagagcggggggtctcagcctagtatgaggcaggtggggacctcccagtccgggacaagccagattgggatgagtcagcccggaacgtggcagaccggcctgtctcaacctgtccctagacagcctaataaaagtccccctggcatgtggcagagggggatgtggcagcccggaatgagccagcaggtgccctcacaacttgggatgagacagcccggcacatcacagagcagcaagaatcaaaccgggatgtctcacccaggccggggacagcccgggatatgggaacctggccccagccagccgggcctgagtcaacaagatttaaatcagcttgtcctctcccagccgggcctatcgcagcccgggagaagccaacccagtgtgagccaaatgggaatgcgccagacatcaatggattactttcagattaggcatgccgaggccggcgattgcccggagattctgcgcctcatcaaggagcttgctgcgtgcgaaaacatgctggatgccatggagctgacggccgccgatttactgcgcgacgggttcggcgataaccctcttttctattgccttatcgcggaagtcaacgaccagcagaagccctccggaaaactgacagtgggatttgctatgtattacttcacctatgattcgtggacaggcaaggtgctctacttggaggacttctatgtcactcaggcctatcaggacagtcaccataactctatgtag

SEQ ID NO: 51119 - DNA, 192 bp, Artificial Sequence
  Description of Artificial Sequence: Synthetic coding sequence
atgacccggatcaagatcagcgtgtgcatctgcttccggtacttcgagttttgcttcttctatgcacttaatattctgtttcagaaggtgtccgaggcaaattctcaaactgagttattgctgcggccgcactgtaagaatattctgtttaacgtcagcttcatgatcgacctccaggcggcccatttttag

SEQ ID NO: 51120 - DNA, 1062 bp, Artificial Sequence
  Description of Artificial Sequence: Synthetic coding sequence
atgggcagcctgtacagcgagtacctgaaccccaacaaggtgcaggaacattataattacactaaggagaccctggagactcaggagacaacttctcgtcaggtggcgtctgcgtttattgtaatcctgtgctgcgctatagtcgtagaaaacctgctggtcctgatcgccgtagctaggaattcaaaatttcattccgctatgtacctcttcttgggtaaccttgccgcctctgacctgctggcaggagtggctttcgtggccaatacattactgtctggttctgtcacgttgcgtttgactcctgtccagtggtttgcccgggaggggtccgctttcatcactctgtccgccagcgtcttttctctgctggccatcgctatcgaacgccacgtggccattgcgaaggtaaagctctatggaagtgataaatcttgccggatgctgctgttaatcggtgcctcgtggctgattagtctggtgctcggcggactgccaatcctgggctggaattgcctgggccatctagaggcctgctccactgtattgccattgtatgcaaagcactacgtgctgtgcgtggtgactatcttctcaatcattctgctcgcaatcgtggccctctatgtgcgaatttattgtgtcgtgaggtcttcacatgccgatatggccgccccccaaactctagccctgctcaaaacagtgacaatcgtactgggagtgttcatcgtatgctggctccccgccttcagcatcctgctgttagactacgcctgcccagttcacagttgccctatcctctataaggcccattacttcttcgcagtcagcacactgaactcactgctgaatccagtgatctacacatggagaagtagagatttgagaagggaggttctcaggcctctgcaatgttggagacccggagttggggtgcaggggcgtaggaggggcggcacccctggccaccatctcctcccgttgaggagttcctctagcctggaacgcggaatgcacatgcccacgtccccaacctttctagagggaaacacagtggtctag

SEQ ID NO: 51121 - DNA, 789 bp, Artificial Sequence
  Description of Artificial Sequence: Synthetic coding sequence
atgctggccctggaggccgcccagctggacggcccccacttcagctgtctctatcctgacggggtgttttatgatctagacagttgtaaacactcaagttaccccgatagcgaaggggcccccgactctctgtgggactggaccgtagcccctcccgtccctgctaccccttacgaggcttttgatccggccgcagcggccttctcacatccccaggctgcacagctgtgctatgagcccccaacctacagcccggccggaaatctcgagctcgcaccttccttagaagcacctggccctgggctgccagcttatccgaccgagaatttcgcaagtcagacacttgtcccgcctgcatacgcaccctacccaagtcctgtgctgagtgaggaagaagacctccctttggatagccctgccctcgaagtgtcagattcagagtcagacgaggccctggtggcaggaccggaaggcaagggaagtgaagcggggaccaggaagaagctcagactgtatcagttcttgcttggactgctcacccgcggggacatgagagagtgtgtgtggtgggttgagcctggggcgggagtatttcagttttcttccaagcataaggaactgctagctcggcgctggggccagcaaaaaggaaataggaaaaggatgacttaccagaaactcgcccgggcccttcgcaattacgctaagacgggcgaaatccgaaaggtcaaaaggaagctaacgtatcagttcgactccgccctgctccctgccgtccggcgagcctag

SEQ ID NO: 51122 - DNA, 768 bp, Artificial Sequence
  Description of Artificial Sequence: Synthetic coding sequence
atggccagcagcgacctggagcagctgtgcagccacgtgaacgagaaaatcgggaacatcaagaaaaccctttcattacgaaattgcgggcaggaaccaacccttaaaaccgttcttaacaagatcggggatgaaatcatcgttattaacgaactcttgaataagcttgagctggagatccagtaccaagaacagaccaataattctttgaaggaactttgcgagtccctggaagaggactacaaggacattgagcatttgaaagaaaacgtgccctctcacctgccgcaggtgaccgttacccagagctgtgtcaaagggagtgatctcgaccccgaagaaccaattaaggtcgaagagcctgagcccgttaaaaagccgccaaaggaacagcggtcaattaaagagatgcccttcatcacttgcgatgagttcaatggggtcccctcatacatgaaatctcgtctgacttacaatcagatcaatgatgtcattaaggagataaataaagcagtgatttcaaaatacaaaatactgcatcagcctaagaagtcgatgaactccgttacgagaaacctttatcacaggttcattgatgaagagacaaaggataccaagggccgttatttcatagtggaagcggatataaaggaatttaccaccctgaaagctgacaaaaaattccacgtgctcttgaatattctgagacactgcaggaggttgtcagaagtgaggggcgggggattaaccaggtatgtgattacgtag

SEQ ID NO: 51123 - DNA, 381 bp, Artificial Sequence
  Description of Artificial Sequence: Synthetic coding sequence
atgagcaccatcaacatggaggccgaggtggacaagctggagctgatgttccagaaggccgagtctgatcttgattacattcaataccgtctggaatatgaaattaagactaaccaccccgatagcgccagcgagaaaaatcccgtcactctgctcaaggagctgtcagttatcaagtcacagtaccagacgttgtatgcgcgatttaagcctgttgcagtagagcagaaggagaccaagagcagaatatgtgcagggatgactaagactatgaatgtgatacagaagctgcagaagcagaccgatctggacttatcccccctgaccaaggaggagaagactgctgccgagcagtttaagagccatgtacccgatctctag

SEQ ID NO: 51124 - DNA, 777 bp, Artificial Sequence
  Description of Artificial Sequence: Synthetic coding sequence
atgaagacccccaacgcccaggaggccgagggccagcagacccgggctgccgctggcagagccacaggctccgcaaatatgaccaagaaaaaagtctctcagaaaaaacagcgcgggaggccttcgtctcagcccaggcgcaatattgtgggatgcagaatttcccatggatggaaagaaggagatgagccaattactcagtggaaggggacagttctcgatcaggttccgattaacccgtccctgtacctcgtgaagtacgacggcatcgactgcgtgtatggcctggaactgcatagagatgagcgcgtcttgtcactgaagattctgagcgaccgggtggcatcctcacatatctcagacgccaacctcgcgaacacaatcatcgggaaagcagtggagcacatgtttgaaggcgaacacggcagcaaggatgaatggcggggcatggttctggcccaggctcctataatgaaggcctggttctatattacatatgaaaaagacccagtgttgtacatgtatcaactcctggatgactacaaggagggggacctcaggatcatgccggagagcagtgaaagcccaccaacagaaagagaaccaggaggcgttgtggacgggctgattggaaaacacgtggagtatacaaaagaagatgggagcaagcggataggcatggtcattcatcaggttgagaccaagccctctgtatacttcattaagttcgacgacgactttcacatttacgtgtacgacctggtaaagaagagttag

SEQ ID NO: 51125 - DNA, 777 bp, Artificial Sequence
  Description of Artificial Sequence: Synthetic coding sequence
atgaagacccccaacgcccaggaggccgagggccagcagacccgggcggcagctggccgcgccacgggctcagccaatatgacaaagaaaaaagtttcccagaaaaaacagcggggccgaccgtcgagtcaaccccgtaggaatattgtagggtgccgtatctctcatggatggaaagagggggacgagcccattactcagtggaaaggtactgtgcttgaccaagttccaataaatccgagcctgtacctggttaagtacgatggcattgattgtgtctatggactcgagcttcatcgagatgaaagggtgctctccttgaagatcttatcggatcgggtcgcctcatcccacatctctgacgccaacctcgcgaataccattatcggtaaggccgtggagcatatgtttgagggcgagcacggatctaaggatgaatggcgcggcatggttctggcgcaggcccccatcatgaaggcatggttctatataacatatgaaaaagacccggtgctctacatgtaccagctgctggacgattataaagaaggggatctgcgcataatgcctgagagttccgagtctcctcccacagaaagggaacctggcggagtggttgatgggcttattggcaagcacgtcgagtacactaaggaggatggctcaaagcggatcgggatggtcatccatcaagtggagactaagccctctgtctattttattaaattcgacgatgactttcacatttacgtgtacgaccttgtcaagaagagctag

SEQ ID NO: 51126 - DNA, 234 bp, Artificial Sequence
  Description of Artificial Sequence: Synthetic coding sequence
atgaagacccccttcggcaaggccgccgccggccagcggagccggacaggcgccgggcacgggtccgtgtcagtaaccatgatcaagaggaaggcggctcataagaagcatcgtagccgacccacctctcagccaagaggaaacattgtgggttgcagaattcaacacggatggaaagacggcgacgagcccctaactcagtggaagggtaccgtgctcgatcagctgctctag

SEQ ID NO: 51127 - DNA, 777 bp, Artificial Sequence
  Description of Artificial Sequence: Synthetic coding sequence
atgaagacccccttcggcaaggccgccgccggccagcggagccggactggagccggtcacggatcagttagcgtaactatgattaaaagaaaggccgcccacaagaaacaccggagccggcccaccagccagcctcggggcaacattgtgggctgtcgcattcagcatgggtggaaagacggcgacgaaccccttacacagtggaagggtaccgtccttgatcaggtgcccgttaatccatccctatatctaatcaagtacgatggttttgactgtgtgtatgggctggaactacaccgagatgagcgggtgtcatccctggaagtcctgccaaatcgggtcgcaagctctcgaatttcagacactcacctggctgagattatggtcgggaaagcagtcgagcatatttttgagaccgaggaaggtagtaagaacgagtggagagggatggttttggctcaggccccagtcatgaacacgtggttctatattacatatgagaaagatcccgtgctttatatgtaccaactgctggatgattacaaagatggcgacctccggattctgcaagacagtaatgatagtcctctggccgagcgtgagcccggcgaggtaattgatagtctcgtcggtaagcaagtagagtacgccaaagacgacggctctaaacgaacaggcatggttatacatcaggtggaggctaaaccaagtgtatatttcatcaagtttgacgatgactttcacatctatgtctatgaccttgttaaaacatcttag

SEQ ID NO: 51128 - DNA, 750 bp, Artificial Sequence
  Description of Artificial Sequence: Synthetic coding sequence
atgagcccccccaccgtgccccccatgggcgtggacggcgtgagcgcataccttatgaaaaagcgccacactcaccggaagcagcggcgaaagcccactttcctcactaggcggaacatcgtgggttgcagaatccagcacggctggaaggaagggaatgagcccgttgagcagtggaagggcactgtgctagagcaagtgtcggtgaagccaactctgtacatcattaaatacgacggcaaggactcagtatacgggttggagcttcatcgggataagagggttcttgcattagaaattctgccggaacgcgtgccgacccctcggattgacagcaggctggctgacagcctgattggcaaagccgtcgaacatgtgtttgaaggggagcacggcacgaaagacgagtggaaggggatggtgttagcccgagccccagtgatggatacatggttttacatcacatacgaaaaagatccggtgttgtacatgtacacactgctggacgattacaaagatggggatctgcgaatcatacccgactcgaactactattttcccactgctgagcaggaacctggagaagtcgttgactccctggtcgggaagcaggtcgagcacgccaaggacgatggatcaaaaagaacaggtatattcatacaccaggtagtcgcgaagcctagcgtctacttcatcaagtttgacgatgacatccacatttacgtttacggcctggttaagacaccctag

SEQ ID NO: 51129 - DNA, 696 bp, Artificial Sequence
  Description of Artificial Sequence: Synthetic coding sequence
atgaagaagcggcacacccaccggaagcagcggcggaagcccacctttttgacacgccgtaatattgttggctgtcgcatccagcatggatggaaagaagggaacgaacccgtggaacagtggaagggaactgtcctggaacaggtgtccgtaaagcccacactgtatattatcaaatatgacggcaaggacagcgtttacgggctcgaactccacagagacaaacgcgttctagctcttgagatcctgcctgaacgggtgcctacaccccgaatcgactcccggctagcagatagtcttatcggtaaggctgtcgaacacgttttcgagggagagcacgggaccaaagacgaatggaagggtatggtgctggcccgagctcctgtgatggatacatggttctacatcacatatgagaaagaccccgtcctgtacatgtacacacttctcgacgattacaaggacggggatctaaggattataccggatagtaactattactttcctacagcagaacaggagccaggcgaggtcgtcgattcactggttggcaaacaagtggagcacgctaaggacgatggcagtaagcgcaccggaatcttcattcaccaagtggtggcaaaaccaagcgtttacttcattaaatttgacgatgatatccatatttatgtgtatgggctcgtcaaaacgccctag

SEQ ID NO: 51130 - DNA, 792 bp, Artificial Sequence
  Description of Artificial Sequence: Synthetic coding sequence
atgggccagaccgccctggccggcggcagcagcagcacccccaccccacaagctctttatccagatctgtcctgcccagagggattggaagaactgctatcagctccacctcccgacctcggcgcgcaaagaaggcacggctggaaccctaaggactgcagcgagaacatcgaggtgaaagagggtggactgtattttgagagaaggccggtggctcaatctaccgatggcgctcgcggaaagcgtggctattctagaggcctccatgcctgggaaatttcctggccccttgaacagagaggaacccatgctgttgtgggcgtcgctaccgccctcgcccccctacagaccgaccactatgctgctctcctgggctcgaactctgaatcctggggctgggacataggccggggcaaactgtaccaccagtccaaggggccgggagccccccagtacccagctggcacacagggtgaacaattggaggttcctgagcgtctgctcgttgtcctggacatggaggagggaactcttggatacgctatcggtggcacatacttagggcccgccttcagaggactgaaaggtcgaacgctgtacccggccgtgtctgccgtatggggccagtgccaagtgaggattagatatctgggtgaacggagagccgagccacattctctgttgcatttgtcccggctctgcgtacgtcacaatctgggtgacactcggttggggcaggtgagtgctctccctcttcctcccgcaatgaagcgatacttgctttaccagtag

SEQ ID NO: 51131 - DNA, 792 bp, Artificial Sequence
  Description of Artificial Sequence: Synthetic coding sequence
atgggccagaccgccctggccggcggcagcagcagcacccccaccccacaggccctgtatccagacctaagctgtcctgagggattagaggagctcctgtccgctccgcccccagatctcggcgcacagagacggcatggatggaatccaaaagactgctcagagaatatcgaggtcaaagaaggtgggctatattttgagcgcagaccagtggctcaaagcacagacggggcacgcggcaagcggggctactcgcgcggtcttcacgcctgggagataagctggccactcgagcagcggggaacccacgccgtagttggcgtggcgacagccctggccccccttcagaccgaccactatgccgcactcctgggctccaattccgagagttggggttgggacattggaagaggaaagctctatcaccagtccaagggacccggtgcaccccagtatcctgctggcacacagggagaacaactggaagtgcctgagaggctgctggtagttctggacatggaagaggggactctgggatatgctatagggggaacctatcttggtccagcattccgaggtctcaagggcagaaccctgtaccccgcggtctccgcggtgtggggccagtgccaggtgcggatcaggtatctgggcgagaggcgcgctgagccacattccctgttacacctgagtcggctttgcgtccggcataatctgggtgacactagactcggacaggtcagtgctctgccactcccacccgccatgaaaaggtatctcctgtatcagtag

SEQ ID NO: 51132 - DNA, 2424 bp, Artificial Sequence
  Description of Artificial Sequence: Synthetic coding sequence
atgcggctgagccccgcccccctgaagctgagccggacccccgccctcctcgccctggcattgcctctcgctgctgctctggccttctccgatgagacactggataaagtgcctaaaagcgagggatattgttccaggattcttcgagcccagggcacgcgaagggagggttacaccgaattctctctcagggtggagggggatccggatttctataaaccaggaacaagctatcgggttacactatcagccgcccccccgtcctactttcgggggttcactcttatcgcattgagagaaaaccgggaaggtgacaaagaagaggaccacgctggcacctttcagattatcgacgaggaggagacccagtttatgtccaattgcccggtggcagttaccgaatcaaccccccgtagaaggacgcgtatacaagttttttggatcgctcctcctgccggcactggttgtgtcatcctcaaggccagtatcgtgcagaagaggataatttactttcaggatgagggcagcctcactaaaaagctctgcgaacaggattccacattcgacggggtcaccgataagcctattctggactgctgcgcctgcgggaccgccaagtaccggctgactttctatggaaactggtccgagaagacccaccctaaagattacccccgcagagccaaccactggagtgcgataattggcggtagtcatagcaagaattacgtgttgtgggagtatggcggctacgcctcggagggggtgaagcaggtcgcggagcttggatctccagtgaaaatggaggaggagattcgccaacagtcagacgaggtcctgaccgtgataaaggcgaaagcacagtggccggcttggcagccgttgaacgtgcgcgcagccccctcagcggagtttagcgtagaccgcacgcggcatctgatgagcttcctaaccatgatgggcccttctccagattggaacgttgggctgtccgctgaagatctgtgcactaaggagtgcggatgggtgcagaaagtcgtgcaggacctgatcccatgggatgccggcaccgacagcggagtaacctacgagtcgcctaacaaaccgaccattccacaggagaaaatcagacctctgacgtctctcgatcatccccagtctccattttatgaccccgaaggcggcagcatcactcaggttgctcgagtggtcattgaacggattgcaaggaaaggagagcagtgtaatatcgtgccagataatgtcgacgatattgtggccgatctcgcgcctgaagagaaagacgaggacgacacgcccgagacgtgtatctattctaactggtcaccctggtccgcctgttcatccagcacctgcgacaaagggaagagaatgcgtcagaggatgttgaaagcccagctggacctttcagtgccctgccccgacacccaggactttcagccatgtatgggtcccgggtgcagtgacgaggacggttctacctgtaccatgtccgagtggatcacttggtctccctgctctatatcttgtggaatgggcatgagatcgcgcgagcggtatgtcaaacaattccctgaggacggatccgtatgcaccctgccaacggaggaaaccgaaaaatgcacggtgaatgaggaatgctccccttccagctgcctcatgacagagtggggggagtgggacgagtgctcggccacttgtggcatgggtatgaaaaagcgtcatagaatgatcaagatgaatcccgcagacgggtcgatgtgcaaagccgaaacaagtcaggccgagaagtgtatgatgcccgaatgccacaccattccctgtctgctttctccctggagtgagtggtcagattgtagcgtaacttgtggtaaaggcatgcgcactcgacaacgtatgctgaaatcacttgctgagctgggcgattgtaatgaggatctcgagcaagtcgagaaatgtatgctccccgaatgcccaatagattgcgaattaactgagtggtctcagtggtcggagtgcaacaaaagttgcggaaagggccacgtcattagaacgcgcatgattcaaatggaaccccagtttggaggggccccttgccccgaaactgtgcagcgcaaaaaatgcagaattcgcaaatgtctaagaaacccctccatacagaagctgcgctggagggaggcccgcgagtccagacgtagcgaacagctcaaggaagagagcgaaggtgaacagttccccggttgtaggatgcgcccatggacagcctggtctgaatgtaccaagctttgcggaggcgggattcaagaacggtacatgaccgtgaagaaaaggttcaaatcctctcagttcacctcctgtaaagacaaaaaggaaatcagggcctgcaacgtccatccatgctag

SEQ ID NO: 51133 - DNA, 1329 bp, Artificial Sequence
  Description of Artificial Sequence: Synthetic coding sequence
atgcggcggacccggcggccccggttcgtgctgatgaacaagatggacgacctgaaccttcactacaggttccttaattggcgacgccggatccgcgagatccgggaggttcgagcatttaggtaccaggagaggttcaagcacatcctggtggacggcgataccctgagctatcacggcaattccggcgaagtgggatgttatgtcgcctcaaggccactgacgaaggatagcaactatttcgaggtttctattgtcgactcaggggtgagagggactatagctgtggggctcgtgccccagtattatagcttggatcatcagccaggctggcttcctgatagcgtcgcatatcacgccgatgacgggaagctatataatggtagagcgaaggggagacagtttgggtccaagtgcaatagtggtgaccgaattggatgtggcatcgagcccgtgtcattcgacgttcagacggctcagatcttttttacaaagaatggaaagcgagtggggtctactataatgccgatgagtcctgatggactcttcccagccgtgggcatgcattccttaggagaagaagtgcggttacatcttaacgcagagctgggcagagaggacgacagtgtgatgatggtagattcttacgaggacgaatggggacgacttcacgacgttagggtgtgtggtacacttttagagtaccttgggaaggggaagagcatcgttgatgtgggcctggcccaggctcgccaccctttgtccacaagatcccactacttcgaagtggagattgtcgatcctggcgaaaagtgttatattgctttgggcctcgctagaaaagactaccccaagaacaggcatcctggatggtcccgtggctccgtggcatatcacgccgacgatggcaaaatcttccacggaagtggcgtgggcgacccttttggccccaggtgttataagggggatatcatggggtgcggaattatgtttccgcgtgattatatactggattctgaaggagacagcgatgattcatgtgacacagtaatcctttccccaactgcgcgggccgtacgcaacgtgaggaatgtgatgtaccttcatcaggaaggcgaggaggaggaagaggaggaagaggaggaggaggacggggaggaaatagagcccgagcacgaaggtcgcaaggtagtcgtgttttttaccaggaacggaaagattatagggaaaaaggatgccgtcgtcccgtcaggcggcttctttcccaccattggaatgctatcctgcggtgagaaagtcaaggtggacttacaccctctttcagggtag

SEQ ID NO: 51134 - DNA, 1359 bp, Artificial Sequence
  Description of Artificial Sequence: Synthetic coding sequence
atgaacagcggcatcctgcaggtgttccagcgggccctgacctgccctatttgtatgaactatttcctggaccctgtgacaatcgattgcgggcacagcttctgtagaccatgtctgtatttaaactggcaagatactgcagtcctggcccagtgttcggagtgtaagaagaccaccagacaaagaaatctgaacaccgacatttgcctgaaaaacatggccttcatcgctcggaaggcatccctaagacagttcctgtccagcgaagagcaaatctgcggcatgcaccgggaaacaaagaaaatgttttgtgaagtggataaatcactcctgtgcctcccatgctctaatagtcaggagcataggaaccacatccactgcccaatcgaatgggctgccgaagagaggcgggaagagctgctgaagaagatgcaatccctttgggaaaaagcatgcgaaaatctgcgaaacctgaatatggagactacgcgcactcgctgctggaaggattatgtcagcctacggattgaagcaatccgggccgagtatcagaagatgcccgcctttctgcatgaagaggaacagcatcacttagaacgcctgagaaaagagggtgaagacatctttcagcagctgaacgaatctaaggctcgaatggagcattctagagagctccttcgcggtatgtacgaagatctcaaacaaatgtgccataaggctgacgtcgaactgctccaggccttcggagacatcctgcatcgatacgaatctttgctcctgcaggtctccgagcctgtgaaccctgaactttctgcaggccccataacaggattacttgatagcctctcgggcttccgcgtggacttcacgctccagccagagcgcgctaactcacacatttttctatgtggagacctgcggagtatgaacgtgggctgtgaccctcaagacgaccctgacatcactgggaaaagcgagtgttttcttgtgtggggtgcccaggcattcacatcagggaagtactactgggaagtgcacatgggcgactcctggaactgggcatttggtgtatgcaataactattggaaggagaaaaggcagaacgacaagatcgacggcgaggaaggcctttttctgctcggctgtgttaaagaagatacccactgcagcctctttacgacctccccactggtggtgcagtacgtgcccaggccaacttccaccgtcggcctcttcctggattgcgaaggtcgaacagtgagcttcgtagacgtggaccaatcttctctgatctataccattcccaactgttcgttctcaccccctttgcgaccaatcttttgttgcagccacttttag

SEQ ID NO: 51135 - DNA, 591 bp, Artificial Sequence
  Description of Artificial Sequence: Synthetic coding sequence
atggccaccagcgtgctgtgctgcctgcggtgctgccgggacggcggaaccggacatattccacttaaagagatgccagccgtacagctggatacacaacacatgggaacagacgttgtgatcgtgaaaaacggaaggcgaatctgtggcacgggcggctgtctggcctccgcaccactgcatcaaaacaaatcctattttgagttcaagattcagagcactggcatttggggaatcggggttgcgactcagaaggtgaacctcaaccagatccctctgggtagggacatgcactctttggtgatgcggaacgatggagctctctaccataataacgaggagaagaatagactgccagcgaactcgcttcctcaagaaggcgacgtggtgggcatcacctacgatcacgtcgagttgaatgtttatctgaacgggaagaatatgcactgccctgcctccggaatccggggaaccgtttatccagtagtttatgtagatgattccgccattttggattgtcaattttcagagttctatcacacccctccccccggattcgaaaagatcctgttcgagcagcaaatcttctag

SEQ ID NO: 51136 - DNA, 474 bp, Artificial Sequence
  Description of Artificial Sequence: Synthetic coding sequence
atggccaccagcgtgctgtgctgcctgcggtgctgccgggacggcggaactgggcacattccgctcaaggagatgccagccgtgcaactggatacccaacatatggggatttggggaatcggggtggctacacagaaagtaaacttgaaccagattcccctcggccgcgatatgcacagtctggttatgcgaaatgatggcgccctctatcacaataacgaggaaaagaacagactgcctgccaactctctgcctcaggagggcgatgtggtgggcattacctatgaccacgtggaactgaacgtgtacctgaacgggaagaacatgcattgtccagcctcgggtatacgcggaactgtttaccccgtagtatacgtcgacgacagtgccatcttggactgccaattttccgaattctaccatactcctcctcccggattcgagaagattctgttcgagcagcaaatattttag

SEQ ID NO: 51137 - DNA, 1059 bp, Artificial Sequence
  Description of Artificial Sequence: Synthetic coding sequence
atggacttccgggagatcctgatgatcgccagcaagggccagggcgtgaataatgtacctaaacgctatagtcttgctgtggggccaccgaaaaaagaccctaaagtgaagggcgtacagagcgcagccgtgcaagcttttctgaagaggaaagaggaggaactgcggcgaaaggctctcgaggagaaaagaagaaaagaagagctggtgaagaagagaatcgaactaaaacatgacaaaaaggcccgggccatggccaagaggactaaagacaattttcatggctataatgggattccaattgaggagaagtcgaagaaaagacaggccactgaaagccatacaagtcaaggtaccgatagagagtacgagatggaggaggaaaacgagttcctggaatataaccatgccgagtcagagcaggagtatgaggaggagcaagagcctcccaaggtggagtctaagcctaaagtgccactcaagtcagcgcctcccccaatgaacttcaccgatttgttgaggctcgcagaaaagaaacagttcgaacctgttgagatcaaggttgtcaagaagtcggaagagagacctatgactgccgaggagctccgtgagagagagttcctcgagcgcaagcacaggaggaagaaactcgagaccgacggcaagttacccccgacagtctccaagaaggctccaagccagaaggagtccgtggggaccaagcttagcaagggctctggggacagacaccctagttctaaaggaatgccactcccacatgccgaaaagaagagccgcccatctatggccaacgagaaacacctcgctttgtccagctctaaatccatgcctggggaacgcatcaaggccggcagcggaaacagttcccaaccaagcctcagagaagggcacgacaaaccagtgtttaacggagccggtaaaccacactcgtccacctcgagtccaaagcacgtgtggaaggaaaacaaatacatgaagagggattggctgttttattttcagtgtatcgagtatatccgcctactctttattttctag

SEQ ID NO: 51138 - DNA, 2058 bp, Artificial Sequence
  Description of Artificial Sequence: Synthetic coding sequence
atggacttccgggagatcctgatgatcgccagcaagggccagggcgtgaataatgtgcctaaacggtactctttagctgtggggccccccaaaaaggatccaaaggttaagggtgtgcagtcggctgccgtgcaggcatttttgaagcgcaaggaggaggagctgcgccggaaagcgctggaggaaaagagacgcaaagaagagttggtgaagaagaggatcgagctcaagcatgataagaaagcgcgagccatggcaaagcgtaccaaggataacttccatggctacaacggcatccctatcgaggagaaatctaagaagcgccaagccaccgagagccatacttcccaggggaccgaccgggagtacgaaatggaagaggagaacgagttcttggaatacaaccatgctgaaagtgaacaggagtacgaggaggagcaggagccaccaaaggtagaaagcaagccaaaggtccctttaaagtctgctcctccccctatgaacttcacagacctcctcaggctggctgagaaaaagcagttcgagcccgtggaaattaaggtagttaagaaaagcgaggagcgccccatgacagccgaagaactacgcgaacgggagttcctggaaagaaagcacaggcggaagaaactcgaaacagatgggaaattgcccccaaccgtgtccaaaaaagcaccatctcaaaaagagtctgtgggaactaagttatctaaaggttccggagaccggcatccatcctccaaaggaatgccactacctcatgccgaaaagaagtctcgccctagcatggcaaatgagaagcacctggccctttcctcatccaaaagcatgccaggtgaacgtatcaaggccggctccggcaacagctcccagccttcattacgagaagggcatgacaaacctgtttttaatggagccgggaagccccactcttccactagctccccctccgttccaaagacaagtgcctccaggacacagaaatcagcagttgaacacaaggctaagaaatctttgtcccatcctagtcattcacgtccgggaccgatggtaaccccacacaataaagccaagtcgcccggtgttaggcagcccggctcctcaagttcgtccgctcctggacaaccctctactggggtcgcaaggcctacagtcagctctgggcccgtaccccgcagacaaaacggatcgtcttcgagcggacccgagcgcagcatcagcgggtccaaaaaaccaacaaatgactcaaacccaagccgtcggaccgtctccggcacttgcgggcccggccagcccgcctctagctctggaggtcccggcaggcccatttcaggcagcgtttcctctgcaaggccgctaggaagcagtcgcggcccaggaagacccgtgtctagcccacatgagcttaggcggccagtatccggccttggcccaccaggaaggtctgtgagcgggccaggtaggtcgattagtggttcaatacccgccggccgcacagtgtctaattccgtgcctgggcgtccagtgagctctttgggccccgggcaaaccgtgagctccagtgggcccacaatcaaacctaagtgtactgtcgtgagcgagaccatctcctccaaaaacatcatctcaagaagctccaatgggcagatgaatggcatgaagccccctctatcggggtatagagcagcacagggacctcagaggttgccattccctaccggttacaagagacagagggagtacgaagaggaagatgacgatgacgacgagtatgacagcgaaatggaagattttatagaagatgagggggagccccaagaagaaattagcaaacacatcagagaaatattcggctatgaccgcaagaagtacaaagatgagtccgactacgcccttaggtacatggaaagtagctggaaggagcaacaaaaggaagaagccaaaagcctgcgattggggatgcaggaagatctggaagagatgagacgagaggaggaggagatgcagcggcgtcgtgcgaaaaaactcaaacggagatag

SEQ ID NO: 51139 - DNA, 1488 bp, Artificial Sequence
  Description of Artificial Sequence: Synthetic coding sequence
atgcagtggagccccacccccggcgccagcgcctgcctgggctgggcatccagcctcgcatgctctactgctcctactctgttggggcgggcgggcagaggccctctgatggcagccaaatggttcaaagagttccccctcaacctcaagactgtatccgagagagccaaaccaggcggcggaggcggcaaacttagaaagaattcggaggccggaggcgccgggcccggacccggcaagggaaggaagaactctgctgcggagcttggcagcgggagagcaggcgtgggcccgaaagacagccgcctgagccgcgacagtcttcaaggcctcatccaggctgcagcggggaaggggcgcaaaaatagcagagccaccgaggaggaaccacatcgcggggctactaagagctcaggctgttctacctacattaacagattaattaaggttgacacacaggagaagaacggaaaaagcaattatccaagctcttcctcaagtagctcaagctccagcagttccgctagctcaagcccctcctctttgggacctgagcttgataaaggcaagatcatcaagcagcaagagacagtgataattttggaagactacgcagatccgtacgatgctaagagaactaagggtcaacgcgatgcggaaagggtgggggagaatgatggatacatggagccctacgatgcccagcagatgatcaccgaaattaggcggcgaggctctaaagatcctctggttaaagcgctgcagttgcttgactccccctgcgaacctgctgacggcggactcaagtccgagacattggccaaaaggcggtccagtaaagaccttctgggaaaacctccccagctgtacgatactccatacgagccggcagagggaggacctcgggcggaagggaaagctcggcccccagactccagacttcccgagaatgatgagcgcccggctgctgagtacgagcagccctgggaatggaaaaaagagcagatagtgcgggccctgtcagtccagttcgagggggccgaacgcccctctttccgggaagagacagtgcggcaacatcatagacagaaatcttggacgcagaagattctgaaaccggcattgtctgaccatagcgagggggaaaaagtggaccccggtctccccttggagaagcagccctggtaccacggcgcaatttccagggctgaggctgagagcaggcttcagccatgcaaggaagctggatacctagtcaggaactccgagtctggcaattctcggtattctattgctctgaaaacctcccagggctgcgtgcatattatcgtggctcaaaccaaagataataagtacacactgaaccagacctccgccgtgttcgacagcattcccgaggtggtgcattactattcaaacgagaagctgccgtttaagggggcagaacatatgaccctgctgtaccctgttcacagcaagctacactag

SEQ ID NO: 51140 - DNA, 1272 bp, Artificial Sequence
  Description of Artificial Sequence: Synthetic coding sequence
atgcagcaggagggcggccccgtgcggagcgccccctgccggaccggaactctggaggggagccgacagggaagcccaggacaccgcaagcgggcctccccaaaggggagcctgtcttctgcccagccccactcttggatgctgactcccagccccttgaattcacactgcgcccatagagagcctatttctagctcgccccaacccgtggctaatgggccaaagcaaaagaaaaaatccaattggaggtccactacaagactcaggattatccgcctcagagatcgcctggagccacgccccctcgccatactggaagactacgccgacccttttgatgttcaggaaaccggcgagggctcggcaggggctagtggggcaccggagaaagtaccggaaaacgacggatacatggagccttacgaggcgcagaagatgatggccgagattagaggtagcaaagagaccgccacccaacccctgcccctgtacgacactccttacgagccagaggaggacggggcgactgccgagggagagggggccccttggcctcgcgagtctcgactcccagaggacgatgaaaggccaccggaggagtacgatcaaccatgggaatggaaaaaggagagaatctctaaggccttcgccgtcgacattaaagtgatcaaagaccttccctggcccccaccagtcggccagcttgattcctccccaagcctccccgatggcgatcgcgacatatctgggcctgccagtccactgccagagccctctctcgaggattcatctgctcagtttgaaggtccagaaaagtcatgtctatctccgggcagagaagaaaaaggacgactgccccccaggctctccgccggcaatcctaaaagcgccaagcccctgagtatggaaccttcctctccactgggagagtggacagacccggctctgcctcttgagaaccaggtgtggtaccatggagcgatttcaaggacagacgccgagaacctgctacggctctgcaaggaggcatcttatctggtgaggaactctgagaccagcaaaaatgatttttctttgagtctgaagtcgagccaaggatttatgcatatgaaactcagccggacaaaggaacacaagtatgtcctgggccagaactcgccccccttcagcagcgtcccagaaatcgtccatcactacgcatcacgaaagttgccaatcaagggtgctgaacatatgtctttactctatccagtggcaatcagaaccctgtag

SEQ ID NO: 51141 - DNA, 1302 bp, Artificial Sequence
  Description of Artificial Sequence: Synthetic coding sequence
atggtggcccagagcctgagcgacgcccaccacgccctgaccatcatgctcagcgagagactctggctgggtcttgagctgctgaattttactcgacggaagatatcaagcgatccccctccctataacttcctggaggccagagaagccgcccttggtcatagatggagaatgcagcaggaaggcggcccagtgaggagtgcaccctgcagaaccggaacattggaaggttcccggcagggatctcccgggcaccgcaagcgcgcttcccctaagggaagcctgtcatccgcacagcctcattcctggatgcttaccccttcccctcttaacagtcactgcgcccaccgggaacccataagctcttcgcctcagcctgtggccaacgggccgaagcaaaagaaaaagtctaattggaggtccacgactaggcttaggattattaggctgagggaccgccttgagccgaggcccttggcaatcctagaggattacgctgatccattcgacgtgcaggagaccggggagggaagcgcgggagcttctggagcacctgagaaggtgcctgaaaatgacggatatatggagccatatgaggcccagaaaatgatggcagaaatcagggggtcaaaagaaacagctactcagcccctccctctgtacgataccccatacgagccagaggaggacggcgccaccgccgagggagagggcgctccatggcctagggaatcccgactgcctgaagatgatgagcggcccccagaggaatatgatcaaccatgggagtggaaaaaggagcggatctcgaaggctttcgctgcacaattcgaggggcccgagaaatcttgtttgagccccgggagggaggagaaagggagactaccacctaggttaagcgctggaaatccaaagagcgccaagccgctctctatggagccaagtagccctctcggagagtggacggatccagcccttcccctcgagaatcaggtttggtaccacggcgctatttccaggaccgacgctgagaatttattaaggctgtgcaaggaagcgagttatctggtgcgtaatagtgagacgtctaagaatgactttagtctatcgttaaagagcagtcagggttttatgcacatgaagctgagtcgaactaaggagcataaatatgtgttggggcagaactcaccaccctttagctctgtgcccgagatcgtgcaccactatgcaagtaggaagctacccatcaagggagccgagcacatgtccctgctgtaccctgtcgctatacgaaccctgtag

SEQ ID NO: 51142 - DNA, 1110 bp, Artificial Sequence
  Description of Artificial Sequence: Synthetic coding sequence
atgcagcaggagggcggccccgtgcggagcgccccctgccggaccggtacattagaggggtcaaggcagggatcccccggtcatcggaagagagcttcccccaaaggctccttatcttccgcacagcctcattcatggatgctgacgccctctccactcaacagccactgtgcacaccgggagcctatctcctcgtcaccacagccggtagctaacggcccaaaacagaaaaaaaagtcaaattggcgctccaccactagactccggataatacgacttagggacaggttggaaccccggccactggccatcttggaggattacgctgatcctttcgatgtgcaggagacaggcgaaggaagtgccggcgcaagcggcgcccccgaaaaggtcccagaaaatgatgggtacatggaaccatacgaggcccagaaaatgatggcagaaattcgagggagcaaagaaacagccacgcagccattgccgctgtacgacaccccatacgaacccgaagaagacggcgccactgctgaaggcgaaggggcgccatggccccgcgaatcgcgccttccagaggatgatgagcgcccgccagaggagtacgatcagccatgggagtggaagaaggagaggattagtaaagcgttcgccgttgatataaaggtcattaaggatctaccctggcccccgcccgttggtcaattggactctagtccatccttgcctgacggagaccgtgatatcagtgggcccgcatctcccctgcctgaaccatcgctggaagattcaagcgcccagtttgaaggaccagaaaagtcctgcctgagtccgggccgcgaagagaaaggaagactcccccctcgcctcagtgccggcaaccccaagagcgccaagcccttgtcgatggagccatccagtcctctgggggagtggactgatccagcgttgccactggagaatcaggtttggtaccacggcgctatctcacgaacagacgcggagaatctgtccgggtgtgcaaagcgcccagcaacatggtgcgcaactgtcaggcccgccagaatgacgtctccctctccttctagagccgcacgcgactcctgtacttag

SEQ ID NO: 51143 - DNA, 1101 bp, Artificial Sequence
  Description of Artificial Sequence: Synthetic coding sequence
atgctgctgagcggcgccccccccgccgccccccccgccccccccccggacatcctcgccgcctaccgccttcagcgcgagcgggattttgaggacccatactctggcggctcctcgggtagtgctgcattagccactccagtcgcccctggccctactccacctccgcggcatggatctccccctcatcgcctcatcagggtggaaactccaggtccacctgctcctcctgctgatgaaagaatcagtggcccgcccgcgtcctcagaccggctcgccatccttgaagattatgccgaccccttcgatgtacaagaaacaggagagggcagcgccggagccagcggcgcccccgagaaagtgccagagaacgacgggtacatggagccctatgaggcacagaaaatgatggccgagatcaggggctcaaaggagaccgcaacacagcctctgccactgtacgatacaccatatgaaccggaggaggatggagcaactgccgaaggtgagggggccccttggccccgtgagtcgcgcctacctgaagatgatgaacgccctcctgaggaatacgaccagccgtgggagtggaagaaagagcgaatatctaaggcattcgcagcacagtttgaaggaccggagaagtcatgcctctccccggggagagaggaaaagggaagactgcctcctcgactgtccgcagggaaccccaagagcgcaaagcccctgtccatggaaccatcttctccgttgggcgaatggacggaccccgcgttacctcttgagaatcaagtctggtatcacggcgccatttctcgcactgacgccgagaatctgctgcgactctgcaaggaagcttcttacttggttaggaacagcgagaccagcaagaacgacttttccctgtcgctgaaatcctcacaggggttcatgcacatgaaactgagcagaacaaaggaacataaatacgtgctcgggcagaatagtccaccattctcttccgtgcccgagatcgttcaccattacgcctccaggaaactgcccattaagggagccgagcatatgtcactgctctatcctgtggccatccggaccttgtag

SEQ ID NO: 51144 - DNA, 690 bp, Artificial Sequence
  Description of Artificial Sequence: Synthetic coding sequence
atgaccccccagctgctgctggccctggtgctgtgggccagctgcccaccatgttccggtaggaagggcccccccgctgccttgacgctccccagggtccaatgcagagcaagccggtaccctatagccgtagactgtagctggacactgcccccggctccaaatagcacatcccctgtaagcttcatcgccacataccggttagggatggctgcaagaggccactcgtggccctgtctccagcagactcctacatccacgagctgcaccattaccgacgtgcagctattcagcatggccccttatgtgttgaatgtgaccgccgtacatccatgggggagcagttcctccttcgtgcccttcattaccgagcacatcatcaagcctgatcctccggagggcgtgcgactgtctccacttgctgaacggcaacttcaagttcagtgggagcctcccggcagttggccctttcctgagattttcagcctcaagtattggatccggtataagcgccagggtgctgcgcggtttcatagggtaggccctatcgaggctacatcatttattttgagggccgtgcggccgcgcgcaagatattacgttcaggtggctgcccaagatcttacagactatggcgagttatccgattggagcctaccagccaccgctactatgtctctggggaaatag

SEQ ID NO: 51145 - DNA, 1023 bp, Artificial Sequence
  Description of Artificial Sequence: Synthetic coding sequence
atggccaagtggctgcgggactacctgagcttcggcggccggcggcctcctccccagcccccaacacccgattataccgagtcagacatactgcgcgcctaccgcgcgcaaaaaaatctcgatttcgaagacccatacgaggacgctgagagccgcctggaacccgaccctgcgggtcccggggattcgaagaacccaggggatgctaagtatgggagccccaaacacaggctgatcaaagttgaagccgccgacatggcgcgagccaaggctcttctgggaggccccggggaagagctggaggctgacaccgaatacctcgatcccttcgacgcacagccacaccctgctccgcctgacgacggatatatggagccttacgacgcacagtgggttatgagtgagctgcccggacgtggtgtgcagctctatgacaccccttatgaagagcaggatccggagactgctgacggcccaccttcaggccaaaagcctaggcagtccaggatgccacaggaggatgaacgcccggctgatgaatatgaccagccgtgggaatggaagaaagaccatatttccagagcgtttgccgttcagtttgattccccagaatgggagcgcaccccaggcagtgctaaggagctgcgtaggccaccgccgagatctccccagccagcagaacgcgttgacccagcattgccattggagaagcaaccatggtttcacggcccgctcaatagggcagacgctgaaagcctgctgtcgctctgtaaagagggctcctacctcgtgcgcctgagcgagacaaacccacaggactgctccctgagtctgcgcagctcacagggcttccttcatctgaagttcgcccggaccagagagaaccaagtggtgttaggccagcacagcggcccgttcccgtctgtgcctgagctggttctgcattactcctcccgccctcttccggtccagggggctgagcatttagccctgctgtaccctgtcgtaacacagacgccatag

SEQ ID NO: 51146 - DNA, 3552 bp, Artificial Sequence
  Description of Artificial Sequence: Synthetic coding sequence
atgggcaacgcccccagccaggaccccgagcggagcagcccccccatgctctctgcagacgacgccgaataccctcgtgaatacagaacattggggggcggcggggggggagggagtggcggcagacgtttcagcaatgtcggcctggtgcatacctctgagaggaggcacacggtgattgccgcccagagccttgaggccttatctgggctgcagaaagctgacgcagatcgcaagagagatgcattcatggaccacctgaagtcaaagtacccacaacacgcgcttgctctgcgcgggcaacaagatagaatgcgtgagcagccaaactactggtcctttaaaacgaggagttctcggcacactcagggtgcccagccaggtttggcagatcaagccgccaaactctcatatgcatccgccgagagcctggagacaatgtcagaggcagaactgcctctggggttttccagaatgaacaggtttcgacagagcctgccactgtctaggagcgcttcgcagacaaagctccgttcacctggagtcctattcctgcaatttggggaagagactcgccgggtccacattacccacgaggtcagcagtctggacacgcttcacgctctgatcgcacacatgtttccacagaaacttacaatgggtatgctgaaaagcccaaatacagctatcttaatcaaggatgaggcccggaatgtgttttatgagcttgaggacgttcgggatatccaggaccggagtatcataaaaatttaccgcaaagaacctctgtatgcagcattccccggaagccacctgacgaatggagatctgcgccgggaaatggtttacgccagcagagagagcagcccaacacggcgcctcaataatttgagtccggcccctcacctggctagcgggtcccccccaccagggttgccttctggcctcccatctggactccaatctggcagcccgagtcgaagtcgcctgtcctacgcaggcggtcgtcctccctcctacgctggttctcctgtccatcatgcagccgaaaggttgggaggggcacctgcagcccagggggtgtccccctcaccttccgcaatattagagcggcgcgatgtgaaacccgacgaggacttggccagcaaggcaggaggcatggtactggttaagggcgagggcttatacgccgatccctacggccttctccacgaggggcgcctgtctcttgccgcagcggccggcgacccctttgcttatcctggcgcagggggattatataaacggggctccgtccgctctttaagcacctacagcgctgccgctctgcagtctgatctggaagattctctgtacaaagccgcgggcgggggtggaccactgtatggcgatgggtatggttttcgcctgccccctagcagcccccagaagctggcagatgtggccgccccccccggcgggccccctcctcctcactcaccttactcagggccaccctcccgcggctctcccgtgaggcagtcctttcgaaaagattctggaagcagttccgtcttcgcagaatcccctggcgggaaaaccagatccgctggcagcgcatctaccgccggagcaccccctagtgaactattcccaggcccaggcgaacgatctctcgtaggattcggcccccctgtgcctgctaaggatactgagaccagagagcgcatggaggcaatggaaaagcagattgcctcccttaccggactggtgcagagcgcgctgctgaggggctctgaaccagaaacaccgtctgaaaaaatcgagggtagcaatggtgccgctacaccaagtgccccctgtgggtcaggaggtagaagctccggggcgactccggtgtctggacccccacctccgagcgccagttcaactcccgcaggtcagccaactgccgtaagccggctacagatgcagcttcaccttaggggcctgcagaactccgccagtgatctgcgcgggcagcttcagcagctacgaaaactgcagctgcaaaatcaagagtcggtcagggcactgcttaagagaacagaggccgagttgagcatgcgcgtgtcagaggctgcccggagacaggaggaccctcttcaacggcagaggactctggttgaagaggagagactaagatatttgaacgacgaagaactgataacccagcagcttaacgatctcgagaaaagcgttgagaagattcagcgagatgtctcccataaccatcggctcgtgccaggcccggagttggaggaaaaagcattggtccttaagcagctgggagagactctgaccgaactgaaggcccacttccccggactgcaatcaaagatgagagtggtcctgagggttgaagttgaagcagtcaaattcctgaaagaggagccacagagactcgatggtctgctcaaaaggtgccggggagtgactgacacgcttgcccagatccggcgccaggtggacgagggtgtgtggccaccaccaaataacctgctgtcccagtcccccaaaaaggtgacagccgaaaccgactttaacaaatcagtcgatttcgagatgccccctcccagccctccactgaatttacacgagctctccgggccagccgagggggctagtctgactcccaagggaggcaatcccacaaaggggctggacacacccggcaagcgctccgtggataaggcagtttccgtcgaagctgccgagcgtgattgggaagagaagagagccgccctgactcagtactcggccaaagatataaataggctgctagaagagacccaagcagagctcctcaaggccatcccggacctagactgtgcttctaaagcgcaccccggccccgcccccacccccgaccacaaaccccctaaggctccccatggccagaaagcggcacctcgtacggagccttcaggccgaagggggagcgacgagttgacagtgccccgttaccgcacagagaagccgtcgaagtcccctccacctcccccacctaggaggtcattcccttcttcacatgggttgaccacgacccggaccggtgaggtagttgttacctccaagaaggatagcgccttcattaagaaggccgaaagcgaggagttggaggtgcagaagcctcaggtgaagctgagacgtgccgttagcgaagttgctaggccggcttccacccctccgattatggcatctgccattaaagatgaggacgacgaggaccgcatcatagccgagctcgagagtgggggcgggagcgtgccccctatgaaggtggtgacacccggtgccagcaggctgaaagcagctcagggtcaggccggaagtccagataagtcaaaacatggcaaacagcgggcggagtacatgcgcatacaggcacagcagcaggctacaaagccctccaaggagatgagcggatccaatgagacgtccagcccggtgtccgagaagccctcagctagtcgaacatctatcccagtcttaactagcttcggggcgagaaactcctccatcagtttttag

SEQ ID NO: 51147 - DNA, 3108 bp, Artificial Sequence
  Description of Artificial Sequence: Synthetic coding sequence
atgagcgaggccgagctgcccctgggcttcagccggatgaaccggttccgccagtccctgcctctcagtcgtagtgcctcacagacaaagctgcgcagccccggcgtcctgttcctacaatttggggaggagacacggagagttcatatcacacacgaggttagctctcttgacacactgcacgcccttattgctcacatgtttccacagaagctcactatgggaatgctgaaaagccccaatactgcaattctgatcaaggatgaagcccgaaacgtgttctacgagctggaggatgttcgggatatccaggataggtcaatcattaagatctaccgcaaagaacccttgtatgccgctttcccaggtagccatctcacaaatggggacttgcgccgcgaaatggtttatgcctccagagagtccagtcctacccggagacttaataacctgtctcctgcccctcatctcgcttcggggagccctcctcccggccttccatctgggttgccatcgggcttgcagagcggttcacctagtcgctcccgtctatcttacgctgggggccggcctccttcctatgccgggtcccctgtacaccacgccgctgagcggcttggtggcgctcccgccgcccagggggtgtctccatccccgagcgccattttagaaaggcgagatgtaaagccagacgaagacctggcttcaaaagccggtggaatggtcttagtgaaaggtgaggggctctatgccgacccatacggacttctacatgaaggccggctctccctcgccgctgccgctggtgatcccttcgcatacccaggggccggaggattgtacaagagaggatccgtccgttcattgagcacttactcagccgccgcgttgcaaagcgatcttgaggacagtttgtacaaagctgcagggggcgggggccccctgtacggggacggctatggcttccggctaccgcctagtagccctcagaaactggcggatgtcgccgcgcccccaggcggtcccccgcctccccacagtccatactctggtccaccctctcgcggatcaccagtgaggcaatcgttccgcaaagattccggctcttccagtgtattcgcagaatctcccggtggcaagacccgttccgctggtagtgcctcaaccgcaggtgcacctccaagcgaactctttcccggacccggggaacggagcctggtgggcttcggtccacccgtccccgcgaaggacacggagaccagggagcgcatggaggcaatggagaaacaaattgcctccctcaccggactcgtccaatcggctcttctgcgtggaagtgagcccgagaccccttccgaaaaaatagagggttccaatggagctgccaccccttccgccccctgcggaagtggcgggcgatcctccggcgctacccctgtgagcggtccacccccaccatcggcgtcatccactcctgctggacagccaactgcggtgagtcgtcttcagatgcagcttcacctgcggggtctgcagaactcagcatccgacctgcgggggcagctccaacaattgcggaagcttcaactgcagaatcaagagagcgtcagagcactgctcaagcgcacagaggccgaactgtcaatgagagtaagcgaagccgctcgcagacaggaggacccactgcaacggcagagaacactagtggaggaagaacgactccggtacctgaacgacgaggaactcattactcaacagctgaacgacctggagaagtccgttgagaagatacagcgcgatgtgagccacaaccatcgtctggtgcctggccctgagcttgaagagaaggctctcgtgttgaaacaactgggtgaaacgttgaccgaactgaaggcacatttccccggccttcagagcaagatgcgcgtggttctaagagttgaagttgaggccgtaaaattcctcaaggaggagcctcagaggctcgacggcctgctaaagcgttgcaggggcgtcactgacactcttgctcagatcaggcgtcaagtggatgagggagtgtggcccccacccaataaccttctgtcacagtcaccaaaaaaggtgactgctgaaacggacttcaacaaatctgtggacttcgaaatgcctcctccaagcccgcccctcaatctacatgagctgtccggacccgcagaaggggccagcctcacacctaagggaggtaaccctaccaagggtcttgacaccccaggcaagcgaagcgtggataaagccgtcagcgttgaggcagcggagcgagactgggaagagaaaagggctgcactcacacaatattccgccaaagatataaatagactcctggaagagactcaggccgagctgctgaaggccatacccgacctcgactgtgctagcaaagcccatccaggcccagcccctactccggatcataaaccccccaaggcgccccatggacagaaggcggctccacggacagagccatccgggcgtaggggttccgatgaattgacagttcctcgctatagaaccgagaagccttccaagagtcctccaccaccacccccaagacgctccttcccatccagccatggacttacaactacccgcactggggaggtggtggtgaccagcaaaaaggattccgcatttattaaaaaggccgagtcagaggaactggaagtccagaagcctcaggtgaagctgaggcgggcggtttctgaggtagccaggccagccagcaccccgcctatcatggcctctgctatcaaagatgaagatgatgaggaccgtatcatcgcagagctagaggtgttcgagcgaagcagtgtatcttccctgcccccaaccccccggcgtcagctgattccgacactcctgagccctcaggacctcggcccccccggtggctccgcccctggacctaccagaaaatctgggggaggcagcgtgccccccatgaaggtggtaactccaggggccagccgtttgaaagctgctcaggggcaagccgggagccccgacaagtcaaaacacgggaagcaaagggccgagtatatgcgcattcaagcacaacaacaggtttag

SEQ ID NO: 51148 - DNA, 2766 bp, Artificial Sequence
  Description of Artificial Sequence: Synthetic coding sequence
atgggcatgctgaagagccccaacaccgccatcctgatcaaggacgaagcccggaatgttttctatgaactcgaggatgttcgtgacattcaagatagatcaatcataaaaatctacagaaaagagccattatatgccgcctttcccgggtcccatctgaccaacggcgatctgcggcgagaaatggtatacgcaagtagagaatctagtcctactcggagattgaataacctatcccccgctccccacctggcttctggctcccctccgcctggtctgccctcaggactgcccagcggacttcagagtggatctccttcacggagtagactgagctacgcagggggaagaccgccatcttacgccggctcgcctgtgcaccatgccgccgagcgcttgggcggtgctcctgccgctcagggcgtgtcccctagtcctagtgctatcctggagaggagagacgtgaaacccgacgaagatctggcatctaaggctggaggaatggtgttggtaaagggcgaggggctatatgccgatccctacgggcttctccacgagggtcggctgtcccttgccgccgccgctggggatcctttcgcctatccaggtgcaggaggattatacaaacgggggagtgtgaggtccctcagcacctattcagcagcggctctccaaagtgatcttgaggattctctctataaggcggccggcggaggaggaccgctgtatggagacggttacggctttcgcctcccccccagctcacctcagaaacttgcagatgtggcagcccctcccggaggacctccccccccccactctccatactctggacctccatctcggggaagtcctgtacggcagtcgttcaggaaagatagcggcagcagctcagtgttcgctgaatctcccggcggcaagaccaggagcgccggctcggcgtctacagcaggagccccccccagcgagctgttccccggacctggtgagcggagtcttgtcgggtttgggccaccagttcctgcaaaggacaccgaaacccgtgagagaatggaggctatggaaaagcaaatcgcctctcttactggcctagttcagtctgcgctgctccgagggagtgagccagagacacctagcgagaagatagaaggcagcaatggagccgccaccccctctgcaccatgcggaagcggaggcagatcgagtggagcaacccccgtttccggtccacccccaccaagcgcgtcatccacaccagctggccaacccaccgccgttagtcggctgcaaatgcagctccacttgcgggggctccaaaactctgctagtgacttgaggggacaactgcagcagctcagaaaacttcagctgcagaatcaggaatccgtgcgtgcccttttaaaacgcactgaggctgagctgtcaatgagagtgtcagaggctgcgcggcgccaagaggatcctctacaacggcagcggactttggtggaggaagagcggcttcggtacctgaatgacgaggagctgattacccaacagttgaatgaccttgaaaagagcgtcgagaagatacagcgagatgtttcccacaatcatcgactggtgcccggtccagagctagaggagaaggccctcgtcttgaagcagttaggggagacactgaccgaacttaaggctcattttccaggactgcaaagtaaaatgcgtgtcgtgttacgggtcgaggtggaggcagtgaagtttttaaaggaggagccgcagaggctggacggcctgctgaagagatgccggggggtcactgacactctggctcagatccggagacaagtggatgagggggtatggccccccccaaataatctgttgagccagagccctaagaaagtaaccgcggagactgactttaataaaagcgtggatttcgaaatgccacctccaagcccaccgctgaatttacacgagctttctggccccgccgagggagccagcctgaccccaaaagggggtaatcctaccaagggcctggacacccctggaaaacgttcagttgacaaagctgtgagcgtggaggcagcggagagggactgggaagaaaaacgtgccgcgctcacacagtattccgctaaagacatcaaccggttgctggaggagacacaagctgaactcttaaaggcgatcccagacctggattgcgcgagcaaggcacatcccggccccgcccctacaccagatcacaagcccccaaaggcacctcatgggcaaaaagctgcacctagaaccgagccttctggccggcgcggttccgacgaactgaccgtgcctcgatacaggacagaaaagccttccaagtctcctccacctccccctcctcgccggtccttcccgagctcccacggactcaccactaccaggacaggagaagtggtagttacttccaaaaaggattctgccttcataaagaaggctgaatccgaagaacttgaggtacagaagcctcaagtgaaactaaggcgtgcagtgtctgaggtagcacgcccagcgagcaccccgcctataatggcttccgccattaaggatgaggacgatgaggaccgcattattgcagagctggagagtggggggggatctgtccctcccatgaaggtggtcacccctggcgcctcccggctgaaggccgcacaaggtcaagcaggctctccggataagtcgaagcatgggaagcaacgagccgaatatatgagaattcaggcccaacaacaggtttag

SEQ ID NO: 51149 - DNA, 1356 bp, Artificial Sequence
  Description of Artificial Sequence: Synthetic coding sequence
atggtgagccgggaccaggcccacctgggccccaagtacgtgggcctgtgggactttaaaagcagaacagacgaggaactgagctttcgggctggcgacgtgtttcacgtggcccggaaagaggagcagtggtggtgggctaccctgctggatgaggctggcggtgccgtggcacaaggatatgttccccataattacctcgccgaaagggagaccgttgagtctgaaccctggttctttgggtgcatatccagatctgaagcggtgagacgcctgcaagccgagggcaatgccaccggagcctttctgattcgagtaagtgagaaacccagcgcagactacgttctgagtgtccgagatacacaagccgtgcgccactacaagatctggcggcgggcaggcggtcgtcttcatctgaatgaagctgtgtctttcctgagcctacctgagttagtgaattaccacagagcgcagagtctcagtcatggcttaaggcttgcagccccctgtaggaaacacgaacccgagcctctcccccattgggacgattgggaacgtccaagggaggagttcaccctctgcaggaagctgggatccggatacttcggcgaagtgtttgagggattgtggaaagacagagtccaggtggctattaaggtgattagccgcgacaacctgctacatcagcagatgttacagtccgagatacaggccatgaagaaactacggcacaaacacatactggcactctacgccgttgtgtcagtcggagaccccgtctacatcatcaccgaactcatggccaaaggctctctgctggaactgctgagggactcagacgaaaaggtgctccccgtcagcgaactgttggatatcgcctggcaagttgccgaaggcatgtgttacctggagagccagaattacattcaccgggatctggcagcccgcaacattctggttggcgagaacacactttgtaaagtcggagatttcggtttggctagactgataaaagaggacgtgtacctgagccacgatcacaacatcccatacaagtggacagcaccagaagcactgagtaggggacactattctacaaagtccgatgtgtggtctttcggaattctacttcatgagatgttttccagggggcaagtgccatatcctggcatgtccaatcatgaggcgtttttgagggtggatgccggctaccggatgccgtgtccactggaatgtcctccatcagtccacaagctgatgttgacctgctggtgccgagatcccgagcagagaccctgctttaaagcccttcgagagaggctatccagtttcacctcatacgaaaaccctacctag

SEQ ID NO: 51150 - DNA, 468 bp, Artificial Sequence
  Description of Artificial Sequence: Synthetic coding sequence
atggccgtgcccggctgcaacaaggacagcgtgcgggccggctgcaaaaagtgcgggtatcctggacacctcaccttcgagtgccggaatttcctgcgggtggatcctaagagggacattgtgctcgacgtgtcttccacatcctccgaagactcggatgaggaaaatgaggaactgaataaactgcaggcattgcaggaaaaaagaattaatgaggaggaggagaagaaaaaagagaagtcaaaggaaaagatcaagctgaagaagaagcgtaaacggagctatagtagctcgtcgaccgaagaggacactagtaaacaaaaaaagcagaagtaccagaagaaagagaaaaagaaagaaaagaaatccaagtctaagaagggaaagcaccacaaaaaagagaagaaaaaaaggaagaaggaaaagcacagttcaacccccaacagtagcgaattttcccgtaagtag

SEQ ID NO: 51151 - DNA, 1704 bp, Artificial Sequence
  Description of Artificial Sequence: Synthetic coding sequence
atgagcgccagcaccggcggcggcggcgacagcggcggcagcggcggaagctcctcatcttcgcaagcatcctgcggccccgagtcaagcgggagcgaattagctctggctacccccgtaccccagatgttgcaggggttgctcggaagcgatgatgaggagcaggaggatccaaaagactactgcaagggcggttaccaccccgtgaaaataggcgatgtgtttaacggacggtatcatgtggtgcgtaagctgggttgggggcacttctcaacggtctggctgtgctgggatatccagagaaagcgcttcgtggcgttaaaggtggtgaaatccgctggccactataccgaaaccgccgtagacgaaataaaacttctgaagtgcgtgagggactctgacccgtccgatcctaagcgggaaaccatcgtccagctgattgatgattttagaataagtggcgtaaatggcgtacacgtctgcatggttctagaggtgctcggccaccagctgctcaagtggattatcaagtccaactatcagggcttgcctgtaccatgtgttaagtccattgtgcgccaggtactgcacggcctagactaccttcatactaagtgtaaaattatccacaccgatatcaaaccagagaacattttgctgtgtgtgggggacgcctatattcgacgccttgctgcagaggcgactgaatggcaacaagcaggagcaccccccccctcccggtctatcgtcagtactgccccacaggaggtgctgcagactggaaagttgtcaaaaaacaaacgcaagaaaatgcgaaggaagagaaaacagcagaagcgactgttggaggagcggctgcgagacctgcaacgcctggaggcgatggaggcggctacccaggcggaagactccggattgcgcctggatggcgggtccgggtcaacctccagctcaggctgtcacccaggcggggctcgggccgggccttccccggcttcgagttcccctgcccccgggggtggaagatccctgagcgccggctcacaaacgtcaggtttcagcggatccctgtttagcccagcctcatgctccatcctcagtggctcaagtaatcagagggagaccggaggcctactctctccgagtacccctttcggcgcctctaaccttctggtgaatcctctcgaaccccagaacgcggataagatcaaaatcaagattgctgacctgggcaacgcttgttgggttcataaacactttactgaagacatacaaactaggcagtatcgtgcagttgaggtcctcattggggccgaatatggcccacccgccgacatctggtctacagcttgcatggcttttgagctggcaacgggcgactacctttttgagccacatagcggcgaggattatagccgggacgaggatcacatagctcatattgttgaactcctgggggatatcccaccagcatttgcgctgtctggccggtactcaagggaattctttaaccgtaggggagaacttcgacacatccacaacctcaaacattggggtctgtatgaagtccttatggaaaagtatgaatggcccctggaacaggccactcaatttagcgcgttccttctcccgatgatggaatatatcccggagaaacgtgcctccgcggcggattgtctgcagcacccttggctgaacccctag

SEQ ID NO: 51152 - DNA, 1602 bp, Artificial Sequence
  Description of Artificial Sequence: Synthetic coding sequence
atgagcgccagcaccggcggcggcggcgacagcggcggcagcggcggtagcagcagctcttcccaggcctcatgcggaccggagtcaagtggaagcgaactcgctcttgccacacctgtgcctcagatgctgcagggcctgttggggagcgacgatgaggagcaggaagaccctaaggactactgtaaaggggggtatcatcctgtgaagattggggacgtattcaatggccgatatcacgtcgtgaggaagctaggatggggtcactttagtactgtctggctctgttgggacatccagcggaagcgcttcgtggctctgaaagtcgtcaaaagcgctggacactacactgagacggccgtggatgaaatcaaattgttgaagtgtgtgcgggattccgacccttccgacccgaagcgcgagaccatcgtgcagctcatcgacgactttagaatcagcggggtcaatggagtgcacgtctgtatggtcttggaggtgctgggacaccagctgctgaaatggatcatcaagtccaactaccagggtctgcctgttccctgtgttaaaagcatcgttcggcaggtgctccacggattggattatctgcacaccaaatgcaagatcattcatacagacatcaagcctgaaaacattctgttgtgtgtgggtgacgcttatatacggaggctggccgctgaggcaacagaatggcagcaggcgggcgctccccctccaagtcgaagtatagtatccacagcgccacaggaggtgctgaccggcaaactttccaaaaataagcggaaaaagatgaggcgaaaaaggaaacaacagaagaggctgttggaagagaggctgcgggatcttcagcgcctagaggcgatggaggcagccacccaagccgaggacagcgggctgagactcgatggaggaagcggttcgacctctagttcagggttcagtggcagcctgtttagccccgcatcatgcagtatcttatccggcagcagcaatcaacgagagactgggggactgctctccccatccactcctttcggcgctagcaacctcctggtcaacccactcgagccccagaacgctgacaaaatcaaaatcaagattgcagatctaggcaacgcttgttgggtacacaagcactttacagaagatattcaaactcgtcaataccgggctgtggaagtactaattggggctgagtacggtcctcccgctgacatatggtccacagcctgcatggccttcgagctggcaactggagattacttattcgagccacattcgggggaagactacagtagagatgaggaccacatagcccacatagtggagttattgggcgatatccctcccgcattcgcgctgagtgggaggtacagccgcgagttttttaaccgccgaggcgagctccgtcacattcacaatctgaagcactggggcctctacgaggtgttgatggagaaatacgagtggcccctcgagcaggcaacccaattttccgccttcctgttgccaatgatggaatacatccctgaaaagcgtgcgtctgccgcagactgcttgcagcatccttggctgaatccatag

SEQ ID NO: 51153 - DNA, 120 bp, Artificial Sequence
  Description of Artificial Sequence: Synthetic coding sequence
atgaccggcttcttcaagggcgccgaggaccggtacagcagccacttgtggcgacctcaagggggacctaggagcaaaggaccggggccaaggtcatggaacacagagtccctccgatag

SEQ ID NO: 51154 - DNA, 1023 bp, Artificial Sequence
  Description of Artificial Sequence: Synthetic coding sequence
atggtgaccctgcggaagcggaccctgaaggtgctgaccttcctggtcttgtttatctttctgacaagtttcttcctaaactattcccatacgatggtggcaaccacttggttccccaaacaaatggttttggagctgagcgagaacctaaaacgactgatcaagcaccggccctgcacttgcacccattgcatcggtcagaggaaactgtcggcttggttcgatgaacggttcaaccagactatgcagccattgctgaccgctcaaaatgctctgctggaagacgatacttaccggtggtggcttcgccttcagagggaaaaaaagccgaataacctgaacgacactatcaaagagttattccgtgtcgtgccaggcaacgttgacccaatgctggaaaagaggagtgtcggttgtcgcagatgcgccgtcgtaggaaattccggaaatctgcgggaaagttcctacggccctgagatcgacagccatgatttcgtactgcggatgaacaaggccccaacagcaggcttcgaagctgacgtcggtaccaagacaacacaccacctggtgtatcctgaatccttcagggagttaggggataatgtgagcatgattttggtgccttttaagacaattgacttggaatgggtggtgtccgctattactacgggcactataagtcatacttacattcccgtgcccgcaaaaatacgcgtgaaacaggacaaaatcctcatttatcaccctgcttttataaagtacgtgttcgacaactggctgcagggtcatggacgctacccttccaccggtatcctgtccgtcatattcagcatgcacgtctgtgacgaagtggatctgtacggatttggcgccgattccaaaggtaactggcaccattattgggaaaataatccatccgccggagcattcaggaaaaccggtgtgcacgacgcagacttcgagagtaatgttactgctaccctcgcgagcataaacaagatccgaatttttaagggtcggtag

SEQ ID NO: 51155 - DNA, 1023 bp, Artificial Sequence
  Description of Artificial Sequence: Synthetic coding sequence
atggtgaccctgcggaagcggaccctgaaggtgctgaccttcctggttctcttcatatttttaacatcattctttctgaactattctcacacaatggtggccaccacatggttcccaaaacagatggtactggaactctctgagaacttgaagagactgattaaacaccgtccttgcacctgcacacactgcattggccagaggaagctttcggcctggtttgacgagcggtttaatcagacaatgcagcccctattgacggcgcagaatgccctgctggaggatgacacctaccggtggtggctgcgattgcagcgcgaaaagaagcctaataacctgaatgacacgattaaagagctgttccgtgtcgtgccaggtaacgtcgatccaatgttggaaaaaaggagcgtgggatgtcgacggtgcgctgtggtcgggaactcgggaaatctgagggagtcatcttatggtcctgagattgactcccacgactttgtcctcaggatgaataaagcgccaacagccggattcgaggcagacgtgggcaccaaaactacccaccacctcgtctaccccgaaagttttcgcgagctcggcgacaatgtgagcatgatcctggtgccatttaagactatcgacttagaatgggtagtttccgccatcaccacaggtacaatcagtcatacttacattccagtccccgccaagatcagagtcaagcaggataaaattctgatctaccatcctgcattcatcaaatacgtttttgataactggcttcaggggcacggtcggtaccctagcaccgggatcttatcagtgatcttcagcatgcacgtgtgcgacgaggtcgatctgtacggtttcggggcggatagtaaaggtaactggcaccattactgggagaataacccatcagccggtgcttttcgcaagacaggagtgcatgatgcggactttgagagcaatgtgactgctactttggctagcatcaataaaatccgcatattcaagggcaggtag

SEQ ID NO: 51156 - DNA, 150 bp, Artificial Sequence
  Description of Artificial Sequence: Synthetic coding sequence
atggtgaccctgcggaagcggaccctgaaggtgctgaccttcctggtactgttcatatttctaacctcattctttctgaattatagccatactatggtcgcaacaacgtggttcccaaaacagatggtgctcgaattaagcgaaaattag

SEQ ID NO: 51157 - DNA, 1023 bp, Artificial Sequence
  Description of Artificial Sequence: Synthetic coding sequence
atggtgaccctgcggaagcggaccctgaaggtgctgaccttcctggtgctgtttattttcctgacatcgttctttctgaactacagccataccatggtagcaactacctggttccccaaacagatggtcctggagctctccgaaaatctgaagagattaattaagcataggccatgcacatgcactcattgcattgggcagagaaaactttcagcatggtttgatgagcgattcaaccaaactatgcagccactcctcaccgctcagaatgctttactggaagatgatacgtatcgctggtggctcagattacagcgagaaaagaagcctaacaacctaaatgatacgatcaaggagctgttccgcgtggttcctgggaacgtagatcccatgctcgaaaaaaggagcgtaggctgtcgcaggtgtgcagtggtaggcaactccggaaacctcagggagtctagttacggtcctgaaatagactcccatgactttgtgcttaggatgaataaagctcccaccgcgggcttcgaggcggatgtcggaacaaaaacgacgcatcatctcgtgtatccggagtccttcagagagctgggtgacaatgtttccatgatcctggtgccctttaaaacgatcgatctggaatgggtggtttcagccattacaactggcaccatatcgcacacatacatccccgtgcccgctaagatcagagtgaaacaggataagatactgatataccacccagccttcatcaaatatgttttcgacaactggcttcaaggtcacggtaggtacccaagcactggcattctgagcgtgatcttttctatgcacgtctgtgacgaggtggacctgtacggctttggagctgattccaaaggcaactggcaccactactgggaaaacaatccgtccgcaggtgcgttccgaaaaaccggggtgcatgatgccgattttgaaagcaacgttacggccaccctggcttcaataaacaagatccggatctttaagggcaggtag

SEQ ID NO: 51158 - DNA, 1023 bp, Artificial Sequence
  Description of Artificial Sequence: Synthetic coding sequence
atggtgaccctgcggaagcggaccctgaaggtgctgaccttcctggtcctcttcatctttctgacatcgtttttcctaaattacagtcataccatggtagctaccacttggtttcctaagcagatggttctggagttatctgaaaaccttaaacgcctgatcaagcaccgcccctgtacctgtacccattgtatcggccaaagaaaactgagcgcgtggttcgatgaaaggttcaaccaaacgatgcagcctctgctgaccgctcagaacgctctccttgaagatgacacatatcggtggtggttgaggctgcaacgggaaaaaaagccaaataatctgaacgatactattaaggagttgttcagggtcgttcccggcaacgtagaccccatgctggagaaacgcagcgtggggtgccggcggtgtgcggtggtggggaacagcggaaacctccgcgagagctcatacggaccagagatcgatagtcacgactttgtgctccggatgaataaagcgcctactgcaggcttcgaggctgatgtcggtacaaaaaccactcaccatctagtatatccagagtcgttccgagaactgggcgataacgtaagcatgatccttgtgcctttcaagacaattgacctggagtgggtggtaagtgccattactacaggaaccatctctcacacatacattccagtgccagctaaaatccgagttaagcaggataagatcctcatctaccaccccgcctttattaaatatgtgttcgataactggctccagggacacggacgttatcctagcaccggcatactgtccgtgatttttagtatgcacgtttgtgatgaggtagatctctacgggttcggtgcagactccaagggaaactggcatcattattgggagaataacccaagcgcgggagcattccgcaaaacgggtgtgcacgatgcagacttcgagtccaatgtgacagccactctggcaagtatcaacaaaatccggatattcaaggggaggtag

SEQ ID NO: 51159 - DNA, 219 bp, Artificial Sequence
  Description of Artificial Sequence: Synthetic coding sequence
atggtgaccctgcggaagcggaccctgaaggtgctgaccttcctggtgctcttcatattcctcactagttttttcttaaactatagccacacaatggtggcaacaacgtggttccccaaacagatggtactggaactgagtgagaatttgaagcgcttgattaaacaccgtccctgcacctgcacacactgcattgggcagaggaagttaagtgcatag

SEQ ID NO: 51160 - DNA, 144 bp, Artificial Sequence
  Description of Artificial Sequence: Synthetic coding sequence
atggtgaccctgcggaagcggaccctgaaggtgctgaccttcctggtgctgttcatttttctgaccagctttttcctcaactactctcacacaatggtggccaccacatggtttcccaagcagatggttctggagctgtcatag

SEQ ID NO: 51161 - DNA, 1221 bp, Artificial Sequence
  Description of Artificial Sequence: Synthetic coding sequence
atgatccacaccaacctgaagaagaagttcagctgctgcgtgctggtctttctgctctttgcggtgatctgtgtgtggaaagagaaaaagaagggttcctattatgactcttttaagctccagacaaaagagtttcaggtgctgaagtctcttggaaaacttgccatgggtagtgattcacagtccgtgagcagcagcagcacacaggacccccaccgtgggaggcagaccctcggctccctaagaggcctggcaaaggccaaacctgaggcatcctttcaggtgtggaataaagattcctcaagcaagaacctcatcccccgcttacagaagatctggaagaattacctttcgatgaacaaatacaaggtctcttacaagggcccaggtcccgggataaagtttagcgccgaagccctcaggtgtcacttgagagaccacgtgaatgtcagcatggttgaggtgacagactttccatttaataccagtgaatgggagggatacctccctaaagagtcaatcaggacaaaggctggtccttggggcaggtgcgcggtcgtcagcagtgccggcagcttgaagtctagtcagttaggacgagaaatcgatgaccacgatgccgtgcttcggttcaacggggcaccaacagcgaatttccaacaggatgtgggcaccaaaaccactattagactaatgaattcccagctggttactacagagaagcggttccttaaagatagcttatataatgaaggaatactcatcgtgtgggatccctcagtctaccactccgacatccccaaatggtaccagaatcccgactacaatttctttaacaactacaaaacctataggaaactacaccccaaccagccattctacattttgaaaccacagatgccatgggagttatgggatattctgcaggagatctcccccgaggagattcagcccaaccctccctctagcggtatgctaggtatcattattatgatgaccctttgtgatcaggtcgatatctatgagtttctgcccagcaaacgcaaaactgatgtctgctattattatcaaaaattctttgattctgcctgtaccatgggagcttaccacccactgttatacgagaagaatctggtgaaacatttgaatcagggaactgatgaggatatttatctcctaggcaaagccaccctacccggctttagaacgattcactgctag

SEQ ID NO: 51162 - DNA, 228 bp, Artificial Sequence
  Description of Artificial Sequence: Synthetic coding sequence
atgatccacaccaacctgaagaagaagttcagctgctgcgtgctggtgtttctcctcttcgctgtcatttgtgtgtggaaggaaaagaaaaagggatcctattatgattcttttaagctgcaaacgaaggaattccaggttttgaaaagcctcggtaaactggctatggggagtgactcacagagcgtgagtagctcaagcacccaagatcctcaccgcggacggtag

SEQ ID NO: 51163 - DNA, 342 bp, Artificial Sequence
  Description of Artificial Sequence: Synthetic coding sequence
atgatccacaccaacctgaagaagaagttcagctgctgcgtgctggtgtttctgctgtttgcagttatatgcgtatggaaggaaaagaaaaaagggtcctactacgacagcttcaaactacagaccaaggaatttcaggttctaaagtccctcggaaagttagccatgggtagcgactcacagagcgtgtcaagctcgtcaacacaggaccctcaccgaggtcgccagaccctgggttcactccgcggcctagcaaaagccaaaccagaggcctcattccaggtgtggaacaaggacagctccagtaagaacctgattcccaggctccaaaaaatatggtag

SEQ ID NO: 51164 - DNA, 384 bp, Artificial Sequence
  Description of Artificial Sequence: Synthetic coding sequence
atgatccacaccaacctgaagaagaagttcagctgctgcgtgctggtcttcctgctcttcgcagtgatctgcgtctggaaggaaaaaaaaaaaggctcctattacgacagctttaaactgcagacaaaagagtttcaagttttgaagtcactcggaaagttggcgatgggttccgacagccagagcgtgagctcatctagcacacaagatccccaccgcggacgccagaccctgggctcactccgcggtcttgcaaaagctaaacccgaagcgagcttccaggtctggaacaaggatagctcaagtaagaaccttattcccagactccaaaagatctggaagaactacttgtctatgaataaatataaggtgtcttataaatag

SEQ ID NO: 51165 - DNA, 129 bp, Artificial Sequence
  Description of Artificial Sequence: Synthetic coding sequence
atgatccacaccaacctgaagaagaagttcagctgctgcgtgctggtgtttctgctatttgccgttatctgcgtttggaaagaaaagaagaagggctcatactatgattccttcaaactgcagacctag

SEQ ID NO: 51166 - DNA, 294 bp, Artificial Sequence
  Description of Artificial Sequence: Synthetic coding sequence
atgatccacaccaacctgaagaagaagttcagctgctgcgtgctggtctttctcctgtttgccgtaatctgcgtatggaaagaaaagaagaagggctcctactacgactcctttaagctgcagacaaaggagttccaggtcctgaagtcactgggaaaactggccatgggctctgatagtcaaagtgtcagctcctctagtacccaggatccacacagggggagacagactctaggctccctgcgcggcctggcaaaagctaaaccagaagccagttttcaggtgtggaactag

SEQ ID NO: 51167 - DNA, 138 bp, Artificial Sequence
  Description of Artificial Sequence: Synthetic coding sequence
atgatccacaccaacctgaagaagaagttcagctgctgcgtgctggtgttcttgctctttgccgtgatttgtgtgtggaaggaaaagaaaaaagggagttactatgactccttcaaactgcagacaaaagagttttag

SEQ ID NO: 51168 - DNA, 276 bp, Artificial Sequence
  Description of Artificial Sequence: Synthetic coding sequence
atgatccacaccaacctgaagaagaagttcagctgctgcgtgctggtcttcctgctttttgcagtcatttgcgtgtggaaagaaaaaaaaaaaggctcatactacgactcctttaagctgcagactaaagagtttcaagtcctgaagtcactgggaaaactcgctatgggaagtgatagccagtccgtgtccagttccagcactcaggatccccatcgcggtcgtcaaaccttgggctccctcaggggattggccaaagctaagcctgaagcctag

SEQ ID NO: 51169 - DNA, 1221 bp, Artificial Sequence
  Description of Artificial Sequence: Synthetic coding sequence
atgatccacaccaacctgaagaagaagttcagctgctgcgtgctggtgttcttactgtttgctgtgatatgtgtatggaaggagaagaagaaaggaagctactatgattcttttaaactccaaaccaaggaattccaggtgctcaagtcactggggaaattggctatgggctcagattctcaatccgtgtcatccagcagcactcaggatccgcaccgcgggcgccagacgctgggttcattgaggggcctggctaaagccaagcctgaggccagcttccaggtgtggaacaaagactcttcgtcaaagaatctgattccacggctgcagaagatatggaaaaactacctgtcgatgaacaagtacaaggtttcatacaagggtccaggccccggaataaaatttagcgctgaggccctgcggtgccaccttagagaccacgtaaacgtgagcatggttgaggtaacagatttcccgttcaacacatctgaatgggaaggctacttacccaaggagagcatcaggacaaaggcgggcccctgggggaggtgtgccgtggtgtcaagtgctggaagcctgaagagctcgcagctggggcgcgagatagatgatcacgacgccgtcttgaggtttaatggtgctccaactgccaactttcagcaggacgtgggcacaaaaactactattagactgatgaattcgcagttggtgaccactgagaagcgttttcttaaggatagtctgtacaatgaaggtatacttatagtttgggacccctcagtgtaccactccgatatacctaaatggtaccaaaatcccgattataattttttcaacaattacaagacctaccggaaacttcatcctaaccagccattctatattttgaaacctcagatgccatgggaactgtgggatattctgcaggagatttcaccagaagagatccagcccaaccccccttcttcagggatgctgggtattatcattatgatgaccctgtgcgatcaggtggacatttatgagtttctgccatccaaacgtaagaccgatgtttgctattactatcagaagttcttcgacagcgcctgtacgatgggcgcttaccaccctcttctgtacgagaagaacctagtgaaacacctgaaccagggcacagacgaggatatctatctgctgggaaaggctaccctgccaggatttaggacaatccattgctag

SEQ ID NO: 51170 - DNA, 297 bp, Artificial Sequence
  Description of Artificial Sequence: Synthetic coding sequence
atgatccacaccaacctgaagaagaagttcagctgctgcgtgctggtgtttctcctctttgccgttatatgcgtttggaaggaaaagaagaaaggaagctactacgactctttcaagctgcagactaaggaattccaggtgctgaagagcttgggcaaattagccatgggctccgacagccagagcgtaagctcctctagtacacaggatccgcatcgcggcagacagacactgggttcactgagagggctcgctaaggcaaaacccgaggcctctttccaggtatggaataagtag

SEQ ID NO: 51171 - DNA, 528 bp, Artificial Sequence
  Description of Artificial Sequence: Synthetic coding sequence
atgaacagccagctggtgaccaccgagaagcggttcctgaaggactcattgtacaatgagggcattctgatagtctgggacccgtccgtgtaccattctgacattcctaaatggtatcagaatccggactacaatttttttaacaactataagacataccggaaactgcaccctaatcagccattctatatacttaaaccacagatgccttgggagctgtgggacatcctccaagaaatcagtcccgaggagattcagcccaacccaccctcttccggcatgctcggaatcattataatgatgacactgtgcgatcaagtggatatctacgaattcctgccgtccaaaaggaagaccgatgtatgttattattatcaaaagttttttgacagtgcctgtaccatgggggcttaccacccgttgctgtatgagaagaacctggtgaaacatcttaatcagggaaccgatgaagatatttatctgctgggtaaggccacacttcctggcttccgaaccatccactgttag

SEQ ID NO: 51172 - DNA, 78 bp, Artificial Sequence
  Description of Artificial Sequence: Synthetic coding sequence
atgatccacaccaacctgaagaagaagttcagctgctgcgtgctggtttttttgctgtttgcagttatatgtgtgtag

SEQ ID NO: 51173 - DNA, 876 bp, Artificial Sequence
  Description of Artificial Sequence: Synthetic coding sequence
atggagaagctggccgccagcaccgagccccagggcccccggcccgtgctgggccgtgaatctgtccaggtaccggacgatcaggactttcgctccttccgttcggagtgcgaagcggaagttgggtggaacttgacctattcacgcgcaggtgtttcagtttgggtgcaggctgtcgagatggacagaacactgcacaaaattaagtgcagaatggaatgttgtgatgtgcccgcggaaactctgtacgatgtgctccacgatatcgagtacaggaaaaaatgggactccaacgtaatcgagacctttgacatcgccagattgacggttaatgctgacgtaggctattacagctggagatgtcccaagcctctgaaaaatagggatgtcatcactctgcgctcctggcttccaatgggagctgattatatcatcatgaattattctgtcaagcatcctaagtacccgcctcggaaggatttggtaagggccgtgtcaatccagaccggttacctcattcagagcaccggaccaaagtcatgcgtcattacctatctggcacaggtggatcctaaaggctcgctgcccaaatgggtggtcaataaaagttcccagtttttggcccccaaggcaatgaagaagatgtataaagcctgccttaagtatccagaatggaagcagaagcacctcccacatttcaagccttggttgcacccagaacaatcccctctgcctagtctcgccctgtctgagcttagcgtgcagcacgcagactcgttagaaaatattgacgagtcagcggtcgcagagagtcgggaggaaaggatgggtggggctggcggtgaaggaagcgacgacgacacatctctgacctag

SEQ ID NO: 51174 - DNA, 270 bp, Artificial Sequence
  Description of Artificial Sequence: Synthetic coding sequence
atggagaagctggccgccagcaccgagccccagggcccccggcccgtgctgggcagagaaagtgttcaggtcccagacgaccaggacttcaggtcttttaggagcgagtgtgaggcagaggttgggtggaacctgacctatagcagagctggcgtttccgtgtgggtccaggctgtggagatggaccgcaccctgcacaaaatcaagtgcagaatggagtgttgcgacgtgccagctgaaacactttacgatgtcctgcacgatatttag

SEQ ID NO: 51175 - DNA, 759 bp, Artificial Sequence
  Description of Artificial Sequence: Synthetic coding sequence
atggagaagctggccgccagcaccgagccccagggcccccggcccgtgctggggagggaatcagtgcaggtgcccgatgatcaggacttcaggtcatttaggagcgaatgcgaggcagaagtcgggtggaacctcacatatagcagggcgggtgtctctgtttgggtccaggcagtggagatggatcggacactgcataagattaagtgccgcatggaatgttgcgacgtcccagccgagaccctttacgatgtcctgcacgacattgaataccgaaagaagtgggattcgaacgttatcgagacctttgacatcgctcggctgactgtgaacgccgacgttggttactactcttggagatgtcctaagcctttgaagaatcgggatgtgatcaccctgcgtagttggcttccgatgggtgcagactacataatcatgaattattccgtgaagcacccaaaataccctccaaggaaggacctggtgcgggcagtctccatacaaacagggtatctaatccagtcaactgggcctaagtcctgcgtgatcacttacctggcccaggtggacccaaaagggagcctaccaaagtgggtggttaataagtctagccagttcttggcaccgaaagcaatgaaaaagatgtataaggcctgcttgaaatatcccgagtggaaacagaaacatctgccacacttcaagccttggcttcacccagagcagtctccacttccttcccttgcactgtcagagctctag

SEQ ID NO: 51176 - DNA, 39 bp, Artificial Sequence; identical to SEQ ID NO: 24878
  Description of Artificial Sequence: Synthetic coding sequence

SEQ ID NO: 51177 - DNA, 576 bp, Artificial Sequence
  Description of Artificial Sequence: Synthetic coding sequence
atggagaagctggccgccagcaccgagccccagggcccccggcccgtgctgggcagggagagcgtccaagtcccggatgatcaggattttcgatctttcaggagtgagtgcgaagcggaggtgggctggaatttgacctattcccgcgccggcgtttccgtatgggttcaggcggtggagatggatagaacactccataaaattaaatgtcgcatggagtgttgtgacgtgcccgccgagaccctctacgatgtgctgcacgatatagagtaccgtaagaaatgggactcaaacgtcattgagacctttgacatcgcccgcctaacagtgaatgccgacgtcggatactacagctggcgctgtcctaagcccctgaagaacagggatgtgatcactctcaggagctggttacccatgggcgccgactatataatcatgaactacagcgtgaaacatcctaaatatcccccgcggaaggacctggttcgcgctgtgtcaattcagaccggttatctgatacaatccaccggaccaaaatcatgcgttataacctacctcgcgcaggtagacccatag

SEQ ID NO: 51178 - DNA, 876 bp, Artificial Sequence
  Description of Artificial Sequence: Synthetic coding sequence
atggagaagctggccgccagcaccgagccccagggcccccggcccgtacttgggcgggaatccgtccaggtgcccgacgaccaggactttcggagcttccggagcgagtgcgaggcagaggtgggatggaatttgacttatagcagagccggagtgtctgtttgggtgcaggccgtcgagatggacagaacactgcacaaaatcaaatgtagaatggaatgttgtgacgtgccagccgagactctttatgacgtgctgcacgacattgaatatcggaagaaatgggactccaacgtgatcgaaacgttcgacattgcaaggttaactgtcaacgcagacgtgggttattacagctggagatgccccaagccccttaaaaatcgcgatgtgatcacgctacggagctggttaccgatgggggccgattacatcattatgaactatagcgtgaagcaccctaagtacccccccagaaaggacctcgtgcgggccgtgagcatacagaccgggtatctgatacagtccacgggaccaaagagctgtgtgattacctacctggcccaagttgatcccaaggggagtctcccaaagtgggtcgtaaataagtcctcccagttccttgctccgaaggcgatgaagaaaatgtacaaggcatgcttaaaatacccagaatggaagcaaaagcatctgccccatttcaaaccctggttgcatccagagcagtcccctctgccaagtctggcactctccgagctctctgtgcagcatgcagacagtctggagaatatcgatgagtccgcagtggccgagagcagagaggaacgaatggggggcgcaggtggagaagggagcgacgatgacacaagtttaacatag

SEQ ID NO: 51179 - DNA, 417 bp, Artificial Sequence
  Description of Artificial Sequence: Synthetic coding sequence
atggagaagctggccgccagcaccgagccccagggcccccggcccgtccttggacgcgaatccgtgcaggttcctgatgaccaggactttcgaagctttcggtcagaatgcgaggctgaggttggctggaatctaacatactcccgagctggagtaagcgtttgggttcaggctgtggaaatggaccggaccttacataaaataaaatgtagaatggagtgctgtgacgtccccgcagagactctgtacgatgtgttgcacgatatagagtaccgcaagaaatgggattctaacgttatcgaaacattcgacatcgcacgacttaccgtgaatgctgacgtgggctactacagttggagatgtcccaagcccctgaagaaccgggatgtaatcactctccggtcctggctgccttag
